United States Patent 9,487,797 (GENOMIC PLANT SEQUENCES AND USES THEREOF) - sequence listing, part 42

SEQ ID NO: 63896 - DNA, 89412 bp, Oryza sativa
tgttgtgctaaaggttatttaagaaagagtgataaatgcaataggtatatgtgtttagcgtttatttttcaacctatgtgcttgttaagatgttgcattataaattgtatgaaatcatgaatttttattgttgattcaagcttaattgtaaaatctttgattcatggttatactttaatgcatgcttattatattatagatgggttcatcttctttttattgcaacacatgacatgatatgctatatgtatgttaagcttttatacattaatgaaataattcctatgctttatgaaatcattgtcaaaagggggagaaataatgtgaaaatttttagatcttttggagttgtcaaaagggggagaaataatgtgaaaatttttggatcttttggagaagagttaagttttagaagagaagagtttttaagaagagcatgtttttggttcaattgggaatttctttcttttaaaaaggggagaaggtttcttgtttttggttcaattgggaatttctttcttttaaaaagggggagtagttttcttttggatttttgagcacgatgtgtacgtttgtacgaagtgtgctttttaccgcttttgtttttaatgttccaaactccaaaacatttttaatgggtttgccaatgtgttcatcaagggggaaattgtaagatcaacgtgtgttttgatttttattctgtgatgaacaattggcatctgtgattattggttttgatactggagtttattcacgaagtggttttggagatgattggagttcacaggtgaatctacaggaaatcgctgttatttcatgtgaccggtcagaccgggaaggtgttgccggtcagaccggcggagatcgagcggtcggaccggccggcccgcggtctgaccggccgacgctgtgtcggtttcggtttcgggttgtttctttggatatctgtgattgtttcatggttatggcttctagatagatactatacgtatgtaatactgtttatttgctaacaatgagtcaagttggagatagcttggtctcggaatatggtttctttgtttgtttcatgtgtaggtgactcgatgcctcgggagagtatttacggtgatggaccgggagtcggcttggtggtaagacgatgtccgtggtggtcagatatcatgcgggatactaaggctagagttgatgcacgtggttggtgaagattccatatgacatacgatggaggtattgagtgcgtatgggatgcggagttaaatttggaaggagtctaaatttggtacgattggttatataaagtttctttcttgtactagagggttttctaaggtgtttaggactcttagtatgagtttggttcgtggctttaggctgcctacctcatgtataaatagagggggagcgtgaggcttcccggtatcgcttttgtatagcttttgagagctagtttagttagggtttcgagtttagtcaagatttttgtaaggagtgctgttggtgcactttgtaaacacagagagaagcaataaagttgtcatctactttgattgttcttcgatttgtgtttcacagggttttggcggtctaaccggcgatatactggcggtcagaccggcggcgctagggcggtcagaccggcggcgcaggcaggcagcggcaggtgatctcggcggttcgactggagttcgatctcggtcagaccggcgtgttccaggcgcttagaccggtacaactacttcggtcataccgcgatccatcgatttcgagggtaacttttatttccgctaaaagtttttggtttttgggtataccaaccattcacccccctttggttggcttagttcttgttattcgatcatacacgggtcgccccatgccacccaatggtaacgtccgcccctgataagagctgagccgaacctatagccaacgagcagagacggccatcccttgagctgtggttgtggtggagcgaggcggccggggccaatcctatttgatacctcgggctgccttcccctcttctttttcttgtttatccctgaacaagatgcaaatgaagcaacacattcaagctatttctttggcattcttttcgagttctgtaacattaatggatattgtaagcaagaagattttatgttgagaatggaaggtattggaaaagaagctattgagaataggctagttgaaagtgatcaggatagcgagccataagttactacaacacagagtatcacgtcgtggcctgagttgacgtcttaagagagtggttgacccaacgagacatactatcgccgtccgaaaatactcatcgtattaagtttttattgcaatgtttgaccattcgactcattcaaaagattatgaaattattatttatttttttttcacttgctttattatcaaaagtattttaagcatgacttatctttttttatatttgcactaattttttaaattagacgaatggttaaacattataagcaacaagttaaaacgacatctaatttaggagggatggatgtagtaaattcaagcaagtagaatcctgaacatgcatgggcatgagtggatgacatggagactgagaagtgtccaatttcctgagttcaaggacaactatgtagacagggataccctactagttgtttgctaaggctgtgtttagatctggggggtgtaaagttttgatgcatcacatcggatatatggacacacatttgaagtattaaatatagtctataacaacacaaattacagaatccgtctgtaaaccatgagatgaatttattaataagcctaaaaatctatcattagcaaatatttactgtagcatcacgttgtcaaatcattgcacaattaggcttaaaagattcatctcacaatttaaacgtaatctgtgcagtcagttattttttcgtctatatttaatactccatacatgtgtcgaaatattcgatgtgacagggcgtaaaattttacaggggatctgaacagggccttaaacaattgttttttagataagtatattttttacacggcctctttatcgaaccggatatttgcagccatttaagttaggaacttagtctctcaaacaacctaatttgaaattcgctcatatggagatttaaacttatgaccttgaggtgctatacaaatcactgaaatcactaggctacatggggtgcttaaacaattgttgctcatgatatcttactttgtgaattttgatgactacaagcagcttgtgcaagaattggattgatttggttacaccacacattactcgaccagccaaaggtcaatccagccgaagctgcgcatgctttaatatcaattcaactagtcaaattcaacgcacaaaaaaactgaatggataaaggtggaacgaccaaagttgaaagaaagcttcattaaagagtatttgcaggtttatgttacaaattgtatgagttgagctgtacacatccataagtttcagtgagtgaaattgatttttttataaaaactaacaagtagtactacttaaaaagaaaacattattcatcgaggcatgaaaaacaatgccatcgatctcatgtttattttttctttccatgtcttatgctaaggctgagttagaggagaggaaaagagggaattgagaagatacgtaaaacgagatatgcaattagcgtatgattaattgagtattaactactttaaattttaaaacagattaatatgatttttttaagtagttcaggaaacatacatgcggaaaacaaggtgttttctctctcaaatctcccagtaacgaaagcagccgtgtagttatcgacatctgtaggccatctaccctatatgttggatacgtccaaccaagtcttccgtgaaagattatgtcatctttgatgacactgaagctcagtcttccggtagcttttcttttttttttcctcttctgtgcaggggggttcagggcctaacaattcgtgtgtgttttggctctgtatattctccatgaatatagaggctggatttgatggcgatataaatatagcaaatctgttgattttttctcattaaatcatgagatgcaaggtagcgggctgctacagattgtcgtctcgacagtgacataatattgattatcagatggatgcgtggtatgagaggcgatgggatggtcgtaccaagcattgcagctcaataagaggtggaggtaacacggggttgttctccggatatctattcgtagcagcacaagtcaacacgaattactagatttgtctaactcttctcccccagagactttggtactcatgtcttgttgcagccgcggcttgagagccatctctaccatcaagcgtctaagcttgatccgagtaatatcatcggtatataggagtaccttccatgacaccaccgattcccatacataaatttaaaatctgtaccatacaaactagtgggagaagagtggttatgtactccagtcaaccaacaagtgtatgctatatatcgttatttgtccttatatagactgaagagggtgggacaggaaaaccacccaaaacatgtttaactgaaagtatagaggacaataatgcatggtgtctgagacttattggcttcagtcggattagagagagttctttattttgtcatgtcaaggaataactaaaacagagtacaatggattggtggaatataaatgtagttctatttcctttcatattggtttttactcccaagtagtttcccctctctactccaaatcttcgagtcatccacagacacaaagtcacaaacaatgtgcaataaccagtccttgatcaaatcctctgatttatgccttcctaaatcttaagcagattaccttgtgcatgtaagtcccgaaattagatgatttttcaagcacattcttatcaataatttcgtaaaaggtgttgatgactcatttgaccttgtttcgtatgctaagtatcaatctgaccctactttttttaatttacttatttgactccactttttgaaattaaagatgaaagctgaccttattccgttaaaacgagttaacattgttaaccaaggggcaagtagtccttttgcccttgcttatttaaccatattatataaaaacatccatatattccaaccttttgacataattgtaacgaatttgacatatctttcacatttgacacaagtttgatagatttggcttcaatttgataaatttgaatcatattgaaaaatttggcggagtgcaccaattttgacacaagtttggtacactgattttgctcttgtggtggtgagaaagcatagccaacaaattagaagaggaagccgagaacaacaccaccataatcttctccccacgctcgtcctactcgtccctccgtgccaccgccgctctctccctctgtgtgcctgcggagccgctgcctccatccatccacccgcctgcgctagcaccaccgccccctcctccctcagcatgtcggagccaacgccaccccctccctctacgcaccggcgctggctctaccgttcatgccgagagagacgagagagcgataagggtcaggcagggtggtacgagatggataagattgaaggagggtattttggttagtttgaataataaatagatttattttctttttcctaaatgaaaccctatcagtatattgcaaatatagtcaaacggtaggttcaattgtgaaaagcagggttaaatcagcaacctagaaaaaaataagatccgattggtagttagccttcgaaatagggtcaaataagtaattattcgtttcctaaaagtgatgaactactcgtagtagaatatttcttctactggtaatataactcacaaatgaacggttaccatagtagtgataatatgggtagaacgataactaccggcagatacccatgtaaaagtactccaattggaattatttgtagcaaatattacgaccatttttctgtagcactaaatattgaactagtctgaaaatggttgtgactttttaattaatttccaaacaatcctaccacaattggactccattgaagctacaattaagttttttgttcttcacatttccgaaagaatgatcaggttatctgatttgaccattaattccctatggagatatacattccaatatcaatatgcttttgttctagagtttgacaatcactacacaatgggggtcttggttctattaacatatatactcctacatctatgtgccagttacataccttgtgatgtataataagcccattaattgatgcaaaatgcatgcaattcggccgtggtaagagaagtcgtattatttctacagaaaagcaagcagagggcaggagtgattctttattaagacgactgaatttttccttctgccacgtggtaatgcaattcatttcattttattgtatttgttaacattattggtgacttcaataatatcgatctccagtatgtattaattaagaccaataatatatatatagtaagtggagttcaattctaaaaactctgaaaaaacaataacaaaataagtatgtgctcttgtgtacctctcgttgctcaatacaatgaaataattatataaaactatggaaaataatgacaaaagttgggctgtgtttagatccaaaatttggatccaaacttcagtcattttccatcacatcaacctgtcatacacacacaatttttcagtcacatcatctctaattttaaccaaaatccaaactttacactgaactaaacacagcctcgaagagagaaggttacgatggttgcagtgaatctccaattccactacctacctaatggtaaattttgcaggttagcccttcaattttatcatattaaaaaacagtgaaatctaaatgaaggtgataatataccctatagaaaaatatggataacacatttaatgaaaatttggtactaccaacactttggtagatatttctattgatttaggaagttctggaatcaatccaaacaacacataagtagtatttagactaccaacaatttggtagtgtaagatttggcactaaattaaaagagcccataatgtattttaattctgagatctatggattgaattgagaaatgcatgtccgtagaggggaatgacattataatccatgctactactttttttctctagatttacaaagtgaacttcccatattgtttcctcatttagtgtacagagtaacaagatttactaaaactgtttgtgttccatacaatttgatctactgttcagaataagaaccaacaacatacccatgtaaaaaaaagagtcataacacaatataaatatttcaatagaaaacataagtaatcgaatttgatacatcattagcaggacataaatatgttattagttttgctgaacgtgcctatgcaaccagcttgccagctactagctagttgagcatacagtatactcccatgcctgatgatcaccgtgatactctttagtgcagcaattcgcatagtctcacctcagcatacatgcccagataacgccattaatatatatagatctgtcaaacttgctgctaacccaagtaattggcagcaaaagcattagtcccggttacccttaaccatcatcgcttcaaccttttgcttgagggaataagtgaataacaaccccactgcaaatggtgcaagcgttgtacgttcttcccatgacaccacccatttccatgtaaaactaaactcgcaagacaaacctaggtttaacaaggtcaggcatgagaagagtgtacaacgatcactgtttgtattactcagctgatcttcccctttgaactgtgcgtgtcaaatctctctctctatatatgtaacaatgacaaaacatatagatacattgtgttataaatagttacagagacttaatagcagagtgaaaagctaatagcagggtgataagcaagctggctgtcagtggggacagctatgtgtatctattgttcaagacaattaaggggatgtttaaatcagggtctaaagttttagcgtgtcacatcgggtattatatagggtgtcatatggggtgtttggatactaataaaaaacttaattacagaatccgttagtaaaccgcgagacgaattattaagtctaattaatccgtcattagcaaatgtttactgtagcaccatattgtcaaatcatagagcaattaggcttaaaagattcgtctcgcaaattagttgtaatctgtgtaattagttattgtgttagcctatatttaatactttatgcatgtgtttaaacgttcgatatgacatggtgaaaaatttttgggtgggatcttaacagggcgcgcgtaagttagattggttcatgattggctgtaacttttaggacgctataatcttgttcgtattggtttattacaccagattaaatcactctgctcgtatcaaccactgaagtagaacttcgtactgtgctatctgttctcatatcactactgatctttgctgggtggtgcaaatagtcccggttcgaatagaaaaatagactaaacatcatttttagctctggttaaaaagccaacgaaactttttgatctttagtcttagttggtgttaacaaccggaactaaacatcatttttagtctcggtttgaaaatttgtcaggccgtgtcaggtcccattatttttagtcctggttagtcaacactttagtcccagttgtttataccaaccgagaagaaagattgaaaagaaaactaaagatcaatactttagtcccggttgtttgtaccaaatgggacaaaagattgaaaagaaaactgacagccgcacgccaccccctccctcgtccttatctccttgcacgcacaagcgaaactccctccctctctctcgctcccgccctccccctccctccttatctcctctccctgtgtgctccctccacctccctcgcaggtgactccctcgatccgccccctccacctctccctcaatcccccctcctcctctccctctcacctcccccgccccctcttcctctccctccaatccctccgcctcccttgctgacggcgctcgccccctcctgtccgactcacctccctcttgcggtggatttggcggcggtgacagcgtctccggtggcggtcgcaggtggatccggctggatccgggccacggcaggtactagcagccacatcaagcagatggtggctcgcggtggggagaagaagaagaagaagaagaagaagaggaggagtggcggagagcgtggagaggatgaggcaaagggggcggccggctgtagtggtggcggagcagatgctgctgctcatggatttgtgattgtattcatgaggcgattgtgttcacgaggcaattgtgttcatggattttgattttttttttcatgattgcgttcatgagatctcatgggtgatgtttatgattaatatgttcttggattggatgaattgatgatggtatgtgaatctgtgatctgtaatgtatttgttttttgagaatttgtgatgtgaatccatgattttatatgtgaatattttatttggggaaatcaatatgcaagccagcaaaaaaaacaaaaaaaaaaccctttagtcccggttgataatactaaccggaattaaatatggtagcgtcagtcacgtggcgctaccatctttagtcccagattcggggtctcagaatttctccagtagtgtgtcgatatcaaccgaatcaaatttttattagttggaaatgtgaagaagctggtaaatctcgtatatattaaatcacattaatgtgggtagcgtctaagcgatgtcaatattaacaacaaaaatagtacggaagacaggtactgcctttgtttcctgaattggccattccaaatttggacctgtacactatgatttgtatttttttcttatggaacaaacaaatatattcaaataccgattctagaaaagatcattatgaaatctaattccaaggcacaagtctgaagattgatggcatcgttcaatggtaaacttatattctcattttgttattcccaggcacaaatcccagagaataatacctttgagaaaacatgtatatgtactaaatccagccaacaaaatggaaatggacgctctggggtgaaccagtgaagcctgtgcttatcttgtccttgatggcacccatttctattaaatagccccacattggttgtggaagggtaaggaatattatatgtaagtgggagacctcttcacctaattggttagcttttgagatgtgaaaggccctttacgcgcaattcgtactattctataattgctacacagtgcttgcacaggaagcacgttagacactaatagaaaaaatgtttttgcacagtcaaaaatagtttttccaggcgggtgtaaggaccgccggcctgcttgcgaaaataatttttgcaggcgacatctccattttcacagctggtagattcactcgcctgtgaaaaaatcacagcgaataaaaaaaaagggtgccgccgccggcctcccctccggtcgacggctctccaccttcatccgctggccactgccacagccgctggtatcatcatcgcgcatcgccgcctctgctccgtccgccggcttccccgcaggcgtcgtcatcatcgtgtcggcgccgtcgtcgcgcgtcgccgcctctcctcctccatccgctggcttcccacaggtggagctgtcgtcgtcacgcatcgccgggagagggaggagtcgagccgccgcctctcctcctcgttggcacaaagaaaagcataagaaattgttcttttatccatgaatcatgtgatccatgccgacaaggctgccacatatctctactattataaaaattgaagatgtttttaccgattactttgatacgttatccatgtatgaatcgatttttaagtttgttcgctttcggatatacaaaaggagttgtacaagaaatccctttaaaaaaactcgcatgctaacttgacactatcggacttctaattgaagttcatgattttctaaaaaatatatatatccaagtgaattcccacaatgaatttcaccttagctaaatcgtataataacaataataagattaaaataacattcacccattgcaacacacggttatttttatagtttgtaaaaaataaaataaatccagtactgttcaacacggacagacaggtgtctcggcagtggttaattgcttctagcaatctagcttgatgatcaaatgaatgtttgctactccatcaagaaatcaatgcagttgtagtgcagcgatagcgcgtggaggcggctactaagtgagatcacagaggcagcacaaggtgattttccagatttaattaggaaataacaccggtataccacccagtagaggtttcaagcatccctgctcacttagtgcaatatccccatgatattctttccatgacaccacccaatcccaacttagggtgtatgcttccattaagggatgtgcgtggaattggactgtgataagagaagtcgtattccaagagaaagcacgcatggggtgttgaattgtggcagagggcaggagtgtttctttattatgactgaattttctcttctcctatggtgtaatgcaattcattccactttattgcgccttcgaatacaactatatacctccagtgtgtattaattaatgttaacattggtatgtggagttccgtccttacaactcaagcatatgtgctctcatacctcaaaatataattaaatagaaaatattgtcaaccaattaataggttgtagaatcgaatacaataaccaaacgtacaagagggggtgaatagtagcaacacgaaaaacaaaaactttttacagagctaaaaatttaccctccaacctaatgaagcccttggcgtagctggtctgactgtcgtgtacacaccagcctgaccgcaacttcaccgcctgcccgaccggtgtctggatggttgaaccactgcctccctgtactgccttctagctgtcgctggttagaccgcccaatgaactccggtcaaaccgttgggatccctaaaaacgcgtatcgacaaaactcttgaaagtacatcaactttattttatcaatatgtatttacaaagtgcacctaaagtactccactcaagtggttgtcacatgatctaggatgggatgctcccacctggcaatggtacacctattatacggtcaagcaagacagcaaatgcacagtgtagaacagtgcagtacgcatagacgcaagtagcgacgtacgtgggtgtcgcgataagtactacggccaaatggagcaaatactggagctataactagcatatccacagtgtgggtctagaaatacctctacaagaggagtaggaagaagatgcggtctaacatgcatgtgtcgaccatgaggaaggactatttttgaaacataggcccaatttgatcatatgcctaattttgtgtagtatatgtgttatcttggaaatggactggagagctataatattttgagataagtttgaaaatttttgaaatacttaagagaaatgaaatattgcctttgaaataaataaaaaaatattatattactggttacaataaataaataaataaataaatagttaaaaaaaatgttagagcaattatgttgaaataggtaaacaaaaatcaaaataacttgaaaataagactggtcaaagttacctgtgacgggtgagagtaatggcgccgtcacaggtgacctcacctgtgacatgccctactttccggctgatcacatatgacaatacctatgacaggccggtgagcagggcccatcataggtgatgtcacttgtgatggcgccaacactcccgtccgtcacaggtgactttgaccgggataagtagggttggaccgtttcccatccctctcagatccagatctctcactcactcactcactcaacactcgtcaatagccacctactccatgccaagcacctcccttgctttctcgacgtcaaccgttgtcctcccgccatcatcaaattccaccgagcagcacctccctgccctcgacctctccatatccatgacaccgggctccacctccccgcccttgactgccggcttccattgacagcctccaccgcactgtcttcctacaccgccaagtgatgcctccctgacgtcgatcatcaaccgcctccggcctcccactctcctcgaagaccacctgcctccacctcctctgcctccacaacagccgccgccttcacgctgccctcgacaccggctgccttcacgcccacctggaagacagccaaccactgcctcctctgtttccacaacggctgccgcctcccccacaccagtcgccacctcctcagctcccccacccctcgcatgtttctctttcttttaaatttagattgttcccattttttgtgatttaggttgtctataaataatttgcattgtttagaatgattttgagtcacaaatgtttagaaatagtttgatttaggttgtttagaagttttatgacttaggttgtttagaaagtttgtgacttaagttgtttattataaattatttaggttgtttagaattattttgatttaggaagtttagaaatattttgatttaggttgtttagagatttgtagacgtaggttgtttagaaatgacttaggttcaattgtcattaaactttgaacaacttaccatcaaaattgattactacgtcttacatgtacttattatttactacattgtattgttcaattgttttctaacttttttgaaatggttggttgtcgttatttttcaaaaggcaaaggctataagtaacttgggtaagtttgcggcaagaaattgggcaagtttgtgtcttcacaggttcaaaagaaatgtgaggtgggaatatgtgactgtctatgtaatttatgtaaaaatttggaatgcatgtgtgcatgatgttaattttgggatgcatctgtgctaaaatggagaatatgtgatattgggtatggctaggatatatgtgatgtttcttttttcagagagtgtggctagcaaatcatgagtctagtcaatatttagaaattgttgtttttcgaaaatacctcataactgaagggtcgtaaacaaagaccgtcacatgtgagctcatctgtgacggccttgttacttcaatccatcaaaggtgagtcatccgacaggtacaaactttgcacccgtcttaggtatctcactgtgacgggttgcaaccaaacatgggcatgtggagacgctcacctgtgacgggaaattaaaatactggcccgtcaaaagtgactagagtcaccagtgacccctaatccttgaccgggggaaatccatcgaaggtgagggttagtgtccatctgagatgacctgatacggcatagtgatgtggaaatatgctttttttatttattttatttagattagggatatgccactgacctccgtcattaatatatgttcagagcatgttaataccagagcttgctgatggagttcagtacaaattacctgctcttactgacttaggctccgttcaaccgggaatagtacgcacagaaaacagagcgatctattagcacgtgattaattaagtattagcttttttttttcaaaaatggatcaatttgaattttttaagcaacttttgtatagaaactttttacaaaaaatgcgccgtttaacagtttgaaaaatatgtacgtggaaaacgagggagagggattgggaaaagggtgtaccgaacacaaccttagtgtgtaatctttgtattgtgcttgcaacttccctgcacacatactgtagtgccttgccaagttgcttcggcaccccttgttcccaactcgtctccttgttttccgcttgcacacttttcaaactgctaaacggtatgtttttgcaaaaagtttctatacgaaagttgcttaaagaatcaaaataatttatttttgaaaaataaattagctaatacttaattaatcatgaactaatggatcgctccgtttttgcgtgcggagggaatgagttcccatcaagaacatgcgaacacagccttagtatggcacttctatgcaaaacatcctcatacacaatatttggctgtatttctaccctcaatccctaaacgaagtatgatccatgtacacatccaaattaatttggctcaaatataaacataagtaattgttcttccatccatgaattatgtgatccatggcgacaaggctgccacatattcgtaaaaggatctactgttcaacacgatgtcttggcagtggtagcttgatgatcagatgaacgcatactacgatacggaagacaacataatggtgatgcagcgagtgcgtgtgcacgcgggtactaagtgagatcaaggaggcagaacaaggtgattttccagaactcatcagggagcaacaccggtatactgcgcagtagaggttccagccgaagtttgacacccatctctacttgaacgaggcaagtataaaatcatccttgctcagttagtacaatatctccaccatattctttccatgaaaccacccaatcccaagctgcaaagagatcgatgcaccacaaaaataagggagaatagagtggctgcatattctatttcacagcaaagcatatatatgccaacgatatttgttcttatataggcaggatgaggaaactacaccaaacgttcatatccctattaccttggtagcttgcaatgagaaaactcggagtgttaggcatgcttgtttcagcttataattaagattatcataatctagattattgtgccaaattactgtaagctagattataataaactagactagaataagatgcgagctaaaatatgtaatgccctcaattgtaagattactgtatcaacaaattttgtaggacaacacaccaggttctaaataagaggtgtgcatccaccatatgatggttcatcgttcacaacaaatcatccacgtacgaataaatcgtccacataggttttaggtacctacatttacccctttataaattgaagggtgatgcacttggcagtatagttcaaaactggaaggtgtccacaaccacctgttgttacatgaacttactgcatgaccaggggatgcacatgctttgcgcagtatcaaattaatgtcacagggtcaatgatggctgaattattgctatcaaacaccgttgctaaaagcacagttgaatgagacttcaaattcagattttggatattgaacatacattttgattctggtgccaacaaaaatattaactcatccatacattgcatgcaaagctccatccaaaaatcagatgtatcaaattcagacccgttccctttcccttcgaacaccttttcctaacataaatccttaaaaactatgatatggcaatgttcaattggtccaagcttttctccgcccgaaaccactccttatttatttttttgtttttggaaaaataatcccaaggtctctctactagtcatcgagttacaaaatcgtccccatcagcaaaatcagatatatgacatccctcaacttacaaaaccgttcattttagatccttcggtggttttgaacccagttttatccgacatggcggctgagtcagcatggccccacatgtcagcatgccacatcatcaccctctctctttgccctcctttcccttcctcctcctctttctctctctctcacttctctgcgcaggctggtcgacaggtggggaggaagccggcgtggtgaggccggagaggaggaggaagtcagcggccgacgacgggcgatgcggcggcgatggtggcggcaatgttggacaagggacaggcgcagcttctccagcgcatgcgaggcgcaggacgagcggcccacggttgtcacagcaaggaggggaacccggtgccgtgggtgcacaacggcatggtggaagacggcggctcgtccagcggcgcggccatccggtgctgctccttttttttttctttttcttcttcctctcctattctttttttgttctttccctccaacggagttgccagatcagcgcttgcagccggtgcggcgaccctggcgcggggtggagtggctgtgcaacgtacggcattttccgacggaggagggcggcatcagcatggccatgcaagtctagggtggcggttacggcatgggctacccggcagcgaccgtgtgcaatggcagcgcagcgcggcgcctgagatggcgtggcgtgctgcttgtcggcggccaggacagcctgcgggctgctcttcctttttctcgtttctttgatttgctctttctatttcatcttcctgatggccaccgacctcctccccacccgctggccagcctgcgcaaagaagtgagagggagaggaggaagggaaaggaagaggaagggagagggtgatgacatggcatcctggcatgtggggtatatgtgggtcctaagctaactcagtcaccacatcggataaaacggggttaaaataaccgaagaacctaaagtgaaaagttttataagtagaaggatatcatatatatgcttctgcagtttgggaacgattttttaaatcgatgacaagttaagataccttgggtgtactttttcctttttttttcctctcttaggctacgttcgttttcagtggttaccaactccccctctcgttctccatgtgcatgtttttcaaacggctaaacggtacgtcttttgtaaaaagtttctatacgaaagtttcttaaaaatcatattaatccatgtttataaaaaaatagctaatggaccactctgtttttcatatgggagggattagttcccatcctcctgaaacgaacacgccggaccagcctttctctctctcggcccatttcaacttttcacccttcactactgtgcagccaagttcagcacctccaattgtttcttgtcgatctctgtcagcttttgtcccaaatgtaacgggtggcgcacgagttaactgcgttggtttgtaagctctagatcggttctactccctccgtactataaaataccaacttactatcaaatgcaaaatattttagtattacgaatttagacatatatctttcaggtttagattaatagtaatagaatatgtcacacgtaatcctagattcattttttaatggaagagagtagttggaacagcacgccgcctgctgtgaaatagttggtgtccagtgatattgctggttccttaaattaaaaaaaaaagattccccagaaaaatatgatcagccacctccctgatctcctcctccgaaccacaccgttccagcacagccgggccgatcaccatggcgccccggccgccgaggcttgccatgctgcacacgaccgcatgctacgctcgcagctgcaactacctagctaccacgatccacagtggtgaaagctaacacaggtagagaaaccatctttggtcagtcgatcaaattccacaatagtcccggttccattaaaaaccgggatctggttaaaaaaaatttaatctttacacaccaaccgggactaaagatgatttttagtcccggttcatcccctgtcagaggcatgtgagggagccgagaatctttagtcccggttgatactaccaacgggactaaagattaccattttagtttcggtttattaccaactgggactaaaattcaacatagtatataatccctagtccttatcctctactccacaatcacaaccactttctcacacacacagatcgatcatcctctcttctccccctccttccctctcctatcttacacagatcctccccttcctccttccttcccccttcccttcctcctccctcccctggagacggatgaggccgctcctccttccttcccagccccttcccttcctcctccctccctggagacggatgaggccgcgccgcgcggacgcggtggacggacggacacgcggcgtgcggcgcagacgtgcgttgcagggtgagcacatgcgcgcaaacgtcctccctcccctaaagttacttgttgtctctttttttttatattttttgattcactaagatgtaattttgtgattcattgtatggatttgagatgtataatctgtgatgtatttgatttgtgtgtaaattttttaggatttgcgatattttagatttgtgtgtataagtaactttaagatttgtgatgcagatttgggatgttactttatttggggatttggggtttgatttgggatgtgcatgccatccgattcgggagaaaataaaaaagtaacaaaaaaaagaaaagggtaccaacaccaaccgggactaaagatagatctttactcccgattatttcacccgggactaaagataacgatgtttagtcccgaattcatagtctcggttaaaaacccgggactatagggaattacaaaccgggagtaaagacagtttctctaccagtgtaatcacaagccacacacacatgcatctatccgaagactaatgacatctaccaatgctaagcgaaggcgctgggacctttcgtcactggcacaaatcgcagagaaccatactgttcacatgcaatgtccagccaacatgatcaaagtggtcaaaatcaacaatctcgtacttgccctttccgtgatgacacccattcctcagcgaagaacacacgatgctgtcacatcaagtactgttttgattactgctaattaagtatgcaaattaacggggagacaggatgaagaaagctagagggagaggcaaagtaatctactgcaagtagaatacaagaacggatcggaggctcgggaatcaatatggagtatatatgatgtgagttcgtgcatatagggccttgaattctaccaaaggacaactgcgctaggatcagctgaatttcatttggttcgcattcatggctgaattctttgataactactggattttccactcatggtggggatttctcaccggcccgttattacatggcaaagattatttttcgttcattgttttgcttctcttttctttgtcttcaaatgagcgcctttggtaagatcttaaaccactgtgtagtgaaagcaagatcatcatgtacgtacgactacgattagaacacttggatcaccatgggaagaaaactcatttgcggtcatcaaaacaatttgtgaaattccggcgtttagttaatcaattgaaccaccaaaaccacatcgacactagaggtttctggtttgggaaggagctatctcgggatcgccggatagtccggccactgtggattgggagagagctaatgatcccctgcgttgtcctcattttgatgcggaagagaagaactacggtagcacattggcatactagagttaacaggggagatcgagatgagattggggaattttttttaccgttttgaactagtttgacaaaaaatatttgaccagagcaactgaatatcgggacataccagtgaatccaatatttcaaaaattttcttttgaaatattttattatgggttgacgacaagtcgttaggtccgatgaaaaatattagctatctatccactactatctagcggtgaaagtggttacagtgaccttagtagcaacctaagtttttgagttcaaatccccataagaacgaattttaaattgggcgcgaagtcatatgagcgcatatatcctgttgggtgtaatacctattctctaaaaaaagtatctagcaataattgatatggaaattaaattagaattttatgctctgcggtatcaaaaggttcctgggctccaagaattatttttagattgtgcagttttacccctctgataaatctaaatgttatgctataccattcacaaacttaatatagagattgtgagccgttcacattaattacatggttgtaccttggaacaaactgtcttcagtatatggcgttttttggttcttgtcgtggtgccctcaaccagggtttgcaaattaatttgttttgaacttttgtgttggggttagctgaaaatttttattatttgaacaaattttagccgaatttgaataaacttttgaccaaattcataaaaaactgaaagccttgaaaatttcgggctaaatagtttcaagtgcgggggaggggataccaaaattgccaaactgccctcaaattgtaaattgcaaattgctcatagttccgatatttgaaacaaaaattgcaaatagtgcgctcaactgaagaaccaatccatgtatgtttgatgtttcactcaaatttagctggaacaacctaatcacaaattgctgattcctccacggatcaagtgatgcctggatacaggttcctaaaaacgtccaatgcttcaatcttgacttaacgatacagggtagtcaaactggaccagtcagttacaaaacattggtttcagccgcagttttgcagccatctctaacttgagtcggttatctatttatctgtattggagctcaagctgatcagtgtcatgacgatattcttttcacgacaccacccattcccaactaatgggatgcaccacacaaattaaaccaacgagaacaaaacggtcattatatgttcctatctgaaagaaactgtgtgtatgcattgatattggcccttatataagccaaggatgcctggatttttcattttagatcttttttaaaaaatattttataaatagacccctacaaaaatttattcttggaatggatccttttcgcgccaacgacattgacgccgtcaccgtggtccaacaaagacgttggtggcgttccccggcctatcctctatataaaagctaaatcacttatatgaaggggaagtgaaccatttaaaaaaaggatctatttttaataagaaatatttatatgtaggtcctcacaataaataacattggcaccgatgacctatttataaatattattttacaaataagtctttttttcaaaaaatatttacaaataggctatcggcgccaatgacattggtgcactactacaggagatgtcataggtgtcggtttctaaagttaagggattaaaagtggacttattcctatttttttcctctcttggccagaccagcttttttccctttcagcccatttaaatttttcacccttcacaactgtgccgccaagatgagcacttccaattgtttcttgtcgtgctctgtcagcttctgtcccgaatgtaacagggtggcgcacgagttaactgtgttgggttgtaaaattgttggtgtccagggatattgctggttcctttaacttaataaaaataggtttcccataaaatagaatgatcagcatcctcccttctcctccgaaccacactgtccctgcacagccgagccggccatggcgccccgcccgaggcttgctcctgcacacgaccgcactctaggatcgcagccgcaaccacctaccgcgcacacgcgccgcaccaaggtgaccaaccgttcgacggcggtgaaagctaatcacgagccacacacacaagcatccgaagagtaatgacttaattatctaccaatgcttataagcgaaaatgctggacctttggtgactggcacaaatcgcagagaatgataccgttcacgaaccgtgcaatgtccaaccaacatgatcgaaatggtcatatccatctatcccatacttgtcatttccgtgatgacacccattcctaagtgaagaacacacacgatgctgtcacggcaagtactgttttggttactgctatgtaacatcagttaggatcgacctgctcgtttctcttagcttgtgtgttgttagaatgcagaagtgtgcaaattaacggagaaacagggtgaagaaagctagagggagaggcaaggagtaatgtactcctaggatagaggctcgggagacaatatggagtatttatatatgatatatgctaccagaggagaactaggatatgctgaatttcattttgttttgcgttcatggctgaattctttgatgactgaattttccattcatggtggggatttctcaccgtccccttattacatggcaaagaatttcgttcattgtattgcttctgttttctttgtcttcaaattagcggcttcggtaacatcttaaaccagtgtgttgtgaaaacaagatgagatcatcatgtacgtacgactacgattagaacacatggatcaccataagaaaactcattttttaggtgacttgatataccaaccaggctccaattaatgtattggaaaggggggaaattatgtgggtcaccaacaattccagcgtttataatcaattgagccaccaatgcggtcagggagagaactaaattaagttacccttgcgttgtcctcatcttgatgccgaacagacgaacaatcgcacattggcatagaagagttagcagaggggttttgcagccatctctaccttgagtcggccatcttttgataagagtcggtgctcaagctgatcggtgtcgtaaagatattctcttcatgacaccacccattcccaactaatgagatgcaccacacaatccaacaagaacagaaaggtcacttattagacccacccggtcaacacattcaagatattacttccttcgttttaaattattggttattcagttttgtcctaaatcaaaggtttgtttcattaatcattaatttctaaaattaatatagtttaatatgattcagtgtttgacgtatgacagaactgggacagaggatgcagtaattattctggttgggccatgcaaaattgcaaattagctaggaccaatcgaaaggtgattccacatatgagttggtgcatagcatgctcgcgctagcacatttgacgcaaattaccaggtggaatcctatttcgtcccatattgttctttctttcccatgtgtatcctctaaatccctcgttttatccaaatattgttgaaaaggtgaaatatacccccacaaaaaaaaaagaaaaggtgaaatatgatgttctcttcaaacaacaactcatttttacctacctacctaagtagatcatgctagtttgatattggatgatatctctttcctttttctttctaacaattccagtgtagattacctcttcatgactgaagcaacaattggggtgatttggagcaaatcttatgttggttttccattagaacgaaagtgtatcacaattggcataacactgccaaaaaaaaataagaaaggttaccagttttgccatccccatggaccgtattccggtccaacatctagtcaagagttttacgtatacactctagtcaattgaacaagacaatcactagaatccaatggagaaaatccccgtgtacccctaaaaattttcccaatctttttatatttctgaattttgcttattcccttttaaaccgcaaattttagtttggatatcttcctaacctttctattagttgaccattattaaactcttatgaagaagtctaatttacccctatggtatggaaaataaataaatttatagagtatagaaatttgttgtatgagactttattgagtttgtaaaatgcgaggtagtatttatgaaaaaaaatatttttaaatatgaaataaaaattaatatttatcttctaattattaaaaattttgttcgtagcttatttattggttagtagaacaacatgttttctatatatagatatacgctacacaaatgatttttcataactaaataactaatattaatttttatgtcatatatacaaataaattttatgataaataatacctcgcataataaactcacagatataatagtctcaaataatacatttctatcttccaatactatacttcataattttatatgtttcttcgtaccaaagggcaaaatagactttttttttataggaatacaacagtcgacccacgattagctaacgaaaagtgtatgaaaaggatccaaactaaaattcatagatatacaagagaatgagcaaaattcagagacatggtaggaattacgtagagaaagtttaaagggtacgtacgcagagaattttctcaaagcaatgtgtatgctctcttagccggcgaacagaatcccggcgtcctcaatctctcttcaactcccaaactgaaaaactcaacaatgcctctgaacttgaagacaagtgcattggcgctgcaacaccttcagcagtttttctgggttatattcatccccttttatttggaaacaacgctagtaaatcggccgtagtggccatcatgcacgcgacacgatccgcaccgacgtgcgccatcccacacgtcagatcgtgccgtgcgagactcggactccacaacagactccacgattttgacgtgaactcacacacctaaagtcttacacacgacgtagctgctagccagctggcccacaagcaaaacaaagaaaagaacgacaaactacccgatgaggaacagtgaaaaatagaaaatgcctaaaaagacaacgccacagacggcgagattgacaacatgctctagatcctattcctagtgtgacatctcaaatgaactttgctgcgagagctataacataggtcatcagagggaagtgagaggcatatgtggtgatggagttagttgtaaatttatctcctttgaacttacgttagaggtaggtacgatagacaaagtagtaatgcaatggcggtgcaacatatccgcgaggaggcagcagcccaatgagatggagatggaggtaggctgctagcacatagcatagggagacttttaagagctatgtgaacggcaacaccagtcgaccacagtacaggttccatccgtattcttacaggtatctcttccttattttggtcagcatgctcagcatatacgactccatatcatgatattctttccacgacaccacctattccaagtaaagaaatgcactatactaatataacaactgagaatagagtgacttcacattcctatcagacatgaagtgtatgcttagacattagtccttatataggctaaaggaggtagcatgaggaaacaaacccaaacatgttaacataaattatgttgcgccagaatttgtgatgtgtgagcagggttttcaattttgaaattgtatttttgcctgggaggaccaaaatttcggaaattttgtggctgaaattatttgaaattttgacttattttgaatgaatttgaataaaatttgaccaaattcacaaaaatttgcaaaacaccgaaatttcgggcgagatgtgagcctttgcttgcttcagttattggcctacggtaacataactcttatattagtcacttactccctccgtcctaagaaaaacaatctctagctttaaacctggacatgcccatatacatgttcatagctaggaactgacttttttaggacgaagcatgtaaggaagaagtaaacatttggcctttttttatctcataccatcttaattgaagccctagttgaactggcttttttttttaatctcatacggtcataccatctttcaacatttggccgacattgaaaaaacaatcaggattcttcatacggccaaaagagtgatcagcttatttgttttcaatcatatctagtatggttgttcctttccaatattaatatgcttttgttcaacagtattgagtaaaaatcctcctgcctatcttaagaaaaaagagttttgcaatgcatactccagtcaatttctattcatcgagacacaatcacgagcaagtagcgtgtatgctctagatctcaaatggttcctgttgtcgaattcggatcaactctttggtggggctgtattaatttggtccgctgctatataatgtgcgatacattatcttcaacttgctccctaactgatgatatgatatgagaaattaatggtataatctgctccatatagtgaagtacgtacacccaagacctgtgtgtctgtgctatatatgtgttttggtatcatcagcaattcagctttagtggctagtacccgcaaaactcacaagtttgtgaatctcacatggcctagacgaatgcagagttgtgtgtaccaccagatcaaagactacaatcagaacactgctgagagatcttgtcttggcattcttcctggttcctttcattcctaagaaaacaaatatgcttcaaggagttccagtggtgcacaaacaagcaaaggtagactactctggtatagcggcccgccggaaggagatagagcatatacatgaacctaagagagaattgttttatctctctagtctgtaccaatttgcattaagttagtacaagcgttcaaggctactcgattttaatgtgtacatcccaaactgatcctatacaaatcgcgagtgaaaagccagacaatctgaaggaagtgagaggcaggtaggtgaggtaagaaatcaatgctactccctccgtttcataatgtgtctaattcattaacatctatacgaatattagcaatgctagaaaaatcttagattattatacgaatggagtaggactttgtgataccagttcccagctcaagaacaagcaaggaagcaacctagctgaaacataattctgggtattgcaataatttgatcaaaataggaatctgccgaacaaaagaaggtatcaaatgattttgttcaacttaatcttcattttctgatcgttgtagtagtctcttcttgagatatccaacgaagcttgcacgttttgaagatttgggaggcttgactccccactgaagcattccacttcataccatcatgacacgccaagtcccaccagatctacacacaattttcctggtgcctcttattcataacaaattgtatccatgtaaatgtaaatcattttttacaacacaggaaaggacaaaaaaaaaccgagtgttccatgatgtcgaagatatagaaatttgtacatgtgtctggttatataaatttggaagtcagttaaagatatatactactacaaagctttgtacatgtgtctggttatataaatttggaagtcggttaaagatatatactactacaaagcataagtaggggaaaggaataagttttccacgtgttttatatgaacacacaccaaattgtgaagaggaggtgcacatttacttaaatatggtatttacatgagataaaagggtttagatgggatttggatataacattcaccatcttatttaaaagggcgtcagttagtgtataaatacactaagtatgcgatagatgactaggaacacagttgttacatactccatccgtttcagattacaagtagctttaagttttttctcggtcaaaccttttcaaatttgaccaaatttataaaaactatagcaacattttcaatacaaaacaatcatattatcaaattatattaatgttagatttaatgaaactaatttggtgttttagatattgctaaatttttaaacttggtcaaacctaaagaaatttgacttggaattttgtactacctccttttttaatagatggcgccgttgattttttctcacatatttgaccattcatcttattcaaaaattttatgcaaatgtataagatataaatcacacttaaagtactatgagtgataaaacaactcataacaaaataaattataattacgtaaattttttgaataagacgaatggtcaaacatgtgagaaaaagtcaacggcgtcatctattaaaaaatagaggtagtaaattttaggtttattaattaataaaaaatatttatgtagcgtataaatatatttatattatatagaaaacatgttttagtactatgcacaaaataagctacatatatgtattttaaaaattaaaaataaatattatttttatgtcctatctaaaaataaactttgtcacaaataatatcttgcgttataaaatgataaatataaaagtatcatacaacaaatttccatactctataagtttatttggttttcataccatagggcaaattggacttttacacaagaatttaacggtcaactaacagaaaggatatggaagatatccaatccaaatatacaagagaataagcaaatttgactaggaatcctatatattttaggaactgccaccatctctatcgaggatggcccccaccgtcaaccttgtcgtcggaacccaccgcctcctcgtcggagcccacccgtgtcaaacttcactgacacctacatgtcgaccacaccaagacgtgctcctgctgcccggacttcgtcacccaacaaatctgttccaacctatcttagattgaccacctatcaatctagtcgttagccaaagccgacgaatcaccatgttgccttcatagttgctgaatgaccagagcgccacgtttggccatctctttattgaatgcaactcgccaaaaggcccgacccacccccgccggtgtgtttgattccaccgaccgagaatggcaatcacctccagcttcaaccaagcccgagtgtttggcctcatgtcaccttgttgaaagtagctttctagaaagttcgagtcaccagcccaaagtgtctgaatccatctattggatcgcaatttgcttctgccaccatcaacccgagcactgcatctggtcatctccttgttgaaaacatccatcgaacggttcaaaccaccgcctgaaatgttatatccaccgatcaaatttcgtttatcaccaccatgctccaccttgcgtgcacattcgtcccttcacatcctgtgtaatcgttgtagcgtggagcacctcccacgtacctctaccatggatttcccataagctctcatacaacttgttctaaagccggcccccaaatcacaattggaaactaaacatgaaagaaacgccatagaagagccaaatttgatgatgacaccgatgaatgatatttgttaacaaagttcaaccgaagcctatatccttgtggcactgattatgggtgctccatcgattcaggcatccaacattattacaatgtattagagttacaacgagcctcagccgaacgtcggcagccactccctctcgcctatggtaagtcacgatgcggttgcaacatatctacccctttatttaagagataggctagaatagagtccgacgcttactctattcctaacacctagtacaactctatgtcctaaactgtaaccgacatattcgacacaaactctaacaccattcaaccatgattggcctccattgaagccacaattaggcttagttttttaacactgccaaataataataagtttaccagtcaccagccagaagcactacaacatatcctcaccaccttcatgcccggcagccggcgacggtgctagctccgatccaacaccggataccagcatcatcaccacacacacagctccatcccaaccccctggtgcgctagagcaggctgagatgcatatgcctccttcttgcccagtcatacaccaagatccacaccatcaggttgaagtgtacaacaccatggatcatctgcgtgccggcacttccaacccacgacgacctcagcagccgtcggtttaactgaggattcaactttgcaggacgggccctgcacgagcatgaacgggatgagacggcgagttgagcgcgcccagttgacgtggtgggcagcatcatggtgatggcgaaggtgaagtagtacaattgacaaagcgaaaatgctgaggagggtggcctctgcaggccacagtgaaaatgttgcctggtgtgtaaagaagaggaataataacagacgctgaatgatgagcctttggagcctggaaggaacaagcaaattgtagggaaataaggcacgtatatatgcaaagaaattggatgagtcaatccatgcaaacaacgcgtgtcgctgtaaacaccggccagcaacgcaagcagatagctatcaaagacaccaaacagaaggaagtaacacaaaaacgagcaagaaaagacgaacaattaataaaggaatcagacgatgagattattggcagcggcattagacgacaccaacagagaacgcagcaacaagcaggcatcgatttgccaacatccttcgttcggacgaccataaaataaacagaaactaccactggtagaacggtacgtcagtaaatcaagaggagagggaaaaaattctagaaaaaagcagggaaaacggaaccccatgggacttagggagttttatgatgcgcgcgaggaggcagtggcccaatccgtcagataaaggcagggctgcaggctgctcgcactagaagactttacggagttccaggagcagtagcaccagttgaccacagaaatacagaatatgtttcatccgtagtctcctggggatctctaccctatttaggtcaccatgctcagtctgttttagcatgataatttttccatcttggttcctgttatggcattcagattaacgctttgctccagctgaattaggttggttgctatattatgggtgatacattattcttcaacttgctccctaactgatgttatgagaaatggtataatctgctccatatagtaaagtacactgagacttaaatcttctattccttcatcttcttcgactcaccatcatcgattgcatctctaattgacggtcctccacctggtgcatgcgtccccctctgtgtcgtcccttgactctcctctattaatttgttaagctttttggttatcataagcaaatcgatattatcagcagctagtactccaatcacagtttgtgaatctcacatggcctagacgaatgcatagctgtgtgtgtaccaccagaccaatcactacaaagtgaccactgcgataacctacttgtctcggccctcttcctggttcctctctcattcctaaggaagaaacaaatgcttgcagtggtgcccaaattaacaagcagagatagagtattctaatctgaaggggtaggagtatactccctccgtttcaaaatgttgacaccgttgactttttagcacatatttgaccattcgtcttatttaaaaaaatttgtgaaaaatgtaaaactatatgtgtacatgaaagtatatttaacaatgaatcaaatgatataaaaataataaataattacttaaattttttgaataagacgaatgatcaaacatgtactaaaaagtcaagtgtcaaacattttgaaaacggagggagtatatatgaacccaacagatcgagaattgtttgctctctctagtttgtatattcgtaccaatacacattaagcagtgttgaatgtgtaatttcagctgtggccccccaaagtgtttcaattgttagagcatctccagcagggacctcaaattcagcccctattcaatttttgagagttaagatcaaaaaactagatccagcagggaccctactagagccccaaaagtgaggaggccctcgaatcctcccccaaggccccagtcctgggggctccggagcacgcccccatcgtcattttttttggcgcggataataattttgcttcgcgcattttcttgttattcctgcacggctgcgacgacggatcttctccggcgagcaccgacgaattcccagcacctccgtcaagactgcccccgaaaggtaagacttttccatacctttcttgcccgtcgatctcaaggccttcggcggcggtccatgcgcatgcccggccgccgatctcccgccatctgcctggccacacgccggccgtcgcgtgccctccaaggctgcccgcacacacgtcacccacctgcacgctgtctgcccccacgctggcctcctgcccccattgacttttctagagaaactctaagtaggtcatgtgctgcgggggttcagtggtagagtactgatcaattttctgaataactctgttcttgacacaaatggacatgtggtggtagatggttctggtggagactgacttgtttttaataatttttttggagaattgtagtggactttgtcgtcaaggaaaatctaaattctcaactagtaatggttgtgtttagttcacactaaaattgaaagtttagttaaaattggaacgatgtgacggaaaagttagaagtttatgtgtgtagcgattgcaatggcttggagaataagtctgctggagtttgttagcagatgcgggagatgcggcgatcaggatctgaatgaccgcatcagtagcgtccgtgtgcgtgagtttagcgcaggtgtgtgtagctgaattcagagatttgcggatcgtgggatggcacgattttgcctcggattcgtttatttgtatcgagtataagtaggagtcttagctcagttttttcatttgtaagttctttatttagttgaatgaaaaaccaccagaaaattgccccacatttgatcgttctcgcggagaattctgaaatttctcagttttttcctctgctctgaatttcctttgttcttcgttactgttttagtctgttgccgtgccggacatctgcagtttgcacgcaatgtgttcgatcagaggttatcgccaacaaacagcatagagagaagttaaaggctacttcatccttatgggtatactttggactgaagaaaacaactatccgatgcaaacagcgattcagcgagtgaaaagccagacaatctgaagtaagtgagagacgggtggtgacgtcgtgtaataagttgtggattaatcttccctgaagttgagaggtaggtgaggtaacaaattattgctagaactttgtgttgccatcccaagttcccaactcaaaaaactagcaaggaagcaacataaatctatccctatactaattgggcactttctacgaactctcacgttaactataaagatctaaccattagattagattgacggtaatatcaggaccgtagatttaaactgtaaacatggacttttaaagtccaagcaatctagcgttagaaattggtccaccatccaatctctttaactgctttaaaggcccaaaacccatatatgtgcacgtattaatctcagccaccacattagggtattcacctacatcgatggctgccacggtattggcggacatcgctcccgacaagacggcggcaacttcgacctccttcatcgtgcacccgaggtttggccgcaattgcatgcaggcaaagctccatatcgatgtcgaccgaatgcatttgtccttgcggggtctcagctcatctattaagaattgatctaaactgatcctacagctacgattgctgatttacgtacacaagtaagattttgttcgaactttctccaattctagctgttcatctgcatgctcttcatctggctatgccaacatatgacctaataaatttcaggtgcattgagatgttataattcacccaaacaaacaagttcgattgcacccaaagagatcgatccgtggtcgtctcatctgctctttatgaaggtacgtaatttgtcaatttggatattctatgccaagttttgcttgcacctaggaaacatccatcgtaggcgttgcatctgtaaaccatgcatgaagataattcatgcatggttgatttgtatggtctcttatatgtatatatattcgaactttgttgttctatagctttctgcacattcaaactaattaatccatgcgtgctgcttcgttgtatccgctcattgttatttaagttgatgccatatatatatatataatttccaaagacaaataacacaacttatttgtctctcgacatgatataaatatatattctttctcacaaacagggatgatacaaatattttcttgagagttcaagacaagtacaattttatattaataattagacaattaaaattgtaacttcaagtttgacaagcagcagccataaaaatatttttgcttgacagtccaagacgagaacaattttaaatttaataattttgattagcaaactttaactaggactctttttatctaatccactataactccctattctaattatgacagagttctaaacatcttcgactatcaatatcaatgtagcatttattagtttaatcatcataaaatcgtacccattgattatgttggttttatattaaataaaacaggccatatgctctttacatttatagattttctaaaaaaaatgaaattaataatatggagctgtaccaattaaaccttggactacgtactatttagcattgctattaataatttatgaaattcaaaataaaaaatagcagattgtaacaggtagggattgattttatctaatcccactacaatgtgaaaataaattcaaacttaataactatatatcgatttatgaccatgctcaactgtcaatttagcacttattaatttaattatttaattcaaaactaacaagttattttaattctaatctactatattttaaaaataaacaacacatctgtagcataaaactgttcatattattgtaacaatatataattatacccgtgcaacgcacgggttgacgtctagtaatatgtaattctgggtattgcaattatttgcataaaaacagaagctgctcaagaaaagaaggtatcaaatcaatttgttcagcataatcttcaatttcagatcgttgtactagtctcttcgttcttgagttatccatcgatgcttgcaggttttgaagatctgggaggcttgactccccactgtagctttccacttctcaccgtcatgagacgtccagtcctatcagatctacactcagttttcctgctgcctcctattcataacaaatgaatatcaatataaattgtttttgagaacacaaaaaaggacaagtacaccgagtgttccatgatgtccaagagatatatgtttggttatataaattttttagtcgatcaaagatatatgtacaactacaaagcataggtaggggagagcaataagtagcaacatattttatatcaacatcatcaccaaatcgtgaagaggaggtgcatatttactatacgggatttgcattagataaaagggtttacatgggatttggttataacattcaccctcttctttaaaagagcgacactttggggaccgcagatattacatgaaacaactaccaatgcaattataaggcattggtatataaaagaaaacattagttcagggtggtcaataactcgtgttcacacgtattttttgaaccgtcgtctaaaagtaagggcatgtagaaatcaggatttttctcaagcagattccatgaccacccgtaaaaatcaattttcatgaatggccggtaaaaatgaattaccagattttgactttcgtaggcacaaaaggtaccaaaaacatattttaggcatctatacatggcagcgaaacataaatcacaagtcacatgattttacctatgagcttttcatgattgttggaaggatatgctatttgtttctcacttcaccattctaaacttggaatatacattttgcacgttgaataacttcaaatggaaatgtcatcagatgtaaacttgtagatcgcgttgagttatacacttttgacatagaacatgtctctatataaggtcatttggaaaactcaaaacttaattttcagtcactaatccataaaaaaagttgattcaataataattagtgaaaaaaaatgaaaactaataaacaaccatttctgtcagatggattaatgcgtgcaatatatatatatcgtcaacattgtcgaacaagcattatgcaaatactacctccgtcccataaaaattgcatttctagctaatttaggacaaaatagtaggattggaaaattaccacaataaccttatttaatgaacccactgtatgcacacattccatatatacaaatgattaaaaggaagtttgagagaattaacccatataattagcatacttaataaaattacaagcattagcagctcaaattatgtgagatggaatgaaacttatatagatgaatcaattggttaggccccacatggctagaaatataattttgtggaacaaagccttggagctagaaatgcaatttttatgggacggagggagtatatgcatattacacacaatattttacactgaaggaaatacaagtccatttattccaaatcccagaaaatatataagcaaaagtaggtggaaaaaaaacaagccaacagacacctcgatcgattaattatctgtttgtttatttacttacctgcagttatttatttatgtagcatcctatgaatagatgagcgagagaaacacacaccaatcgatttatctttgaacggtaaataaatttgtcagccatgggagacctaaagctacccaagagctgatgtctccctccatggctgtcctatctccaaatatcaccgcgatgatgacgcgcaccaccgcgccgacgatgttccgatctcgctccgacggaatgccatggagaggaccaccttcaccgatcatctcctcgctgatcgccagcatgatctgccctccacatttcatgtcccgagctgcctgccatctcctccgtgcgatctgcttgatgcaggacacgtgcagggacacggcctcgccgccgccgtcgacgacgtcggagttgtagtagcaccattgctcctggcggcggaggcggcggcagcagtgatccgggccctcctcctcctgtctgctgcataggctgcacttgctgaacgccgcgatgtcgaaggcgaccccgtcgatagtgatcttggctagtccctgttgagaatagtcccacgttacttatttatggggttgagccaacttaaaagtgagggaatctctcacctctttaactagcttttgaggcgtagcaagactttctttcggttggtccaacgtctcccggttttggaccgggagttcctgcaggctcgcacagcatgggtggaggtcgaggttggcgcctgagcagtggtagacgagaccgaacacatggtcgccgcaggtgtcgcaccacctgccgccgctttcgcctctgccaccaccggtggcggcggggtgcggtttctccggtcgtccttgcggtggcttggcgagaagctcgaacgtgcggccgaagagatggtggtagagcgtgctcggcgcatgggcacagaacttgtgcatgttgaggtcctcgcaggtgaggcagtggtacctcggcccgtctccgggctccttgcaggcgtcgcacttgaacggcgcttcgccggtggtggtcaccattctaagcttgtgctccgggtggctggggtgggtgatcgtcttcatctccggcaccataccgttgtttgttccattctggttctcgaactcctccgcatcaccgttactttccccactgtaactagcgcattcaatgatcccgatcagtaaattttttttattatttgggacaaaactcgatcaaactttaaatatcctgacaaccatttcttttttgttagaactacttgatagtatttatagttttgtacaaggacacaaagtctccaagaaacaacactcaagaaataaccttaataacacttttctactatactttctccgcccatttttaagtgcagttgtggttttttttttccaatgtttaaccatccatcttatttgatattttttatgattagtatttttattgctattagataataaagcatcactagtactttaagcgtgtcttattttttttcaattttttcataatttttcaaataagacggacgagcaaacgttggacacagaaatcaacaactacatttaaaatagaacgaagggagtaatattcgtataaatatgaacaaatatataagtttattgaagtacttttcaagattaatctatacatatggtctccatatctgtatgagaaatatttcatagtcaaatattttaaattttgactttagttttatccaaaacgataagtattatcgtttcggagcaactaatttataaaataataagtttttgacatctatccgttatattattaggacgctcttctaccgcattcattctagaagctagaaatttctagaaaaagaaaaaaatcttaacagttagataacggtacatatagttgtataaaaatacaattatatctacagaaatataattcaagagttatatatgaaatctaagcctattgaaatagaagttaagagtggtatatgacattcaaaccttatagaaatagaagctaagcattgtatatataaaatctaaatatatttctacatacaatgttaccaatagaatataaaatttcagaattgtatactaaatctcactctatacgtgaattatctaggggaatcccctagctcgttatgataatttccttatgacataataattgctggtagtttttcatgtacggcgttgtactttccaatcataaattaataatttctatcatttaacacttttttcagcgtaatacatatcgttttatatttttttaaaaaagaaataactgaattatttgcacgtggcttttttattgaaataactgcataaatgtaatactatggaagttctcgctgtagcaacaaatttagctatatgatttccatgtgcctcaaacatatgttctgaacaatgattatggtcgaaaatcactgcaatgattctaaaacgaaacttatttatcaggagggaataaattcatatatacacacctgctattatcttgtgcagatgcaccttcaccacaatcatttgtcggcgtcccgtcctccattagaatctcatacaaattagtcagagtctcgtgtgagtgtgacatcaactccttcaagcacgacaggtgcacgtcgacgagctcgtcgccgccgctgcggcggaagcggcaggtccagaacccgtgacggtacccatcctcgccggacatgcagacgccgcaccgtcggcggggagccgccctgcggcagagcttgacggcggcggcgccgcgagctgccgccactggcagcctcagcctcgcgcagcgcgggtggaggttcaggccgacgaggccgtgcccatcggcgcagtggtaggcgaagccgtcgccgcgcaggaggtcgccgcacgcgtcgcacgccggcctccagccgccgccgccacggtcgtcggcggcgagccatggcggcggcggcggaggccgctcgaggaggcggaagtgccggcccgggagcagcgggtgctctagggtgagcggcgcggtggcgcagcacgtgtagagggtgaggtcgcagggctcgcacctgtacctgcggcggccggcggcgagctccttgcagccgccgcaccggaaaggccagtgaccgtcggtgacgttgtcggccagcctcagcttgtgagggtgaaacgggtgagtgatctccgccaccggaggatcacccaaatccggcgtgcgtaacatgtggttgtcgttttctgttgaaatcagcaaattcaagatcattaattcattattgagcaagccatgcaaatttgagtcactagaaaacctatcggtatagccgatttgatcggtgctcaccgaaatttccgaaattttgaataaagtatagttgaatttgaacaaataataccaaaattcacggaaaaatttaaaatttaaaaatttcggccgaaataatatcgttccggaatttccaaccctgcactcgatctcgttagtgatacacatatatactcgcttcaattctgaacatttgaaagtttaggacaagatttgataaaaacatttaaaacttcgaccgttaatgaatttataaatatttacttgaagagatttgctccggttcaataaaaagtaactcgagttaccggtattttacggtactaaatcgttttcgatcgttggatctagctgggcaggatgggcgttgttagatccaacgatcgcaaacgatttagtatgagtacctcgagatactttttgtttgaccagagcaaatctcttacttaaaactaaaaagtataaatatggtatgagcatatttgactccaaaagtattatatattatcagttgtcaaagttctagaaaactaatttaatcctaaaaattaatgtaaactattgtcccatgttgaattaattatattccaataaaatttatgtccatgcggttatatgatgaccaattcaaaaaattttggattgtattatatgatgatcaatttagaaaggaggatgtatatagtaagtgaggattcttaaaagtagttatgttcaaattaaggatcgatggatacctctggatcgaccgagtcagcctcggagaagatcggcgtgaaggtttatatcctactcctgcccgtaccacaagaaggccaacgtacaagctgcagatcgaaggaatatgagagagatagactgagactggatcttctatttatacaccaattcaccagccggcatgattcctgtttcaaactaaactatatgcgcactcagaatctttcactaattgtatatatgcaaatatatacgtatacgtgcagtgtcctagtccgagaagtctctcttaacaataactggtagatatttatatttatctacacatctacgtcctgaacagcttgctctacttcttccggaaaaaaaattctggacagctaattatgcttataaattattactcgtttttattcattcaaacttataacggaattagtcttccctttcacttcattgaaaaacaaaatttacaacaaagtgtcctggatttcataaaattaaacgacatgtcgatcaatactcacacgcacactagaaaagaattggctataactctttgagcaaaagctgagattctattctattatctaaaaaagacacactagaaagaaatttaactttcagaatattcagcctgcccatatctgtaatagcgcgcacctctttgcaaaacaaatcaacaaaaaaattctctaattatttatataaaaactattatatcgctgtttctcaattttttatctcaaacaatgatatatggaagttttccaaaaaattgaaaaacctctcacaaatagctaaggtaatattagacaaccatacaacctacttgagtttgtgagatataaaattgagaaatataagataaaaagatataaacacgagcaatggtatttattaattttatatctcattaacgaacatgagtttgttcgtataactttgttcggttgtttattatttaaatatcacctatgtgtgtaattgttttgagttttcaccatatatttgccctagataaacaattagcaagttaattgttaattagcccatccattcgcaaaggctactgatgttgtcatttgtataacaaaatacatatctatttaagtttttccaattatatgcaactagttaatatttttacttcccatatttttttattaaaatggcagttgcattttctaattattaaatgattgtttttacatatggaaattatattcagttataaataaatctactttgtctaaattaataattctaaagttgtatttgttatagttataaaattctaaattaataattacatagtgtttttccttctaaattatatatagaatcaattccgagctagtcacataactgaaatattagggaaaatatgtggtggaaaccacttatgtagtggaaatttgaaaactgccactggatcgaaaaatagacgctggaaattcatccacgtcactatgagtaaaaaatttactcactgtaaaatttttactcatgagcaaatccgtgagtaaatttttacttgtgatgaaacgtacgaatcttgtatgtctatttttcaatcaatggtactttctaagttttcatttcatatgtgattcccaccacatattttcccgaaatattacgccagcactacctagataattttctttgactaatttagttaaaacgacatgcgcaaagttagcatagttgagcggattaggtttatggtggtggaaacttttgtcgactcaggttgagtccgcgactaagaacatgtacaggttcttatatttatgactaatattctttcggtaacatgcgatataacagttaaccatgaggcacatatatatagtgagttcgccaatctcaatatatgctgaccttatctctcatctcagaagtcagaagtactcataggaaaaaacgtatacctgtggacgtttatatagttgagtgtgaatgagaccctaggtgcctatgattgcaatgcaatatatatgttccccaataaataaataaataaaaataacacgtatctgttagtgagatacttgaatgacttggcactctagctagctagttataggtttagtgaatcgcagaaattatatacagcagattccgtttgacatggattatatacaatagaatctgtttcacatgggtacgttaaatatcagagattctgtgggacatggattactatatatatctaccagatattcacttcgccaagcaacccattacgtataataaccttcttctggacgtggatcgtgtttctctaaccctttctaacctgatatatattaacaaataaccaatttgaagtttccatttgtttctatatatatagggaatttggaaatattagttgctggtaataaactgcagagaactaattacgatgccaaggaactgcaggtacatcagatccgtttaattatttgctgtcaagtctcaataaaaaccagtgaacaaagttacttcgagaaaaaaaattagagtatatatgtttgctatattgtcacagctttttttttttaccggcaaaaaaagtagtgacgaactgttgattatgaatagcattgccttcactggtagagaaagcgtttgtagttccggttcgtaacccccctttaatccctgtttccaaaccgggactaccaatccgagactaaagatcgctatctttagtcccgggtgaaataactgggactaaaaatcgatctttagtcccgattggtaacaccggcgtcccggttggtaacaccaaccgggagtaaacaaccgggactaaagatcgagctgaccttttttttttcatgtccctgttgctgcatggtttatatatatgcatatatatgtttcaatacatatatatgcacatataatatatgcatatatatatattatattatatttatatatgtttcaatacatatgtacatatgcaaatgcatatgtatatatatatatatatatatatgaccaaaatatatatttacattatagaaaatgtgtacacatgcatatagaaacatagtcatgtattaattacaatccattatatgtcctagctagctacgatttcgacgtagtagtagtcgctagctcagaagctaaggacctatgaattgtgtttccgtcgtagtagaattcacccttgggatcaaggatttgtttattgatgaatcccatgagttgttcttgaaccgccgcgataaattccttgtgtgtgatcaggttatccctcatacgaataaactatatgaatgtatgaaatttattagtaattaaacaacaaatcgatacataatgaaattttaaatttatttgtacgtacatcgagctctcttgtggtgatgatttggtctgcaaggcagtggcaatactcgcacacgtagtagccgcacaagttagttccctgcttttgctttgcgcactataaataaatgacaaacgacgagagatctaattaatgtacacttgtatgtatttgaatcagagaaatataaatgtagagcatatgtactcacaggaaatttgaacttccgcctaagtctttctctccatttgccgcggaccaaatgatagaaccgataccaagccctacatggagtttaaagctatgattcgtagtagcaattaactataacaagattcttaattaacataggaacttatgacagtacctgtctataagttcgaaaaccttgtcaaacgtagactcttttttatccattgagtcatatacgttgacgttacaggcttccaggtcgaagagtaaaagcacccagtggaatctgcaatgtgcgtgggatgcattacatatgaaacacttagcaagttcatacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagtatcgaaaaccccccgccgttaggccctttgaatctccattctacaacgataaaagggagtatatattatatatagtctacttatatacaaggacctaattacttaaaggagacgtagtaagaaatctaactgaatgatatacttacaaaatccagcaactcataatagagacgtcgagggcgtccagctggtatagttcgtagattcccttgaaattgatccagagaatgtcatctccttgcaagaagtccgtgtccctgatccttgctccaatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgtctcctagcaattgatccgtagttagcccggtgtcattaataaattcttgtattccaaaatcttcaccagtcaccaacggctcgatctcctggtttggttgctctccaagctgagggactggtttggactttccagaagatgctttcttgagcgttcgctcatagtccgatagctttatggcctccttggcaggtgcagacatacccctgaagaagttcctaacactcgggtctataggaatcttcttttctggacttcgaggcttgaattgtctgttgacttctgatgccacgtaagcttcaagctcctcttgcgtgcaatcgtaccccgggtccttgttcttggcggtgtcaactttcgccttctttattgcccttgtgggggcaggcggtggagcttgggttgcccttgacttggaaggtgccggaagaggagcctaaggaggagtcggtgcaggagcctgaagaggagtcagtgcaggagcctaaggaggagtcggtgcaggagcctgaggtggagacggtgctggagcatgaggaggagacggtgctggagcctgaggaggagacggcggagccagaggagatggtgcacgagacgccgcttgtcgcccagggaggatgatgtatcgcttgcgccatagaataatggtgtggcttgtgtctcgtagatgcgtctcaccatctcctccagggtaatccagctcgaggtcctcgtacgcgtcttcgaccaactcaacttcgaccttggagtatcctgctgcaatcggcctacagtggtaagtacctgaagggtccgttgggatggccatgcccgacgccaccttcatgtggtgagtggttatttattagtaatcaacatatataagcaacaactagcggaatggccaaatctaaaatctataaactatgggcttacctttattgataagttcttgaaaggaatatgcagctcacatggtgtccgctgagtgatgtcatcaacggggcaggtggattcgtcctgcgtttgcatggcgtccatgctctatgatcctacctgcccctttgaggcgcagctgctacggtttcctgacgggctcaccattgcaggaggaatggtcggctggggatcatgggaccgatgtgcggccatgcattcatcaaccttccttgccacctcctcttgcatgctgagctcgtagctcgataccctgaactctagatctgcaatcttcgcctcggtatctctcttgctcctcatccgactcctgtacgtgtggatgtcctccttgaacccaatcttccaaggaatcacccctttccctcgtgttcgtcctggatgctctggagtctgcagggtgagtgacagctcgtccttctctctgttcggtcggaacgtgccctaagaagaggcttccactgtgtctgttagtcgacgcgcagcctcgcgtatctgatcgccgaagaccagggagccatcagctgggttgagcattccaccgtgagcatagtaccagaacttcgatcgttccggccaattagcggtggccggttcgatacccctctcaagcaagctagcctccatctcctcccacttcggcatcgcgacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcaggatatatttctggtacagatctcccttgaagctccgaaactgttctgccattttcttcagagtccaccttttcactttgtcctctgtacccgcgggaagggtgaatgtctcgagcattgtggtccacagcatctctttctccgaatctgggacaaagctctcatgatctccgcgtgcccttgttctgcgccagtagaccgtactaacaggcacgttatcccgcgcaacccaaccgctgtgacgtacatagttcttggcggcttctgccggggcactaggtcggccgtcttcgtccacttccgttatgatgtgccgaccctcaagcttcttcgtggcacctcgttgcccgcgtcccctcttctgtccaacggagggttgacttccactagcctcctcctcctggttcccctccacatccctttccacgtgcccctcctggttcccctccgcatccctctcaacgctcccttcctcgttcaaatactggtttggatccttgttcccctcttcttcgttccagttctggctgcttccctccgcgattgtatcgtacaatatctgttcctcattgcgatcagccatctgttcatacaggaaacatctgctaagtcatgagacatttatgttttaacaatcttatatgctaacaatcatatgctaagtctaggtgacgtatattataggaccctagctagtcaataaattatatagtaagtctaattacaaatctaataatcttatattaaaactcaaataatcttatactaaaactcaaatagtgataaatgctaagtctaggtgacgtatattataggaccctagccagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtataggtgacgtatattataggaccctagctagtcaataattatatactaagtctaattacatgcatgataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattaaatccaatagtcttaattgcattacaaatataacaatcatatatataattacgtcacttgcctgcgcgaattccttcgagggctagctaccactccggcttgagggacgacttcgacaacgtcttttctgcaggatacaaaaagatgtattaggataaacgcgaagtaacatatattgcatttgacgttcacgtttcgttcacgatcgttcacgttcgcgttctcgttaaggtcacgtttcattcacctacgttcgttcacgtacgttcgttcgttcacgttcattcacctacctatattgcatttcacgttcacgttcgttcacgttcatgtttcgttcacgttctcgttcacgttcgtttgttctttcacgttcaattctcgttcacgttcgttcgctcgttcgcgttctcgttcacgttcgttcggacgttcacgttctcgttcacgttcgttcgtggcggcggggcggcgcggcggcggcgtggcgccgcgcgcggcatcgacgtggcgcggcggcggcgtgcggcgcgcggcgcggtggcggcgtggcgcgcagcccggtggcggcgttgcgcggcggcggcatcgtggcgtctcgtacgtctcgtgtcgtgccgccgcggcgtcgtggcgcggcgtcgtgtcgtgacgacgtcggcgtcggcgtcggcaaccgagagggagagagagagagatcgagatcggagagagatagcgatgagagggaggcggcggcggctctcaccccagagatgcggcgcggcggtggaggaggcggaggcggcggcgacgacgacgagcgcgagacgacggcgagatatggggatgccctaggcagtggcggtgaaggagaagtcgagagagatcgatcgggcaaaaacttctaagtgttggtggagaagacgagggcgcgcatcaggaatatatatacccatagatctttagtcccggttgatgagaacaatctttactcccggttgttctcatcaaccgggactaaagatattttcccgctatttccaaattctttttaaacccggttaggattaagaaccgggactactgataagcgcactgaatattattttccattacatatgtgctcctaaaatagaaaataatgctttaaaattattaatgacaattacttcgaaaaattattgttgtctgtaatgaattaagtggataaaacgtaataagcaaatatatgatttaaaattaataaaaattctaataatcatatatacttagcatatgaatgatattaaattggtaaaaactctaattaacatatgtatatacatacggcatgatttaaaattaataaaaattgtaataatcatatatacttagcatatgaatgatattaaattaattgttaaaaactctaattaacatatgtaaatgccacatgcatgatgtaaaaattttgaaaattcgaatagtcatatataattagcatatgaatgatagtaaattaattgttaaaaactctaattaacatatgtaaatgctacatgcatgatttaaaacttttaaaaattcgaatagtcatatataattagcatatgaatgatagtaaattaattgttaaaaactctaattaacatatgtaaatgccacatgcatgatttaaaacttttaaaaattgtaagtatcgcatataactagcatatacatgattaaaacctctaataatcgtgcataattaacatatgccatacatcaattgatttatatggataatcaatacatccaaaatagtttacatcgtgtacacaataattacggcaatacatcggcggtgacagttgaccgcacgtactttttcctcactattgttccctccttgtgatcgctgcgtgagtaaggggtgtcttcatttgataggaggatgctagggtcaatcatcaccgtgaaagggggttgcccatccaactgatcgtaatcctcgtcagtcttgtcctcagctccgacgatttttcttttgactaggagaaccacatgacgcttaggctcgtcaggccctctgcccttctttcctttgctagacatatccttcacgtaaaagacttgcgttacatcattggcaaggacaaaaggttcgtccgagtatccaactttgtcaaggtcaaccgttgtcatcccactgtcatcaatcattacgcctccaccagtcaacctaaccgattggcaccggaacagagggaccttgagaggaccatagtcaagttcccatatgtcctcgatggcaccgtaatacgtgccagttgttccatcgtgtcccatggcatcgacacgaacagcgctgctttgattcgtgctcttcatgtcttgggctctcgtgtagaatgtgtacccattgatctcatatccctggaatgtcgcgatcgaccaggacggtcccctcgccaggaaggtaagttgttggttgatcgactcgttacccacgagatgttgtagtagccacgcggggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttacggaataaattgttgtctaccgtcattattgctttccttccgagagttccctttccctgtagtctcccttcatggcgtgattcaggtaccccgattgggcgaaggtcttcgataaattctacgcaaaattcgatgacctcctctgtttcataacccttggcgatgcttgcctctggacgagcacggttacgaacatacttcttcagaacgcccatgtacctctcgaaaggaaacatgttgtgtaggtacacaggcccgagaatactgatctctttgacaaggtgacaaagcaaatgcgtcattatattgaaaaatgaaggtagaaatatcaactcaaaactgacgagacattgcaccacatcattctaaagggcttctaatctatccggatcaatgaccttctacgaaattgcgttcatgaatgcacatagctttgttattgttgcccggacattgtctggaaggataccccttattacaactggtagcagttgtatcatcaacacgtgacagtcatgagactttaggtttgtgaacatcttttccttcgtggagtatccagacggcacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcggacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcagccttatgttcgaagtgcttgtctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggatagtttgctaagtgcaggccaatcgttgatggttacgaacagcagcgctcgtaggttaaacacctcctgtttgtcctcgtcccacacggggacaccttcctttttccacaacagtttaagatcttcgaccagtggtcttaggtacacatcgatgtcgttaccaggttgcttggggccttgaataataatcggcatcattatgtacttcctattcatgcatagccaggggggaggttgtatatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcctgtcctattgacgctcttcaacatgccatcgcatcattctagcattccccttgttcctgaacaaacgccttagccgtggtattatagggaaataccacatcaccttagtaggaattctcttctttgttagctgcccgtcaacttctcctggatcgtctcgtctaatcttgtatcgtagtgctttgcaaacagggcatgcttctaggttctcatactcctcaccgcgatataggatacaatcattcggacatatgtgaatcttctgaacttccagtcctagcgggcagactatcttcttagcctcgtacattgtctcgagcaatttgtttccctctggaagaatgttcttgacgagtttcaataaatcgccaaatgtcttgtcactaaccccattttttgccttccattgcaagaactccagagtggtatccaactttttgtgcccctactcgcaacctgggtacaacgacgttctgtggtcctctaacatcttgtccaatttatgggcccccttttcactttcgcagtcctccttggcgtcctgcaacatctgaccgagatcatccgcaacgtcgttaccatcagcatccctttcctcctcgcctgtttgatttccttcaaatccaacgtactgagcaaagtccggaatattgtcgtcttccacttcatcttcttccatttcaacaccttgctctctgtgggatgtccaacaattatagcttggcatgaaccccgactcaaacaagtggaaatgaatagtcctggatgcagaatacttcttctgattcttagacttattgcatggacaacgaataaaacccctttgcccgttagcttcggccactctcaaaaaatagtgcacgccgtcaatgaactctttggaccgccggtcagcgtacatccattgccgagtgtacatccattgccgatccatctacatgagtcaaaaaaaatcatacacaaataattattcttacaataatgacagtcatacaataattataagataattacaaactctttccacagtcatacaataatgacatatctttattcatacaaaaatcataaaatattacaccaaataattcttatttactatttctaaagttttaaactaattttaatgtgttttacttcttttaattttcattttagtttgttttctattatttaagattaactttcactatattttctttctcaactattttataaaaccttctttagcaaatcaactaaatttctatatattctttcttccccacacaaattttctctctcatcaacttacaactaaattttggagacaaaaaagtgtgcaaaacatagctgcaaatgtaatatgacaaaaaaaaaacactggaggatgaagttgcaaaccttttaggcacctccgatttgtatgtaatcaccaaaataaattcactagaaattttggcgtgacctcccctcttttttgaagaaattttgaaacttgctcgggcagctggaggagaaagaagacatatatataggggtgggactttagtcccggttggtgttaccaaccggggctaaagatccccgagctctttagtcccggttggtaagttacgatctttagtctcggttggtgttactaaccgggactaaagatcccggggggcctgacaggccctgacagcatttgaaccgggactaaagatcaagttttagtcccggttaaaaagggtaacgggcatatttgatctttagacccggcatatttgatcaaccgggactaaagatcatctttagccctggtttttattgtatccgggactattgtggaattcggccgaccgacgaaagatggtttctccaccagtgcttttagataaatatgtggtcatcctgcagatatttacatgttttttaatgtaaatgaatattattgtcatctcatatttactgagcttgaactttcatctcttgttaatttgatatatataacaatgcatggacaaactcatgcagttcacttgaacttttagagaaatgaatggattactgtgcagcccgtcaattatattggtttttgtttatttgtaattttggctcttataaatatcgtatactaaaaaataaattccgtgaatgttaatggacttgcactggctcttattatattcatacataatgatgaaatgcactttacattgatggagtaatagaattacatattctggcacataatgataatttcactggaaaaatatgtaactattgatgtgccagatgtaaccgagtggaataattaacgcagcacaactatacacaaattttataaaaatatcaagaaacatcaactggtatatagaaactttttatgtagaataatgtttcctagctctacaattatcgaacaacagagaaaagtaattatattgagataaactaaaataccaagcctaatatgtcttcagttacctactagcaaacttacataagaactttttgtatcagagaagggtatttttttacccagcctctatatcgccaatcgaatatatgcagccttttaaattggaaacttagccctttaaaaccacttggctacatacccttttgcaagcacataattgattgcttatgattaggaagctacaagaattatatttgaaacagattcccttgtggtggttagcaaacaatttgataggtcaatccatactacattgaatcaagatttgaagttcaaattagttggttaatttccaagagatgaagttttgttgggtacgtcgaacggcgaacacggtacagcacacatgctagccattagcgaaggtgtgtagcgaaggagagtatttcttctcgtgttgctttacaacctgtgtttatatgttcctgcaggctttattttacctttccttgataatgattgtaagcaagattatatgtagtggaataaatctccattaatttttaccaaaaaaaaacaagtgcaaacctcgttctacgatatttttctctttttccttttgagaactctgattctttcttgacttgtcgaaccatacaatgtatataagaccagaaaaaagaaccaatatctacaacctacagtagatcactatcatcgtaccctggcaaagagaaaaaaaaagtcactgtctacacatattatttctttagtttttgaagtaatttcatttgtcaactcaaatttactgaccacttcaaaattccacaccttgtaagttgttatacataataacgactctaggtcgtttatctattttggccctttaattagttatatatcccatattatgctcaaagtttgtccgcaaatgttaatggaataatattgattttgcagtcgtcatgaataaatggacattggatgcaggaatctatcgggatatcgtcattgcgtgcacttcgaggcaaaacccttgtagattccctctatatatagctttaataattctttctatgatgtatggtttttattattaaccttttacgtggtcaattatctaaaagaactgttaagtgttcaatgtacatatactattgtgagtattgtcagttcaattgcagttgacacggaataattacatgataattaccatgcatgcaaattaattgaattataggctaatggaattgttccggccggtgggtattctagcacatggataactcaagcagatgaaatatattgatgtgttatacccactggaataattaacgcggcacaaaatgtaactagcctctctgctatgacaaactactgagtttaagaaaaaaaaaaagaggaagaaaaaagagaaagaccggtctactggaaacttgccttagttaatttgggccgttgtttcacacattcgttttctttccgttttcctagtgaagactgggctgtgactgtgagcgatatacttcgacaggtcggactaagttcacattaggtcctcaatttgtcttccagccatttcatgcttgaaccaaaaaaccagatataacccgtcctccaacttacaaaccggtgtaaacaagatcgcttagcagtattatctccagttttagctaattacgtgtctcctatgacttggtcttcgtcccacgtgatattgacataacatttacacaacaatttgatcccaaaaatagaaaggacactacttaaaaaggaattttccgtgagatcaaaaatggttttcacgtgcgggtgggccaactgcacgcacccaagtgtctacaaaaattgctatttttgcgtatgggtgggccaaccgcatgcacccaagtgtctacaaaaatcgctatttttgcgtacttaactctgacgcgatctctttttctctacctctccatatcttcttcgccgtcgtcctccctctcctcttgatccccctcctcccctccctctctgcgaagccgatgacagctgcgatgaaaacgacggcgggcggcggcgccctcccgtccgctgggagggaaggcggcacgcagcggcgcacgagggggaggcggcagacggcggccacgcagtcgtgctgatgcggcccggcgaagcagtggcgccccggcgaggccatgcgacggcgggggtgcggctcgcgcccatgtggcagctatgctttgctagacggcggaggagctcgtcctggcggcggcgtggctcagccgggcggcggcggcgcgcccgtgcggtggtgaggtggccacgtaatggcgcggtggagcgcggcgcggcgaggccgacggccggcgggggtggacggccatgcagtggctgcacgctcccccctttttttttgttctttttttaatggttttctgttgggttagtcccacattgttaattgatgatgggggagcacgaattaaaaggttgttacagttctcatccatcagactgtcttttggattgtgtaggcccaggacctaaacttgtgcctccggttgggtctgtggaccagacgcctacggttggtggaacaggctgcgcactctaacattttcttcctcttctgttgactatcccgggatggtgtgaagccttcctatcatttttcttctttttttcttcattctattccttgtctctcttgtccgagtactgctgccatggcatgggtgttgctgccatcattcgatgtacgatgttcgatttgtaaatttgtggatgattttgttgatgattatgttcatttgatctgtgatatgtcaatttgatgtggggatttaatttgatttaggaatgtcaggagcaacttgacgtgggatgcaagcagcaaataagaataaaaaaagaaaaaaaagtattgttaacaccaaccgaaattaaagataatagtaccaagtggttggtgctaccatctttaatcccggttagtgttatcaaccgaaactaaagatatttcaaccgagactaaggatacccagctttagtcctgaattggatgtctgggttgcatacccaaaactaaaggggttaccaatcagaactaaagatgggttccccactagtgaaaataggtatggtcagtgaaagcaaaaattcaacagtgacatgttacacaaaagagcacccaaatacactaaaaacacatatatttatgtaaaagcaatctggtataaatagaatggttccatgttatttaattaccttggatttatcctaaatatttggtgtattcctgccaccaaaaagtgtgttaccgtacaacaaagtgtgcatggtatgaatatgatgcatattgatgcctaatctaacaataaggaaatgtgaatcctccgtgtcactactacaaaacactagtaggtactagctcatttaaccgtttccacattggataaaaaatatataaaaccagcacatttaagcagctataggtgccgatatggcattaataatataggtgacactttttagaaaaccggtacctatatttatatgatatggcattaataatataggtgacactttttagaaaaccggtacctatatttatattataggtgccgattctttaaaagattgacaactttatgaaactaagctgagctgtcacgggtgagactccttttaaccccaccaaccttatcgtctctcgcactctcccatcgcccccatcccctcctctctcggcctgtcgctgccgcccatccactccagctcacttctgcgtgcatcgtcgccgccgtcccaatcctcacaaccttcaccactgcaccgcccatcatcctctcttcccacttcctccacctttcctgcaactgtggcaactcccatccactctcaccgcatccccctactaactacttaagcttaacatgcaaagatgtcacatcattattcactaacaagatgccacatcatcatccactaattaacaagatgtcacatcatcatccactaacaatcatcacatttaaacatcatgcaaacatgctatatctttatagttttttataatttaagagcttttcaaacacagacatgttaaattattatccaacataattcacataatgtttcaatgtatatcttcatactaaattcccgcagcaatgcgcagggtttcacctagtatttatattataggtgccgattctttaaaagattgacaactttatgaaactgagctgagctgtcacgggtgagactccttttaaccccaccaaccttatcgtctctcgcactctcccatcgcccccatcccctcctctctcggcctgttgctgccgcccatccactccagctcacttctgcgtgcatcgtcgccgccgtcccaatcctcacaaccttcaccactagcaccgcccatcatcctctcttcccacttcctccacctttcctgcagctgtggcaactcccatccactctcaccgcatccaatggatcggcggcgatgacctcagtgtggagatggtgacgacgcacgcatgcatggagatcacgctgctctcgccggtgggaggtgattgggggtggggtcaccggggatgacgcataggcgatcgtgataaacgggaagatggcaaatgtgacggtgctggtggtgaatgatgcggcagcgggaaggttgtgagttcttgatcttttttttattttatttaagatgagttttttatcctacttgtgtagtttttgatgttgtgtagttcttcatcttgctggtgttgctttgttactgatgggaaataataattgaatatttctatctgtgatgtgaatggagattattgatgctaaatcaatatagagttcttgatctgtacatattgtgtatggggattaaaggcggcttgaagaaggtagttggatgcatcggttcattgagccgatgcttctagtctgtctctgttttttttaattgtgggaagtacaaaaggtgttggttctaccaccagcaccaaataaccattggtcattggtactagtagataaatggtgccagttgcaaaaccgatttttttgtcaggtttgcaacccgacaccttttcggtactatgtattagtgtgtgccaatcagtcacaactacacaactatgattcatacttgagtcataagatatttgggcagaacacaataagttaaacaacgatatatttaaccagttctcagtagcaaccgcatgcaaatatatacacacacacatatacacatgcacacgcattattttacacccaaggatatacaagtccatgccaattggaggaaatcaacaaaagcacaaattaactagaaaaaaaaaaactagaacaaaacaatccaatgcacaccgattaagttcttgttttagtttagctctgaatgctaaataaatctgcaagcccctggagggataaagccaccctagcgttgtctcccttgttggcagtcgggtctccgaaaatcaccgatatgatgatgcgcacgacacccccgacaacaatgcggtcttgttccgacgaaatgctcttgagggggccctccttcatcatgagctccttgctcgccagcatgatctggcctccgtgtttcttctcgcggcccgcctgccatctcttcccggcgaggtgcttgacgcaggccacgtgcaggtacacgccctcgccgttgatgttggtgtggtagcaccacagctcacggtccggccctttctccttcttgcacaggctgcacttcctgggtgcccggacatcgaagtcgtggccgtcaagggtgatgggcccctgcaggctcgcgcagcacgggtggaggttcaggttggtgccggagcagtggtagacgaagccgcgcacggagcagtgatagacaaactttacaaacttcaattgtaccaaatttagactccttctaaattcgactccgcatcctatacgcacacaatatctccatcatatgccatatagaatcttcaccaaccacatgcattgatgtttagcctaagcacgccgtatgatatcctgatcattcggacgtcatcttctcccaagttgactcctgattcatcatcggcaacattctctcgaggcattaagatcacctacacatgcatcaaccaagaaaccatattctgagcacaagctatctccaacttgactcattgttagtaaacaacagtattacatacgcatagtatccatctagaagtcataaacataaattatccacggatatccaacaaaacaacccgaaaccaaaactgacacataaattatccactgatatccaacaaaataacccgaaaccgaaactgacacagagtaagccgatcagaccgcgggctggccggtctgaccgcacacatagctccgatctgaccggcagcacctgcctggtctgaccggttatcacctgtcagcaatatctcttgttcacctgcaaattcaatcatctccaaaaccactccaataatcctcaaatattaaaaccaataatctcatatgtcaattgttcatcacagaataagaatcaaacaaactttgatttaatctcccccttgatgagcacattggcaaactcatcaaaaatgttttagtgtttggaaaaataaaaacaaaagtggtaaaaagcatcggagtactcaaaaatccagaagaaaacttctttcgttttcctttacctgaaaaacatgcacttgtatctcttctccccttttgataatgatttcatcaagcatagtaattatgtttattaatattcaagagcttagcattatatatatatatatatatatatatatatatagcacatcatatcatgtgttgcaataaaaagaaaatgaacccatccaatatataacaagcatataccaaagtataatcatgaaccaaagattttacaattaagttcaaatcaccaatcaaaattcatgatttcatacaatttataatgcaacatgtttacaagcacataggttgaaaaataaaccctatacatatatacctattacatttatcactctttatcaaattatttaatcagtactcagtagcaaactgcatgccaatatatatacacacacgaattattttacaccgaaggaaataaaagtccttgccaattccaggaaataaacaaaagtacaaacaaaacaagccaatgcacaccgataggtcttttgttcttttcaaggagagtgatcacacaccagtttagctctgaatgctaaataaatctgccagcccctggagggataaagcgaccctagcgttgtctcccttgtgcagtcgggtctccaaatatcactgagatgatgatgcgcatgacgccaccaacaataatgcggtctttttccgatgaaatgctcttgaggggaccctccatcatgagctcctcgcttgccagcatgatctgccctccatatttcttttcacggcctgcctgccatctccttccggcgaagtgcttgatgcaagctacgtggagatacacaccctcgccattgatgttggagtgatagcaccacagatcgcgttctgggcccttttcctgcatgcaaaggcagcacttccttggtgccccgatgtcgaaggcaagcccgtcgaggatgatcggcccgtgcaggctggcgcagcacgggtggaggtcgaggttggcgccgaagcagtggtagatgaacccgcgcacgggatcgccgcaggcgtcacagaccctgcggcccgagggaggcagaggcttgggacaaaacctgaatatgcggcctttgtacatagggtgctgtagaatggccggcagaggttggagcagaacgtgtgcatgtcaaagttgcaggcgtcgcagcggtatctgggagcgtatcctggctccaagcagccgtcacagcggaacggcatgtcacaagtcgtggtcaccaggcgaagcttgtgctgcgggtggtcgtggtgggtgatcatctctggctctgccacaggttcctcctccggtgctataaaacatgtgtgatgcagttagcactatatgccagtgtatatattcgtaaccaaagcatatatatctcgtagttaattaatccagttaagtatttatcttacgttaatcctagcttgtttatctatttggattatgcggagcaagttgtttgcgtttaaatctaactctatcctaatttcatcactaatatattaatgccattacctcgtgagagataataattgatatttcacccatccgttttcatagccaaaacccattgtcaaagttggataccttctcttctctcccaaaagggatgaaaacttttaaagctaactctaccgtaatgtgatcctcatatattaatgccattacctcatgagacaccctttgagatataacatttcaacaatcagcttgcctatccaaaactctttgttaaagttgcgtaccttctcttttctccaaacaggggtgacttcagttctaccccctccatcaaaaagtcaagacatatttcactttctggttttctaaatgagatggacatatttgtagttttgatgcgctaaattaaattgttgactagaacccaagcagtcatcttaatactcattggttgcatgcatacatatagttccttggttttatcacatggtagatgagttattccccccttggtcttggtgaaaaaaaactgccttagacttttggatggaaggagtactacatatctgcctagcttatttcacatggccactcatcagcaggcttctcatataacttttggctttccaaaaggtcaattaatttatcgatttcaaaaagatgtgctgcacatgatttcaattggaaagcttacaattatctgtacacacgtaattcccaaaatttaggcgtgtatgactagcattaccttttaccccaaacaaagtttgcccaaagtaagggttggaatagataaaaatgacaatgaggtgtattaccttgacctggtgagaacaaaggctccgtcaccgtttgagacctattaagagcaacaattcaacttagatgtacaaataagacagattagtgcaccagttctcaagctgtgtatccgcatatggccaacacatcaattttttttttttactgtgaagcatccctttcttattatgcttaaaattttctagtatagaattttaaataaattttgcgggttcaattttcgttttattttactattcatttaaaatgtccatttcattcactctaacaatttgattgggtcacttaaacccctaaacaatttttagctcatgttacaactgaaactattaactatggttcattatactgcttaatactcttttttccagattcatagtactaagttgtgtctaatacagtactatgtcactatattttgagatggggggtacattttttatcttttttttattttttacaagtcttattttaagctaaaattttttaaagccatagatggcatcattatctaagttccataatattttcaatttttttcatgattgtttgcttgaacatttaaattttgatgtttaagttagttttaggtgcttccaaccttgtaaacaatgatgaaagttctaaagaaaatgctgaggtaagacgtaatgcatctatcagtcctatcaaattcaatgcaaaataccatttatatatataggtcgagagaatctacaaagtaccactgagttcaacacacttcaacaataagccaccgaatttgttgatatccataatatgccatcgcattatccttaacctctatgatttgccatcgtcgcgccgtttgtattgttaattttcttagttatgaccaaaataccctttgaatcatctaaccctagcatggcccagggccccttttttcccagcatcgcatctcccagcgccgcatcaccacccttcccagtgccgccacagcgccacgcctcgccaacgtcgccatccctagcgccgacccgaccttcgggacccagtgccaccatccgtagcacaagtcagcggtggtctagccaccatcgtcacatccgacgggagacggcgcccctgttggagggctgctggtggtgctgccatcgtcatcagcgttgccgtcgcaaacaaggggacacgacgtcgacgcccctgctggagctactgctggtgccgccgccgtcgtcagtgccggcattgcatgcaaggggacatggtggccctggccctgttggagagctactactgtcgtcagtgcaatccctcaaccgctcctcaacagtcacggcaaatcaaagctctaccccctcctgtagccttggagatatttgttcataatcaaaatacttaaaatatgtgctcataattatttataatcatgctgcttaaataaagatatttttcatatgtttagtaccgttgtatgttctctttatagttattataactctcggtaccttgcacggtatggtctcagtgctgctgatcttcactaagggcatacttgtcttttctccaacgcaaactaacaggctgtagatggcgatggtaaatcgtagaggttaaggaaaaggcgatggcatattattgatatcaacaaagtcagtggcatattgttgaagtgtatcgaactcagtggtactgagtagattctcttatcatctatagtgaaatgttttcaatagttttatgatgtaaaatgactgaaaaatagtttacggggttaaatcctccggctaaatagttcgagggagtaaaatgatttttttcttattaattgcaaacttgtacatatatagtttttagtgaagtggtatactcaagagaacgtgatgaggaacatcacctgaccaattcataaagtataggtgttacaagtagaattggattttctctactaagaacaagaagtcaaaatttgagttttgaatctatagtacatacttcatgaaaactcaagaataattatgatattgcatatgtcattatatcactagaaaatacttgtatgtccaatgagttgtgttctaagtgtcattgagtaatagatgagttgttttgagtagcatcctagttgtcaattaggatgtcatcaggttgtcatatagttgtatcgagttgtagatggctttgtagcctttaaatagaggcaatggcctctagtttggaacttacttttgcttaccaccttatcaatagaactagatgttcctattacagaacatggattagatcttctttggagctttggactaagctcttgttgtccgtggattcgggctgccttagggcattatctactacttcctccgtttcaaaatgtaagactttctagcattgaccacattcacatagatattaaatatgtctagattcattaacatctatatgaatgtgggcaatgctagaatgtcttacaatatgaaacggagggagtaccacattaaagtcgttcctacaacattttgtgctatatctacatatcagcacaccgaagaagttcctccgataattgtgctacatcaacgtataatttccatccctaaactcttaaactattcggttagtctagttgccatccctcatctttgaaaccaggtaaactatgtcctcaaactatcaaaaccgaacacctttaatccctcgagctggtttgaggttattttgagtccacatggcaactaaggtgatacaattgatgacaaggacttcgtatgaaaggatcaaattttgatttggatttcgtatgaaatctcaatatccaaccaagtggatttcttggatcgagtcttttgttttgggtggaaatgtatcaatagaagtgaatgatgacatcagacatttcctccaaacaaaaaagggccttcgacaaggtgatcctctttcgccaatgttttttaatattgtagctaatatgctggtcactctaatcaattgagccaaagtagatggacaaatttgtggagtagtccctcatctagtggatgatggcatttccattctacaatacgctgacgataccattcgttttatgaagcatgaccttgagaaggctcgtaacatgaagcttttgctttgtgcttttgagcatctctcaggtctcaagattaacttccataagagtgaattgttctattttggtgatgctcgaaccatggaagaccaatataccaaactctttggttgttcttctggcgaattcccgttatgctactttcctattcattataggaaactaagaaataatgattggaaatgggtagaagaacgctatgagaagagacttggtagctggaaagggaaactactttccacgggaagacgtttaacattgataaactcagtgcttagtagtcttcccctgtatatgatgtttttcttcgcaatatcgagaggtgtactcaagaaactttattgttttcgctctagattctattggcagtgtgatgatcaaaagaaaaagtgtcatttgatgaagtggagtattatgtgccgacccaaagaacaaaggggatttaggaattcatgatttatatatgaaaaacattgcccttcctagcaagtggttatttaagctactcacgatggatggtgtatggcaacaattgattcgtaacaagtacttgggctcaaaacctatgtcacaagtcgagtggaaagctagggactcatacttctaggccagccttatgaaggtcaagcgtgattttctacgttttggcaaattcattatgagagaagcaccactgtgagaacaatacccttgcctatacaataaacaggatactatagcaaatgtgctacaaaactaccctccgaatgtatcttggcgaagggatcttattgagccaaaattagtggcatggaataaccatgttccacgaatggcaaatctagcgcttactcaggaccgagataagttccactagaatttaatccagaatggagagttttcagttaagtcacattatcttgccttggtacattcagatgtgcccaacataaataaagtaatttggaaagtaaaaataccacttaaagtcatgatcttcctaaggtatttacgtcgtgggatagttttgacaagggctaacctggccaagcgcaattggcaaggaagtaagaattgttccttttgtcacacagatgagacaatattacatttgttttatgaatgcagatttgcccgttttgtgtggtgcactatacaagtggctacagggcttttcccgcctcgtggtgtatccaatatgtctggtaattggctacggggaattaggaaagaccttaagtcgcttatcctgttaagggtaaccactatttgttggtcattatggttttgcgggaatgatatgacatctcttctcctttataggttattttttaaactatccacttccttcgtacatgggctatccttcagaagcctgattcacaagatttggttgcagcggcatgtcaacgcttggagtaggtggtcagggagtgttttactcaaggacatggatggcggtctaggctgaagattggtgctccctagattttactactttccttcacttgttacaaactcttttgtgggtgtgtgtgtgttttggctatgtgcatcctagttatgcagaggccgggagttttttttagtatggttctatcagcttgatgtaatcgactgagattaataaaagcttcctttaccaaaaaaaatgatgacatggatgaaacagctaacagttacctctcttctctaactattcctttccctcactcccaaaattccccattgtgagctcaccagcagcgatgggcacacaatccaacatgcatgtgagagtagtactggtgtggcgactcctgcgccctgtcttcttccagcagctgctgaagtggcaccatggctgcctgccaatttgctagtatacaccatcggaatctgtcttcaactgtcccattggtgagactgctgcccacctttcccgctgctatgatcagttcagttcaattttgactcaatattttgtttgctttgcagctacactagatatctattttcatcttattcttcttctgggtctgacattcactttacaagtttgcatcacctttctatgcacgttagcaaaatactggaattctcactgaaagcagtacgtgctggcatacatggccaataaggatgatgaggccaccaagtagatattcagccgattcctgctcagttgtctttcatgttaatcgtggctgctccttcataaaaagaaaaagctctggtgcaggcaccaggatggattgcacgtaggtgtatgctgtggttggccactttgctgacaccagcggagaggctacagacctgcaactgaactcatcattttccaggacctcatgccggctctgacgaatagtggctatgactcatgaacctttttaccaacacccaaatatgaaagggaagggagaaaagatgataagggccctaatgtggggctagctctatgatgtggaggacggctgggcgcgcaaagtcgatgacatgtcacacccaaaaccagccaagggacataacttgtctagtttgcatagttgagggaatagttttacctggtttataaattgagcgacgaaaactagaccaacaagataattgagagacaataactaggctttttcctacacgaaataatagtttcaatctaattatatgctagactcaaacttgtttatacatactaggtattatgatctttctttattctgctttcaaaatgcacatgtcaaattgtcaactgtatgataagagaactgcaaaggccacaatcaacataacagaacaactaagcaaacccacattgagtttgtcttggcgatctttactctaaagccagataaagttatccaaacagacgtcagaataaatattcttgagcagatgggtggtccaagtcagattggagtggtgatccgaggcagtttgttatgtaatctgatggataagttgggtagctgggtaatcgtaggtcgaccaattttagagttatatacaaacactagaaccccatcaaggtacaaaatggctgttacaggcaaaactatggtattgtagtttgagtagaatagtaattcttagcatgtggattcttgttattggagtataactatatggccaaccgatgtaaccctcaggcctcaatatatcatcaaataaattcttaagaggccggagtcaccttacttggctccgagggacatagacataacaaatatcgaatctcatcaacaatggcctgctctcttgcattatcgacttttaagtatttctaaggccctgtttgcttcagcttaagattattgtaatctagattattaaattagattattctaacctagattataataagctaacatagaataagctgcgagttgtttgtttctctgaattattagagacatctaagggtagtgggtctttagccactcaataatctagaaaaagctcctctactcctctagaggagattattggattatactaatctggcttatagattataacaatctagcataataatctacttgtttgtttcagcttactcctaataatccagattataataatcctaagctgaatcaaacagggcctaagtcaattccagggatctatgtgttctgaatttcttgtcagctggtgtcacccaaattacaacaatcccatctaaaaaagaaaaatgtttatgagtcaatagatgaacgcatgtttggctgagttcaaatttttgtgagggtgaaatttttgtttagattaagttgtttcaatgtcaaattttaagtgataattgttcttgagttgaactaatgttggttcatggtaaattgaaaataaacctgtgggagtgcaaagtaattactagagtattagggttaagaaataaagtgaacaacccgcagcggtggaaagtggctgcgatgagcgtggaccattagctctggaattgaccaactgtgcaatagcagttgtatttgatggtggccgttctttagtaatgaaatcaactatatattacctggtatcggtttctttcttccggagttcctcccgtccatgctctagaacattacatacttcatccttgtgctgaaactcctctgtaatttcatcttgtctcagtggcgtacgatcaccatcctccgcactgaaacaggtgtaataatagtcgtatactaactggacgaagtagaacaaaaatttggatggttttttgtgatcgctagttatgaactgatacctgctgacaactaattggtcggatgtatcttcgcctaaaacctctgttggcgtccactgtgattcacccattaggatctcatacagtttagttagggtttcatgtgattttgatgccaagtcttttaaacacgccatatgcacgttaatgtcctggccttcctgactggagcggtaggaccaaaacttgttgcgataaccctccttgccacacatgcaaatgcaacatctgctgcaagccgacaccctgcgaagctccatgacatagccctttacgtttgcagtgcgaacaggcagcctcgcacagcgtgggtggaggtcgaggccacgctcaaagcagtggtagacgaagccgtgcatgaggtcaccacatgcatcacaggccctaccgcattcagaggccagaggctttcggaggaaccgaaaaacggagcctgggaacagagggtgtttcagggtgtgaggcgctgttgcgcagcacatatcatagtacaccttggagttgcattgctcgcacttgaacctgtggccggcaccaagctccttgcagccatcgcactgggtaggccaggacctgacactcttatccagcctcagattttcatgcatatgatccgtgtgaggggtggggacaatcggaagatctgtgccaaagcccgaagaattagcacaccagatgaccatataaagatctaatacagtatcttttctttataatggctaattgaaggttttttcttaaaatcccatataaacagttaacactaagaggtgaaaggtttctcatattaataggtcacaaaatatctaacaaaagctcccacttagtctgaaaatgaaggtgtcttaatgttcaagtttttcgatgcttgtgacctaaagctcagatttgcatatggtatgttcgcttttctcccattcttgcctttactaaataaatgctactccctttgtttcaggttataagacattttgactttggacaaagtcaaactgtttcaagtttgactaagtttgtagaaaaaaataacaacattttcaacccaagacaaatttattataaaaatatattcaattattgatttaatgaaactaatttggtattataaatattactatatttctgtataaacttagtcaaacttgaactagtttgactttgaccaaagtcaaaccatcttataacctggaacggagggagtaccagaataaaatattattttctccatcattcagaatatattgaacattatgtgtcatccaatgtgctaccaatgaagggcaaccaaaccgtttcacctatactcttaatcctcgagcttgtctaaaatgattagtatttagaatcaggtagaagaataactaggcaatcaaatctgtaagtataggataattctagaactgaatatccataaggccataaccatgatgggcaagcacgatattagaacatcatatcccacagccagaaggtgataaagtataagcttggaaggaattagtttctaagctcatgaatattaaactgacacatgaaatcgacacttttagatgaacttacatcagaaaaaggaattttctgttcattcaaatatcaagccttattttctggtgcttacaacgtgggtttgtatatagcacaggattagctttgctaagagaaattaacgacacagctagaaatgttttttaatgacaatgagactattcaacatttgttttttcattgccatacagcacactgtgtggcgtgaggtacatgcagcttttaatttggatccagccactagtattgtccaatttattcggaaattgattagttggtttggactaaaagttaaaataagccggtgtacgttggtgcggccaaccggttattatctattggattacgtcataaggatattgtttttagaaaaagaagtccattttactcccccccccccaaactatttcattggaccactaaacccctaaactatttttcggctcattttaccacctaaactattaaaaatggttcaccttactcctttataacatttctctttttttttcctttttatataagttgtattttaggctgaatttttttagagccatccctgataccattatcaaacttcaaaaaaaaaattaagttttttcttgactgttggcttgaactttaaaatctccacatttaaatcagtcttagctgtttccgacttatgtaaagagtggggaaaaatctaaaaaatgttgagacgtgtaacagcccgccctacaaaaccgtgtttataagttggttccaaccttgctacactaccgcagttgatactaaacatgcgcacacagctctcatgtaccacacaggcctaatcctgattggaccggaatgtcacaagacatatgttgtaatgcatctatcgttctaccaaaatttcaatgcaaaatatgacttatatagagagaaacgaaaaggaacaatgggcctcaacttttcgcttatgcttatacttatcagccaaaatttgaatttttaatcttaaatttggagctaattttgaggttttttcatcaaagtttatttttcagcctttgcttttagatcgcttagaacacgtatataaaagttttatttacaaataatttttcgtttgtaaatatgccgtttcacttattccgcgaataagcgaaacgatggctcctaatatcgttagggagtaaagtgaaccatttttaatatttccaggtgtaaaatgagccaaaacaaaattagggggttaaatggtccaatgaaatagttcggacagtaaaatgtacttatttttcttctataaaaggaattatcctaatcttacatctttatgggctccaactggctatggtttggtctcttcagcgtgaggagttgcatgatctggtatttgatgcaggcaacaccttggagcgtagtcacagaacttttcaaccatattggatggtggtttaataacagctagcctatgtatcttttttttttttagttaactagcctgtcgaatacttcttttatcattttaatgaactttcacacacgcttgtaataatgtggctgtgtacaccttctggttgctgcttccattatctttgcaacagtaccatctctacaatgtcactgatctgatcattgggcctcttttatataataaaatcagtatgatgtgtacaaaagaattacgtagtaggatatgggatatccactgctgttgatcgacctaactaaagacattatactacagcaggtagtaggatgttttgattggtaaaacaaaaatgaaatggatgattgcaggtcaaatttgcatgtccaaatggcatactaaaatagatatgtggttcaaatgattaccctagttaaattctcaaataaaatattttgaatagcgaaaaaatcgaccatgtgcatctcgtccaaattccaatgttaaggcaaggagtgtatcttgcgcaaataaacacagaaaagagggcatgtttattgttacagtagggtatgtaaattcgtaccttttataaccctgttgatgaaccgtatgattacacttgatattcttgtattttgcctgatggcattgttcagtacagaggctatagccattctgttagcttcactagtaccggcaatgcaaatttttgcgctgaccttgacacctgacaagtgcttgaagcccacattttcaaggttgtattgctccactgtgctaccattgaattccatctttaacctttggaggttgggcatagctccttcatcaaatctcagacttgatacagtactacacttgaatttgaagtacttcaaaacatggaatcctgacttgtcaaatatgataggttctgcaggggttgtccggacatacagtgagaaaacagtgagggcattcagcattgagagagtctcaatgtctttcctcaggagttccatgactgctactttcaaaatacagagtttctcaatagttatgatccaactgggaagtctatggaagacgcaaacacgtggaaacaactcaagcctctgcagaaggctacaaggggggggaactttatctaagaaatccaagaaaatggcaatgcttgaattttcgttatcattagaatcttcagagaagcagacaggaacaactgttagagatttgaggctcttaagtatcccaataattgaacccaacagtttcatgttgtgcttaatatggtcagaagtggctatctgaggacatgcgagttgaagatcctgcaaattggtcagttcttcaatactctgtacactccctgcgtcaacaaagtaccctagattgggtggaagtctgaagtgcagcaacggcggaagatgaacaacttctgatctcaaaaaggtcaccattgcaccaatatgcagagtcctgagatacttcagtccttggagctctgatggtaagtctatgcaaacattaccttcaatctgcaaataagtcagtagaaacagttcacgaattctagtgaggtcaagaaattcgccatgtttaccatgaaggaatagaactcgaagaagatgaaactccgaaatggaaggcccgcacttccaaaatccagaaaacacaagtgatcgtagttgtgacaatctaatacatgctggtgcctttgcatcttttgaatatccgaaatggagagagagtcgtcgaactttgtctgctagtctataccagactgagaatgatcaattgcagtgacaaaattctcttccattgccttgcgtttgataaagttaagaaccatgtcatgcactgtgcaagatacaacctcatcactacagctgatatgttcagtttcaagtattcccctatggacaagctcataaaaatgattccttgcagcttcatccaaacttttcccttccgtcgcacttacaaaatcttcagctacccattgcttaaccagatcgtccggattgattatgtgatcctctttatatatactcagatacagcatgcatgctttcaaatgatgaggaagattgttgaagctattgttcagtagttgtgccattccttcggaagtaggttgtatcctcaaatctggaatcaacgacttctgtacatagatccattcatctggtttgtctggccgactcaataaaagactggctgcagcgatagttgctagtggcaaaccgccacattttcgtgctatctcatatgaaacttcattgagttcttcaggacatttgtctttatcaccaaaaactctactaacaagtaaatctcttgagaaatcgtcattaagcggttccatcttcaaaatatgcttcttgatcacgtgagatgcattatgttgagacttgtaaaaactccatgcctgagccacatcgttaatttctgttgttactactattctactacagcaatcctcttgtaaagcatgtctaacaacattccatgttgatacagtccacacattatcaagtacaatgaggcacctgccaagtagcgcatggtgtttatgttatatgaattcaactagaagatattgacaggttctccctgagtagaaatatgattgtaacatatagagaagaaacgccgttggtgtagaaataaataattgtacttcaaactctcaatttttttcatctatcccattaggctcaattgcaaaggggcatttaactatttgccacttttagaaatgcaaatttctaccgtttcttcgctgaatttcggaaaattttacctttgattacaggaagccaaggcttgaccttgccgccgccaagggcccgacctcgacgtgctcctccagtaaccgccaccgggcgtgctcgttctcgtcgcactttcccagccacagcccgaccccgacgtcgcaggactcgatctcaccgccctccccacgccgccgccgccggggggtccaagctcgcgacgctacccagccgctgccgtccgtcccgccgagacgaagcccgcagccccgcaccaccggccgctgctgcctccgcgtgttgtgaagtgacagggagagagcaacatgattcgcggccgcgggcggggagatgtcggcggggaacacgccggttggggccccccactccccccatgcggccggctcggcttcttcgccaccggacttttccgggcggcggatggctcctcggatgacttcacttggcggaaggcctcgtcgcctcctccccctttggcgttagggatgcctaccgaggcctcctcctcctcaggctctttcccctcttctctcccttcctcctctctctaccaccgaacctagctgctccggccgccggcgacgatgactgcggcggtgtcgtaccagtcggcggggaggggaggggagggacgccttcgcggcgtcgggtccgccaccacgcggcgcgggtgggccgcggcggattgctccggcccatcgaagcacgccggtcgacgggtgcataccgctgtcggcccgtgcgggaggcggcggcgtggaggcttatgggaggcggagcgactgcgaggccggaggggagcatggtgcacggtggattggtggtgtgtgacgccccgcaataattacggaaaaaaacgaaatttcttccaatcggtcgcttgggggaaggtagccgaaatcaggcgctccctcgccccaagatgcacgcccctctaggcctcactcacgtgtcccctgctcccaatcatttgtccacacacaactccatgcaacaaatcacccatatattttagaaactatctgttaagaaaattcgttttatttttttttcgaaaaaaaaaagtttcacctagtttactcacaatgtttcactatgtatagatctaatgttgcaatgaactgaaacattattttgtaacagatcaccaacatattttcaaaaccctctattatgagaattcgtttcacttttttgttccaccaaaaataatccagtgtacttataatgttttactatgtatagatctaacattgcagtgaactgaaatattctttcgctatttgctgaaacattgtttttatataaggtgaaacaacgcccgatttaaacgattgaacattttcgatctacttagtgaaataattccgatatacttggtgtaacatcgtgcaacatttaaaatataattcaataataagctaaaaaatttcgtcggaatatatccatgtgtggtcttgttttgaagatttaattgcaacaaatttaatagtataatcagatcataatttcgataaataatttaagataaaaaatagtttaaaatggtttttcacacatgcgtggcgctaacatcatgctgacgtcagcccccgatttttggacgcctggatcgggcgcccgattctaagtctcctccgacaaaaaaagagagagaaaaagcacaagcaataagcatgttggtctagaaaaaactaagggacaattgctcatttgaccttgttttaaagccaaactactaatctgatactacattttttagtttgctaatttgaccccgctttttaaaatcgagcatgccgtttgaccctatttacactatgccattagggtttcaaaaaagaaaagaaaaagaatcattttactattcaaagtgaccaaaataccctcatacatttcacttcaagtcttcaaccaatctctcattcacatctcggcggcagcggcacgaggaaggaggaggcgacggcgctggcgccgacgtggggagcgagcaggaggcagcggcggtgcaaggaggaggcgcggtgacggcgacggcgccggcgtgcggagggaggcgatgggcagatcagacggcagcgcaaggaggaggcgcggtgacggcgacggcgccggcgtgcggagggaggcgatgggcagatcagacggcgacggcgacggtgcacggagggagcgacgacaatgaggacacatggagggagtgatggcggcgagatgtggagggagcggcggctgtggctggatgcgccggtgccagcgcttgtttgatttttgtgatcttgtttgaatgttattgttggatgatgttcttagcagggatttgtttgcatgttgatatggatttgaatcgatgctggcatgttgttccggaaccatttgttgtggtgatctaatttgcgttctcaattgtttttttttggctaaaattcaaatctaattcaaattcgcacaagacatatcaattccaagtgaaatttattagaaattgcatcatgtacaccaaagcgtataaaaaaattagggtcaaatgagtaaggatataaaggtatttcgacctcaaattaacactgtcaagttggtttcacgaaatggggtcatgtctgatgtcgatagttaaaaagcagggtcaaaaaagtaggttaaaaaaaagcaaagttaaaaaaataaggtcaaattggttggtagtttgctttcaaaatagggtcaaatatacgattgccccaaaaactaaatactcttgacaatgtatgtttggctatgtacttgtagagaccgagtttttaatacatcttctaaaaaaaatattagtcagataaaattctccacaacattttttttttttggaaacacaagaggaggttatgatctagctgtttgtgttgaaggttatgatctcattacccatcttactaaatgcactttccaatctttaactaatttctgaaaattttctacttgtccacattaaatcttctgcaaatttgatcactgccgttgcaaagaatgttgggttggaaaataccactacaagaagatcagctacaaaataccatcacagggaaatttgagttggaaaatgccggtaccattactgtttcatccaaaactgcaattaatacctttttaggagagagagttttgaaaattccaacactacccttttttttccactcagttgtaatactcaacattccaagtcgcgtttggatgcatttaacaaatctcgcatttaatttatggtggaaatgtttagaaaatcagctaatgcaaaaattaagaaagagtaaattttacaaaattaatgtactttgatcaatatatcacaatactatatatttaagaaagtgtattacaaattaaactacagatttaaaaccatatttttttacaaaactatagattgaaagtatcattagaaaactacaattttataaatgagcatatataacatcagtttaacatcagatttaaatatatatatagtataacatcagttttatcagaaagctacaacttttgtaacatcaacagtgctatagatataaactctaaaatttgtagttatttgataatttcatttctaaatgcatagttttgtgatacaatgctttaaatatgtagttatgtgataaatttcatgttaaatctgtagttttatgatacacattttaaatttatagttttgtgatagtttagccaaaatatctgtagttttataaaatttagtctttaagaaataagcaataaaaacattttcaaggaaatagtacagttcataatttttaaataaatatattatttttttactgcatccctatcaacaataattgatgttcttgaatacatcaagtcaatgtgttttgtgtttaaacttttactatcaatttctattaaaatatttcgatttaattttaaaaattgatataggtatatttgtctttgaaaacaaaaaggagtttcaaaatattagaacgtccttgctatatttttataggttttatactagcaatcaatattgatcatttcggtaatcttgttgctttctaaaatgtcacttatttgttaccgaagggagtacgtataaggcaagcagtctgtataaaatattatgaaattgagagccataagtatagcaagcacaggaaacaaagaagaaaaaaaagcagggggcaaattagtcattttcttccctgggtggaaatgatcacggtaatggtatttttcaactcaaattctctttgtgatggactgatggtatatattcatcagcttaggttctatgtatatgtgatagtattttgcaacttgagtttttcctctaattctgttaattaattcttttactccaaattttcccatgataacacgtgggccgggtaaggtagcaagtagatactccagtaattattgtgctagcttgttagtctcaacattgatttttcatacacgtacaggtgctaattaggaagcatatataaggactatagcagtgtttagatcccttcaaacttctaaaaattctgtcacatcaaatatttagacacatgcataaagcattaaatgtagataaaaaaaatcaattgcacagtttgcatgtaaattgcgagacaaatcttttgaccctaattacgccatgatttgataatgtgatgctacagtaaacatttactaatgatggattaattaggcttaacaattaaatttgtttcacagtttaccgacagaatctgtaatttgttttgttattagtatacgtttaatgcacgggactctaattatgggtgttcctctgtaatcaacatagctagcaccccttgctgctatgagtccatggtctcgccgccattctctttctgcgtgcctatgttacattattgacatgattgttacattggtggtcactgcaggagaaacaatctttaatactagttaaaaccccctttcgtaccggctgtagcaaccgagaccagtaaatcgagactatctttagtaccggtagaaagaacgagtacaaaagatgcatactaagtcaaaaaaaaaaagtgtgggatgtgagattcgaactcaagatctatcaactcagtcctcacacacgttaccattccacctactactatacacatctgacttgaatgtagatgctttctttttgaactgatcccagagacatcgttagtaccggttggtattaccaaccgaccggtactaaaaatatctttagtatgagttggtattaccaactggtgctaaaattgcatcgttattaccggttggtaacaccaaccgagactaatgctactatagcattagtctcggttggtgttaccaatcagtactaaagatatatttttattatagggtggtaacaccaaccggaattaaacatagttttaggaacttcaacttttagaaccggtactaaagcatatttagtaccggttcttgatctagtcaggatatttgtgttttggggtttaggataaaaaatcgtttctctagtagtgggtgcccccatttttatttaaagggttaccgggttatggagtctgatgctaaccccaccctctagctaccatatattacaactttaagtttaactacaacctattaggacaagtatattcggcacctattttaacatgctccacctcactgaatgtaacgccacccacaagtagtagaattatcatgtggattcaccaatccactagacttggggttttcttcttgcagattcctcgtgagatggttgatgagcctatgccagaatcaccgctaccaaaagcaatagctatcccaattactgtttccttctggtctacacctgtaatagtacaccctcacaacttgtaaaggtacgacaacaccttctcttcaattatcacaatcctactatccccgtgaaagggtcaataacctagtggttacaagagtctcagtagcacataaggttctgggtttgactctccatgggagcaaattttccatgatttaacggcttgtgctttcagtggtaggcgacgtacccgtcgacagcgaggcgcctgtggtgacttcgtcaatctcaaggatttgcctgcgcagtcttcgaagatgctcataggggtagagtttacgtgcctccattgtgagtgtctgcgttgtactgtgtaatttttttaaaaaaatcctactgtccctcatggtctccgtggatccgaaaggtacggcatctaaaaatatctcagctataatcatacataagagattcggtttgacatggtattaaatacaagagattctgcgtgacatgggttagatatgtgtgattctgtgggacatggattatgtatcagagattcggtttgccaagcaaccaactatgtactgacccggtctaaggttctccactatttatacccttctggtcgatcgtctttctagcaccattcattcactaaaaaacactttcaacccccacttcaccacttcagaatctcagataccgagcaaaaaagatctagatcaagttagtaccaaaatttagtgttgtatcgatcgatgattgaggcagcagagaccatggagaaagcggtgataactgccttcgtgaacactgtcatgccgccgctgtttaaggtgctgtcaggcagttgtaagatggtcatgaacgtgatcgatgatagcgactcaatgagacgtaaactagttctgctcgcagcttccatggacgacgacctccggcggacgaagaaccccacggccgccgccaaggtgttcggcgaccagctgcgcgagctgacgcacgacatggaggactgcattgagcgcttcctccaccgcgtgtcctgcgccgagggagcgtcgcgggcgcgccggctggggcgcttcctgctcaccatctgcacacgctaccggttcggggacaagatcaaggcgcttaacaggcgcctcgaggagctgaccaatgaacgcctgtgccagttcgtctacgacaagcccccgccgccgccgccactggcgccggcggcggcacaacaacgcgaacatgttcaactcaaccccgtgggcgtcgagggagccaagggggacatcctcgcgatgctggaggaaagtccggaggagctgagggttatcgccatcgtgggttttggcggctccggcaagacgaccctcgctaaggcagtgttccgctcaactgatgatgatagaatccgggtgtttcgttcctgccgtgcatgggttgatcgagccaaggagaaaaatgcgggggagattttcagatcattactccagcaatttggctatcggggtcagggattattggtcgatgacgagcaatatctccaagcccagctcatggactacctcaggggtagaaggtgagagaatttctgtagctgtttcccagttgcacgcattacccatccacacctttacggtcattcagaatgtattggaactttacgtactacattgagtactttattgaggatcgtaaaaccactcattcgctgaaccttgcgcccggccgttggttagagcaagtttaataatatagtcaactactagctctaattcatctatagccaatctaatagctcattcatataatagttacatactacactatcaataactggtcccacctatcataaacacattgcgtcttggagtccgtaatacagctggctacaaatttgtagcccactgctcttctctctcctcgtttatctccttaaaatatatttgcagttggcttatagcctgctattgtacctgctcttacccgaaatttgtcagaaatttgtcagatacttgattgttattgatgacattgggaatgggcaatggaattctataaaatcagctttcgaagaaaatagtagaaacaacggaagcaggataatagttaccacaaccattaagtcggaagcgaatacctgctgtggcaatggcaaaggtttcatataccaaatgcaaaatcttgaagatcaatactgcaagacaatagctcttggggaggcaccttcacctgagttgcagatgggctcggaagaactacttaagaaatgtgatggccatccactttcccttgtttgtgtggccaattatttgggaggtttaaatgagcctactgggcagcgctgtcgcgaattgtgtcgctacctaggttcaaaaatacatgacaatggtaactttgaaagactcaaaggcgtgatcatggataattacacaagtctttcaaaccacgttgtcagggcctgcttgctatatttgagcatatttccaaacgatgttccgctcgagaagaaagtgataatcaggcgttggatagctgaaggattcgcaaggagcgaagatgtggacattgatgaccagactattgcacgttggaattttgagacgtttgtagactgggacatctttcatcctatcattgacacaagcaataatggcgatgtcaagatgtgcaagactcgcagtatcgtgcacgagtatatgttgtacaaggcgtcgagacttgagaggttcatcatgtcctttcctgactggcgaaggaaagttcgtcatctctgtatcgatcataggacacctcacaagcgcagaactacaacagatatggatttgtcatgcgtccggtctttgacgatcttcgggacggcaggtgacaccatttgcgagtttcacaggtacaaggttttgagagtcctggatctcgaagaatgcaatgatgtcaagaacaagcacctgaaaaatatacacaagttatggaatctgtgtgaaaccatgtgtggttatagttcttttgtgatgggaaattgacaagtaccggaagtgcaagaagtgtgtgcgtggactaacattggtcaggttgcgacatctgtgccaagacaacggttgtttggttcatgtgggtgcaggtgatcggagtcgatcttggtcaacggcggatcgggactagactcagggaggagttgaggtccaaagcgatcaaggatgccaggtgacaagattggacacaaggttgcacacagtggacgaacaccgtgtgaggaggtctttgcaacgggcttcagaaggtcaagtgtgcaagcatcggattcgcgaagaaatcagaagggactgtgcaagtgcattgctgctacagtaaatggacttactgtaggtagcatacttgcatgtacacgtaatgtacttgtgcaaggaggagcttgcagaagctgtgcatgtgtgctgtgattggttggcagggaggccaagccaatccagccgttccacgtggcccaaggagatcattgggtcggttggcatcaagtccaatccggcctgtccagctcgggagctcggtcggcccaagcacgttgctgactcaagatggtgaaggccaggccgagcagaccctagacatgacgacggcccagctcggctcggcaaatgcacaggcgtgtgcatgcgcgcgcggaggcgggagatcgtacggcacctggaggcgtggcggccttctgttcgtcaaggaagcggagactcgtgggaccgggtcccccgcggtttttcacatggcgcgcgcgggaacgtggttttcgcgagcgcgcgcagaagcggctcggcgggaggaacggcgacatggcggcttctgacttgtggcgcgcaggtgcgagaggagcgggcgcgggctctctgggacgcgtggcgcggatgcattggcttggaggagcacgacgcggatcggtgtacactgattggcttggagtggaatcacgcggatcgcacgagggcacgcgacgtgaagagctcggatcaacaacgtggcgactatccaggaggtttccttcggatctaaggaacaatggacatccaggattttatcaaggctagggtttcgccccacgggtatttgagacaatgtcttaggggtcttaggctataaatagagggatggatgcaagggtggaggttgctccttttgtaatccttttgagatgctcggtgagagagtttccgtgtgagtttggagtgtgtttgcccgagaggcttttgtattaagattagtttggagtgtgtttgtccgagagattttaagtttgtgttattgttcctctgaaggtgtttgtttgctcctagttgagcggttattttgcatcacctatgaatgaaatgatttgaaggatttcgtttttgccttgtccatttaaattccgcaatttaaattccgcttgaaatttgaactttgcgatgatgagttttgctctctcctcctaacctctcttctagttttcgggaattccttttctcttcctcttctagtttcgggaattccttctctcttctttttctctcttcttttctagatccggcttctctaatagccgcggttctagtaaggattttgagaaatccggcttgatgagtattttcgggggaaagatttgaattgctatattcaccccccctctatagccgttcttggtctttcaattagtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatcaccttacactatgcccgatgatgctgacatcacgcctgcaaatgtggctcaagttgattttaattatcgtgcaagaaatgcaatcattggtggaatttcttctggtgaatttaatcgtgttcaacaccaccagtccgctcatgacatgtggactgctctgtgcaatttccatgagggaaacaatgatattcaattggttcgtcagaatcaatttcataaagaatatcaaagatttgagatgcacccaggagagtccattgattcttatttcaagcgttttgaagaaattgtttcgaagttgagatctgttgaaaaagaattttctgataatgataatgctcgccatcttttgaattgtcttgattatggtgtttgggaaatgaaagttacttccatcacagagagtgcacctttgagtgaccttaccatggacaagctttactcaaagctaaaaacccatgagatggatgtcttccatcggaaaggcctcaaacactcgatggctttggtagctgatccctctggtagtacttcttctaatgacttagcttttgtgtgtggtggcttctctcttgccgctttacactcagtcactgaggagcaattagagaagatccctgaagatgatcttgctctttttactagaaaattctcaagagcttacaaaaatgtgagagatagaaaaggaggaaaaaccaatgaaccatttgtgtgttttgagtgtggagagcctaaccacataagagtgaattgtcccaagttgaagaagaagagtgacaagacaaccaagaagctcgagggacaagggcgaaaggggaagaaggatttgataaagaaggcgatccacaaggtcttggcggctcttgaggaggtgcagcttagcgacatcgactccgacgacgatgatcaagaaaagggggacaaggacttctccgggatgtactgtctcgccaacaacgaggacttcatcaacctgtgtctcatggcacttgaggataaggatgactcatcggagcatcatgaggtatgtcttgatgatatcccttccttggatggttctctttgtgatgattcttgctcagataatgactctgttgatgatgaactaagcaaagaaagaatgacacacttgatgattgaaattagtgacaagtataggtcttctaagtataaaattgagaaactaaaatatgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttatagtgctagtgctgcttgctctacttgctatga

SEQ ID NO: 63897 - DNA, 4298 bp, Oryza sativa
cagtaagctttctgttaaagatggtgatacgattaccatatcacatagtctgtgttagatgtattgtatagctagctgtgtatttactcccttcttgagggtgctttcttcatatttgtattgagctttgtgtatatctgtttggcccagttggcccatttaatctgtggtccaatatttgcaacatggtatcagagcatatggtttagggttccacatccgccgccgtcgtcgtgaagctctctctctcctctcacgtgactggatccctcttctctctcgcgcgagcgtcgccacctctgccctatgacctcgcctgtggtcgccgccgcgccggcagtgtcgccgccgcgcctctgcctcttggggtcgccgccacgccaactggagtcaccgcccctcttgcgggcgccaccttcctctgctcgcgggcgttgcctgcccctgctcgcgggcgccgccgttcctgctcgcgggcgggcggccacgggcgggcgctgcctctgctgccgctgcctgcttctccctcatcttccaccgtctaaagctactgcctctactgtgatggcgccgccctcgggaaaaccgggtgccatttctcttctgaagcctccggtcatcttcaacggactcaacttccgggagtatgcattgcatatgcagatacacatgtgcagccagtggttgtggggctacctcatcggcgatcggccttgcccgccttgtccaaccttgcctgctgagcctgccatctcggcagatgctgatgagaacactaagcgtggtctccttgatgatcttgctgctgctatggaggcgtatcaaacagatctctctctatatgagacttggttagagcaggaggcctatgccaaggctattttggttgggagcatggaggttgacatatcactcgacattgcgggccttgctagctctgagttgatgtggacccgtcttcgctagcagtacgagcctcgcaacgatgccatgtttcttgccgttgtgaatgaggcacaatctcttcgtcagcttgatgccactgtggatgagttctttcgcaagatgtctgcggtgtggcgtcaaatggacctacagggcgctgatgtttgtcgcacttgtacctgttgtcagcgccagagggtccagactgagaccactcgcctctatgagttcttgtctcgtttgaggcctgagtttgagcctgttcgagctcagctgttggcacgacgccctcgaccttcattgttggagaccttgcctgagctacgggctgaagagactcgttgtcgtgaggctggtataggcattgcacagcagtccacctctgtcttggttgcacagggcttgccttctcaggtccatgtctctgcccagcctgttgtggtgccatcacctttacctgttgcggctggtgctcctagtactccttcaggcattgtttgcgggtactgtagcaagacagggcacaccgcctctatgtgctacaagaagaagagagatcagagtcatcgcacctctcagggctctcgacagggctcttctcagtcaagctctcagcagatcacatcgaccgagcaagagcttgtaaggctccttcgtcgtcttatgactacagcctctacctccacccatgggtctgctgctcaggcttctagtcttccaccaccacctccatcctcttcaggtatattgtcctcgtggtttcttgattctggtgcttccttccatatgacacccgattccacacatctttcttctatgagtcctcctgatacccctctcacagttcagacagctaatggcacctcacttcctgttgttgatcgtggcacactttctacttcttcctttcgagttcctactgtctctcatgttcctaagttaaccatgcagcttatgtccgctggtcagatcactgatcatggttgtcggattatacttgaggctgactcttgttgtgtccaggatcgtcgcacagggctcctggtggggactggtcctaggcgccatgactctcagcgtctttgggagcttgattggctacatctcccttctgatgcttctaccagccagtcagtcggttccactgcttcagcgttagctacttcagccactactacttttgctcagtggcatcgttgtttaggtcatctatccggtgctagattatccacacttattggtagttggggtcttaggtcctgtttctggagacaccgctctacattgtacgggttgcaagcttggcaagcagctgcaactcccctattcttctagtgcctcagagtctcagcgtccttttgatcttatacactctgatgtatggggacaagctccttttgtttcgaaaggtggccattcctattatgtgatctttattgatgactattcgagatttacttggatttacctcatgtcttctcgtagtcaatttctttctatttatcagcagtttgctactatggttcgcactcagtacgattcttccatacgggtttttcgtgctgactctgttggtgagtacatttcggcagcccatcgccgttttctagctgagcagggaacacttccccagttttcttgccctggtgctcatgctcaaaatggcactgctgagcgcaagcatcgtcacattcttgagactgctcgtgccctaatgatctcctcgcatctttcgcctcatttctgggctgaggctgtctccacggctgtttttcttatcaatcgatagccttcttctgttcttcatggttgtactccctatgagcgcctatttggtacacctcctaggtacagtcatcttcgatgttttggttgtgtttgttatgttcttctttctcctcgtgagcgtaccaagctgactgcccagtctgttgagtgtgttttccttgggtatagcactgagcataagggttatcgttgctatgatcctgttgctcgtcgcatgaggatatctcgtcatgtcacatttgatgagtctcgtccttactatcctcgctcttccacttgtgatcagtcctccactgtcaaatctatctcctttttgactcttccggattggtcctttccttctccaccaccagttccgtctccatcaccacacctccctttggtttctacgccatctccatcactgtcaccacctccttcgccgatgccatcatcacccatactaccatcaccacctcctagtactcttttagatgctccacatgagctagcacctttttcgctgcactactctcgtcgttcacgaccccttgttgagttgtcctctccctctatccttggaccagctcctgctcctgcttctcggtatgatcttcgtgatcgccatgctattaggcctgcgcctaagtatggctttactgctgcggctattgttgagcccacgacttaccgagaggctattgcccaccaggagtggcaacaggcgatggcagaggagattgctgccttagagcgtaccaagacttgggatgttgttcctgcacctactcacgtcactcctatcacttgtaagtgggtctacaagataaagactcgctctgatggctctcttgagcggtacaaagctcgtcttgtagctcgtggttttcagcaagagcatggtcgtgactatggtgagacttttgctccagttgctcacatgaccaccattcggaccctgttagctgttgcctctattcgtcagtggtccatttctcagctcgatgtcaagaatgcctttctcaatggtgagctgcatgaggaggtctatatgcagccccctcctgggtattctgtccctgatggcatggttcttcgtctgtgtcgttctctttatggtctcaaacaggcccctcgtgcctggtttgagcgcttctcctcagttgtcactgatattggcttcaaagccagcgaccatgaccctgctctctttgttcacacttcttcttgtggtcggacccttcttcttctatatgttgatgacatgatcatcactggtgatgactctcggttcattaatcttgtgaagaagcgtcttagtgaccaattcttgatgtctgatttgggtcctctcaggtactttcttgggattgagttctcttccacgtcttctggtttctacctctcccaagagaagtatattcaggatctccttgctcgttcgggcctcactgataagcgtgtggttgacactcctatggagcttgggatacatctacggcccaatgatggtgagcctcttcaagatcccacccgctatcgccaccttgttgggagtcttgtctatcttggcggggctgcaggaa

SEQ ID NO: 63898 - DNA, 7583 bp, Oryza sativa
agggtacacaaacgacaaagttgacatacagatccacgtcttacaaacattataaaagtcttacataaatgcagtggaaatataaaagataactagagctaagtctggacttggatagcagcgggaacaccactccacaggcatcctcgacggcacggacaaagcctactcctcggagaaaccaccattggacgcatactcgaactctgagggttgggagatagagcaagactgaatacttcctactgtactcagcaagtcataccggaacggagggtatgatgcaatatataaccaaaggaaggctaaaaggggatcatttgcacaaagctagcatttataaacagtagttgaaagcagtaaaacagttctaataattaatcaatattaaccatccactgtccaatgctacaccatgttgcaacaggcccaaccatccacctgaactaatcaattccattagactaaactagggtgagactaatcacagtgaatctggttgaccgcccataaccgcgggcacggctattcgaatagttttactctgatcagaggtgtacaactgtacccacaagacatagccccacaacacgtttccgtccgccggcatgccaccacgacataccggaaagagaccgtgacaggaccctttgcataacctcctctaaccaaacacaccacacctcaggtttcacccccactactcgcaaggcagcgggcagtcccctctcgtgcctaggtgaatccggaagcgacaaaggccgtcgcagggcccatcccgctccatcacgcccacccttgcctggatgcgtcagctagaggaaagctacactacaagcccaaccgttgcccaagctggcttgtggtaagtacgataagttcttctagggcatcccgcgaaccggtacttaactgccatgggcgcgaccatcaaaaccatacacccacagccaatcatttagcatattttagttaaccaacaccggagcggtggcactaaaccaacatcaatactagaataggaagtctaagtgttaatgtaaatcccccattgtgtgctagttgagctaagcatggctaagcaatccctagtccaacagctactcatgttataaccccaagctaacaaaggaacaaggtaacaaatagtatggctgagacaataggtaatcatcccatggtatcattataaaacaatgcaatatttaaaggagaacaataaagcatttgcaatgtgggatcaccatgttcaagtgacaagcatgacttgccttgctctgcggctggaggaatctcggcgactatctctaagtacatcggagcgtcgggagagccgaaatctatgcgacatacaaggcaaacaatacaaacaggctataagactactgaaacagagaacaaatatttttaatggattctttgcatttttcttgatttactgagacttgaatgggcttaaacgaagcacggatgaattttctatgaattttagaagattcactgtgtttttactataaaagaaaaaaccttaattggattattgcgcattaaataaccccgacatgcgggccccacatgtcatcggcacaagacgccggtccacggtggaccgagtccacgggatcggggaaaaggaccaccacgtggcgccgacgtggcaccgatgtggcggccacatgggccgccacgcgggcagcggaatggatggccccgatctacaagggggtagatcggacggcggaggcggcgcacgcgcgggtggcttaagccggcccggcggcctggcgtgcggcggcatggcatgcggtggcgcggcggcaagcggcggcggcgcaagctggcccgacgactgcaaacgggcgatggcggcgagcgacagcggggcggcactagcggctaggcggcggctaggaagagagagagggggaaaaagagggactcaccgaagacgacgagcgacggcgagcggcggaaaacggcgggcgacggcgggacgggctccggagcgacctggggaacgaaatgggagcgattagagagagagagagcaacggacggagacgccggccgaaggcggctgcaatggcgagctcacctgcgtgcggtgaaaggcggattccggcgacgggatcggacggcggaggggtggacggcgtggccctcgggctcgcgaacccgacggaggcaacggcgaggctcggcgacggctctaacggcggcgagcggtggccggaggcgcttagagcggtggcggcgggtggtgcacggcgctagggcagagagctcgggtgcgagtggttgcaaagcggaaaagagagaggaggggccaggggtgctttatataggctcgaggggatcgatcgtggccgggaggtgcgggaatcggccggcgacgtggggaaggtggagaggagagagacgggattagaaaatcgaatcccagccatctcgagcgcgggtgcgggcgggagagtggggcggcggttgcaggatgtgtggggcgtgcgcggggagggcgacgtgggcgtgggcacgctcggagagggcgggagcggcgattgcgggcgcggcggcgccggccggacgtgagagacgggcccgataggtgggcctcacctgtcggtgacctaaagaggaggtgggggcgcgggcgaggtggctggccgaggcccagctggcgcgtgggagaaggagggggagtgggccggcgggggagaggagggaatgggctggtggcccaaaaggaaaaaaggagggaaaaagaaaaagaaaaaggaaaaaggatttttccagggatttaaataatgcttgtgctcgattttaattggttaaaattatttctagggctctgaaaattccactaaaaatccggttagcatattttgacatgtagaactcttgaaaaatcccacatgccatttccgattattatttgcatttaattccattagggtttctctcttactttaacacatgaaatttcttaagaccacttattaatttaatttaggcttgggagaagaacttcagggtgtgacaaaaaccttctctttttttctcttctctaaaaataaagtgatgaattcatgacttgaacctatgatctcatagttctcctaatcaattcaccctgtgacgctatgtgattggagattattgtttgcttgctacgtatgattgttcaaattttatgatactgtaggaatctaaccttgttactatgattcagtaatattatcatagatgggtagtaacatgctatgttactttaaaatttataggtcgttactgcacttttggtaatagcacataataaatattgcaataacagagaaaatgtaataataccagtgatgctataatagtaatgcttgtgcagatatagaaactttaaagtcccaatcttcaaagagcaatatttcttacataatatcttatttttctaatccatttgcaccataatgttcataaaaaaatatttaatgaaactagatctatcgtgactatattttgacgtcattactacgaaaagcacatgtgttactgcatactgaccgtcacgttactacgtaatttctacatgatgagggcaacaaagaggttaaattgggttgagccagtaagttcgagctctgcaatctatttttcctatatagttggttcccactacaagaataactcctataaagctgtctccaggttaagccacgttatcatcaccttacagccgttggatcaagtgccatctttgttcgattcatagacctgatagaaactcaaccagtccaaagtccacccagacacgatgaggaattgctagcgttggatcagcttgcagtgagttagaaaaatggagcgttttctgtgcgtcaaatttaggaaactgattaaggtgactgaggagcccatcttaatgaccgtcatcatgctttaatcgacgcccgttcagaggttcagcaactcagcgtcgctcacagtccctggagttcaggaatcaagatcatccttttggtttgccattggttgaaatcaatcacatgctctctcactcggatggattcaactctgttcaatagctggaattactttgcctcatatcaactcatcatcgataattgggacaatcattccagtgaatcggcgtcgtcgctcgatggcagaaacatagtcactgtcatatctcagactctcggcataggtaaccaatttgtcatcctgcagttctttttgggataatttcatcctttagtttttatttcgtagctggctcagattaagcttctttattttttcaacatagcaatacaacatgccatcacaaatattcagcaatttactacagtacgtgtctatacatacacagaactactcgaagcaaccttctaactgccagtggatttgcaaggaactatctcttcaccctaatgccagtggatttttttctacctttaaaatttcgaccatttttagcaattatgagttcatttgtccagtccctaataaaatggtgatttgagatcatctgaaaactgatgcactccattttccccccttttcaccgcaatacatttcttttcattccaatgatgcaaacactgaaacgcatcttatttgattattagcttctttataacttttgttgaagaaacttttgtcgtccgaatgttctcaaaattggcctgacaaaattgacctcaccagtccattcatatgtctcaaagttgaccttctatcttcatatcacttataatttgttacaagagttaaacatattttgttttgttgaacataacattttacaacgcaacttttacaggtcaatatgatgtatatagcatatggaaaacagcaacttgagctggagaaaaatacatgccaatgacaaggtttgcaattattcctgtgtctttttgggcattaaattactactgtctatatattaactggtttatcactaacccatctggcctaacatattgatagttgatttttcttataattgtattatgacacctttgtatcatcattaaacttgaaacgtcaaccttctagtgaccccattttataagaattggtcacttttcattcgtacaaaccatcgtaataagcaattttcagttcatcacttaaaatccccgccgcaacgcgcggggtatcacctagttgtacatatacatgtagccaaggccagctctgggcctagctaggccggttgtgcgaccatcatcaccacccccacccccacctacaggcctcagcccatagcctcagtagaggcggaactgcgcgcgggcggccttggagagcgatgcggcgatccagtctctagggcacgccgcgccagttcgtcttcgatctgcggcggtgcggccggcggccccgcgcggctagcgctttctctccgacgctccttgaccacgacacagcagctatcaacgaacgacgcgtcgatgccctctcccgtgattggtgatcccttctagcagtggctgggtcgtaggaagccaaccaggcaagcagcgcacgcacagccagcggcacagcaggtttgccttctaaacttcttccttgattccttctaggaaaattaggttatgtacttcggacctctcttgtttgcatgcttaattttcttccttcttgctatttaatttactttgcaattttacttaaaaatttaatttactttgcaagtttactttttgaagtgttacagaacgtattacctatttgtcggttctcagaaaagaaacagaagaaaatgggaagaataatttatcgattcgcaaaaaggtgctatatataaattttttatagcttcaaaatcaaatagtgttgttaccggtaatgatcctcacacatgtcaatgtggatgttgtggtgcaacaaaataatacccaagatcaagaacaaggatttgatcataatgtaaatgcagaggttaaagttaatgaagatcaatctgatcatatttatggtctgctaataaggtatttataatattttatttaattatactatcagtattatatatatatatagttatttacaaccgttttatttattatttaccatgttagaaatgtttatttgtgtttcttcagaccatatgtgctttgtaaattatatagtataaataaaaaatagtattaagggcctatattacagagttcgcctatggccctaaaggccttgcatgacgcgctcggggtcagcctggagccgagcggagcgcactgtcgaatccatgattgtctctgggcctttgtttgcatgttgtacgcatgccgcaggaactgcatgcaaaagcaaaacgtgggatgacatggacgcacgcaagcgacgtacgaaatcagagcgaggaggatgttgcagatgaaaattggaagcacttgatcgccgatcggaaccgagatagatagggaacgatagatgaagaaaaaaacttgaaaacaaattttattttttaagtaggtaaggaaaaatcatgtattcccccgtttcaggttataagatgttttgactggtcaaagtcaatctgcttcaagtttcaccaagtttatagaaaaaaatagtaatattttttatccaagataaatttataatgaaaatatatttaatataatatttaaaattattataatattttcaacacaatgctcgtcacactagggttgactttccagttgcaattgaggctagggaggaaagccgtcaactgagaaagtatacgatgatatgatggacaaaaggattagagatagctgaagaggccaagctaaaagatttgaagattgggctacattcatcgaagcaaccatctatcgtattatgaaagaaatgttgtcggacatttctacgtccaacaatgacatggatggcaagcacgctaatatttaaatttattataatattttcaacacaatgctcgtcacactagggttgacttcccggttgcaattgaggctagggaggtgaaccgtcaatgtgagaaagtgtatgattatatgatggacaaaaggattagagatagccgtagaggccaagttgaaagatttgaacattgagctagattcattgaagcaaccatctatcgttatatgaaagaaatgttgtcaggcgtttctacctccgacaatgacatgggtggcatcgttatgaggcgtgccgaggcactagccagctggccagagtatcaagagcttgttgagcaagaactgtggcaggcacgctaagcgcgtgcgtgctaagcgagcagaacacaagcgaggagaattcattgcacgagcaaactccatgtgcagtagaattcaagtggcatttatgtccttatcaagcaatggttacagggtgtacgaggaggtgttaacgtcacctaaaccgaggaaaacaacagcagcaacaacaacattgtcttgttggctagtccggaagatagcgtcaagtggtgcatttgaggttctttcttcaatgctggtggggatcacgaaagcggatgatagcaccagtgatgcatcatcttcttttgtacacttcgaaagaaagaatgcccgaaaaattgttgtaccgggtcaccatcatgt

SEQ ID NO: 63899 - DNA, 2299 bp, Oryza sativa
aaagaaaagtcagtatatgcaaagtttagagaatattactgtatgtaaaaaatcagcatatacctctctatgtaaaagtgcaatatatacttcttcgtaacaaggtccagtatgtaaaccactatggaaaagcctctgtatatatgtggaaaaatgcagtatatgctatcttctagaaaagttcagtatgtaccacatacaaaattcagtacatactatatgctgtcgtataacaaagctcagtacaaagcctcccatagaaaaattcagtatatctgtgaaaaattcagtaaatactggtgcgtatcaaagttcagtctatgaatcactgtggaaagattcagtatagatgtggaaaatgcagtatatgctatcgtccaacaaagtagagaataaagctccccacataaaaattcagtatatactattgcctaacagagagttcagtaagaaccctgccacaccaaaaatcaatacttaataccgtctagcagattccaaaaagtttccctccaaagaaaaaatgagtatataccgttgaaaattcagtacgtactaccatctacatttttctttatgggggtgggggctaaaacagcattaacttcatccacccaaaaaaccatcatatgcactaaaaggggaaaaattagcatctgaaactgagagagtacatgaaccgaactacacctaatccctctctacaggcatacatgtattcaatttcaggtggcataccttggactgtggtgacaaactaattttcctgtgaccctgcggcaaagaagaaaattttaggcaacgtgtcttgatcttgccgtacaaaaataaacgaatactaacctgctgctttggatgaaatccactgctatggcccatcgattttgccattgttgccccgctcctgcattcagccgactctagatcgattacttctgcttcaggaacacatgctgttgagagaggatccatcgctggaggaaggggaggagtcatcactggaggaaggaacgaactgctatctctgtaccgccgccagccacacagtcgccgctgaatcgctggtccgtcgccgcgccgccccccaaaaccccaattttcgggataatctgtttggcctgttgggagcaaaccccaaattacgggataagcagtccggtcttttaattagaaaaactaatcggatccaccgagccaaacccgttatgatgagggagggagtacatatctgatcgatcagatgaacggtggatgggagagggagtacgtactccctaggagtatagaaccattttcctatatatatatatatatatctcataatccatatgattgttatgtaaggtcgttttatgtaatcggaatactatctaaataatgaaaagaaatactgtaattaataacttccagtctctacaattgtcggaggggttgcaaatcttatgtgatttttctagtggtcaagcctacataaataattgtagtgtgtaatcgattgtggtgggacatgcacaaccaagctagaaaagcaaataataattcgtgcgtacgtgcacatgttgatcgggatatgcatgctacggtgtgagatacacgtacgtgctgatgactcctgctaggtaataatagtaatgtaaaaatactccatgcataggacactggagctagcgagtgctattttttttaaaaaaaaataacaatcatttgactattcctttttctagaaaaaaaatatttgtgtaaatagagagatcaggcatgcttaaaatacttttgatgacatatttggtagttctcttaattaattaagtaattgaataaactgttggtcaaagtatataaaaacagagcttatatatattagcaattagctaacattaatacccaggctggacaaaatatccagtttggaacaataactaatcaagtgtaggccacgacgggtatttatcatatatatttagtggaaagtgagtatctataagttgcaaaagaaaaaatattaaatgtggacagcttactgagatagctagcaacatcaatctcacctatctaattaatatgcacttttgagatatatattacatcaatcgactaaatcatttcccgtagattgtactagctactaatggattggtagtggatactgaccactgaagtaatacatactctacttagatataatgttgttgtgtatcatggtataaatgatccagtgtatgcatggtaatcggtcgagactatctagataatacatccgtcgataattttttaaaaaatattatcagctgctttatag

SEQ ID NO: 63900 - DNA, 19508 bp, Oryza sativa
taaagctggtaggcagagacttggttattgtgccctacattgtcataattccagattagttgatcgatcatatataagtactaaaatgtagttagtctatcacaatagagaccaccgacctcaaactcagccaaagtcttcaccttttctctatacagaaggcgcatgttgtggcacacatagaatccgcactggtcacctatttgttgcttaaccgggaagtcttttttgtggataagggtgtcatgtcctgtcttcctgaggcctcctctttgcacgtattgggcccacgcttcatatatcgctagttgaattggggtcaaatcatatgcgttcttatcaattctggtccacttaggtgttatgaccagaaggatccaatgggcaccgcggcattaacatagtgaaagttaattaagtactgaaggaatgtgtcatgctgttgtgtatatttagataacacacttactgttgattataggcgcacataatgtactccttgtctcggcgggaccacaaggtgttgtagatgtaattgaccatttcttgatggtcattctggagatttgtgacagtgaccacttgtggatcaaggaaggcaatttccggtgcatgcttctgacaccattgccaacttaacctacacacaggataaacgatcttttaagtgagttaaaccgattgttattactagattgagttgggcgacaatacttacaaggagtagcacttaaggaggcttgtgtccatcgctcggagcctgtagagatcgaaaagatccttgaagtcgaccacgatataatttgttggaccaaggaatggctttccatcatgctctccaaggatatcggtagctttattcggcttcctggcgttagatttctccatgtagtataagtgaaagtccttgcaagcggtgcccattgcggcaagcacgtcatctccaaccaatggcatgcctagttggaactcctgtggagcgacgtatttctttttgacctctttgcccttagtctcttcctggaccttgcccagatctagcttccttggagctagaagcgaggcatgcacctttcctccccttcctctcccctttgcttcgggtttatcgagagtaattctctgaggggaagagtgtgctttcctactcttcttcatcggtgggggttcatgaatcgccttgctgtcggcctccgttcggtcctccccaaaatccgtgtcgtactgcaactacacatcgtaagattgtgcatgacgatcttgagcaggaggggctgaaggagcaaaggcgggtctctttggtggacgaccgcctggtgcagtggttggcctcgctgtaaccctgatctcaatgaggtccttgggccattggatgaaggtaccacgggcatttcctagtgagaggacctcgtcgttcggtggatacttcagtgggaacagctcgtattcaggcttcaccgagtcgacttgaacttttgcacagtcggccctgagttgcactccatgcacttttgtctctggggtcggcttgtacgcaagtccctcggctgctggaaccatgaaggtcggcatcaccctaactgtgagggtgcagctcattggttcctgcgatagattaatcaatttttttagaatattatatatcatatggattcgttaagtctttcatgtattgagtaagttcacttttaccgttatgtggttgacggcgccgtcgaccgatgttggattttccgccaactcagttgatgcgcaactgctgcgtttttgggtgggacttcctaactcttcgtgcgcagcagcagcggcggcctgggggttctgttgctcttctcggatctcttgcctaatcttggccctcatcgactcgagcttttcatcgaattcagatgtcaactcagctcttatcgacgcccggatcttggcttcaaggcgtgcatctttctccgccttgttggaagtccgcttcttgtactgccacgcgtagtctggaaatccatacttccagggaacagaagacccaacgccccgtgtccgtccacggtgttccttattgcccaacgctttcgtgaggaggtcatcctcgcgtctttgagagcaggcctcttgcgaggcttgttgctcggcaaccaactccttctgcattacaatttagtggggttaaataaactgcacgatgggaaacaatgcaaacatacacgagcggcgtgttcgattcctccgcttcttcatcctcacgctgccattcgtcttccttaccagcatatccggcggtgccaagccggtgcggatgctggttcctggtctggagcaagcgatatgcctcgcttctagctctggactcgggggtcgacttcttcgcatggaattcctcccagatctgttctgtgatccaaggaaattactctcttggatctggattcgccgggttgtagacgaactcgccgactagcttagtcttgaagttcttccaagcattgcccataaccttgaaagcagcctgcctgagacggtcctcatgctccgcaggataatcgaagctctccttgaacgttagccaagcaatgtccttctctgtggccggcacgagcttgatgtcatcttgcagaattctaaatttctgcctccctatgaccccgcagatagaccttaatcggctcaatattttccttggagatgccagcaaccctacggcgcccaccgctgttatgcggaaccgttccttagggattttgttccctgtcctaggagtacgtgcccttgaggacccactagttgtcgtcgacattagttctccttgctgagacatcgtctacttttcttcaaaataacaaaaaaacacaattgagtgttacaatctattaaccacatttcacaataatttcagtaatgcacaacatttcatcccaacatgaataaaccacatttcatcccaacatgaaccacattgcatataaataaagttaaatgaaccacatttcatcaatcactacaatcatctatcacaaaattcataaatgcaccacatttcatcccaacatcgacatgtctcactcatagttcaatcacatatcatctacatccacatttcaatgacatgtcattcacagttagcagagggcggcacgatggaggactcacctgaggatgaccggtggggctcggtggagggcgtcgccggtcagtggaggcagcgccgggctcgatggaggcagcggtctcggtggcggcggcggcgggctcggcgaaggaggagttcgcggcggcggcgctgggctcggtggagggcggcgccggtcgggcaggtcggcgccgggcgggcggcgttgggctcggtgggcgtcggcgacgtgtgtcggtgaggacgcgggcggcgacgacgaggaaggccgacaccggtccggtcggtgtagaggctcggtggcggtggcggcgggctcgggggggtcgtcggtgaggaggcggcggaggtccaaatggagggccgaggaggctcggtggtggcggccgcgggctcagcgagggaggcggcggcctcggcctcggcctcggcgtcggtggtgacagcggcagactcagtgagggaggacgacggcggcggcggtgggctcggtggcaacggcggcgggcttggcgagggaggacgacggtggcgctagggttctaaggagacgggaaactgtagcgggacttagaaaaattttcgatccgatctgagaaaccctagttatagtagagtgatgagtcatctcaatcgggctttaccgtagggcccgtcacagatgactcatcggtgacgggctccatactaatgcccgattgaaatgacattcaggcccgtcacggatgagtcatctgtgacgggccctaagataatgcccgatagagatagattaatctctatcaggctttaactaaggcccgccaccgatgactatttttccatttttccaaacaagtctttatatttgtgagtacaaaatatatagctgatgtataataattcattttattagtcataatacattttcggatagtaaatgatttcaaatcgaaatatggtcaacaacaaaattgtagagcctttcaagatctacaacttttattttggtcatttttctatataattttttcccaacagcttgaaattgattttgacaatatgacaaatctaattaacagcatttgtaaatactaaatgatttcaaattgaaatatggtcaccaacaaagttgatcctctcatcaggatctacaacttttattttggacatttgtaataaaacaaaattagccatattaatgactacacatatcaagtctttgcaataaaacaaaatacttcattcattacaatagataagtacaaatgcatcggtcacaaggttatgccttccgtatgatctgaatgagcatatgccacaggctcttggggatcatcgtcaaggtcaatgtgaggtcttacatgaatattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaatggttcatcggcgtatcccacctttgatagatatactaaagtgaaaccttccttgtcggctttgacaccagtgcgtagattcacccaacggcagcggaacaaaggaaccttgaacttgacgtagtttagctcccatatctcctcaatgcggccgtagtatgtgtttgatccaacttgattctggaatgcatctatacggacgctactgttttgcactgtgcttttgtcatcttgtttgacggtgtaaaatgtgtatccatttatatcgtatccttgccatgtgtgtacggtccaagacggtcccatccccaacaactgtactgtctcatttgggacatctgtggacattgtcacacgattcttgaaccattcgttgaaccgagaattatgttctctgttaatccatgcatcagatcgccccaagttctcatctcggattttcgctaagtgctcctcaaagtatgggccaacttctgccatatgttggagcacagcgtaatgagcctgcgcgtacgacgcttgatcgggcctaattcttttccttccgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttatgaacgtacgacttcagaactcccatgtacctttcaaacgaccacatttcccttagaaaagccgggccacatagttttgtttgcttcaccagatgaacaaggagatgaaccattatatcaaagaaagacagtgggaaaaacatctccaggtgacagagggtattcacaatataggtctgcaacccatctagatcttctggatctataaccttctatccaattgcattgaagaaggcgcacagacgttagatcgtgtgacgcattttcggtggtagaatgcctctgatagcaactagcaagatttgtgtgattagcacgtggcaatcgtgagacttcattccaacaagttttagaaggtccaatttaacatacttacttatcctcgctgaatagcccgatggaactttaatatccttcaagcatgttaacattgcgatcttctcatccttcgacaatgtatggcaggctggagggaggtacactctacctgtctctgcatctcgtatgggctggagttcactgcgaatattcatgtcatgtagatcaaggcgcgcgttcaacccgtcctttgtcttcccgggaatattcaacatcaggccaaccaaactctcacacacattcttttctacatgcatgagatcaatgcaatgatggacatcaagatctttctagtaaggtagccgacaaaatatggattttttcttccacatacccttctcctttgtcttgctacgttttcttttcttcccaaactcattgcttatgtccttgaccatattgtggacctcatcttcggacaaatctttgggagcaggctgaagttctctcttaccgttaaaaattttcttctttcttctaaatgcgtgacgtagcgggagccacctccgatgacccatgtataccatctttcgtgatttcttcagccaccgacttcgtgtatgttccttgcaatcggagcatgccttctttccttttatagtttgtctggaaagattaccaagtgcagggtagtcattaatggtgcagtacaatagaactcttagcttgaagttctcctgaccatatgcatcccacgtttccaaaccttctttccaaagaatctccagatcatcgataacaggctccaggaatacatcgatatcattgtcgggttgcctcggaccttggattaacaagcacaacataatatatttccgtttaaagcataaccatggcgggaggttatagttcgcaataagaattggccaagttctgtgagtactactcatgtcaccgaaaggattcatgccatccgtacacagacatatcctcatgtttctagggtcggcagcaaagtctttgtgttttcgatcgatattcctccattcaatcgaatctgctgggtgtctaagcataccgtcattccttctcttcgtggcgtgccaacgtactaacttggcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagtatccaagtccgcatattgcttgtggtacaatatgcagtcgtttggacaagcgtaaattctacggacctctaaccccagtggacacataacctgctttgcttcgtatgtcgtctcgggcaatgtgttctcagcaagaagcatagccttcaaaattcctaaaagacctgtgaaactcttgtctgtccatccactactttccttcagcttcattaggtccaaggtaactgacaacttagtgtgttttgctttgcatccagcgtacagaggcgtctcggaatcacagaccaacctgctgaacttcattccatctctctcattctgggctaggtcctcaacgtcatgtaacatgtcttgcagcagatcgtgatacacatcaatggagaaggtacaaacatgtcatgctcatcttcatcttcctgattatgcgcaccacttctgtctgctactgctccacttcctgattcttgctctccatgcttcacccaacatgtatagccctccatgaatcctcgttgtatcagatgaccatgtacgtcctctccgctatcaaacatattctcattcttgcaatctgcacatggacaacacatgtaatcactgtttcctcttttccgatcctcctccgcggcgttcataaaatttattacgccctttctgtactccgtagaatgacgtttcaaatttttcgcatacatccaacttcgatcaattgctacaaaataaaaaaaaacaaattagaggcacatattataagatcagtattgcaaaagtaagacgtgatgaaattgctcaattaatgaataatattactcacttgattgatccattttgatcacttttgggaatttaatttctattttccttggaaaaaggacaaaaaaatcgccctctacagcctcccaccaaaatagtgaacagtgggatacatttacactaggtggtggtgggtatttatactgtgcaacaaatatctgtaacggccctaaaacaatcaaccgtgacgggcatacaagtaatctctatcgggccttaataaaagcccgtcaaaaaagagtgtcatctgtgacgggcattaaacttatctcaatcgggcctctagttggagcccgtcacagatgaccctcatctgtgacggacttcttttagggcccgattgagatatggaaccctcatgtcaatcgggcctcaactatagcccgtcacagataagtgtcatccgtgacgggctttagttttatgccgatataccatggttatgcgaccatatctcaatcgggcgaaacttcggcccgattgagattacttccttgtgacggcccgcaaattccagttttgttatgggccgtcacagatggaaggatctgtactagtgcgagggccttgtcaatagggagggagaaggatcacgctccaggcaaccgctatggcacccaatttctaggtagctgcgagacggtagggaggaggatcacgctgtcgtcgccgtcaaagaaagaggctgagagggagagcgcgagggaggggtttacttggaaagtagtgtcctagagtgtgagacgtctactttaataatattttttaagttggcctacgggctgaagggctcctgtcattggtgccatttttctccttaaccggcattaatgtttggcccatcagtgccggtaggtttttaaataaacctgcactacttgcaaactagtgctaataaattagttcatcagtgttgggtttttaaataaactgacactgatcacattagtgcctactggtttttcttccgatcgatactgtcgtaatcagtaccggttatttgtccttcagatcatgcatgggttccaggaggagggggcagaatccttaccagtgtcaggtttaatccaaccaacacttgatagaggtggcattgataggctgtactttagtagtgaaatttctactaaaattttgatgtgaattttaactgaaatgctcaatgattagaggcatgcggagtaacatagatgtatactttatattggaactagctgcgtggcccgcgcaattgcacggctagcactcatataaaattatctattatttaatatgaatttactaaaaaattgttaaatagctatcttgttgtatcaagactttgaaaggttaaaccttatcatccacgtgtttctaattttatagtttttaaaagccatgctagttgctaccccttatttcttaggcacccctcgatgtaccacttcttctattcattctccttagaatgtttaaaaattagaccttgtagtttttaaaatttattgtctaatcggatttcatttttataatttttagatgtctcatccactgtctcctctttttattgtcattgtgattttcaaaatcaaacaaaactattgttcgggttcaattttttactttctagaagtcccaccaaaccgccagcggctttgcccccttacttctctacaacctacccgctgcctcctctcttcgttgtcattgggattttaaaaatcaaatgtaattatgattggggttcatgtttttactgtctagaagtccaatcaaaccgtcgtcggctccgtcactgtactcctctacgacttgcccgctgcctcccttctttattgtcatttagattttaaaaatcgaacataattatcattgaggtttactcttttacttttcagaagtctcaccaactgccgtaacaatgctatttaacgacccgcccgctgtccctcatcttaatcgtcgttggattctatttgagattttgtttatagtttttagatgacccatcaaccgtcaccgctctacttgtttacggacatgttgttttcccctttttattatcatttatcgtcattgtattctagatggatttgtttttttaaaaaaattcaatatttttcattccgatgttttgttatttataaattgtattcgtacttgaactcttataattattttatattttacgaatttattttatttttattttgaattttaatttatctcgtgatgggttttagatgatcttctctttcaatagctagtttttatgttttatttcgaaattgggttatttataaattatattctaattaaaatcttattttaatttttctattaatctcatattgtgttatatatgaattactgttttaatattccttatttttattcccagttttagtagtttgtaaaaattattcttaatttaactcttatttctgattttctaattttggaattaattttatttttgtacatattttaattaatctttaattgtgttctacatggactcttctttcaattttttatttttatttcgattttcaattatttctaaaatatatttccactcgaactcttttttttcttcaattaatgtggaaatttctagccttcatagtgaacatggtgactcttttaatttttttatgttttattttaattatttataaattatatttctaattaaaatatcatatttcttttttctctgattagtgattaatgtgagaatttctagcctcttgagtgaatgttggccattacaatattaggtcccacgttgatcagacaatatatatttcttttttttaaggcatgtggcgttatatatatgcctcattgttaatcacccgttaattgatagaatgatttcactaatagtatataacctttttaacatagtaatatatgacttatatgcgtaaagatgttctaggttctcaatatgtgctactactatgcgcttaatttggtctggtaataagctgcaaggtgctgacggtggaacagtggcttgcatgttattgtattttatatacctttgtttaattcaaaaaattcaattgtattgcgtttattaacatttatgttatcaatcttcaccgtataattggttctaccacaatctaacagcttagattttttcttcgattgctatgataacttataatagaaaaaaatataggacgactaagccgttgtcttaataataaagatttgtacccctctagaacgactatgatgattttctaagttatcttaataatatacatagataaaaggaatatctggaaaagacaatttacatatttattgttggtattatgtttttactccaaatgttatttttacgtttattttggaatctatattttcaaagaaaaactttttaattgtattgcttagggtatgcacctatcttgctgtcgtgcacatgctatcgtgccttctggttgctgacgtgcatcaccgagtccgactcatcgcgcagccgcacggcttgacctgctgctgcggatttccgtcgctacctactagtatctatcttcagatcaacaaaacacgtctaaaatagggctatgcagtgctttgttgcttgctgcttcatttattgcctaattcatctaggtcctaaatctgtttagtttcggaaatcggacaactctgttgagtccgtttgcatgtttggtcctagtttgagattgattctaattcagcacgtgtacggtgctccttatctcttactttaacatgccggatttatgttaaatctcatatgttaaaatatagacctaacaatctaacggtgtaaataattcatattttctccgattaatatgagaatttctagcctccacagcgaacgtggtgtcttctttcaaggctgttttaataatataatagatagatagatagatatatgcttatctaaaaaactgtatgtaggaattaatgtgtcatttcacaatgtttaatacatatactaattaatttattaatttatacagtaccagtatagtaaactaaactaatcattgtctgttcgttctaggacctactgacaataatgagagtatatcacatccattcaggcaaataaacaattccatgacagggtaagctttaattaggttctcgtattaatttggttaaagcttttgaaagcatgagcttggttagacaaaaaaagccatcacatccattcaggaggtctagaaaaaaattaccacatcaattagggaaaaaaataaaatatttccaccacttaatcatcgtgttagattgttaaaatgttgcatacaaaattgtgtctgtgaaatctgaagataagaggttgtatatcaaataatgtaattattatactttctaagtccattataaatatacaagatacaattatgtaaataacaactaatacaccatccgttttttgaataattatcaactttgacaaaatcatttattttaaaatactcgtcaccacgactttcgttagtaaaattacaactttgcccctactctggatatttgtcaccgcctatttcatcgcaaatcttcaactaaattgttggcttgttctgcgtacaatgatcaaaatgtctatgagttaaggagagagagtactggtatatataatatcctattttacttttacaatttagctctgcaaaattggtcgattattgcacgggggaaaatacactaaccaactatttcttgttagataattaattagatcattgctgatccgtttttgtattatagtcaatgcaaacagaacagatggagttctctcacagactccagacctactagctgcaactaattaagccagcatgcacatatggacatgaactttatacaaagctgtagctgtctaataacgattgaagcaaccatattaatttgttaacgaaacatccaaccgtgcatctggaagcaacattcgtgtagtaccaccatttattgtgtggccaaggatcggtagtacggacgtcgccgatctgctactgtgtactgtatgtgttgtcattgaggtcatcgtcatagatcgatgcaaaattgcaaaccgcgcgatgcgtatagggacgatgagagggaaattaaagctagcgacaggggctgggggctatggcgaaatcgccgaaatgtgagtgttacccttcgaatcttcgatcgattttaaaccaaataaaaaaaaagaacacgtcaataataattaaccagctagctagctagacgggtttgcgtttgtgtcgtgctaaaagccacataattttgtcttgctaattattagctattagttgtatttattattagttatcacctgtattggagaatgtattggttgtgtatactcaagtattgatgcaaatgtgcaatattgaaatataaattcgtcgtcacgatgtgatttgatttagatatataccaaatgtacttgtgatccaccaagttgggcgatcatgggacaccaaggaggcaattgtattcacgggaagggatctgcctggctataaaaactggacaccttccgccccacttgatcaaggaaattggccggatgcaaaagtagctatcccgctgaaaaagatgggaaaaagggtttagtggccctacaagtactatctatgtggagattcacaaagggggtgtttagatttaggggtgtaaagttttagcgtatcacatcagatattatatagggtgtcgtatggcgtgtttaagtactaataaaaaaactaattacagaatccgtcagtaaaccacgagacgaatttattaagcctaattaatccatcatttgtaaatgtttactgtagcaacacactgtcaaacaatggagcaattaggcttaaaatattcgtctcgcaaattaatcataatctaagcaattagttattttttagtctatatttaatacttcatgtaggtgtttaaatgttcgatgtgatagggtgtaaagttttggtacgggatgtaaacagggccgaagtcaccataaacatctagaaaccttgctgtcgacggatatatcatttatcacttaaaaaattaattagtcgtaaatgcgtgtagctggtgataatgcaaaacatacatacattgatgtgccggtttggtctaaacgaatgctttcttcctccaccttttctaccttaaattgaagaaaaatttattgtcattgaggatgatgtaccatcatttgaattgaaaacagtataaaatcactctcaatggaatgttgcagggtgctggcaggggcggtgaacctgcgcggttggcaaggcgcgcggctgcaacagaacggcccatgcatgcaagggtccgtgcgattaagggcccattgccgatttggattaacttttggagaacaaggacgtacgttcctagctgaaagcacatggttagatggttgctacatatgttgactcattttaatatactttttaaaagtttgtttgttttgcaatgaaaataaacattgttgtacttttctataaacttagtcaaataaacttagtcaaatgtaaacaaatttgacttaagataattccaaacaaaatttatattatgaaaatagagggatggtatactttaattagggttgtacgcctgacgccaaaagaagttagagaaaacttaacactctgcactaggcgtacttgattcctgccaaatgttgctcctaattaaaccccatgcatgtatgcatgtgagctagccgcgaatactccataatccaggcatgcttaattaatatacgtgtgtactccaagtgcatgcataagccagatgtagctagctagcttagctctgatcgcttaattaatttgcaggcatgtaccctgaacaattttaaaaccgttgtgagagatcattagtgggggcaatggaatccacaggggttgtgcgtagcgatgcctccaaagccggcacccaactcgcaagattctcgctttgccaagttgatctcgctcgatcgttagcttgcttctgttttgatgggacttgagcctctctctctggaagaggccaatattgcaatgcaataattttttgaatggaattgaagagacgtaccaatgcaatgcaataattgttttgtctgctggagaaaacagcggaatgtaaccggccaaatactatacgtgcgtcgtcggcggcgctagctttgacgtggatgtctatacatgtgtgtgttgttcttctaagttctaaggttgcaaattaactagaatgcggctaattggccgatgcaaatggagggagttgatccttgaaaaaaataaaatacccctctaataccgagatttattctaaggatgtcatgataccatgcatgaagtaactcgattttaccttcgtgatactacatcaatatcgatcatttttaaaacccatgattatcgttgagtatcatcgtatattgataagtatcatcaagtatgtatggaccaatatcattgaatatcatcaagtattttatcgcgtgtatatcaacaagaatcattgagtatcatcaagcgtactatccagagatatcacgacatagtatcaagtattacattataccaatataataaatcaatatcatgatatctcaaggtaccatgatatgatattatatagtactatacgatacagaatgatagatcgatatattatggactggtacgacacctcgagataccatgatatggtaactcaaattatcattggtatcatcaagtattattggtttagtgataaatattattatggtatcataaatatttcatatgttggtaccaaagactcaaaaacaggctttcacgactaaaagaaataggcctgttcttttctccaataggagttggatgaaaattaagattttcgtggtacgttttttaaactgctaaatcgtgcatttcgtgtaaaaactttctatatgaaagttgctctaaaataacatattaatctatttttgaagtttgtaataatgaaaactcaatcaatcatgcgttaataccatctcgttttgcagaaaaaacttaatcttcatcttcatgaaaaaataacaccaccatactctatcacaaaatgacaaaatgacaaaggaaatagaaaaagtaatcatggacaatcagcaagcctcgacacactgtcgggccgcgacgtcaccttcgcgcggtgtttgctccgcctccgcgcgatgccgggctactgctacttcggcctctccaagcgtccgcccgaaccgtgtcaaataactgcgggctgcggcgctgtccctccgtctgcgtgatccgacaaccgcctgtccgcctcgcctccgtgcgtggccggacccgacccgacccgaccccgcccagctgccgcgtgttgcccggtggggacgcctcatctccagtccacggctcaacgtccacgcacacgcactgcgcagcgcgaggaggccgcgcgccgcatcacatacacgggccacggcctcacgggggggccttcccgtggctagcccacgtattcccctccttcctgggcctaagctagcgcccgtaagccaaatcgcggccggtttccgcggatctccccgtggacctcctcctccgtgtggtgtgatcgccagtaacgcccaggagcttcgagagaattccacaccattcccccctaccaccacgcggcgcatcatcacaatacacagcctctgcttcccccggcaacccaaccgattcgcgctcacgccacctgcaatccgcgaccagacgcgcgggccgttgagatcaacaaacacatcgcacgcgacgccgcgtgagcccgtacgatcgccccctcccgcgccgcgcctccgcactctggttggttgcctcgccggcgatgtcgacgcagtccatctcgcccgccgcggcggccgcgtccgcgcagtactcgtacccggctgccgcggcggcggcggtcccgtcctacttccccgtcccgttccacctccagaacgtgcagcagcccgccacctggccagcggcgcccgcggcgtacaacgccgtctaccccatgccccaagtccagcaggtaggaactctgcccctcttcttctgattacgttttcaaccgctcctttctgtgtgaattctactgcccgtttgttgatgcggtgatggcggattagggaggatctagactctgttgttttagaggcttggagtaatgccagtttggggataatgcgctatgtcatgtttgattcaactgaaaggctcatttggtctttcgtcatccacctttcatccttgggacaacacaatgtaaaagtggaatactcaatggaagccaattcatattgcactataccagtgtatcatatacagtttgtaggttgtgaaatctgtctgcagaatgatgcacagaaatctacatattcggctcatgttatgcaagatcttagatgctacgtcatgatttcatttctatagatgtagggaggcgtgccaatgtttatgttttctaactctgaattattaacatttgatgagagacttgttcagtgcaactgtaagttgtatttcagtgtaaatggaaaaggatgtagcttcataaatcaagaacctgatagtactaatttttattttggaaactagctgtaactagtctattatggtatcaccacgacgcaggttcagcaactgttccagaaagattcacagataatcactcctgaagctctagctactgtgaaagctgctattgcaaatagtgagaaagacaagaagattgaagcaaacaaaaaggcagtacctcgaaaggcagctgggcaatcttgggaggatccaactttggctgactggcccgaaagtaagatctctttctcactatttcttcctggtggttgtgttggaatgttgtggttctatgatctataaaatcttgaacttggcagtgtgactttcccctcgtctgaacttgtctgaatgtctgttatcctcacgtcaacaaaccatcaaacaccttcaattccccaggcaagatctaatgttcgatctatgtattctaataagacaaactttcccctgtttccttctgttaaaggtggccgaggatgtgatatgtagcccaacaggtttcagagttgatgcctgtctcgtggaattaggtgggctttgcagatgatatagtaaacatttcctgtgcctttgccattagtttacatgcattgtcatctcgtttttgcatgcctaatttgattatatgaatatgatatttgaaaatttttcatagagttatacagagaaatatgttctactgcgcattttggtgcaaactattccacttatattttttattctaatgttcctggtgtaattttgatgatacacttaccatcctaggattaatatggtgatagattcttgttggggactgtccaaataaagatcttcccttatatatattgttatcaacaaagcatgaacattattaaaaagttttgttccatatattagtgattgcataaaggatgaggcttttagccaatcaacttactttccacaataatctgattttatcaattcgtcatgttgcgttcctgttagtcaatataacatgtactgtagctcagctcttgcagattgtttgtcatccttatttttagatttttgtacaattaaatatattaactgtatttagcatttttagctacagttttctagttttacatgcttagctgacgtatcagataccactatttagttgtaatacttcatgatgtgtcatccatcatgtaacatgtctaagatgtagcagccttgctgagttgatgtataataatttagcagcagcatgcaatgttggcagcgttaaatacttatgatgctatattgtctttggaatttactagcacctgacatgagtatgtatttgtgctgtcatgtttcgtcataatttgatagaagcaaatatattattctactttagtctgtagcaatgaccaaaaatggtgctataacagttgtttttctcaaatgtgccctctttttatttcaaagcattcacacttacatctgacaaattttccccatccacagatgattttcggttgttttgtggcgatcttggaaacgaagtgaacgatgatgttcttacaaaggcattttcaaaatatccatccttcaacatggctagggtgagtcacaccgtatatagcatggcaagcttttagattcttcattataatacctttttgctgcttcaagatgactgttaataatggacgtcttctgcttcaggttattagggacaaatggactggtaaaactaggggctatgcctttgttagttttgctaatgcgtcggatcttgctgcagcattgaaagagatgaatggtataagttcatgcccccattccctgtcaccatttgcctggattatcgtcgcactgcagatatgattaacacatctaacatcatgcaggtaaatatgttggaaacaggccaatcaaactacgcaagagcacatggaagaacagaatcgactacgaggcattacagaagccgaaggttggttcccattgttatcttgtaagacttcctctttctcttgcagaagtgttcatttaactgatttgttttatgcgtgcagactcaaccacagaagaagttcaaagcgcagaaaaaaagcattctacacaagtgaagtaaattcactctctagagagtgatccctagtgtcatgttgcacatgagtcctttgttgctcctgcaataaacgacgttaaagccttcagcgcccggcggtgcgcttgtcacgtttggcctagtgattgttctagggtagtatggctcgt

SEQ ID NO: 63901 - DNA, 1406 bp, Oryza sativa
attaatcttctttaattgtttttctcctgactaaaacaaaacgtctcgtgcacatgggcgtgtcaaaaacaccagcttatgtctgtacttttaatggagtgtaagttttaattagtcaattatatcaaaatcgtagaactacgctgagaacactttggacgtctccatagttagatgcataacgtcaaaacatacggcatacttacaaataaattttataatcaaagaaggtacaaagaatgttaacaatagactatatgttgtgtttaagatgagaggagaagatcgagaagaatacgcaaaacaatgtaaatattactacatgattattgagtattaactattttaaatttaaaaaaaataaattaatatgattatttaaaataacttttctatataaatattttatgaaaaacgtaccatttaactgcttgggaagcatgcacgcacacaacgaaagagtttttcttctaatccacagcgccgaacccagactaaatcatcaacgtttctgggtaaaatactccctaaccctctgctccaaaggttaacacagccataaagagtccatgaagagtcattgagtgcaaatgttggacacgagatgttacaactttgataccttttcttcctagcaagaaaaatatataaatgatttttttttctgaaacaaagttttaaactctgttactaatctggacaatcaacaattgggccgtcaggaaaaaatggatgcgagaatggaagaaacggaaccgagatatttctagagaatcatatcacattgactaattcgttcaaagaaaaaaagaactctgaagccagtagctgctaatttgattaggtgaagcatggtgaagaagttgataggtgaagcgagggaagcaaacaaggacgaaggagatgaggtgaggatggtgatggaatatattggatgcatcttgcacgatttcttgtgagtgacacttgttgtgatgtgtgctttgtttccatgtgggaatctaatgcggccacagaaacggccaccggcattttggcctaccggagcagatattgcgtggcacgcttgatgatgcagtacttatttcaagaccaggaaattttgcacgtacctgcctattagtaaaaattgtgtgtattatgataaagaatattatctttacttccaaatcttctgatagaacatttccctccccaactatctgttaatgcaatatcagtcatcaaatatgtgtcactacataatatttatataggtatatcttttagttcaaagagtataattcctcctgttaaggggaatttaactatttgccacttttaggtttgccacttatctaaatgctcctcttaggcttgcgcttaataatttaccactgaagagatgatttcttaactatttgcca

SEQ ID NO: 63902 - DNA, 1847 bp, Oryza sativa
tcaccggtaccctaactgaagaacaaattcagagtaaatgactctgtctcagcctctcaggatgaacagttaactgatctagccacagagagcaatcaattcttggctctgttcttagctagatctcgtgaaatccaggacttggggagttcagggtaaagaaaacggcagatgttttttcagcaatttcagctgaagcagagtagaagcagcagctagtataccttgggcggaggagggattggttggcgtgggagtaggcgaggtggccaaggtcgccgagctgcagggacacggccggctcggcggcggcgaggaagcggccgaccagctccgacgcccgcgtcttgggcgacggcgtccggctgccggcggccaccagctccgccggcacctccaccaccgcgccgctgaacacagccaacatcctctactctactgtactgtctgtctaatcaaagctaattaagatcactacacacaaactatgaaactactccaatttaatccaatcctactgctaaaactctcctctgctaatgatcagattagcatagataaaaaaaaaatacgtgtggcgttccacactccttggatggatagatggatggagcaagaaacggagctcacactggatggatggagaaatggaggaggagaagctgctttatatagccacaaacccaagcaatggagctctgtttacgtgggggccgcactgacgttttcttgtgtgttaacctccgattaatcttctttaattgtttttctcctgactaaaacaaaacgtctcgtgcacatgggcgtgtcaaaaacaccagcttatgtctgtacttttaatggagtgtaagttttaattagtcaattatatcaaaatcgtagaactacgctgagaacactttggacgtctccatagttagatgcataacgtcaaaacatacggcatacttacaaataaattttataatcaaagaaggtacaaagaatgttaacaatagactatatgttgtgtttaagatgagaggagaagatcgagaagaatacgcaaaacaatgtaaatattactacatgattattgagtattaactattttaaatttaaaaaaaataaattaatatgattatttaaaataacttttctatataaatattttatgaaaaacgtaccatttaactgcttgggaagcatgcacgcacacaacgaaagagtttttcttctaatccacagctgccgaacccagactaaatcatcaacgtttctgggtaaaatactccctaaccctctgctccaaaggttaacacagccataaagagtccatgaagagtcattgagtgcaaatgttggacacgagatgttacaactttgataccttttcttcctagcaagaaaaatatataaatgatttttttttctgaaacaaagttttaaactctgttactaatctggacaatcaacaattgggccgtcaggaaaaaatggatgcgagaatggaagaaacggaaccgagatatttctagagaatcatatcacattgactaattcgttcaaagaaaaaaagaactctgaagccagtagctgctaatttgattaggtgaagcatggtgaagaagttgataggtgaagcgagggaagcaaacaaggacgaaggagatgaggtgaggatggtgatggaatatattggatgcatcttgcacgatttcttgtgagtgacacttgttgtgatgtgtgctttgtttccatgtgggaatctaatgcggccacagaaacggccaccggcattttggcctaccggagcagatattgcgtggcacgcttgatgatgcagtacttatttcaagaccaggaaa

SEQ ID NO: 63903 - DNA, 3704 bp, Oryza sativa
attttcaaaattttgataatttcggtaaccctggcataaaattcaatttcgaaattttaaaccctgcccgtggaacgggcacgggcgaggtgtctttggatgcccaaagcgtctccatgaaatacgtcgtcggaattccatatctttagtttcaactcggagaataatatttgcagtagaaatataaatgggttaattcatgaataatttactattaaaagtttgatatctgtattatttacgactttagaagttaatataaaaaataaactgcaatataaaacctcaaaatcaactttaattcataataaattgaggcgaaaaggacctcaaaagcagctgataaagtcataatttcttttgaaataatacaactttaatgaaaaattgtaaaaagtatatggtgattgtttgaaatcacaaatttaacaccatatcgaacaaatcgttgttcaatagggtttaaacaaatcgagaacttgggatgtgcgtacatgcatgtgagtgggttgtggggcctatcgaactttgggagtttgataggccaccccatatgcttgctatttttttttaatcaagtcaactatactgtcgaacggccgttgttcgacacgtatatctgtaaaattttacaatggttgtttgataggtatcttatcaaattacggttgttcaacacggtgctaaatttgggatttatatcgatcaatatctattttcacaattttcattaaagttgtattattttttttgaaaaaacattcgataaagtcaacaggtaaataatgaaatgcttctaatatcccgtaggctcgtagcaaaagagatgtcggagaattttacctcatcgtctttctatcgtggcgaatttacagtggattttgttgagtttactaccttattatgaaaatcttgataatgtaaaaactccaaatgtttctattacaaatatatttaacaaaatatacatgctgtttaaaaccggattcttccgccctctccggtctccaccccatgtcgcatctaggtcgcacgaagagcaaccaccagctcccaaaaagaccagaaaaagagcagttcactagaaaaaaaaatgtatatatggactcgtatagcctatcctcgatcgtatgagcccgttgcaaggtttgacggcaagtcaacacattgatccggaaatatattttttcttttaggcaaaccagaaatttcattactcatgatccgagatatcctcagcgacctaaagactgatacaaactcgggggctgttcagattatagccaaaataaacttatcaaattttgacattagtaagttgacaatattgcaagttttggcagaatagccactattgtatagttgcctaattccttatgtatttaccaaagttgggtaaaaaactaaatgtacacacatctttgacaactttataaaaaaaagagtatgatttgaaatagcattaatctagacaacccctgactatgctatgtaaagtgccaatactttggtatggctttcaaaccaaaaactccatacaaaccaacttcacaaatatgacgcagatgtcaaccacaataatgcagagaatgcaagcaaacaaaaaagaaagccaatagacgatcgggcgctatacatttttgtttggaatatcagaaaaattgtttcaggtattcagtaggaatttattttcttccagatggggtttgaccgataaatacatttgtgtttacttaaaagaagacaagcacatttctgagacgttagagatctacgatgggcctgttcactttgttgccaaaaaaaaccttaccaaaattttggcaagatttcttatatagttatcaaaatttggtagcaaactaaatgtagccacttttttagcaacattactaaaatttggtaagtttgaaaatggcatcaaagtgaacaagcccgataaacagagcaaccgatcaagaatgacgctagcactatataggatagtaggactataggtggtagtagaacaggcttcaaaagctccaaatcttccaaggaacacacataatgcaaaagtacaagagccagcaacagcgagaatgaaatctgaatcacaaaccagatgtcccaacacaatgacatatcctaacaattagatgagggcaactgcaactaatagactatcacattctgtcagattctgctaaattgtccttagtcttgcctagtttctccccccaaaattaaaccgcagacctaatggattagaatagagcccataatttgtcatcgcacatggcaaagattaacagccatgccctacaaaatgtgtcagggatgggggtgacaaaagatgatagctcaatagctgatgctactcctgaggagttaagcagacattgatgtcaggtgaaggcctgtgccccatggactgtgagctgactggccacccaaccatggtgaaacctgtggagcttgagctgttaaggttcatggcgccactggctgttgcactgtgctccattacaccggtgtgggcttgcggatgcatagatgagacctgcggcgcatggcaaccattagttccaggagctgcctgagagataggcattgcagctgtgagcacaggaggtggagccataggcggtggtagtgccggggcagcagatgttgctgttgtaggcccatcctcctctgatgctgctttaggctgttgggcaggaagctccccacaatcacctgtccaagaggtttgtgttagtgaacagggaaaaatggtatttgcgtttaacaatggcaatgagacaagaggagatcaatgttttatgtcttgttgagttaattgttgagtgtattggttgatttggtagaagatgcccagttctctttttacctgaatagggcttgcggcacgcagcatcccagctactacaccaccaacgacacggccatcaggaccggcaagcgatacactgagcccaccagttctcctccgaccaccttcttccgccattgtaaaggagccagtcagttgcagaatctcaaaccgaccctgacaatcagataaacgagatgatttagtcttaagagtttgaaaatgagcaccgtaaatacaaactcatatgcaggatatatgacgacttctcttaaattgttatcctacactcatacggccatccaaatgaaactttttgtctcttatgcttgcagttatatatatggagttatggtcttatggatgggacaccttaacccttagcacacatcccatgctagttgctgactgtttccaggatgatgttcctgagcctcatgtacaactttcagtcatgcataatatgcgataacacaaactgcccaaaatcaatgtgagctatcatggatggagcgaaaaatggtaaagtcatttaagcagagtattaccgacttttagtgacgaaaccttcaagagcatcttacatgaggtagctaagacttaagactcagataattgagatgaaacagatgaaatgtcaaaatataccccctcatagaacatttaggcaagaaaaccatttgtcgtatttactccgttatttattacagtggtgatatgggacctaaaagacttggtagagaagaccccaaactaaatagaccaaaatggttcagcttattcaggactttgtacatacccatcaaaagttaacaaaagcgggtaccgagctcgaattcgccctata

SEQ ID NO: 63904 - DNA, 4211 bp, Oryza sativa
ttcaggtgtgctccgctaaatgttctgctataaattatttaattcttgaatgtttatcaaagcaagactttttcacaacttgcttgtgtattgttatattgatgtgcatgcaatgcacttttgatcccgacaaatttatttaatgttgtgagacattgagtttgtttttaggatcaactcaagtacttgatattattgttcagtgcaaaacatgaattaaacataatattttgtttaatcattttccataatctccaggaaatttgcaaggaactacaagattcttcacctgcgaaaggtttttgcaaagatgaacatccttcaaagaatgattgcatttctgagctgcttagcagtgccatacaggatcatttgaagaattttgataggcaataccgtttaacagttaagaaatcatctctctccgggagcaaataattaagcgcaaacctaagaggggcatttggataaataacaaacctaaaaatggtaaatagttaaattcctccctattaatgccaaagtatacctctaccttccacaaaccgaaaattattcctcactcaaaccgcaaaaatgattcaaataatctaggggcaacagcaaatttaccacgatttgaatcgtcattaggaaattatgaccggaattgtcattcgaatggcattcttgtaaaataaaaaaaaagatcaaaaaatttgcaaattccccaataatctatgcagcatctcatgaccagatctgctgattgagcaatcgcaaaataagcggaggagaatccacctccacaagctgataagtggacagcatgaactacgacactgttgtagtgttgtagagaaaacgactgacgtagcaccccaaattcgtccacaccattaaacatccctttagttcgtaatgatctgtcttaaaattgacttgcactaaaacatctaattccccattcccgtcgggtacgctcaattatgcacaaaaagaatttgcaagaaacgaaatgatatttttttggtcactcagggaatcaagaatccagcaccatacatgtcgctttggtacgttagagaagaaaacaagtggataatcaattaactcagttagatgattaattggatgacaaagggatgagtcatcgactcatcgttaattacgtcttcagagaataatattttcctctgagcggacgagaaaagtcgagtatctgctctgagccgagccaattttgttgaatttaggacttaatttcataaagtcaccagcccatgcattacacagattatctaggttgtgatagcacgatccacctaatcaacaattaattctttctggttaacacataagctctttcagagtgtctaattaatataggtgtagatagatttagaggtcttattaattaatgtaagcttttttttcagtcttagcccaatgaatttcttaaccaaacataattcgagaaacgcctaggggttttctggctagctacacaagatagtgagctagataatctgggttcgaagcataacttcatctaattatttgatattaggtcattccttaatattcatgtcttttaaccatacataattcttccggaaaataatgtatgcagtcttcttgttgccaaactgatctgcattgtatagtgcttgttcttcgttaccaaaaattaccattcctcgagcgtgtacaaaatttaaatatcaaaaatgtttatatttgggaatggaaagagtagctaagttgaactaattttcattttaggtacattattgattaacctacatactatgttacacctttcattaaaccattttgaatatccaatccaaatataaaaagaacataaagataatagaagttttagaactttccaccggacatgctacgtttgtattttattcagtttatttgtctgtatgcacaaaagcaacactccattattttggactcaagttaatagtctaattcgaattatgtgcattaaaatatcgaacttacgcaagccatgacatatgttgatagtcccatgtataaacaagtaaaagaataaaagaaaacccagtttgctatatcgtgtgacaccctacgtagtacacaatacaccatatgctcattgctaaaaaagaagaatatcctagagtccaaggagtaaggaatcattggcaagtcactctccttgcaatacaaaatggaaaggaaaacaaaacgaacacaagtggctaacatttttgcgaagagcttgacatggtgacacaataggaggagaacgatgaagcatttgacaaattgttttgctaaaaccatttgacgtttcagtttgttttacacaaatacaagaaaataaaatgaaactcacatttatactaaatcagtcctttcatataggctgattttttaaaaaaaactttttagagacataaaaaaccctcatatacaaaaatgagccttgtggggctgtggcacagctaaaactctgacattgattgctcagcagggcaaaaccttgttgtgcaattatgccaattaacaatgtcgtcttaaaggaaaacaaaaacaaaaaagaaaaggaggaagaaagataaaaagttgtacgcaatttattgtcaaatcgatattatggaaataagactgaggtggtgtttggatccagggatttaactttagtctctgtatttagacactaatttagagtattaaatatagactacttacaaaactaattacataaatgaaagctaatttgcgagacaaaatttttaagcctaattaatatataattagagaatgtttactgtagcattataaaggctaatcatggattaattaggctcaatagattcgtctcgtgaattagtccaagattatttatgggttttattaatagtctacgtttaatatttataattagtgacaaatatccgatgtgataaggacttaaaagttttagtcccatctaaacagggtctcagtgagtcagtattagtctatgtaaatgcacattagttgtgcagtcagcttctgcagtagcaagctgggtggctgcaacttcaacctcatctttgaattgaatggaacggcttaattatcatggtcccggataaggttcatctgtaaaatatgaaaaaataagtcattcttttgcattctatttatctcttcggtcttgttgcaaacccttaccttttgttttgatcttttttttatatatagttgtgtgtggcttagttgaatccgttccgagtagtgaagtactgaccaaaatatccttgtttaattgttgcaaaaccaatgggcgcccacaggattagataagacttaagacccacggatttgctgatttttctgcacgacctgtggactgcagagagaatctagccatgtgattcagtgctaatgggattcttctttagttcttccaaattgtgttccaagagtttaatttgtggtatggatacattgtaaagggatcaaatggggacttgtcaactttagttaaaattctgattaaaagtggctggcctttgcatctccaacatggtcagcacaagtctgctgttcttctcctctaggatattttttatcagaccttgtgtttatcacatccttttctgtatattttttcttctaaatatgttatgctagtactactagtagtaatttgtgaaaaggaatcaaacattattgttttcaccctttccctttcatgagaatgacagccactgaaattatcctacaactaattaatacaacatcagtttatctaagctaaaattatgcaaacatagcagctgcaagttggcaagaggcatacctaaagttactgcactacattatttcaatggccatcgcctcgaaagcgattgcctggatcaggggaagcacaaagaattactactagaaaagcaagcaagcaagcaaagaatcttggctttgtaatttgccaacccacacggtgccaatgaatctagtacacttttcagcgtgtcaattcatcaaataatccaagttgcagtattgctttgggcatataattataccaattcatgttaatgtgaatctttggtttcgttcttaatacgaattggaagcatctcgaaggaacagttcaggaatggtttgtgcccacagtttcgaaaccaaagtctccccaaccagacaaggtttcagctggtaaatttcttcagagcatttctaattggataccacca

SEQ ID NO: 63905 - DNA, 992 bp, Oryza sativa
aacagcagcactcgatgatttgggactcaaggacatagtctaattcgaattatgtgcacacaaatggagaacttacactagccatgacatacgtaagctagtcctatgtataaacacgtatagactagaagataacccaggctgctatatcgcgtgacaccctacgtaggacacaatacaccatatgcgtcatcgctcgaaaagaagaatatcctatagtccaacgaacaaggaatcataggcaagtcactctccttgcgatacaaagaggacaggaaaacaaagctaacagcagtggctaacattttagcgaagagcttgacatggtgacacaataggaggagaacgatgaagcatgtgacaaatcgttttgctaaaaccatttgacgtttcagtttgttttacacaaatccaagaaaataaaatgaaactcccgtttatactaaatcagtcctttcatataggctgattttttaaaaaaaactttttagagacataaaaacccctcatatacaaaaatgagccttgtggggctgtggcacagctaaaactctgacattgattgctcagcagggcaaaaccttgttgtgcaattatgccaattaacaatgtcgtcttaaaggaaacccaatacaaaaaagaaaaggaggaagaaagatataaagttgtacgcaatttattgtcaaatcgatattatggaaataagactgaggtggtgtttggatccagggatttaactttagtctctgtatttagacactaatttagagtattaaatatagactacgtacagaactaattacatcaatgacagctgatttgcgagacaaaatttttaagcctaattaatatataattagagaatgtctactgtagcattataaaggctaatcatggattaattaggctcaatagattcgtctcgtgaattagtccaagattatttatgggttttattaatagtatacgtttaacattgatcattagtgaca

SEQ ID NO: 63906 - DNA, 4395 bp, Oryza sativa
gtgaagtttacacatggtcagaccagatggaacgctatcgtcaactacgaacagtggctagtgaagcttttttccgatgttccatgacagaagaaagtacactgaaggtgatgaaaatgctagataatttgatgcttgaagatgactgtagtgcaaattgtgacaactttgagattcagtttggtcatgtggttcgtcaaagtatgcgcactgacattgaaagtagtgagaaagtgcttgatccagaactagttgtccctaaaggagctcctacaaagagaatgagaggtttcttggagaaacgcaagaggaaatgtgggttttgtcgtttgacgggacatacaataagaacttgccctgtttacctaaggcaagttgtcctatttgttattaacctcttcataaagctaatattgttttattcactgaaattgtaatgttactttgaacatagtactttcagtccacgaagacataagacgtcttgagtctgaacatggcaaactacatgaagcgtctacatctcaagttaccaataggatttagggacttatattgcaacactgtgtctacatctcaatttttctttccaaccatgtctttgaatctatcggttctgattgtcccaactgtatgaactattttgacaatttcaatctatcaccaccgatttattgggggaaatatataatacccatacaatgaataaaaaaccacaaaaagcaaccaattaacacacaccttatggatcagttttctccctcactctgcatgttgtgccacgcatcgaggccgctgcccgcagtggccgacgattcaccgtcgccgccgacgatgcagccccggccgcccgccgtcaccgacgaatcatagcttcaaccattgccgggctcccgccgacgaatcgccgccgccaacgatgcagcgccgcctacgcatcgaggccgctgcccgcagtcggcgacgattcgccgccgccaccgccgatgcagcgccgccgttgcatccagaaaagtcgcgtccgctgtcgccgacgaatcaccaccgccaccgatccagcgccgccgacgccggccgtagccgtcgaatcgccaaggcttcccgatttgggccgccatcgctcgcccttggcatttagggtttgtttgtctcctgctcctgcccgacgaatacgaggctctattctctcgcgatacagagaaggaaacagataacgcgaaagtacaaaactaccctcccacacacggtactgttgtgatacgtacgtgcggtacgacgaggtaccatcgattttggaccgtccgatgaggccagatcaatggtcaggatttggtaaggatgggaaagatgctcttataattgagggtcgaaaactaaattaaaccaatccccaaaaaaaaaggtgccatctaatcctcagcaaccacaattctagctggagatcggttaagttcagttgcaatttttggacgccgaagccaattcaaccagagttaactgctaaatggcattcccaattgtgagaaaaatattatactgctagtttccatcacacgatgaatgggagattctccagagtatcactcgcatccgccactaataattctctaccaaattacagacaacgggagatacatttcagaaagggcgatagaatttacttacgcgtgggcgcgcgcggcggtatcctgctcagggaagtggtcctcgatggcagccgtagccggtgagctcgagctcggacggcggcgccggcgatgggagtccttgacgtttgtgcccaagttgccaacccacgtagaagatcacttccccttagatcaatacaggggtagctccggcggagactgcaggcggcggaggcggcggtgatggaacgggccggactgggtcaactgataccagtagtttaatcgaagcccaacatggccacgtgcgtgattacaggctactggcccagaacatattgggcttcaagcccagtacacgttggtgtctttctaggataaaagaagtaaagaaggaataagtttatttgtcatccctcaactttacgtcgagtttgattgacatccctcagcggtgattttgcttcacatgttcttccgaagcaccgcaaatgtccccaaatactgcaatacattgctaccctgcataggacatcgcaaagcagggcattgcaaagtaaacttacatctacaaatattcctcagtaaaacggcattgtatttgtagatgtaagactaggctaaaaacaatggcaagactaggttaaaagaaaaaaaaaactcctgtcttttgatcgggaaacaatagggtggtaagcactgaaaacctgatcactgatcatgatgccctctgtgaccctgttcgttcgtccatcttgctcccgacagctttgtattaaaactgtaaccctgtgtcgttcgtcctttgttcttcttttccatggcgcgtcgcatgatcaccgtagctgcatttggctttagcttacccagctagcatctgttacaactttctctgaatatataccatatcctctttgcctctttgcagcatatgctctgcttcatcatctttttccgctgtaattaacctgaagaaacgtggctggagatgatgcagacacgctggtttcatctagaagtacgcacccagccagaaacgaaatctgaacaaacagcagctgccagtctgccactgcacggtagcagtgtgtgacagtgtgatggatactgtcgtgcatactgatgcggtgcaaagcgaaatgcaggattccatttagcaatgatcgccactgcattgctcctctcgccatattctgtcgcccggttgccggacacccacaactgtactcactccgttaaaaaaaaacgaatataatattagatatgacatattatcatagtaaaataaatctaaacatgttatatctggttctagattgattttatagaacgaaggggtacgtatcagtagcatttttttattaagatatagagtacatattttatcttagtttctattaacatgcttttaacatgttaaacgatgtttttttataaaaaactttttatatagaaattacttaaaaaatatcaaatctattttttaaatttataataattaaacctcaattaattactctcttcgtctcaatatataaatatttttagcatagtgtcaagttaaacatttttaactttgactattaatagaaaaaaaataaaaagatcaatcatttaaaattgatgttacatgatttatcattaaacaaactatgataatatgcaactcttttaatttaaaacatcttatttttacaggtattgttggtcaaagtactatctcgaagactatattgaagtctaaaaatacttctattttaggatggaggaagtatatgtcaatgaatttctcgttttgaatgtgctgtctttatcttcattttaacatatctcaaagatagcatctctgaactagcatcatctcattactcttcctataaattggttgccaaaactcaaatttagagttgatgtttgggagttcttattttccatgtggcttacttttcggtgttaactcaattttaaactacgaataacacaggttaaaactttttatttgtttgttcatatgtcattttacagtttatctgttgtagactgaagaatatttttaagttttatccacaaattattattattttattgcttatatgcagttttacggcctgtcagcggtagaccggaagaacaaatcttactagtaaaaagaattcataaatacaactcaccactgagcaacatgtttcaaagttcataggaattttgcggggttacatgctcgaaaagtccaaatgggcctaaaatatttgtatatactagtatagcactatggagatactcgttaataagttcttttttggtgagacagtcaccaaccaggcaagtgaccacgttcagacaaagtcagatacgcgcagcaataatttactcccgtccggggggacacgcacccggcaactatttggcgcgacagcgcggcgcccgcgtgcgcgccatgccagttcggttcgccgccgtcccgcgtcccccaccacgtgcgccggcaatggcggcttcctccctagctttgcacgttcatccatggcagcttcctccattgggatagcctgtcttgtcttgtctagtagtactccacgggtgtgccggggcagctgtcgtcgtcgtatgacatgtcagcgttcgcggcggcggcgttcgcggcggtggcggtggcaactctgaacggcgggggaacgtacggaggcgtggcgcaacggaggagcgcccagttgacgccgctgaagaaggggtgccgcttgatcaccgcggcgccgacggtggcgcc

SEQ ID NO: 63907 - DNA, 14159 bp, Oryza sativa
atgaacataataacctaagtactgtactgtgatgtgtgtattattacatcactggagcaagtatacactagcaggttgtaaacaaactctaaaacgtgtgaaagagataagagagtagagagaaaaaaaatagagaggagattataggctttgtttagatccaaagtttagatccaaacttcagtccttttccatcacatcaacctgtcatatacacacaacttttcagtcacatcatcttcaatttcaattaaaatttaaactttgcgctgaactaaacataaacacagccatagtcgtaccaatgtgcgacttataatacactagtttaaatgctaggctcaggtcaggtactagtataaagatagtgatgcgatggagtagtactataaagaaaagtagggttgtcctcgccccaaaaataaatggtagagttaggtaaaaaaaataactcccactcccccaatatataagtatttttatcatagtgacaagtcatctattttcaactttaattattaatattaaaaaattaaaaaaaccaatcatgtaatattgatgttactaggtttattattaaactattataatatgtaactcttcttatttaatacatcttatttttatagatattattgttccaaatagtatttcgaacatcgtattaaagtttaaaaatatttatatttttaaaatggagggagtactactatccattagagccgcatgttttggacgcgcagcgcctcgtcttggcgcaggccatagcgcctccgcatgcggcgcatcgcggtatgccggtatgatgtcaatgatggcagctaccgtgcccgtgcgccagcgagcgtggcactggcacacacacatgacattggagctgcagatcttttggcgcgagcgcaacgtgcagccgtgcaccaagtctgagcttctagaatgagccttgtccttctctcgctgcatgattaaccttgtactataccattgccaaagctgcagtgatgatgaggtggcggttggtgtccacaagaccacaagttcagtgtggatcatgtgcacacaacgaatttaggaattgcataatcgttaaagctgaatctgaacaggtgaatgcgccttgatgcccagaccaaactttctgctgagtcaggcaacacacagggacagcgacagtagtagttttttttcccccaaacgacgtcgatgtgcatgtcctctctgatagtgccagctacagatatttgaaaataaacttatacagtaatcaatatcacatttcaaacgacgtccaatactgtattactcccttcgtttcttactataaatcgtttaacattttgaatataaaacaaatattatattaaatatatttaatgttaaatttaaaaaattaatttgtgttatacagtacatgttactattttttataaacttagttaaacttaaaaataattagtatatcagataagtcaaacgaattatcaaatgaaacaaaggagtactaaagaaaaatgtaacaaacctgaccttcctgcagattgacgagagctcagagaacccgcactggcgagcgatcgggtacagcccgccgaccgacgaaccgccggcggaggagcacaccgaggcgacgaagcggccactcgacgacggcgtggtcgagaccatcaacctcacggacgcgtccctcccgtcgtccctcgcggagaaaggcctcgcggtgaccgatgacgcggcgcgcaacgtgtgccgggtggagtgcgacgtcgccatcgtcggctccggctgcggcgggggcgtggcggccgcggtgctcgccggggccggccacaaggtggtggtcatcgagaagggcaactacttcacgtcgcgggactacacgtccttcgagggcccgtcgatcaaccagctctacgagtccggtgggttcgtcaccacgatgaacggcggcgggctgctcctggccggctccacggtcggcggcggctcggcggtgaactggtcggcctgcctcaagacgcccgagttcgtgcgcagggagtgggcggccgcgcacgggctcccgctgttcgccacccccgactacgccgccgccatggacaaggtgttcgagcggctcggcgtgacgtcggggtgtacggaggaagggctccagaacaaggtcctccgcaaggggtgcgagaagctgggctacaaggtcgacgcggtggcgaggaactcgtcggagggacactactgcggcagctgcggtttcggctgccgcaccggggacaagcgcggcacggacacgacgtggctggtcgacgcggtgggccgcggcgcggtgatcctgacggggtgcaaggcggagaagctggtgctggaacgcggcggggcgaggggcaggcggtgcgtcggcgtggtggccaggagcaccaacccggcgatcacgaagacgctggaggtgcgcgccaaggtgaccgtgtcggcggccggctcgctcctcacgcccgtgctgctgcagcggagcgggctcaccaacccgcacatcggcaagaacctccacctccacccgaccgccctggcgtggggctacttcccggacacgatgccggacctgaaggggaaggcgtacgagggcggcatcatcacgtcgatgcacaaggtggagacctccggcgccggcgcgccgcaccgtgccatcctcgagacgccgatgatggccgtggccgccacggggacgcagatgccctggctgtccgggcgagactcgaaggagcggatgctccggttcgcccggacggtgcacatcttctccctggtcagggaccgcgggtcggggacggtgcacggcgagcggcgtgtcgcgtaccgcctcgacgcggcggacagggaggacatccgcgacggcttgcggcgcgcgctgcgggtcctcgtcgcggcgggcgcggcggaggtgggcacgcaccggagcgacgggcagcggctgcggtgcgaggggctgaccgaggaggcgctggaggagttcctcgacggcgtcaccgtggtgcgcgggccgcagtcgaggagcgagacgtggggcctcttctgctcggcgcaccacatgggcagctgccggatgggcgccacggcgggcgacggcgccgtcgacgcccgcggcgagagctgggaggcggagcggctgtacgtgtgcgacggcagcgtgctgcccaccgcggtgggcgtcaaccccatgatcaccatacagtccgtagcgtattgccttgcaaatggcatcgccgactccctgtccgctaaaacgacttaattagctcctatcgtatcttctactacaaaattcatccattccagtccattccagaacatcacagcttgcaaattcgattagtacgttttagcgtatatgattgttacgaggaccagaataatgtgcatgattcttgtcgtgtgaagttatggattatctgtaattatctctataaaaaggaaaaaataaacaccgcaatgaaaatgcttcctgcatactttattcagtctagaattcgtcgctcttgcacatatcttttcattacattagagatgcacagtactcacaataagtactagttaaattgagcacagttggagaatagagtgaccgtcgacccaggatgtagagggacgtggaacgaacctgcgctgcactgcacatatgctatcagaaacaaattaaaccatgcgtgtgtgtttaaatgtgttgatggcgcacgggcattttcgaccgggagatatggcaatgctcttgactcagcatttcagaagaggcgtcaacgccagaacattcatgcatgaagcgacaggtgctgtgcaagcagcagttgagtgctccgtctttagccaccactttgcctacccggatggtattgccctccatattactgctgcatacgtctattgataggtgatgccattaatttttaatatatgtttaatcatttatcttatttaaaaatttcatataaatacgtaagacataaatattagtaagaaatttttagtgataaaacaactcataataaaataaatgatagttatatgttttttttaaataagatgaacgattaaatatatttaaaagtcaacagtgtcatcaattaaaaatgtgaagatgacactgctagtttggctcgtggtttcggctatactcaattgtcaactttgctttgtaaaagtttagtggtttcctcttttgtcacaggtgggacgtggatgggatgatactgcaccagtgtaacgatgttatgatagcattaatgtgcatttccaaagaaaaaaaagttggagtgaattaggagcttccgtttcgaaaattctcttcgtgacttcgcgacgaacttgtcatttaatgctgatatttgcacacgtaggtgcaatatttttcatcgaaataaaaaaaagcatcaaaataatcagtaattctatgtgtttaatctagcattgctgcagatgtgcagtattaggcaaaagaacacgacaggatgtgcattgcccttccataattccatttggtcagcatcatatcttctcagtagtttacatcaaaattcatgattattccttcatgattctaacagctattcccagtagtagtttacatcaaaattcatgattattcattcatgattctaacagctattcgtactagtttacatcaaaacagtgcaacacaaatgacatttcactacgagcgccgaatacaagttggtgatggcgaaagaatttagtactagccttcaagttacaatgaatctacaactgtactgtaggcaaatacatttgttagatgcctgggcctctacatcaactttagtcctagcttatccgagtcctctattgtcgaatgtcaactgcataattgaatgaagaagctcaagtaccaaattttagggaaatgcacacccaaaccgttcagataatcgatcaattttgttcacgatcaggcataataaaattacgcagaagcaaatttaagaaaaatgcacaccgcaaacagtccagataactgatcaattttgttcacgatcgcgagaggaaggcgtaataaatcaaagtatgccaaactacgggcacaagccacacaggtgctctgtgacatatgtaatacaaagtgactacaccttcagcttgatttccggcacaatgtagtgcacagttcagcatcaaaagaagggttagttggcatcatagcattagctagcgtccaataccatttcagtattagaacagaacaatatgatcataacacgtcatcataacctatagccaagatgttacagactttacaatcagttatcgcgcatatgcaaagtgtaaagccgtactctcttgctcaaggcaaaaacagataaactccactttaactttggcaaaaagaagtggttgctcagtttggtgccgacagaggtttattaacagtagaccaaaatgtttctaggggaaatcaagccaaaataattccacttcaaaaggatttggggttcccaacttcagacccctgaaatatgtcatgagcaccgctcatcttgtgccagcaaaaaataaacttgatgttggtatactacaaatagttaattatttgacagatgcttttacagctttctcagccgcatcatcaagatcctctgcagtgattaaggtcattccactttcctgcaacaggacatcacagtcaggtacgaaagtttccagtgaaggacgacttggcagatattcctacaaaaaaagaatgcatgcaagtaatttttacctttagaatcctcttcccttggtcaacattggtgccttccaaccgaacaacaacaggcaccttcaggtcaacctggcggtcaagagaatgattcaatacagtgcaggaaagttttatattgtacattaaccagcaagataatctaaattgtcccgcaaaaaacaaaaatataaaatcatcaatccaaggaaataactgtgtcattacattcccaagaaacagtaattgttaaaagaatatttctcaaacaaatacaagagaaaatgttgtggaacagacaagattccacaagaaattgtcatagggttaatctcaaatgttttatacttgatgcaataccagtagtactttcataaagaaaagaaattgttctgaaaaatttaatagaaaactatctcataagaaacttccacatttaatggaaaaggttaccatggaataagaaagattcaataggtatattgtaatttattaatttgaagcaagagggaaccacaataagctgctttagtcattaaatgaaaactacatacaaaatttgaagacaaacctgttttgctgcattcactattccacttgctatcacatcacatttcatgataccaccaaaaatgttcactagaatagccttcactctatcatcggaagtcaaaatcttaaatgcttccacaacctgaatacaagttatataaaaagtttataaatgaccaaactgggaagcataacatgcaaaaacaaaataacaatttagcatggattccaacaaacagattatcagttatatgaaaatcttttaggctgtgttcaggaggaggggttcggttgggaacccctcttccccggcacgcaaaacaaagctcatattattgcatgattaattaagtattaactattttttaaaaaaaatggattaatatgattttttttaaaacaactttcatatagaaagtttttgcataaatcacaccatttagcagtttgaaaagtgtgcgcgcggaaaacgagagaggtggattgggaaaatgggggggaagaacacagccttagtggcgcgattcacatgagatggtagttacaaaaagaattctcagcttattatacctgtccctctgatgcacttccaccaacatcaagaaaattggcaggcgtacccccatgcaacttaatgatgtccattgtagccattgccaatcctgcaccgttcaccatgcagccaatttctccatcaagcccaatgtagttcaagtcagctttggcagcagccacctgtaaaggtattagagataaactcataaatatcttcagtttccattctcagaacaacaaaagctgtaacatccctccagaggcaagtcaagccatcctccaaaagaaggggtaaatgaaaaaaaaaatacatagatagagataaaggaacacacagactacaagagaaagtgaataaaggaaatggcaagcagtaatatacctctctgggatcttcctgtgttgtgtcacgcatggcaaatatctctttctgcctaaaggcagcattgtcatcaaagttcaactttgcatcagcagcgaccagcttgttgtcagctgtctcagcaagaggattaatctacccacataacatgtccaaattagtcataaccagtgcagtggtaaagcgggccattccaaatgagataccatttgttattgattacctcgagcagtgtgcaatcagacttgcagaacagttcatagagcttcttaatctgttctatggaagactgtctgtcagctgtctttggtgccagaccatcaacaactttagctgcatcatcatctgtgattcccttgaatacatcaataggaacctggcaatccagagcattgcatttcaatgtatgatcgatttcattagaaacaattaaaaaaatgcagaagcacacaatgctgttgccaacagagggatattgattagaggcaatagatttaccttgatgatcatatcagggtacttctctgcaagatcttcaatactggttcctcccttgctgcacgctataatgagctgaaaatgagtgaaaatcagttagtctacagcaagaagtcaagaacccctatctgaaataggggaacatgcatattaactacctaatggtttaattctttaagtaattcaggcacaagcaaaaaaagaaaacaaaatgatagcaaaaaaggatttataaaaacaattatgatgcgtctaaattcagaagtgagcacaaaagtaatcctactcgaaggattgattacatcattcccatgtataatttataattataccaaaaccaatacaaaatatttttgagaaaaaaaacaatacaaaagtggaaaataattattggttcacagccttagaatgcttgacctttacaaagatgcttagtgacacagctactgcatgcaattatctgttactaattgtgaagcccattatccgttgactaaagatttatgtgaaccttcatcagctcatgcacactttgttagtttatggtattgaaaaaattaataaaataaacaagtacacatggttgcaaaacaacaacaaactgttattcttgtggaaaattgatccatattttagtacttaccactccttaacatagtctcataaattatcagaatctaggttacaagaaatactgaatctagatggaaaagtgtgcaataccaagcttccttaatttattcaaataatagaacaaaactcagtaaataaaaagagaaaaatgagcaatacaaaaaaattgcttgtgttcaaagacataccggaccagcagtattcctgtcaagggtgatggcgaagtacatctcattaacaagtgacagtttctcacataagtagacctgtcaaaacacaaatcaacgaatttagtacttgacaattttcagtgatttgagcagaaacatagagcattaaaaagtgtgactcttgctttgaaagataaggtagtgaaagacgcagaacttatggacagtcgcatgacaacctgtgtaagcctctttctacatgaaattgcatctaaatttgcattcaaaaaagtaataactacaagatccactatgattagactgaaaaaagaatcaagggaaacaatcattgccacagcatgcaccaaaaaaggcactccgtatagtgtaatggcttcttccaattattccatttatttctcatatggaagtacattaaacggcattggatttacaagttcaatactgttttgggcgaacacagtcatatgctaaagcttaaccttctacatatttgcaacaaaaaaaatatagtgataaaaagctttcttactaaagaatcaataatcaagcaaacacaacaacagtactttctaacaatgctggaaacaccaaatgaaactgtggtagcaaaacaaaatggcaagctgattgcagttcaaattggaatatagatgctgaagggggctacatattactaaaaactaaccttgctcacaatcttcccctgtggaccagtttgttttgttaccagaatctggccaagcatttttgctgcagaggagataacataaacacttaaaagtaggagtacatacacaaataacatgtatagtatacaacttaattgaatgactacgaagaaaagaattgaatgactatgaagaaaagagagcattgcatgtcacttaaaaggccattcacttcaaatcataaggcatcgaggcagtcaaactcagaaccaaaacaacaaataaccaaatcttaagttggtgagaaaggtaaggaactaattaatcaattgaaggaataaatcacctatcatatatggatttattcaaatctgaaggtagtatcaaggatgtcagacttcatacaataagattatctttacttgcatatttcattataacacatgtaattgccaaaaccaaataatagcaataaattgcattggaggttactgtgtagactgtgaagctagactagtgtgcatggaacagttatgtataaacttctaaatcagctgcccattatcatctgaagcaacaaacaactgaagcacatactgggagaaacttgtcaagctgctgttcaatatattcgtaagtctctgacattaactcgtacctgcgaggctttcagcttcctctgccttaacaatatgaacaccaccctgcagtccacttttgaatgttcccaatccacggccaccagccaggatttgactcttaacaactatctgcagttgtgtcatgttttgagtatggctgaattgaaccacaaaatgattcatgcaataatacatagatctaccctacaaagtaggctagggacaacaatcagctagatttgattttggagtaggccagcctaccatctactgactcatctttatagttttacggaataacaaacattttgaagcggaataccccaatactatcttgtgataagcaaaaggtttccccttaaccaagttaagggcttacaagccacattgactataaaccttggcaatattttcctagaagatatgattattttaaagagaccacatgtgggtgtataatctttgaaaaggagaaaaaaaaagtttatatgcagtcctatgactaaacagcattgaaaaattactcaaaacaccaataatagtgtcataccagagtagctaagactaattacaagtaatgttactttccaggcaccaacagtgatgtatttcacccattcgtattatatgaaactatatcccgtatactacagcaaccactaacctcccctctggagaaaaactggtcaggccatcagcagaaattgcagtaaactacattctctatatacatcctaataccatcaaataactgccacaaccaagtctcaaattggccgcacaagcaataaagaataaggaacggaaacatcacctctttctcactagggaagacgttcttcaaggtgtttttgacctccttcaccgatcccgccgccgcgcccctgggcacgttgatcccgtacttccccatcagctccgcgccctgcgatacccacacatccacgaaccctagcgcgttagcccaggcccctaaatcgaagactccaaaaaaaaacccgcaaaaatcgaacggaatatggtgcgggaatctgcgggatctggtggagggggttgcaagagcacctggtactcgtggatgttgaggcggcggagctgctggtgctgccatttcccggcgacggagagggcgcgcgaggccagcttcccgagcgatccgcgaaccatggctgcggcggcgtggggggctctctcctccgatccggaaaccctacaagcgtggagggatggcacgcgtggtctttcgctgttcctctctctctatatgcgggtttgatttttcactcggttttttctctcgtcttcttttcccttttctttcttgcgagagggtgcggcggcggcgtaggagaggaagagggaccagacgccggcgcgtttgactgacatgtaggatcacgacagtttcactgacatgtgggtcccagaactgtggggtccatatgtcattgtcagatgaatgtagggcgcggttgctcaggtatagaggcacttgtgcttcgagcctttgatacacttttcatgggcctaagcggcctaactggtatccctgctgtatgggctggacaggtccagataagctctaagatgaaatgttgttgggctggcctaaatctgtgatttacacacatttaggcagtggccagtttagcccacacagcccagtgcaggaaagtggcactgggaggcacatgcaatgcaagtaatcaaacacgccccaatttgtattcggggagtttaaaattttgagaaacaattagttggtagctaacttccaagaatatggagaaggtgggttttccaacttctagctcctagtttgttttctagattttacaactgtagcttctcagaatttaaacgaaaagctagattatttgagggagcttctgatgctgggataagctgcacctaccggaaactcccccaaataggtcccaagagtcctagaccaccgcggctttacatgttgtaagcacaggtcgttggtattctgatacatatcttattcgtagatatgccaacccaaaacgatggaaatcccatcatttatcttaattttcatagcatcacgaacagcataagagtttaatatgatctcactagattggtaggaccttacataagatctcgaccctacgattctacataagcatcttttaaatttcatgtgtgttgaaaataacgtgaataagcctactgagatttaaaaaaatactatctctgtttcatatcatatgtcgttttgatttttttcaaacttctttaagtttaaccaagtttctagaaaaatatagcaatattttgaacacaaaacaaatgtattatcaaaatatattaaatattggttttgatgagacttggtgttgtagacattgctgttttttataaacttaatcaaacttaaagaagctttaatagaaaaaaatatatcaaagtaacttataatatgaaatgcattgagtaccaattaaatttatcaaaattaatactagagacttcaaattttaaaacatgttacaaaatttatataaaaaatatgtaccttataaaaatctgatagatcccaagcctacaatattatttgaaatagaatgatccaacctaatattccgatcctaacaacctcgcaaacacatttgggatgtccggatgtagtcgtcttggtatgtttgcggtagctgatagctaaatgataacttggatgtaccgtgtactccttacgcggttacgccccaaaataaaccaacttcttctcctaaaataaagcaactatactttcttagaagtacctactattggttcataactatataaattctattccttcaatacctctcacctatccatccagtaatataacttctctattaattagaggcatttaagtctattgtattgctccttaaatatatcttgaaaagatgggatttgaattttttggaccaaaggagtttttgagatttgtttccgtactttcatttacattgaaaaacacatggaagaaaaaacgtggaaatttactcaagaaaccgtacaacttttgttccttttgctcagcaaagaaactgctgtaattaggatgaatacacccaagccagtatacctgtttggcaattggaactcggcaaatgcatggtagttcagactagcaccaatcaaattattctagagttggcatggccacgattgcaagctatcttcgcaagaaagaaaacgaaaatgttcgtgtcaaaagtgaggtttaacttaattggttttttattgtagaacctgcgatagatttaagttctaaatttagtatgagtgctcatatttacgactaattatttttcagtgatacaaggtatacccatcgacaacgagtcgctcataataatttcgtcaatttcaaaatatactggaacagtttctcatagatgcccctaaagataagatgtgtgtatttataaagatgtgtgcgagcccccttatctgtaccctattttttagaaaaaatgttagtgaaaaaaaaaacaaaatgtttactcataccatttgccaccttggcgggtaaacgattgtccatatgtttcccaagtcccgccacgtagcacggcccacaaaaaggcccaaatccgaaccacaataaacccaggtcaatgaccattataccctcgcacctaagccagaactacatacctatctttacacggctgcctcactacatcccctcacgatggcaataccgaagtttcaaccaaatccgatggctaaccctagcaaacccgtgcataaatacaccacccaagccgctcctccccgcccgcctcttcatttcccctcctccctcccctttgccccgccctctcgtccggccgtttcgtggccgtttccgtgggtcccatccacttgtcctcccgtgcaatttacgaaattgcccctatcatcttcgggtggtccccacactccacgactttctcttgccccctcccttttctccctccctttgtttattccccaatcgctatcgccgagcgattccgtctcgtctcgtctcgtctcgccgctgctctgctggcgtggcggcacgggggccgtcgagatgtcgatctgcgcgagggcggagccgccacgtggcggcgggacgctcggcaagcggaaggagcgggaccgcccgtcgtcggaggagcagcgggcgccgccaccgccgccgccgcctctgttcccggcgatgtccgctaggccccagccgcccaggccggctcaccccgctcggttcgtcaagcccatgccaccgccgccgccgccattccc

SEQ ID NO: 63908 - DNA, 9236 bp, Oryza sativa
  unsure (1)..(9236): unsure at all n locations
gcaccggtggttgcaccgcgacctcgccgccgtcgaccgcgccaggccggcgttcgtggtggcgctggtgcacgcgccgtggtacaccagcaacgaagcgcaccggggcgagggcgacgccatgcgcgccgccatggaggagctcctccgcggcgcgcgcgtgaacgcggtgttcgccgggcacgtccacgcgtacgagaggttcgcgcgggtgtacggcgggaaggaggacccgtgcggcgcggtgcacgtgacgatcggcgacggagggaaccgggaggggctcgccgggagctacgtcgacccgcagccggcggcgtcggcgttccgggaggcgagcttcgggcacgggaggctggaggtggtgaacgcgacgcacgcgctgtggacgtggcaccggaacgacgacgacgaggcggtggtcgccgaccaggcctggatcaccagcctcgcctccaacccggcttgcaacaagtgaccccatcaatccatcagaaattcagaatgtagcagaaacagatttatgaattatataattatataagttaatttattgcattgatatcgataattagaaatttagcattagtacttctacagttctatgtatgttagaagatactctatctgtcacataacttagaacgagatgtgagcctctcatactgatttgtttttcttatgatagaaacccaaacacgagttaaatcattagcgtatgatcaattaagcattagaaaaaaacaaaaatagattaatataacttttcaaagtaactttccttgagaaaattcttacaaaaatcacagtgcttaacaatttgagaagggtgcacgtaaaaaataagagagtatggttaagagagaggagtatagaacacactatccttatataaaaagttttgaaaatctaatagcgacaggcgcaaacactttttcctaactactctactttcttcaattctataattcttgacgttttagacaagattaaagtcaatgtttatgactttgatcatcaatatatttaataatatttaatttaaagataatataacaacatatacaaatttatctatcttacggagtactataattaaaaataaaaataaattatttattacatatatgataattaaaaaatatagtcaaaatatattttgaaaattatattaatacccaaaacgtcaaataattatggaacttgaggaagtaacaccgtaaaatgctgataattaaattacttgttgcaatctctctctgtaacgttcattccgagacgaacggagatggttaatgatctcgggggcgatcattgagaaatggcaaaatactcgctataataacgaaactggtaaaccagatcgaggctcgcaaccggcaaaccctaaccctctcttatccctgccgccgccgccgccatcttctctcatccatcgccatggctgctgcagcccgtaattaccttaatctggattttgacgtttccgatacgaaacctctccctgactactgcttctcagaggcttcggaggtgtggagagctcattctgatcgatcggatgaggaaagggaacaggaacaggctgttttgagggtaattaattaaggatatcgaagcctccaagaagctttaatttgattttctttgctttgattgtgcctgcatatatacacgcacgtatcttccatcctccgattctttaattgcatatattacttcgtatgaatacatgatttttaattgtactgcatttctttctgatcatttttgtgttccattctgttacgcaattggtatatatgcatgatctttcttaagatgcttgtagttctacgaagagaaggaaaaagagctggaggcaattgacgattgttctgaagccctaggcgacgtggattgtgatgatgaggaggaggaggaagatgaaggaacatgtgaggtgatgatatctactgtgtgacagtctccatttgcagcacagtttgagattgatcactattcatcattataataattaattcttggcttaattggttgcatctgttcatcatctgcagctatgcatgaatgaagggttggcaccaagcccgagaaaccatggcgagcacttgtgcccagtgtacctggagatggtaaatcagcaaattctggaggaaataaaggatcaagaccttcacaatgtaagtattcatgattagttcgttaagtttgctttgtcattttttttcttctgattttagtggctagttcagtgtcacacgttattcatattgacagaaacgatgacattagattcttctgtttctacgatatactccctctgtcccaaaataatctatgaacttattaaaggaataaaaaaaagtagcctccacattcgctctcacggcttagaaattcccacattaatcggagaaaaagaaaaacatagtccatatagaaatacaatttataaatagttaaaattcagaattaaaaaataatgaatattggaagaggagactagagtccatatagaaatacaattaagaaacaatagaaattcgaaattaaaaataaggaatattaggagtagagtatagagtacatatagaaatataattaagaaataatagaaattcagaataaaaaataaggaatattagaagtagagtaaagaatccatataaaaatataattaagaaataatagatattcagaattaaaaataaggaattttagaagtagagtatagagtcaatataagaatttaaaactaactaaaattcggaataaacataataaaattaaaagtagagtttagagttcgtataaaaatacaattaacaaataactaaaattcgaaatttaaaaaaacatgggaagaagagtctaaagtcaatataagaatacaatttagaagtaactaaaattcgaaattaaaaattgaagaatagtgaaagatgagtttagagtcgtccacatagaaatacaattagaaataataaaaattcataattgaaaataaataatatcggaagaagagcctggagtccatataggaatataatttacaaataactaaaatttgatattaaaaataattaataattaacacgtatataaaatacaatatgaatattatacattagtagtttcgtaaagggagtacaaaatttaaaattatgttgttattttattaatatatttgaataaataattgagaaaacatatatgttattatatgacaggaaatataatgatgctagccgcgtaatctgtgcgagccaccatactagtttaatctaaaataagatggtgacgtacgcattctaatgaagttggtttgaaaatcaaattaattattggtatatggtatattgtacatttttgtgcttttgtgcaaaggaggacaacaatatttttgaacgttttggagtcatggttgactgggaggatgaggacgaggacgatgatggtgaggaatttgaagaaatcaacaaggtaatttgatttttgtgtccagccagtgtaattaaacaacagcatatcagtattgtgatttaaattagtcgttaacataatagattactaactaatatctgtaataatgttagaagtttattcagcttctgggtcatggaaatgaacttgctcgtgaaataatggatggcgcccccgctgcttgaggcgcttgccactggcggctgcagccgataattgggctttgagttattgggcctaactagccaaggcccaaggagcggaatgcatgggcttcgatgggaccggcccactttcgatcccctgctttatgctccagtttcgagcaattcgtgtgttaaaacaacggttaatgtgttcaacggtgtattgcttgcttgtcgcctgcttgtaggtctttgcttctggtggtacaatttcgtcgatttatgtgctacattatatgcaactttatatgaaacaatccaattcttgcacaaaagatttccagcacatcagagcctcaatttattgaggccacctttggaagagaggatatatatcattaagagtaatttcacataaattaaattagttttaagcctcatttgaaacaaatgaaaaaccatagaaatttcagaggattttatcccatagaaatcttatggaaccatttgaaacaaataattgtttcctaccaattccttcaaaatttcaatgaaatgaaacattctagaataatatttggagaaaaataagtataaggaccatctcatgtttttctcttgtgtttataattcctgttttttcatttgtgctaacgttttaaaacttttcttcatttcaaaatcctatagaaatccaatgagtatgacattcttctttattcctattttttttcctttatctgtgtttctcaatcccgtgttccaaaagcctttaattaaagaacttgctactactaaaattcatttactactacagtgcatgagggtaggtttggcacacaggttaggtcagacatgatgatagtcgaaactgcagcccgctagagtactgatgctgagctcacattctctgctcccaatgtcctgcaccaaaattgacattcctaactgccccagctcactcatcacggtgagagcaagttcaatagtatagtcaactactagcttcaatttatctataaccaatttaatagctcattcatacaataattacatattacactattaatatctagtcccacctattatagacacactgcgtcttagagtctgtgctacagctggctattaatttgtagcccactgctcttctctctcctgatttatcttcttaaaatatgtttgtagctgacttatagcctgctattgtacctggcttactgacactgcaacactgtgcaagcttagctgtgtttgcaggacaaccatttccaaggcttgttccatcctgtccctgttcatgttgctgtcacaaaaatggagctgctcctacactggagtagtaggcatgatcatttcctgtttaccaaatgcatgccttttcagaggaagatcacggcaactcacactccagtttcgctctgtccgtccgtcctcctgaccggagttgtacacactgtcactgtgcccatacggatgcaggatcacttccaaaagtcaacacgtcagatcagacttgaagaatccaaatcttgaagccaggattattctgcaggttgctgccaatctctcctgtaggagtatcttcgttttaactgcagtgcaagatgcaggggctgtgtttaggccggtcannnnnnnnnnnnnnnnnnnnnagtttggagaaagttgaaagtttggaaaaaagttgaaagtttatgtgtgtaggaaagttttggatgtgatagaaagttgaaaatttggggtagttgggggtgaactaaatacggccagggtgtgtttagttttacatcaaaattggaagtttgaagaaaaaattggaaatttacgtgtatagaaaagttatgatgtgatggaaaagtttaaagtttgaagaaaaagttagaaactaaaccatcatgaaaacggcgagaagaactgaaaattcaggtgatccaggaggaggaggaggatcacaagtcaaaatacacaggaggaatacaggagccaaaaagatttcattgtatcatggcctcacgaaagacacaaagtttgtaaaggactgtgagtcaaaaacctgagtcaaacacagcctaaatgacaggttgaaaattttaggcatcttaaagaacagtaaacagaaggccatgatgcaatgtttcacatcagatcttggttccgaggagatgtgccatgatggtcgttgctgctgttactactcctactccatactagggtcattgacgaacagaagacatgcacttgaatgctgcctcatcatttgttgatgccttgggacagtaagagatctgttgcaaagatcagcaaagagcatttcgagttggaactaaaactcaacagtgtgttaaatgttctgctttctgttttgccgtcaagctagctgctacagtactacccataggctataaaagcagatacaatagcaggctataagccagctataaatatattttaaaaagataaaaaaaagagagagaagagcagcgggctacagatttgtagccagctgcagcatggactttaagacgtaatgtgtgtatgacagatagtaccaggtattaatagtatagtaagtgactattgtacgaattggctattacattggctatagatgatttggagctaatagttggctatactgttgaacttgctcttagctgcctgtggtttcatcattgaacagtaaataggagtattaactgttaggatgggcattgttcagcctctagtcaaacttgatttgaaagcagtttcaatttcacggtaggatttgtttcactagtgcaggagtggtgctgtgtcctgcattgttcatcggcaagctgctcctagagtagtttgccactgatgaagtattgatgttttggccataaaatgaggaactcactgctaataccagagtgctagtatctgcataatgagggtttccgatatgtatgtgaataaaatcatactactgtatatatgaagcatgattgatagactattcaaaacaaaatcacagcaagttcagaaatcaagagttgtgaaacctgcattgttcatcagcaagctgctcctagacagaaattcaacacatctcacatcaagttattgctggtactagtactcatgatcagagagagtaaaggcaatctaggatgtggaagaagaagaagaagaatttccaagaagaagaatttccatcgattgcgtatctttggacggaacgtgaactgcgtcatcaattcatcaccatcatgaccacattttcttgacagctagctactcctccctcctttaccacagagatcgagttaaggccttgtcccttgtgcagttcagttgtgcctgcatttctgctgttcttctgcaggaaagaggaatactgacgttactctcctccgatccatgcctataaatacaggcacccccattcaaacccaaactccacagcacaaagaagccaagaacaagttccgtttcaagttctctctcgctactcttcagagattagagattttagaggtgatacttacaagcatcatagttctagctagtattagcatgcaaacatcttttctgaaatgatcgaaattcattctgactataaatgtttttgtctgaatttcatttgttgatcgatgctgcagcagaagggaaggaagaggatcgatggatcgggtgacgaacctgtacctggagaacctgtgcataatgcaggagaacgagcggctgaggaagaaggcgcagctgctggacaaggagaacaaggcgctcctcgccaagctcaagctcaagaacaacccctccaccgccgccgccgccgccgccgcctcctcgccgtcgtcccagcagcagccagacgccggcgcctcggcggccgccagcgtcgtcaaggccggcgcggcggcgccgtcgtcgtcctatggcgggaagaagaccaagtgatgcagctagctagctcgagcatgcatggagatgatgacgtggatcttttgtaattagttgcactagcttaagtacattagcatatttgatgttactagcatgcaatgcatcatggagcattaacgatcgagtgttagatgatcaccaggtagccagagcagcgtcgttttggactaattaagctagctattagctaagcttgcagtgttttgtgccagtatttgctatcttcctgctgcaagtatcatgagatggtcaatgtgctaactccagctctagcacttccagtctagtatactgcgtgctttgcaccttatggaagtgaaaacctttatacgtacttattgttcttcaaatgatggataacctacagaaatggtgtaactctacttttagatttaacacaaaatgcggtcttaatgatctatatgcggcattctcagccaaatgtttcagcgagtgagacctgaaaactgcaagctagctataagtacttctacatgtgcataacaaacaggccatatgctctctttctcaaaaaaaaagaaaagaaaaaagaaggccatatgctcgctaatgctaactccagaacttcctttgatttgtgcaccaatgttgtgtgatcgactgatcgtaagcaggagtactgacacctgatcgactagctttgagagagagagagacctttttattaaaaaggaaattacggatacctacaccattggcactgtagggcttgtttattttaatgtcatttttaaccatgctatttttagtaaagttaaaaaaaatattgtttactttgttgttaaatttggtaaatacataagaaatcctgctaaaattttagcaatattgctatcttgctaaaaatttagtattgccaaaacttaataaggtttattttggctataatctgaacagctcttaaaccctcggatcttacacaaatgttgatctgtgtgcaacgtttctcacacccatgcaatgtttcatagagtgagagacctgcagaaaaccgcaaggtgcaagctagttttggccatataggagtagttcattatcacttcgtcctaaaaattaactgaaaaggatgaattctcattaccgtttttgcaagaaaaaatgctactcgatcagagctataaaacaagacattacttaactgtcgagattattttggtattagagccacggtcctgtagcaattttggtcgcaagagataatactccatcgttagagcatctccaacagcatggctatctcactcttcaaactaaaatttagcaattttaaattaaaaaaagactccaacaaattagctatctcacttttcaagctatatgactggccaaactgagttccttgctggccaaacttggccagtcaaaatcggctggccaaccgcggggcccacaccgtttctcttccccgtctctctgtacactccgacgccgccccagccccttccactgacgagccggcgtctcctctccccgcctcccctatcgtcccccttccgccatcgcccgtcggagcggaaacaacaacgataacgaagatgatgcccctctgtgcagcggtggcgacacatcccagctccggtatagcccttccagtgttgccgcccgtcatcttcggcaacgagacgttgaggatcggagatcgcaagc

SEQ ID NO: 63909 - DNA, 754 bp, Oryza sativa
ccttccccgtcgccgccgtcgccattagcggcggcggcaggacgatcaatgccgccgtccccgtcgtcgtcgtcgctgtctccgaggcgttggtaagcttctagtagcgtcactaagttgtcgaacgcggtggcggtcgccatggatgatggttcatgatcggtgccggcagaatcgctttcggtgcgtcgtgttccgtcgacgtcgtcgtcgttgtccatagtcaaaaatttaaaatccgatcagtttaattttggactatatatttatttatatctaacaactggatcatggatctgtttgttttgatttgatttgctcccgtatcgcgtgtaatctgctactgctgattaaacttatagagagatatacgacgtgaatacgtgcgtgactacgagagttcgtgtcggagggggatgcgtaccggaattggcgtacggccgtacgtgcagctcatgaaccgtaccactaccaaatacggcgtatgtgtagaaggattctgtttcggggttttcgtttttagattttttttaatatttacagaaataatctatcgaccaaaaaaattgcagaaatagcccctgccgctctaatggtgggcggcaagctgaggtggcagacggtgggtcgaccgcgccgtctgccgccgtcggccaaaattgcgattaggcccttgccgcccgtacagagggcggcaaggggctaattgcaattttggccgcccataaagagcttgcggccgtacttttttcat

SEQ ID NO: 63910 - DNA, 4329 bp, Oryza sativa
gattatgtgcttggattagtttgagctcccgagcacgcaggcagaattcaaatcgttttgcagtttccaccttgatacaagtaccccaaatgatgctcaaatcaaatgctaaattgtactggtagacctaatagtgaaattaattatgacatggcatccctttctccctttgttttgatgaatccggagaaacaagttcaagtataaatcgatttctgaatttgcttcaactgtatagaacgatacagttgatttctgtataggtctacaggaacaatcagtaaccatatggattatgtctattgtcctttttttctctggcctgctttaaaacaattcacttccaacagaaatctggaaaagaaaacccctgcatgcctggaggctggagtcctaagaggagcttaaatggttcggcgtgctacatgatagtggatactagacagcgaaaaatgtagctcacgttgtccctttccttctaatcaacaaacacgcactattggaaactgaacattggatatagtacttcgaccctacattacaacatgaccagtatagaaccagaatttgtattaaaatagggagtactttattaaacatgcttcaatttccctttgttcttaacccgtatcctggtttttcaggttcaagtgataatgagataactgtagaggaagcttcttttgtgcatactgaacctccgcaagatggctctgtcccacctgtggtttcctctaatatggaggtccttcatgacaaagttaaaaaacaagtcatcaaagaaggccatggcaagaaaccatcaaagttcgcgacgtgcttttgtatgtcataaatggtttgatcattccctatatttatcctggtgatttatagaatgaggctaatatattccaccttcattagcatttgtcttatcatcacatttcatctcgttgttgtttctatggaagttccataataagagaacttattctctgtgtatcaggggctcagaacatacatttgtaaagttacatgtactaggggctcagtatttatgctctgttgtactatctcctagctctctgtttcttttttgtacacttctttttaactaaattgccagtactggaactttctgtggaaagagcttcttattcagataccagaaatcatgaaatacttaacagtattttaggatgaacaattcgatgtacgcacagccttctctaacaccacaggcttactaataactagtgtggcacatagcagcaccaaactcataacaacttagagcaaatgatatttaaaactagtcatgcacttgtgctttgctatgaatcatcagctttgagcacttcttaccaagtggcacgtccatcatttgtataagcatgtcaacgtctgtctattacagatcaatcttccattctcagaccatgtatatacttattcagaaggagagcatctgcataatgtttgtttctgttttttctgttacagtgcactatagagcttgggttcaaggctctctgcataaattcgaggatacttggcaagaacagcatcccattgaactagtaattggaaaaggtgaaaataatgatacttcattttatccctagttcttctacactgcatgcatgccttctatagatgatacacatcaaatagcttactcttatgccattctgatcttatagtgccacaaataatctatgattctaataagggttttgaaaatcagttgatcgatcagcaactttcaacttgctattgatattctagttttttttttgggtgtgtgtgtgtgtgtgtgagggcgattgacaacttgcaaggacataaagactaaatagttatatttttattactaatatatttccccccctgttttctgatggttcactaaatatacaatacaggtacagggtaactatataactttcctacaaatatcttttggacactcttgagcatgtagagtatacctgggatttatcagtgattatcacatatggaataaaagcctttttctctttttaccgacagagaaaaaacaaatgtctggtttaggcattggtgttggtaacatgagaagtggggagcgtgcactgttgcatgttggctgggagctaggctatgggaaagaagggagcttttcattcccaaatgtccctccaatggcagatcttttatatgaagttgaacttattgggtttgatgatgtcaaagaggtagggaaacatccttcttaccatctccacccaacataatgcttatccttattatttctgatagtaatctgagactattgttggttggtttcattttatttatggttttcaaggtgatttggatgttctaaggaaccttacaaattgtgtacaactgcaggggaaagcccgaagtgacatgacagtagaggaaaggattgaagcagcggacaggaggaagattgagggcaatgagtatttcaaagaaaagaagtttgaggaggccatgcagcaatatgaaatggttagttgtccttcttcaactgttgtgagatgattctctaatcgtaatcctctagctcctcctctttacaggcgattgcatacatgggagatgacttcatgtttcaattgttcgggaaatacagagatatggccttggctgtgaaaaatccatgtcatctcaacatggccgcatgcctaatcaaactgaagagattcgatgaagctatcgcacagtgtagtattgtaagttttttttgtttgcataaagttcaatctattaaaactcatgctgtcacactcacaccagtcggtttgtgtatagcttcagatgaattaggattttgatttgactttcagacaataaagacatacaacatgatattattatggtaactagacgcttggaccaaaaagtgaagaatatagtgcagttgcctatattttcctcaacttatttttgtaagacaaccctcactaatttcatgacgtaactgacctggcaattcatcaagtgaagaatttttccccctttttccgaaaccgaataattattgactggatgatgaactcataatcctattcttcaggtgttggcagaggatgaaaacaatgtgaaagcattgttcagacgaggaaaagcaagagctgaacttggtcagacagaatcagcgagggaggacttcctgaaagccaagaaacattccccagaagacaaggagatccagcgtgagcttcggtctctcgcggaacaggataaagctctgtaccaaaaacagaaggagctgtacaaaggcctctttggtccaaggcccgaacccaaaccgaaggcgtcaaattccatcgttcgcttctggcagtggctcgtgtccttgattggttatctcataaaactgttcaaacccaagaatgaatgaataggaacggatagtgcagaactgacgatttgacgaccaaaacatggactcattgtactgtaggctgggaattctactacaagtagttgggagtgttgaactgcacgcaatcggtgtcaaattctacaatctctcggcatttttgtgccttcagtccttcactgcattgtgacttgagctttgggagctaaaagttcagacatttttcctatgaacaatacattgcctttatggtgtcaatgatttggtatgttatgcggtgctgaatagttgaatgatttgttacgattattttgatggtataaatgaattaattaaatattataaagttaaaaataaattgaaaaccacttttctaaggaaactcatatatacaaaaagtattttacgtaaatcgcaaaaaattgattataagtcaacgcttattagaaaaaaaaaacttacaagtaatattttggcttaaaatctaattatgtaaaacaaactacaataaaaaaaaataaaaatcacctctaaaaccaagttttaattcaaagtttagctacggctaataagctgaaagaacaaacgatagaaccatataaatttgagaaacatgcatattcttatttcgacctggtttagttcccaactttttcttcaaacttttaacttttccatcacatcaaaactttcctacacacacaaacttctaacttttccgtcacatcgttccaatttccattaaactttcaattttggtgtgtttattgccaatgtttgaaatagcacatctgtctctcaaagttggcatttcaacatttcaggtgccagcaataggccaacctagcaaagccaatgaaagaaatcaaagaaattattttcctaaaaaaggaaaataagaaaaaaaaacacattctctttgctggcgctgacgatggaatacagcttgg

SEQ ID NO: 63911 - DNA, 6008 bp, Oryza sativa
tactatgagaccttctttgatcacagatcttacaatgtagtttgcgcatatagcggaactccatacctttatacttattgggtagtaaaacttaaagttaaatggcatggattctacagtgataaatagaaataaccacacaaataattaacaaccaggattctgaggaaaaattatctgagcctcatgggaagacagtttggtacgtcccttggatgagaacatcacaggtaattttcgtaccccattttgcattaattactagtaaattgtttgccagtggcattactgatcaataaaagctgcatcacagtcctcatcctcattatgttacttgtagactaatattttaacatgaagtcagtctgaaagtaggaagtatatgcattggtgccactgaaatatttagttataggctgagtgcttcaccatgaactttggtggtatggtaggaggtaaaacttgtgctttcactgcgaaacatatgaaaagccacaagtattttctgcacattgcactgaacaaatatatattctgccttatgtagttatgtacatctcaaaacaataccatcttcagtttattttctagggattgtgtttgaactgaagtagcaaatcactccaggcccagtttctgtcataaactgggtcaattccttttcttcttaatataaaacaggaacccctgtcctcctcctcgaggtttaccttggggcaaaaaaaaaaccctgaagtgtcgtaagttcaagcatgataatgggtcctgttgttttagtgatgagatatatagaatatgtaatactctataagttcattcatcaatacccatgctcaagtaaatcctatttgtttgaatgataaaaaagttcacggtttagttcaagctctttattataagtgtggcaagagcaagagtgcaagaccttggtcatgatggaaaaggtgaaaaaagaactgaaatcgtcaagctgacacagttcatcacaaatggttgcaggatttacctgtacttaacttgaatttgtcatagaagattgctcttatctatcatcgtctgcagaaattttgagttaggttatcgcgaccggtgtttgatttcagagctcttcattaacactttaactctgtaacttgtattggagtaatggactgaaaactgccaatgcccagttctgtcgattcaaaatcgatcaactgggttttccttcttgattcactgattcattcacacgattcattaagaaggtgaaggtatgcgactcctgatatttaagcacagaatatttcacttaagagttactaacatccaacaactaatgaaagcacattgttgacaattgacaggacatgaaactctttttttttttcctttttccattgttccccgacctcagccaagttgggcagctacttgccttggaagggtgctcgaaggccatgtgcaaggttagattaaacaccatattattttgcagcctactataggaaaaggttctctaggtctgatttctctgtttgttttcactttaattatcatctggcagctttataattttggttcctgttttgctttcacctcttttgcatattaaaaggtgtaaagaacagaggtgtgtgagcttctcccgccactttgttgtttttatattacatgaagcttgcaaaaacgtttcgtatcagaatccccactttctttggctaattacacaatactaccatcacgtctctttaatcaaagcttattggtaatcgcctctattatattaaaccttgggaggcgagttttggcttcttgtgagtactcttgaagcaagtacagctatccattaatccataccccaactgtcaatatctcaacaaaactttccttatattttcctttcttgttatggcctaacaatcagaaatgtgttctttggttcctgattgttaaccgtttagtttagcagtctaacataaaaaccaataggtatgtctaattacactagtatcagtacatgtttgccattagagggagaatccttgttaatgcatgtttcagtatctgaaatgcaataaatgcaatatcttttacttacagtgtactacattgcgtatccaaccattgatccgcagctcacatatctccccatcttttgcactcgccactgcacaaattttgctccagctagctgttgtactgcttcacagagttacagcgttagcactgtaagcttttgtttccaaggaaagggatactgaaactccctctcacccgctcaagttgttactactctgtagtctgcacaactaatttctctgcaatttgttgagtagtattttacacttgatactccactgtttttgtttctgcttctcttgtagtctggtgctccttaagttcttttaccaccagtaggagtttctttctcattgtcattggggataaaaaaaagggtatggatgggatagcaccggaggccttgtttattcatacccatctatttgttttataacaacgaggatttggagcttttacagttacagcgcatcatggatttgactgggctttttttatttttcaactttgaattaactccagctactacactgatttcccgaaaggcagagctttactcctttcagtcttatcccctcagcgccagttggacagctgttcaggctgttttttttttaacgaatggctgattaaaagaaatacagaattggtttttcatggaaaggtatgcagacctccctcatttgctgtttctggagtacgttgggctagtgtttggagactgaccaataatactaggaaaatgggttatgtgggatttttttatagttttttttacaagaactgaactaactcatgaatattcttgcattccaaataaatcctaattagttctattgtctttttacactatttggaactgtcaaagattgagacaccgttctatcttcttccatgttttttatatgagcatgaaattcaaaacacgagaaagatagggaatcatttctttcttatttttaactatgtaacgaccatttttttagaataaccgatgctgtttattttactatataaaatttgaccatggataggaagattagggaacactttaattttttttgttaatactatgtaacggcctttttttccggaataaccggtgttgtttattttactatataaagtttggccatggatagaaagattgggaaacactttagtcttgtttaaactatgtaacggccttttttttttggaataaccgatgttatttattttactacataaaatttgaccagttatagatttaaaattgttcaacgagtgaattaatgttgttgtaaaatgattcaccgagtgaattaatgttgtattgtattaattctagattttccatgcaaattaaaacttttaagtttttataaaaatctgttactaaaaatagtggccaaagttttactgtaaacacaatgatttcagttatttaaaaaggatggagggataacttgctgtacaatagctattgcccaaagtactgaactgcagggcacatcctccaatgtgattgcttttttcttgctgactttatgatataaacaacaaagtgtgaaggaaaaaacaggggaaggaaagacatactggtaaagaagaattagacaaatatacagtggtacaaatttagaataaaagaatcttacttggacatttttatagggtttgcatagcagatacttcctccattcttgaataattgttactgttaactacaaccgtctcattctaaacagaaattacttttcaattattacattatgatggatcggagttattcgcttatatttatgatggcatatacttcgataatatcacatatttttaagtattttttttacgaaaagacaaactgccaagtttaaatttgaatagtgtaagggtcaattttattcgagaatggaggaagtaactagattcaataagattacagcatatgacaaaaaatattggccttaaaatgtgccttatgctgtcatgtagtcatgctaacaaaaaaaatgcagactagggttaaatattatttttgcatttagaaataattatattggtattaatctgaagttttaatttgttcctacatcagatacatttcgcatctttatttttctcaccattttttctgaagacatcgtgcatcgcattggttatgtctactgttcaataaaatggaggtacgtactcgtatgctgtactacgtactccagtacactttttttgcagtccaaccaatcagccaagttggtcaaaggagagagagcgaaagagagcaggaaccccgccattcctgtgcagtttctgccccaaaaatctcatttttaatcatcccatttttttcccctgtctttaaaaatcttcctccatgagacttcggtaacaacagctactactggtgcctggtagtaaccagacacagagggaaagcaaaacaagagtgggtgtctcctgttgtctgtcttcctcctcgtttgagctccaagcaagcttagccaagaaacaccataaagaagagagtgagagagagtgtgtgtgtgagaggaggtgagcttctctcacatgcacatggagggaggggagggcattgctgtagcaggtgcaggtggtggccatgaagccggcttcggtttgttcagagcggccgatgtgaccatgacagaggcgcaagaagcagccaaggagtaccagtcttctccctcctcgccgtcgacgtctcctactccttccccgccgccggttgctgcctccggccatggaggggaggccgctgcaacgccgaccatgtggagtttgggcggcgagaagatgccgagtgaggctgcaggggacaacggcatgcagatgtcaggccacagtgagcatgctagcttgagctccggacggcgtaggggccggccaaaagggtccgggagacgccagatcctagccactctaggtcagtatctcccttccaaaatcccaagtttattatacatttttttgtgtgtttggaatatactcatttttccatttttgctggttattttcttgctatattcgccatcgtttgtggatttttctgtttcattgccttggatggggtccagtcagggtgatgtgtaagctcccttttgtgctgaaggaaggctagctagtcaataaccgttagttagcacagtcctgttctgctgttcttgtatcgcattcgtcccctatttttgttcaagtgattatttttgttttcccccctttcttctcagttggtactaaccttacttttgaagattttgtctaatttctgtagattattataatgcaattaaggttttgtttcacatggtcttgtagtctggttattcagaaaatgcgcatttgcttgactgattggtattctgcaatgcttgtaaaggggaatggtatgcgctatcagctggagggagcttcacccctcatgtcatcatcgtaggcacaggggaggtaaaccctctatgttattattcctttttcacaggtcatgactagcttggcattgtgatctggtagcgagagaatgaacactgactgttcttgtgcaatccgttggtacttggtaggatgtggcggggcgcataatgtccttctctcagaagggtccacgctcgatttgcatcctctctgccaatgggaccatctccaatgtggcattgagccagcctggctcgtccggtagcaccttcacctacgaggtatggaatggagttgcatcttatgatggttctatgatacttggcaaagttgtgatctttgacctgctagcttttgttaacttttgatgggtatgtacaaagtcctgaataagctgaaccattttggtctatttagtttggggtcttctctaccaagtcttttaggtcccatatcaccactgtaataaataacggagtaaatacgacaaatggttttcttgcctaaatgttctatcagggggtatatttcca

SEQ ID NO: 63912 - DNA, 12921 bp, Oryza sativa
gttccaagttggatcagcaatatgtgtaatggtcttagagccagaattagtactactgtttaatggaacctatttcatatttaaattgagcatggttgtgctttagagattttgtatgactgatggctgttaaatagtttccaacatatgatcactggtgatttgtgtggactctactcgttaccagttgagattgccgtgttttgctcgtgcagcatattgcagtcttgagtcgctgcaccgggttattgaatgttacaccacctactgagactggaatattcacttgctcagtcgtgccgaatggcagacgctatctgtttcaatttttcaaatggtaggcgtgcttctacattgaagaatggaaaatcgttccatttcctgagttagatggaaaatccttccattttctgagttagcaattttttctctcattttcagtagttggaaaattaaaacagcaatatacccagtctggactggtaggataaaatttaatgttttgttcatttgggtctgaatttgattgtatgtcatagttgtataatttggtttataaatggatggactgcatgtaattatgttttgagacattttaaaaagagactgtctacgaaaccaagtaatttatgtttgagacattttaaaaagagactgtctacaaaacaaaaaaatctcacctcatccatgcgaattctatctagatcatctttgagccgccttcaacaacacctaacccgtgttgctgactagaaacccaattctatccatctctaagttcagtcactatacaaccatttcgcacactaactctcatcggatccaataagaaggagccgcctgatctagctcttcatcggatcggcttctgcctcccaagtccgatgacacaatagcgtgtatgatgacggggaaggaaaaaagacaaggaaaaaagacatctggttgtgcatataaaggcggagaggaggaacgatggtggctcatggataaagtggcatgtggaccatcagtcatcataaagaaatagttagttttaaagtagtaaaaaaattgagataaaggtagagtaagtatggatgaaaacactttggaaacggacgaaaaccacttatcgtttccgtttccatattcttttcaaaattggaatggaatcagaaacacggatacataaacaaaatcgaatattatcgaatacggtaacacttatttatcggaatataaaaaccccttaagccgaacttctaaaatcaatgaagagatgtagctcgatatcttttctgaaacaataaatcaatatttttagtttttatcattaataatacaagtagtcgtacactttattttcttggagaaagagaactatattcatctataactgcaattgttattactatggcacatagtataaatataaatatttagagtagaaaagtctggagctaataaattgcacatgtgaaacacttcgtttccgattccgagaaaaaaatatgaatccgtttcctgaaattttccaaattcgttttcgacggatagtagcattatcatatccgtttctgttttccgagaaaaatatctgaattcatttcctgaaattttccaaattcgtttttgacggatagtttcaggaaacatatatcctaaacggatagtttgggatatatgtttccaaattcgttttcgacggatatgtttttaggaaacatatatgaaattttctgtttccaaattttccaaacatatatgtttctgtctccgagaaaaaaattcgaattcgtttcagtttcttagatccaggagttggcaaatactacctctgtcccataaaaatcgaaattctagttaatttagaacatattaggctttgttcgttgctaccaagtttctgtacgaaagttgcttaaaaaaatcatattgatccaactttgaaaaaaataagctaatacttacttaatcacgcactaatagaccgctccgttttccgtgcgcggaagatttgttcccgaccactcaaaccgaactcagccttagagcatgtacaatagagccctaacgctggcgataatggttccacgttagctcgcgtgatgcgctggaggaaagaaggaaggtgagtgggcgactatttagtcgccgagctgctcacgaactctaagaagttgggcccacagatacaacacgaggggaagctggtccacgcaacgcgaggaagagagataaataaataaacatagatggttccgttaattaaaataaatatataatgtgtcagcaacttattattagagcacaactattgtatcatgtgtctcttaaattatactatatgatgatgatgtggaagaattggagctaagagcgggctgtactattaaacttgctcttaggaggatagacaaatgaccagaataatcttatttaatgaacccatatatgtatatatttcatagtataaaattgattagaatgaattttgagacaattaacccacataattagaaatacttttttttagtaaatttcacaaaactacacgttttgtagtccaagttgcagaaaaccacacacacttttgacacttggcacttaagtatatatatttttgtagtgtcgtttcacaaaaccacactatcaatgaatggattcacccgtgagatgatgtgactgtttcatctaggacgaggacatatcatcctattaccagccatcgcacgaaattaatagggtgccacatcctcatcctagatggaacgaccacgtcatctcaaaaggtgaatccatacatcgacagtgtagttttgtgaaactaaactactaaaatatatatatacttaagtgccaagtgtcaatatttgtggttttctgtaacttgaaccataaaacatgtagttttgtgaaatttacttttttttttttttttgataaaacctcatagctagaaatctcctgtaacacgggtatcttcccttcgctccgttggcgtaaaataaagaggaatctcgcgtctcgtcgtctcctccgctccttgcgccaagacgagtagcggctgaacacaacaggcgaggggcggcggtctccatctggcgagcagagcaggggatgggaggggatcctggtgagcatccacatcctctttctgattcatctctcaatcccaccgggactacttttgtctggaattcgcttgcgtttgttaaccctagcttctcttctagatctggaagaagcccttctcttaatttcagagccttaaccttaatacaagtagcagtttgtttgttccccccaaaagtttcccaagttggatccgcccctggttgttaacatagtagcaaatacaatatgaacaatgagagtcgaccaaagtggagaaaagttgcctatgggggaaggcagccaggctatgacgataaccacacggacgagtcattccttgaggagatggttatgaacgccaatgttgtcaagagggacctcctgaaagtgatgatcgactcggtctccatatctcagtatctctgcattgttgctcttgtggtttcaacatggacctatacactgaacttggtcattgatgaggtcactcttttgaagctagacactagtctacttcttgccgggttttcgatgctcttgctcacggcaagtccgttctcgctcaagcttctctccaagtatgtcctcaatacatcattcttcatcagtggtctgtatgttttggcaccgatttatcaaaccctcactaggtccatcagttcagattccatatgggcacttgctgtatgccttctgttggttcacctctttctgcatgattattctggttcaactataaggccacctggtgcactcaacaacccaaaattgaccagcaatatctccttgaatgcatcgatagtagcatccgtccttgtagcttcgcgcctgccatctaggctgcatgtctttgcaatcatgctattctccttgcagatcttcctgtttgtgcccctcgtcgcgttttgtattaagaagttctctcttagacttcatctgctcttctcctttgctctgatgatcatgaccctaggcgtcacataccaattgcatcacatgttcttcatcctactgctggcactgcttgtttttatctcaattgtttgcccttactggcttataagaattcaggaatacaagtttgagatcaatggtccctgggatgaagctaaactctgctttgatataactgaataacagaggaaagtgcatgtgcagaattttggtttcaatgttcattatctataattgatgtattaccattagtcttattattctggagcaatttatgtgcatgtatatgcttttcttaacatatactaccttcgtcagaaaataagttactctattacgggacgtgacatatcttagaactacgaatctagacatgtctttgtccaaaatcgtagtactaggatatgccacatctcgtactaaattaacttattatgagacggagggagtgtctacttgttcccttactgtgatcaatatacatggcgggccttatctgttctgccatatattgataagctttctgagcgcattcagtggtttaaactttggtgtacaaaataattaggtacaaacatcgtcacatgtaatctttaatcgagtcaagagagaactgctcagcccagtcacatggatttcttgcaataaggtgcaagtgcagattaaccctaacatattggtacttgttcttgtgttgcctccagtttcgttggcagtgctgctcactgctctgtattctgttccgattatatactgccggagttttttttttaagatataaaagaacgttccatcttttgcgcgttcgcgaaaaaaaaaaagaatgttccatcaaccacgaagccctaacacaacttcagcaacatcagctgggggcattacctagcaaaaaatgatcaggacccatgtacaacttcattcctgtacatgtagttgtgcctggttgtaacagcctttttttatcttaatacaaagatatgcattttgcatatttcaaaaaaaaacaaacaaacaaacgcattcctagctgaggtaagtgcatagtactttattacaggttattgagaaatattcaacagacacaacagctctgaacccaaccgtagtagttcaccactggcaatagcctcagattcacaaatgttcttggaacaaagaagattcagttcactcaaatttgcctactgctagagcatatttgagttaaatcagttgtcaaaaagtgaaacaaatattttgatagttagaaaagtaactgctagttgaataacgatatctgatcgtatgatatattaataacgattacatgatctccaagtttttaaggaaataatgtgacggagtatctaaagggcactaaggcaaaaaaggatattgattatcttaagagtatagtggcagagtggcagaagttctagttgcagtgcacaaaggaaatactacgtgatagtacatattttgctagtaatgaactgctttatttcaataacatttctacaaatatttgatcaacatcagcattaattggaccagcacagttgctggtccgggttcttctgaatggcgtgtaaaatgatttctttaaccatttcttttgcgccaagattcagtaagcaaacttcactcttaagcatatctcagcatcatctgtagcacagaatggtttttacttgttgatcagtaatcatcgtgtgaaggaatccccagtgtcctcactggagcagcaactcacatcttttgctcttcgaagcattatttccttctgtcagcactgattgaaaggcgttcaaaggtcctcaaagtgggatcatcatggacatttcttgcagttttggtaagcgaggacctggtctcaagtcctgttgactggtgaagcctctgcatagttgatgggcgactgctgccactgctggttggaattaggttactgcggttcggatcaatgggatctccagaacttggtctgctgcttgacaagagagccttccttgatgtgctcccattacgagatgatgatgtgggccttcttttatctaaatcaacagcctagcacgcatggtaaaattgacataagccttccagaatacagagttccagctatcatcaacagcaacgtaatgtaaaaacacaacaaaagatttctgcgaaaagatggtcaagactaacgaagaaacatccgtctcattatcctgctaatttgagcagtttttttaggatactgctagaaggtgatctagctgctcaatttcttaccgtcttgggtgcaagtaatgaatccaatatatttctgtgctttgtgtgctctccgtaatggccagaaccagagccagttcttctagcaaatggatcgactgtaccagagaatctgtcaggaacatcctgtcttgctgttgagacaacaccccaaaaaacccctgttattttccaaacttatttcctaaatataaattcaaaaaatgtctatgctactgacaaacctgcagctcgttcagtccgttctgcagatggtcccaccaacccacttgtccttccacttgactggaagcaaggaaaagatgctacacatttagtacggtaaagctttgcattaccaaaaaaagttagaaaaaggaatagcagacatactcgcaatctgttactttctgaaccttgcttcgtccaatcaaatatataatcaagctggtaccctgcaagaattgagaggaaatcattttagatgtgtatgcagagatacttcattgtattatatttgagcataccttcacggatgaatagatctcggaaaagtctcttcaaatagctgtagtctggtttatcttcaaatcgcaaagatcgacagtaatggaagtatgaaatgaactctgtgggataagatttacagagaacctatacaaaattgtgtaaaatatgataaggttaagttgcaattaaatcaaaaaatgtcatgcttcttcatagattttttttgcatggaaaccaatttccattacctcaactgggagtaacattttcttttcactaatttggccatatttctggtttttttgtgccagcttttagaccttgccaaggaagctgaaatggacaagttaacatagatcaataaaatgtattgtcgtataaaatggaattttaaaaaatagaaaacaagcatcgtctcaccttcctcttaagaaatacataagcacatagcccagagactctaaatcatctctcctgctttgttctgtagtgaaaaacagaattaaaagaacgcatatactagcagtcagagtgcaattgactaattttgttgcaagctaaactttatttgtttcaaaggagctacacttgttcataacttttcagtgttgccacattttgcacctcttaaatacatattagtttgcgttagttcagatttttaaaaaataaaatctcttctgatgaaaacgaatcagtaacaggtaaagacacttacctactccaagatgggtgtttacactagcatagcgtgctgttcctgtgagatttttgttctccctatggtaggaaagaaaaacatgtaagcttcaaacatatatccccagaaaagtatgaagcataatcatgcatagaaatataatggtagataaactggtaaactttttactattagtatgaaggaggtaactgctaagtagtgaatagtgatagtgtaacccgtgttactgaccaatgtcacagtatagtactaaaacataacagaaaatggtttatcaattatcacaatcatcattgatcaaattgttgcaatgctgctgtcattactcactactatcaagcatttctcttaatttcaagaagtaaaaacagataacaaaattgtgtgggcttatctatatagttaatagcagatactgcttgccaatatggttaatagcagatactgctccaccggtagtgtgccaagcacagttatggtaatgaaaaattctaaattaagcactttgagctctgtcagataaaaacggtgttgctaccaaaacaatatactttagtatgatttttcataagctgagtgctctactacaacaatcttccaggtgtaaacataaatactttctaaaacatttactagagaagaatttctaattacctgtaaggtatatgcttatgagtttggaggtcccggtatttctttgcaagaccatagtcgatgacataaacctgttacagaattgtaaagatcactcacaacaatgtctacaaaaagttgtgcttatttcttgatgttattcattgtaagatatatcacatatgaagtaaatgcaggctttcgatcatcagttagcagcagtactagaaaggcagttgatatgcatatgctgagtaacagtatgcacaaataagagaaaacagaaatattatccttgtattcttcaagttcttacgaaataataaaacgtatggtaaatcgatgatcacagtcagcagtttaaattctccaaagtctttctacattcataaaaaagatgtttctaaaaaatactaaaatttattatacaagataatttctccataaagaaactagtataatcatcaagcacacagagcacagctgacagctgttgttggtaatatcatagcctctcttagaaagtataattgaagatactactgccaattgacaaaacttcatagcaccaaaaaagatgatacttagaaaccaggccaaatactcgaatcaagatgttatcaatacaaaattatacagaccaggcaaccaacaacatccaaagcgcagaaaaataatgaattatatctaccagcaactgcagatgaatgggacaaacctggcttgctttgcggcctaaacccataaggaagttgtctggcttgatatcacgatgtagaaaccccctagtgtgcatgtactctaccctgttgatctgtatagaacaggaagttagtggttaaatcagacaaataaagtcttgaaatttactttccttgatcgttaattaattgaaatttagtcatacaggtaaccaaaattaacagccaaaataatagaattcagtaagaaaaacccaccatctgatcagcaagcataagtactgttttaacagaaaactttctgttgcagtagttgaataagtcctctaaacttggaccaagaagatcgataaccatgacattgtactccccctccactccaaaccacttcagatgaggaattccagctgaacataaccaagacataataagtgaacaattttatttaaatagataaacagtttcccgtattacacttacttcccccctgcagaagcatgtatagttttgactcataatgaagctgaggatgccttgattttacagattcctaacaaaataagagatgacagaaaaggtttaggtaatttgtcccagtgtcagcaaggacaagtaatcagtgctgacagtgactattcatgtcaatatagaaatacactttccaagtttccgaacaccttattttcattattaccaacattttctcatagaacaaggattgcaccatttaagaaagcaatccaatgcatacaggcttacaatatagaaatggcattcatgattagaaaggcaaagctggttcacaaaactagcaactacgtgaacttacaaggtaagttgcttgaaaagtagatgtgaccaaactactaacaatcatatcgaaataatagaagcttctaaaagaagtgcattgaccactgaaccggagcaataatatcaggagaatccttgaatgctgctttgaaacattgaaatagacaataaccaatgcttcacagctacccaacctagccaaaacatgcacaaggtattccaaaaggcttcgtttccccagacggaaaagctttgtttgcaggtcttacaggatgtgaacagaatcacgggcggctgccctgagtcctaatgttacaagagcagataatatagtatgacaagggttggtgggctgcctcatgttatttacagatgtttcagaataagtgctctcgtaaaccacacacatcacctagatgaagcaattaaataatgtcaacgatccaattggaagctgaaaaatcttcacctcttttttcttacttcccaattctgaacatctctaatagaccagttaggtcggagaaccaaaaaaatttagaagacctggtttctacttgtatgaaagagtatgatactaagcaagaggtcatgtcaacgatttcacaaggacgtatacatgtagcttcattcaaatttctgatcatgcagcaatgcaaactctgttacacctcaggtgatctaatcttttctaggagggcagaacaaaccatattcgcatcacaacatcagcacaaaagaaaccaatgcaatactaattactacaatatatacattggcgtaagaaaaggcttatatatcagaaacgaaatcatcttcacataccaacttgatggctacctcctcgctgctctgtatattcacacctgtaatcgaaacaatccatgaatcaacgacatcatcacaaacagcgtaaacagtaagaagaagaaaaacgaacggtgcctcgcaacgagcggcgatagacgagagatccgagaaccccacgaggaacgtaccaaggtatagctccccaaaagatccgctcccaatcttcctccccagcttaaacttccccccgatcacatgctccatccccgcaagattcagcaccgaatgcgcgcgcgaatcgcctcaccccccacaagaaccccagtcacattgcccggcggccgcaagatttgcgtcccgggaacacccaagaaaaggaagatcccggatctctccccccgactccagcccaagattcgccgccctgagacggcgcgggcagatcgaattggcggcgccgcgagattcaggacgaggctagggatcgcctccctctctgtgggggggagaaatttctcggcaggaatcgtgggggggcgggttaatagatggcgatggacgaaggaagcggaaaatgtgggaaacggacgtgaggcaacggatagataggggtagggcggtggattttcttccttcctttattactactgctagaaggaggaggcgggtggcgatggcggcggcggcggcggcggcggcggcggggggagcgtgggaggaggcggccggtggccggagtagaggtgggaggaggaggatgtggagattatgggtaccccatacccacacggcatggtatccgactagttataggggataacttatatatataaaatatgtaacagatcatgacttgggtattacgtttccctgtatattatgaaacggcctaaagtcctggtttgataagattgtaaagtagatttaggaaaccgataccgtattggttaaggtttctatcttgtaatcctgccccccgtcctatataaggagggcagggagcccctctaggggcatgagacaactagatcgtcagatcaatacacacccggcggattcaaatccccaaacaggagtagggtattacctctcattgagagggcctgaacctgtctaaatcctttgtctccacatccatccacttttaggtctcgtgcgctaccccattttattattgccgaattcatgtttcgacagttggcgcgccaggtaggggtgcgtcgagtttcccattgacaagtgcgatggaaactaaccttcagcattgccggattcgtcgtcgctttacaaccaatctcctgcttcggtttcttcgtcgacgacttcggaaagctctcgatttctcacttggacctaatcaagtcgggaaggttcaagactaccttgatctcgtccggccgccgctatgtttatcagtttcattgaagaaggtggccgcaccgcagtcatcatctgttttaatctattcagggatgcgtatcaattctcagccgccggcatctgtggcgccggcatcttgttggtatcgtatctcccgacgagatccaattattaatccaaatccgagtcaacttgtcctcgcagccaatcgattggagcaatcatcatgggccagcgtcattagcaattgcatgtaacaagcacataagccaatccggtactttctgtgtgcatgggaaaccagccgaccaatcagaggaagccgtcggcctaaatacagctatgcatgcacatcgatcaatactgctctgcccagaaagattactctacaatttagcgtcaagcgtatacagagcaaaatcatcatcaccaagaccatgaaggcaatggttgaatttcccaagtcaccaagattcatcttgtatttcaaggcagggactatatctacgcacatgcatctcgcatcaagattaccaagtatcgctcgctgcctctgccgccactgactggtgtcctcgcctatacggttggttggtcacaccaccgttcatgggcgtccatgcctccgcctacacggctggcctattatgccgccgctgttgggcgtctacgacttcaccgccggcctgcctccgtcgccgccgactggtgcctccgcctacacggctagcctattatgccgccgctgttgggcatctacgacttcaccgccggcctgcctccgttgccgccgagtggtgccaccgcctacacggctggcctattatgccgccgctgttgggcgtctacgacttcaccgccggcctgcctccgtcgccgccgactggtgcctccgcctacacggctggcccattatgccgccgctgttgggcatctacgacttcaccaccggcctacctccgtcgccgccgagtggtgcctccgcctacacggctggcctattatgccgccgctgttgggcgtctacgacttcaccgccggcctgcctccgtcgccgccgagtggtgt

SEQ ID NO: 63913 - DNA, 70223 bp, Oryza sativa
ttcatctagatgaaactcatttcacctcttcattattattttttttgtcatatcatcaaaaatgctgacatgatagtcaattcaatgagacgtaggcgtgtatttgtgtttttgagtttggtgttgtaagatcttggtggagggtttcacccaccactttctttctcttttagtggaatgatatgtagatctcttgcgtattcgagaaaataatataatatttttttatttatcgcacataaagattgtgagcaattaaactttttgttttttcttattaaaaaaaacatttttgtgttttcctgccgatggtgttgctggcattgaagtttcttcactccgttgtaggtaacatgttcttattcttattcttcctaatatttcctccgtcccaaattataaggcctatatttttttatatagtcttcagtgatatactttgaccattaatttattccatattttgtttccaacaaatatgaaattagcatcatatgaaagtactttagaatatgaaactaatgatatagcatgcataacacttacagatatatagatatgattggtatgattattagtcaaaagttatcaagtttattcttaaaaaaagttatcaagtttaacttttcagaaaaaagaggacatcctataaattggaacggaaggagtatgttggctccactttccttatgaatgttaacaattgtagttagttgcatggggtgaggattgtgcataaactttatgggaactttcttcttggtaaatctctcaatctcttataaagaaacatgcgcatggatttggtctctgttgttctcacttctcagtatgttcgcttttgtgatcatatcatgcacaaattatcctgctttccagttagttgaagccacttttttaacacttcacacattacttagatgaacagtgttagtagttcgatattgggaagttgttaatgtgaactgttcttcagaagtacatctctatatatgttatcacttacggtggttgttgatgttaactggacctcgatgcatacatgctattgagctgcttctttatactttttccttgagcagaaagctatacgtgttttttctgtgattctgttcttgagaatatagtaaaggaacttctttttcaaagactgattaaaaaaacatgacctttgaatcaagcttgtgacctctcagataacaaactttttctgccacctagttatgagtataatatggcttacatttacgcaggcgaaaaatggaaacgagaaaagaaaaggcacaatgagaaacaacggctgatgtatctattatgttctgcccttctttcactgctgcaaaatcgattttcccaaacggtaaaaaatcaattttcgcatgtggttggtcgaccagcatgtgtgaaaagatccgtgaaaatcatcattttctcatacaggtagcgcaaccacatgtaaaaacgggattttcgcatgcggtcaccttagccaaccgcatgcgaaaatattttcggcgaaaaaaaataaaaattcaaaaaaaaaagccgaaaccctagctggccaccagccacgccagatgacctcatttttgcatgtgaaaatcgattttttcatgcgagccagcctcttaaaaaaccgtatacgaaaatatcctctcgatttttcaggtccatttataatctacggagggtctcgtacaaacatttttaatagtgtttgttgtgacgaaatgtcttaatcacatggatggcggggtagctggctgttgcagtagcattaactgccaactgtgcgctgctaatctgatttgatccaaattatatggttattaatcaaatcgtgcccggagaaagcttctataagatatgctcaaacttgtatattttggtgcttctgatgctgcgacagtgtgatgctctcgcacatcgattggtggaacagagtatcccggtcaaagccattagccaccatcccgacgtcttcctccatctcgcatatctctgcaatggcagggaatgcgtcagtgatgcggaggctctacctctctttctacaactggattgtcttcatcggatggtcagttctactgcctgctgtttgttgacttgtgtatgaatatcgatctcacttctagcatctttctttgctggccaattcttggattgtacacagggtgttgttttgatcgaggatctttgatttggatcatgcagggttcaggtgtcgtggtccatgatattggcattgttggagaacggatatgaggccgtctatgctgccgtagagcagcatctgctgttcgcgcagactgctgccatcatggaggtttgtttttttttttctcttgttgcctttgttgtagtaaaactgtaaatttgaatgcagctgtacaacttttttttgtttcattgctcatggagattgagaggcgctaaactttttatgttttgctgtttgcctggtgatggtgatgctggtagtgcagattcttcactccattgtaggtgagatatcctctttctttataaagaaaataataagtaataagggttggtgaggtctccagtgtcttctactattccacaaatcactggaaggttgttcatgatctggggcatcttgtggagcttccctgaggtaatatcaggaccttactccaagttataagaaggtttatatcttaaaaaacaagttttggattagaaagcacttcttagaatgatgaaacatagatgttaggtaatgttgcagctattagaacatatcccatactttcatttatgatcaaaatgactctaagtaggcattggacaaaccgaagctacagaaattgcttaagtaatgaagcggatgcaattacatcatggagaaggacaaaatagtgttcttttcctagattcctatttcatgtatttaacttctaatcaagtaattgttttatttataaacaatatcggtgaatcactgtccacatgttttgcagacacacactcatatttttgttacctccttgctcataagctggtgcatcactgaggtatatgttacttcctaaaacttctcaccaaattactcacttggaagatcatggatttcggatgcaattttattatagttctgcttcttgaaatgacagtagttgttgaagttcctgaaagaaaatcccaagctttgaaagttcctgtgttgagcttagttgaacaaatattatgaaattttcttcacttcagagcatgactttgtagacaaaaaattactaattccttgcaggttaccagatattgtttctatggcatgaaggagtcatttggatttacaccttcctggctcttatggcttaggttggctctagtcgtaaacaaatcataatatgtagcataaacttcagcgaattctcttaaaaatatgctgctgttacttccatactaattactttgcaggtacagcaccttcatagtatgccttcctgttggtacggttagtgaggttggcctaatctacattgttcttcctttcatgaaggtaacttaaataacttagaaaggaagatctctgcctccatttcataacaaatcttgtttaaatgctcttcttttgcatgagcaatatcaggcatctgggaaatactgccttaggatgcccaacaaatggaatttctccttcaactacttctatgcctctatctttttcatggttttgtatgccccaggtagtgtttccatgggattgtacttcatttagtaattgatgctacaacctagtactccctcggtcctttaatatatgacgccgttgatttttgttacaagttttgatcattcgttttattcaaaaattttgtgtaaatcttaaaaatataaataatgcttaaatttcatttagtgttaaatcaagaaaaatatttacttaaattttttgaataagacaaatgaccaaatataatgtaaaaagtcaatgacgtcatatattaaaggacggagggagtattttttttaaggtagttgtaggaatttctgaaatgaaaacaattaggatttgataacacactgcgttgttgtttcatttggatgagtgcagtatatccacgcttgtttcgctacttgatcgcccagcggaagaaggccttggcaaaagcaaaaaccacataactatactcaagagctatctactctgatttctgctcgcggctacagctcaggttgctaccgtttcttgagcaaataagtaaaagtgtattagaatggaaatgccgaaatacagactatcttttcccttggtaaataaaaatgtacacgagtaccattttcatgatttgctaatggtgtgtcctaccaaagatcggcttttccttctgtaaataaaattgtactccatatctgtgcccaaaaatgatgtgtagattttctgctttttaaggatgaagaaggtaactatcaccatttgattcatactagatgggctggcgcggctcacgccgcgctgcacttgtggtatcattgaacacaatagacataaaacagactattggtaatgacaataaaaacacaagaacatttaaataagttcacatgctaacaaagtcttttgtctgtttcaaattacttgttgttttaactttttctaaataaaacacttgtatattctatcatcaattcctaaaaatcaacttaattaaaaatcgtaagatctatgttttagattcaccatgaacaatacttttacaatatataattcacatcttacttaaattaaacaaggtttttaaaaaattaatgatcaaagcgtttgacttagttaacagagggagtagctaagttaccgcagttataggctttatcaagcctgtagaaatcaagaaaccgctcagcaaaataaccaggtttgagaaaaaaaatgctgaattcaatttttaggcaaaatctgtaagaattcgccccatgtttttgtcaataatagagtgaaaccatgattactggaagagcaaaatcacttacgaagttatgattccctgcagacaccacatattacaaatgtagatgatgcttgtccgtctgtattcccattgcccaaacccctcaagttaaatcagagacaacggaaaagataagaagatacaaaacgacacttcttacatgacacataaaacaaaaaaaaaagaaaagaggaataaacaccacacacatctacaaaccatctctgaatcttgttcagttttctgctcctaataacagctacagtgaagagtgacatgatccatgccccctcttctgccaaaatcacaacagccttgcaggcaatgccggtgacgggcggcgttggtcaggcgaagcggttgcgacggcaggcgacggtggcgaggaggctagcgatgccctttggttcacatgtcaatgctctctatggatgctgcactcgaactcgatcacccggtgctcttcatttgctacatcattttcttcaacaaaatcaggacatatcacagatatctctttattttttctagggtaatatcacagatatatcaggggtacaccgtatacactcgtgggtatctaaaaatttatagacatgcagtaaaaaaaaataccacgtacatatcgtcagaaaggccatatacgagcaaaattcgttcagatgggctgaagggaagagtttggcgtttcagtaaaaaaaaacaattgattgattctcatataaccatcctgcaaataatacttgaaaagattgctactcttatatggcaaaaacaaaatcaacacaagaaaacatttgagttgccctgtcgaaccagaaattttcaaaaacctgctactccatcaaatgtttctgacaaaacttactaatatggtataaatgacggagggaatgagaagcaacaagcacaccaacattttttcagaacaacatagtggaaatctagagccccaaaattcctaggatggattcattatgaatagagcagcacatttttagttgctttgttgaacagagcaggatatcaaagctcctgaacggaaaactcactaaaaagattatcatggacagatttgtgctactttactgcataagaagactcaagtggtcaagaacaagaatatgactgaacacaaatttatagaacttgcaggttgcagcaaatagcaaaaaggcggttcaaacctccctaaataattcagagcttcgagtccgaataacagaagctcgatggggctcatcacccacgcatagatcagagcttggaccacgggatgcagatcgcttttgagctgctgtgtgctagattcagttcgggtcaggggcgccgagatccattgctccatccatccgccatcccatgaaaaaaaatgcaaaaggagtaaatcggtcactcccgatgtgtacctgctcctggccgcacaaactttgcagctcgagatctaggggcaagcagacaggattcgaaacaacaaattccacaaaacaaaatgaaaaccttcgaatgggaaacaaaaatggaaatgaaacaaaatcatgagccaatcgaacagagtgaaaaccttcgaatgtggcatgttgaccaagcgcttcggctgactcgaaatgattttgttgaatcgaatagcaaatgatcaatggtgtttgggtaggttacctttgcgggtgcgcttgaggagtcggtgccacgggcgaggagttcttggctgcagatggtgaggaagttgttgtcgtcgtcgtcgtcgccgaagctgttgctcgtgttgctgccgttgccacggtggcggtggtgatgctgctgcttctgggcgttgtgtttgtagtgttggtgatggttgatggcagcgatggcgttcttctcgacggggatcacagcggccacgttccacacgtccctgaacgccctcgccttgaccgtcgccacgcctctcaatgctgcgttcagatatcaagaacaagatcaatcacggtgcctcgatggagatgatgtgaatgggtggaacagcgagggcgaaccgttgccccattggcagcggcggcggtgatggtgacgatgtcgccgggaggcggacgctgacagtgaaggcgacggcggcggtgaggtggtcgcgctcggcaccgagggactcggcggcctcgacgcactgggcggggaacagcttcgccgcggacggaatggtcatgttggtgcgcgcagtgcggtcgtccctgccactgctggaggacgcggtggtggtggccaccgctgccaccgacacggcggcgtggacctgcgcgttgtgcgcacgcgtctcctcccgtcttcttctcattccctccttcagccacctccccaccgtcttcccaccgctgccgccgccgcatcgatacggctgcagcttcggcgtgctcaccgctctgcaaaacaacacattttttttcaaaaaaaaaatttgttaaattagcaaataactaaggaagaggggtaccagctccggcgccgccggcagccaccgccgcgaggtgaggaagaagaagacggagagggacatcgacgtcgaatccgacgcgccacgcgtcccgacgacaccgtaaggggaaggggagggggacaacggcaccggcctcgacgccgtcgcaaggggaagaagaagaatgttagttgcgatccaaattcatttgtacttaataaaggccagcttctgccgtagcggagtggatcatcatcccttttagggttccaccacatatatatatatacctgttgtaagccgccgtgcggcgatataacctcacctcacatatagtgaagataattttgctggctggcgcctgtggttttttctctcctgttctgagagggttttccacattaaatctcgtgtcttctgtgattgatctattgttcttcatcgtttgttcgcctatcgttccctaacaagtggtatcaaagcttgttctcatattagggtttcgcgatggcgtcgatgaagtatgatctatcgctgctagactacaagatgagattctcgctgtggcaagtcaagatgcgggctgttctggcgcaaacttcggatctagatgaggcgctggagagcttcgggaagaagaaaacgactgagtggaccgctgaggagaagcggaaatatcgtaaggctccgtcgctgatccaacttcatctatctaatgatattttgcaaaaagtgttgcaggaaaagactgctgcagaactttggctcaaactggaatcgatctgcatgtctaaaaatctaaccagtaagatgcatatcaagatgaagttgttctcgcacaagttgcaggagatcgttgccgacctagtgtcgatggaggtacagtttgatgatgaagatttaggtcttttactgttatgctcactgcctattccatatgcaaattttcgtgacaccatacttttaagtcgtgatgaactaaccctagcggaagtttatgaagcgctccaaaacagggagaagatgaaaggtatggttcagtctgatgcgtcgtcctctgagggcgaagcattgcaggtcagaggcagatctgagcagagaacctacaacgtgtcacgtcctaataaattcatcccgaaataaaaatcattttctaaaaggaataatagaattaattaaaattctaaaagaaattggcaaacactaaaatacgtacaagaaaaattcaaatgtagcccggagaatttttgttaaattctccttggtctaaaaagagccctcaaattttacttaaattttcagagcaccggaaatatttattaagcaacaacaactatgatcaaagtttacttaaaaagaaaaacctaaaattaatccccctcctccctttgggccaagtttggcccaaagtcctctctctctttctctccctctccgtctctccctccttctcttcggcctccccttcccctcccggcctactccctcctcttctcctcctgggccgcctcggcttcgcccggcccaagccgagccgcgcctcccacccgtgccgcgcacgtgcgcgcgcgtgcgcgccgttgccgcacgttgaccgcgcgcctcccgcgtgggtcccgcctgtcaggccgtccccgacctccagctgccggcctccttcctctctctcccgtgaaccttagcgttgttcctcctccaaatccaccccattcaagccggctctttccaaattaaatagggggaattaatctccattgattcctctttgatttcccccgttttcccccttgaatcgtgcccccaatcgccgggaacggacgcgccaaccccggccgccattcccgcctctgttccggcctctctcgttgccggctccctccccgcgcctataaaatggaaccccctccttccgttctccagttttagccccctcccgcgctctcccgtggccgccccacctctccccgtcttctccttctctctctctccggcgtatggccatcggggaacagaccagctgcacgttcatggaggttgctgtgcccaactcctcaaacagagactgcagccggcagtatcactttcagtcttgctgatgctcgcaagaagtttgcagattgatgatgttggattttagtactagatgtacggtaggtaactggacgctgtgatttaatttagctccatgaataaatcggacaaataagatgggagcaggggttttggtagtttgtgcatgtgagaatcgtacaaattaattaaaatagttccaagaaagctcccatgaagtgtactgtaactttatattgcattttattacaagttaggtgggccatgcatttgtaagttcaggggagtgaaaagaatttagaagaccaataattagtaatacctgaaagaaaataatccctaagagttgggacgtgtaaaacaaatatcatcgtcttgatgaagttatggagttatagttgtgggactcgttttttttacataatggattaaaccggcctctacatccaaacggatgtacacagccaaagttgtgggactcattttagtcgagataaattcaaatgacacctaaaattaaagatggccttgtgaattcttactctggaatactcggtgcagagactgagaattatttatatcaatatctttaacatcacttattaccaccgacaatatcccatatattgatgcttcctatgtctccttcctctcttccatttctgtgtttccagatagcctctgttttttttttttggtcaatacatggtctatctcgtctcttactgaatgtctatctgataaatgaaacagtacctactgcttaacaggagtacccttcatttgggaataggtggcatgaggaaataagcacattgcttttttgaggatatcatgttaggaagccaatgaaaaaggacagggacactgcctgcttttcctgggagccggccagggatattaatcgtcggagatatcaagaacacaaagttgaacacaaagttgaacaggcgtcgaatctcgcaagaggcaaagaagcaacgactagccaacctgggcacgaccacactgtaccatatctgtgactttggatcctttatatcagacaaatttgtaactaaagatgcatggcctgcatgcatgatccacatgtccaatttactaaaaactaagtagttaattttgaaaaatttcatatatgttttatcgaagttgcagaaaatttacaattggcacttttaccacagtgttggtaaatgcattttcccacgaaaacacaaccatgtgtgtgaaaacatatgtagacatcaaaataaaaatgatagatagtcaagcatctcaacaactccatcaccacagtctgcttaaccagagtgaatttttatggccccttagtgagcaatttcatgactttctgtgtgtaatcgaggacgattgagaagtaagtaaatttgaccttaagaaagatttcggacatgcgacaaacactaaaagctattaaggccattcccaacccaataactggatggtgtctatagcattaaataagctgccaccgagaataaaaaatgatgtggcaagtgaataaatgagtaaagagaagaaaccatgtcttgcatgaaacatggtttctacgtaacatccaagacatcatgtgagataaatagcattaaattgaagtatggaatagtggtgtttgcattggaaaagtagtgtctagtactagtttcttgatgatgtggagtttatcgaaactatgtatagtatcatgggtaagtaatggcctaagaagatcatacaaaaaggtgtgaaaaacaactgactactcctagttatgttttctccttgacctacgtgcatacctacgtgcatacttattatgtacatccttttcacctctccacttttttttctttcaaaaaaattaactgtatggccacctacgcaattttgacacttccaccatccattcctcctccagtttacattattcttcactagataagggttacttcccctatttgtctgcaaagtgtgcggcgacgcgggaggcgcggctagatcggcggcgcggtgtggtcgagggcgtggcacggtgcggccaaaaaatcgcgaaggcagcggaagacactactacagaagatgtaaagggtgccaggtgggaaagccccttcggtgccggtttttccaaccagcacccgtatggcagcactgattagctagggtgaaaggtgtcggttccaaaaacagcacctttgaggcgcccatgagccaaaaataaatcggctagatgcatcgagccgatgcattgagccgtcaagccaatcccatctaatacctaaatctcaaaatttcctcaaatcctcaaaaatcacattcatcaagaacactcgtcaacatcatcacattcattaaaaacactcatcaagaacacatcaacatcatattcaaacacattcatccagaacactcatcgagaatcaagaacactcatcatattgccttcaccaccaccgccactaccgccactaacgtctccaccgctgccaccgtcatcggatggagaggagggcgccgctgccgcagcaccgctgtcgctgtcgccgggccgccgctgccgtatccccttctgccgccgggccgccaccgccatctccctcccgctagatctggtggaggggagggacccgccgccgggccgtcggaccgccgtcgcctcccctcacgccgccgacctgtcgccgccgcacccccttttgccgtcgcgccgccgacgccacctcccctcccaccagatctggcggaggggagggcgccgccgctgggccacagtatcccctcccaccaccgaccggccgccgacccaccgccgccgcagcatcccctcccaccgtgcacgccgattcagctgagggagagagagagagagagccgattcgatcggtggagaaagagagagttgagagagagagagagagggagggaatgcataaggaaaggagaggagaggagatgaatggataagattgatgtgcaggccgggggtcgggtcggctcagctctgctcgatttatttggttgtcggttctttctttaaaaaaccggcacgtataatatattatatgtgtcggtttttaatcaaccgacacctataatatattaaaggtgctggtttttattaaaaaaactggcacctatagaatatatattctatataggtgtcggtttggttttatacgatttcaacccgcggaggtgggaaaaatcttataggtgccggttttagtactttcggcacctatagtggcgacacctaattaatgttttgtagtagtgagaggacgtgagatcacgacgcatgcgcggaagaagcggcgaatttgggtaggagaaggaaaccagtatttgataccatgtagagaattatgagacaccacataacccaacatgaggggattgtatttatatagccaatgcattagagattacaacaaactcttaaataagagatctatacagatagaatagatatctaggctatacaaatctaatataactctagtattgttcaagtcatttcggaatgtgtggcatccggaaagaagcatattggaccatccagttgtgatgtatgttagtgaagctaaggtctgaaccacggtccaaagactgggaagagtcccagagacacggcctcaccacctgttgatcatggaccagcgaagtatacgtggactacttgttcctaggtcgtagcatttgttgtaatatgaagtgaattactccgtattttcttattagttaagttgataggttgagctagtcgatgcatataactttgtatggaactagagttagacgcctcgagttcaaatccttgctagtgggcaattaaataaaaaaactacagagcacttctattctacgctagatacttgaggcgacctcgcatgcggaggactgtttgaggggggcttgcgtaaggagggatctcctaccaatatgtgaggattaatctgtagccagggatttttatataatttttgtaacaattaaattgcttcgtgtgaaattcatacaaaatttctacatttctgttttcaaaggagtactaaatctatgccctgttgcatgcatgacccacttgtcatttcaaccaagtccataaaaatgatttattcgccaatgcgcattggaaatgattcttatttacatcaagctatatttttatctagtcgtgatagttatgtaaaaggcctgtttgcggcacacaatctgaagtgtgttcaacaaattcttggatccattggaagtacgaaagtaaagtacacagatatatctttgtaccccacatctcccttcaattccaatctactaggatatgcctcttttttaatccacatgctcttctcgtccatggcttgaaaccaaccatcgtggtttccaatagggtttctgcctcctctttctgcttgcctaccagatgaacactatttcctccgtttcatattataagacttttagcattacccacattcatatatatgttaatgaatctagacatatatatgtacctagattcatgaacatctatatgaatgtgggtaatgatagaaagtcttataacctgaaacggaggtagtacatactttttctttgagagatatttatatttgtatgtcaaaatatgcacgaagtgcacaacacacataatagaatattttatttgagaatgagcgacatcagataaagaacatacatgatattcttgatatcaagtacactgttatcagggccggccctgggtctaggccggttgtgcgaccgcctagggcccaggccggtgaggggcccatcaccactcccccgggagcccagcccagccatcagcccacgcgcaagacaggagggagggatacagaaggccacaatgccggttcgttaatcgctactacctccgtcgtcccggaatataagcattttttagagttggacatggttattaagaacgttggtataagtaaatgatgaaggattgtgattggctgagtagtggaggtaggtgggaagagaatgttggtggagaagttgttttattttgagacaaatcttgagagctaagagttgttgtattttaggacagagggagtagttcgcttcgttttctccttttctcctcgcgaatcgcgattccgtttccgcgagtaactctccaactccgcgaccgcgacgcgtctcatctccggctctccgcgctgacggcgccagattgccgggcgcctggccgagtggccgactggccgccggcacgccgccatgccagggccgcttctatcctctaatcgccaacacctgagcgcccgagcctctgagcctcacgcctcttcccgactccccatctccagtctagtagtctcctgttgtggtgttgccggccataagccctcggcaaactgaggttagttaggtactccctccgtttcaactttctagcattacctacatatagatgttaatgtatctaaacacatacatatgtctagatttattaacatctaaatgaatgtgagcaatactaaaaagtcttacattatgaaacggaggaagtaattaggttaattagacaaacaataaaccgaggtttgttgcttgcatcattgtacgatatttccactcgaaaaattagattaattaggctataattttcatgattattgctgtataatttactttacaatatatttactatttcaggtgttacaatgttatccaaaaacatttgttgggtgcttagaaaagaaaaaaaaacatgaagatcaattaataggttcacaaaagaaatgatttcgcttcaagaaatgtgcgaagaagcccttttttataagggagataggatatttgtggtctcctattaagtattcatattactttgtttctatggtgtttttttcttgccaattatactatcaatattatttatcaataataaattacaatattgcaacttgtaaactattattatttaccatgttagaaatgtttatttgtgtcactatatagtgacgtatatgtgctttatatagtatatatattaaaaataaaaatatttagcctcaacttcttaaagacctattgtgtcaagttcatctaggacctctcaaatgtcaggaccgaccatgactataagtcatctgaacctagggccgatcctggggcagggcgagcagtgcaaccgccctttgttcccgttacctcaagcaaacaccagccttgcacaatatgtctgcctagcttgcacggccattacacgtaaagtagtaaatcactgattatgtgctagcacaagcacgttaacgttatcaaaaacccggaagctcatcggtacttgcgcccctactcaggaatcgcccgccgttgaaaccatctcgttcctctcgaaggcatctactctctcctctcgatacaaacatctatcagtactagttggcattcctaagcaattggtctctcttggcaaccatgaactaatcttatcatatctttagcctatggtctatgattaataacatcttgaacataaaaatcagatagaattttgctgatttcctattgttttatagctagagataggagcttgaatgaacaggtttgggcccgggtttattacttctctcgattggttgattcatttctcttgtagctctgcactaacagatagtatttttttatggagacataatataaacttgaataattttaatttgatgtctttttatagtatttaggtatgctattcaactatcacctaacaatagtttgtgcttaatgatgtctaaaagttaaacattactttctatttgaaatataaattatttgtcatacatacatatgtactaatgttacaaggctctttatttttgcctcgtcctgggctaccaaaatttcaggaccagctccgactgacactgtatctactctcgcgtccttctactcggacatgagacattaagggcccctttgacttggattcaatggggccctaataggttaattaggtcctgtttcgattttaacttttttcttcaaacttttaacttttttatcacatcgaactttcctacacataaacttctaattttttcgtcacatcgttctaatttctttaaacttttaatttttaattttgacgtgaaacaacatagcgttaattggaagatctagccggcaatctcgctcgtgtccttctctcttttgtttcggcttcactgcgcgatcacacgtctcctcttttctgttcggcttctgcgcgatcgttgcggctgcacccacctgtaggaatgttgggcgctgctgttagtagttctgggcgaggggtgccaccaagagccaacgccagctgagaattttgcatggacacttttttatttttgcaattagtcacttgacaacttcttgaatagtatgaatttgttaattactccctccttccctaaatgtttgacgccgttgacttttttaaacatgtttgaccattcgtcttattgaaaaacttttgtgaaatgtataaaactatatgtatacataaaagtatatttaacaataaatcaaatgatagaaaaagaattaataattacttaaattttttgaataaaacgaacagtcaaacattttttaaaaagtcaacggcgtcaaatattttgagatggagggagtatatgcgttgtttgagtaaatttcagttgtgtcagttttaggacgaagaataacactcatcttccctctatagcattcatatttcattatcactacttcttaatggtctttatttatgcccactattatgtaatagattttcctggacgacgccttattttatttctatgcggttcgtaaatgcaaccatatagaaaaatagagaaaccagtgttaggctgtcactcacacgagaaaatatattgtcccgtgtgggcggcttaactcactcgcacgaaaaaaaaacttcccctatccctttctctctctcctggcctctccctctcgaaatttcaaaaaaaatttcatcctctcaactctctctctcctccccttcgtccttatccttatcaccacctcatccttattcttctcaccacccacccctctctctctcctctcctgcaggatgtgcttgccgagcgaggggggcacggcggaggcgaggccgatcccggcggcggcggagaagggggcggcgagccctagctctggacgcggcagcgagccctagctccggacgcgccggcctccgcctggacgacgatgacgacgacatcgccgacgcggcggagacggaggcggcgagccctagcagcaccggcacgcgcggcggcaggcgcacgggcgcgctcctcagcatggctcgatggccggcgcgcacggagtcgcgggcggtgcggagcgaggcggccggcgcccggatccggcggcggcgcccctctcccgccctcccccgctcgacggtgacgacgacgacgttgccggctccgacgatgacgacgatacgttgccacagcagggcggcagcgagcgggttggcgcgcgagtagggcggcggcgcccggtcctgattttcgttttttttattttcgctttttttgggttccgtgcgggcggtataatttgaccgattattccgtgtggtccacttaatccgaccgcctgcccgcccggttgggtcgtccgcccgcgaaaatattaattttcccatacgattggctggagacgggccggacaatcgcacgaaaaaatcgaaatacctgtatggaaaaatgttgtccgtagtagtggctactgatttaactatgtggttatcgataattatatccagttgaaagtaatatgagttaatcgtataagtcgatatggattattaatcattccatcaggtaaaaaaatcaaataggtttgattttcgtttcataagcttccctggtaggcctgtcaactttttatccacgataacttatatatctacttcatgcagtccaagaaatagatagttatcgtggataaaaaaaagagtatgaataccctcttgaactatcacagtcgatcgaattacccccacccccaagctaaaaaagagatattttacaccctaaagtatataaacaggacaaataaccccctaacttaatctgaagtggtttcaatcctatatggtagtccaatcagcaattattttattaaaaaattggtgggccctgcatgtcatactctccctctctctacctctttcccctctcacctctctctctactcttatcatcctctctctctcaccgagcatagcaaggaggaggcgacatctgctgctctagcaattaatcccggtgtatgcattatattgaatgagaaaaggtcgctcgtgcaacaaatggacgtagtggtgtaagtgggctaacccacgaattcccttatagactaatggaataagttcatctgagatcccttaatttgtcaacgaatccgattttcgtccttcaaccggaaaatcagatacaacgggtccttgaactatcaaaaccagtgcagatgaagtccctcagcggtttagatggcggttttggctgatgtggcgcctatgtggctaatttgactcggtcttcaactgacgtggcattcacgtagcgcttacgtgacaattcgatctggaaaaataataaaacccgcgggacccacatgtcagtttcacacataaaataatttcaaaatggtggggcccacgtgggccccacatgttagcctcactccaccctttatccctctccctcggcttcctcgccatcgtcgacctcgacggtcgccgcgtcgtcttcctcggcacctccaacatctacggcttcctcgccaccgtcgacgtcgacggccaccgcgccgtctccctcagcacctccaacatcatgctccgcaactgcgagctcaagataacgacctgggccatcggcgtcgcggtctacaccgtgcgggacaccaaggtcaagtgcagccgcctggagacccacacgaaccgcgagaccatcgtgctcactctcctctgcaccctcgtctccctcctcgccggcatctggctgagcgaccacagcaacgagctaggcgtcatcccctacttccgcaagaaggacttctccaatcccaacgagatcgagaactacaaatggtacagcacaactcccaggtggtgggcaccgtggcaggggccggggtggtggggctggtcggaacgctcaaccgcgggctccgacgacgaggacgaccactccggtgccatcgccaccgcgtgcgccaagaaggcaccgccctccatcgccgtcaggctcgagaaggagatggcattctacggcgacggcggtggtactgagggcggggatgtggccagcgcaggaccccgcggcagcgctattgacagtcgttatcgatcagtttcgaccgtcaatattattaaaacaggcgagaactagtgatgcttgcgatgcatatatctgttagaataataatattccactagttttagatatactaaccttttgcagagaatgacaataaagtagaggagaatcgacatcaacacagacgataaatcaatcggacgatgtcgagaaccagacttgtgtatgatgggccaagaacgcagacttgacacgatgaatcaggccaaaattcacaagtctacgaagtgaagcaacagaggaggccgctagccgaaattgggctggattgggccagccccaggttcggccgaacctccctcgcctccgttggatccaggttttggatggacggtggagatgaagccgcaatgacggttggaggtattaccgactattccaaccgtcatagctgagctataaaaggacttcactctcttcacttcaacacacacctcaagcaagagctctctcattcctctcaagtttagtttagtagtatctagctggtagaatagaattagaataggaatcaggagtccggaagcgttcggaagagttcgggtatggctctagtagctttcctttcctcttttgtaagctttgtacttttattagaatactcttctatatacatttctggtattgaaatactttccgagtatatgagtacctactttacattatgttcatgttatgctgaatatactgctagcttatctgtgagatgctttggtgcgggtatagtctttgcctatgcaattactctatgtcatgacgatgatattagagtagtatctggcagtttagacgtggtgtctagattacgggataccattatttggggttatatattgcggatgataggtgggccgctgatggtgacagctcagtacgggtattcctccgtatttagccccggttggatggtcatgacgggctgtcgtaaggaactcgacagtcaggggtggcttctcgaagtatcaggagggcatcggatagagggtattagctagtataccagttaactagaatgtatgtatactatgtatattagaagtataggaatagattctctttctcttttctttctacctagcttagattatttattatgaggatgagtagtaatggttgtgtgtcactctacccttggattatcttaacccctacttagaatatgattatcacaagtgatatataaattattagttgagttctctctacatgatcttcccacaggataaaataaatacgatacccttggaatactctcgggtgatatgctacaatagtatatccgtgcgcttgcaaatgaactctgtaaccataatataccagaagtatttatgcgccattgttgggaattatatttctaggaatgtcgttaagaaataccaacaagcgccgaccaccacgccgccagtctcctccaacaagacgcctgcacccaccgctgcgccgaccacccccgccactcggccgtggggcccaacaccccgcgcccgccgttgcacttaccaccaccttacccgctgcagtgccgaccacccccgccacctcggcccccaccacggcgcccaccgcctcagctccggccactgcggcgcctcctctccgccggtcgaggctcctgtcgctggtgccattgtccaccatcttggggatccctgttgcggcgcacggcgagcagccgccgccactggagctcggacagccctcctcgctcgcctgctccgccgtccacccgcctgtccgctccggcgctcaacaggaagaagagagagagaggggagacggaagaagagaggagtgaggatgaggaagaaatgagtgatgaaagggagatggaagggagtgaggggagatggaatggagagggatgaaagggagaggaagaaataagtgatgaaagggagtgaggggagatggaagggagagggataaaatgagtgaggctgacatgtcgggccacgtgggccccaccattttaaataatttttttgtaactgacatgtgggcccatggtttttattatttttccgcgatagaattgccacataagcgccacgtcaatgccacatggaacgaagacctagtcaaacaagccacgtaggtgttgacggtcattatcgatcagtttcaaccgtcaatattaccaaaatagaggagaactagtgatgcttgcaatgcatatatatcttagaataataaaattccactagtattaggtatactaacctcttgcagggaatgacactaaagtggaggagaatcgacatcaactcagacgataaatcaatcggacgatgtcgagaaccagacttgtgtgtgaataggccaagaactcagaactaaaacgatgaattgggccaaaatttacaagtctgcagagtggagcaatagaggaggccaccagccaaaattgggctggattgggccagccccaggttcggtcgaacctggtggttcggccgaaccaatcctggcgtcgttggatccaggttttggcgtggacgtccaggattgcatcccaatgacggttggaggacacttcggacaattccccttccacaaccgtcataactacctctatataaggagctcactctcttcacttcaacacacacctcaagcaatagctctctcatttctctcaagtttagtttagtagtatctagctggtggaatagaaatagaataggagtccggaagtcttcggaagagttcagatatggctctagcaactttcctttcctcttttgtaagctttgtacttttattagaatactcttctatatatatttatggtattgaaatactttccgagtatatgagtacctactttacattatgttcatgttatactgaatatacggctagcttatctgggagatgctttggtgcgggtataatgtttgcttatgcaattactctatgtcatgacgatgatattagagtaatatctggtagtttaggcgtggtatctagattacgggatatcattatttggggttatatattgcggatgagtggtgggccgctgatggtgacagttcagtacgggtattcctccgcgcctatatataatcctaagttaatttcctggggagggtatttctccgtatttagccccggttgtatggtcatgacggactgtcgtaaggaacttggcagtcaggggtggcttctcgaagtaccaggagggcatcggatagagggtattagctagtatattaggtaactagaatatatgtatactatgtatattagaagtataggaatatattctttctcttttctttccatttagtttagataatttattatgagaatgagtagtaatgcttgtgtgtcactctacccttggattatcttaacccctacttacaatataattatcacaagtaatatataaattattagttgagttctccctacatgatcttcccacgggataaaataaatacgatacccttggaatactctcaggtgaaatgctacaatggtatatctgtgcgcttgcggatgaactctgtaaccataatataccagaagtatttctgcgccattgctgggaattatatttctagtaatgtcgttaagaaataccaataagcatttctggcgctgttgccagggattatatttctagtaatgtctttaagaaataccaacaagtatttctggcattgttgccggggaagattcataatagagattgcttgaactaatactttatatttacctctatgtaatcatttcctttgcaggctaaccttggttgttttcacttgttgttgtgaaaacagggtagtgcgtgactggtttcaacctaccagaaagcttcaaagaaaatccagaagctttcttccggaccgtcaggccgtgagtcgttgctctgcagaaaattctaccgacagagaaaccagtcgtaccagcgccaccgaccttcaagacaatggccagcaagactcttcgcgagttcgctgctccctctgctgacaatgtggccattgggccgcaggtcaacataggagacgtggatttcgacttgaaatccaacctcatcacgatggcgcaggctagcccgttctgtggcaagcctaatgaggatgccaacgctcatctgcaacaattcctagagatatgtagcacatacaccatcgagggagtcagacccgacaccgtcaggctgcgactgtttccgttctccctccttgggagagcgaagcagtggttttatgccaaccgtgctgttgtcaacacctaggataaatactctacagcattcctctcaaagttcttcccgatgggcaaaaccaatgccctccgtggaaggatttccagtttccagcagacaagggatgagtctattccggaagcatgggagcgtctgcaggagcatgtggccgcctgtcctcatcatgggatggtcgactggctgatcctgcagaacttctacaatggactcaccccaatgtcccgcgatcacctagacgcggcagctggaggtgctttcttctctaaaacggttcaaggagccgttgaattaatagagaagatggtctccaatatgggttggagcgaggaacgactccagacccgtcagcgaggcatgcttaccgtcacggagacggagttacttgctgccaagctggacctcgtcatgaaacgcttggacgaccacgagaaagggccacagggcaccgtcaaggccatggattcacacgtcacgtgtgaggtctgcggcggcacgggtcattctcggaatgactgcccggaaacccgtgaggagacgatgtatatgggcaacaacaacgggtaccgtccacaagaaggttaggggtggaacgaaccacgcccatattatcaagcaggtaacaataatgataacttgtctaaccagccctccttgaaggatctcatttttgcacaagctaaaaccactgatgcactaagcaaaaatcttgctgctaacgataagatcctagagaacattaatgtcaaactagatggctttgcttctgcttttcaaaatcagtcgagctttaataaaatgatagaaacccagttagctcagttagcatctttagtccctgcaaatgaaactgggaggattccggggcaacccgactcttctattgaaaatgtcaaagcgatcacaacgagaggaggtaagtccactcgtgatccgccatatcctaaccctgcaggaactaatgggatgtcaaaagaagcgccatctaatgactcggcttacaaggagattcagcccaacaagaccgtgccgctggaatactacaacacacggttgctgccattccctcaacggagtaggaaaccgtcagtggacgagcagttcgctcgttttgttgaagtaatccagaagattcacatcaacgtgccgttgttggacgctatgcaagtgccgacatatgcccgttatctcaaggacatactcaacaataagagaccgctcccaacaacggaggtggttaagctgacggaacaatgcagcaacgtcatactccacatgctcctggagaagaagaaagatccggggtgtgccacgatcacctgcttgatcggggcacaacaattcgaccaggccttgtgcgaccttggagctagcgtcagcgtcatgccaaaagacgtctttgacaagctcaacttcacgatgttggaaccgacgccgatgcgcctccaactagttgactcgtcagtccgttacccggcagggatagcggaggatgtgccagacaagatacgggattccttcatcccggttgattttgtggtgctagacatggacacggggaagaagacgccgctcatcctggggcgtccattccttagcaccgcaggagccaacattgacgtgggaatggggagtatctgtttccatatcaacgggaaggaggaaaagtttgagtttcaaccgaggacggaacaatgctccatggtcagaatcaaatacgggccaaacccgcagaatattcaagaggtcaaagtggagccgcccaagacggacagcctagtgaaattcatgcaaaacttcctggagaaggaaacaacaatacccaggaaccgttattggaggacgccggtaaaatcacctgtatcggccaagaagttagagcagccggctcagaagaagccgccctctgcaccaaaaccaaagaaggtgtggaaggaaaagccaaagatgcccgctccatcacctccggagacgggtagaaaatccgcgcactaaattggaaggaggtacggtcttgcacgtcggactttaaatgacgcgaccttcaccaacaggcaaattggtatgtatccacatatttgctttcaacaatttgaatttttgcatcatcacatgtttgaatttcaaaattgcatttagtatttttgaattttgagggaattcttcaaataaatttttcaaagcaaaccaaaataaattcattgtgcaccgaccacactgatcgttggaatcaaacggccgaaagtggggccggttgggcccaccaggggttcggccgaaccggccaggccaacggtcggctgcctcttcctttgaggcaatggctagtgggccacacaggtcggttttgaccgttgtgggtgcactacttaagccaaccaaccgggagagggaactccacctcatttcaacacattttcattccctctccaaagtttgctctcaagttcattcaagctttgatagtttccctcaaattcaaatctttagttgcatatatacaagttgctttggtgaaattaaccggcgggtgaaattcttgtcatttctaacccccgccgagttagtccgttcttgcttcattgtgcagaatgaggaggcgattgtctcgtccattcaaggggaccggctcttcatcaagtcgtcatgacgagtctagtacttgttcatcagccgatgtctcaatagaagatgccgaagctacgtgacaactcctgagcgacactgaccttgaccttgtcagtgatcgggagaggcaagcctactacatgctgaatgaccgggagtatgctcacacgcgagaatactcaccggatttgctgaaaaagataggtatggatgttgaatttcgctctatttggaaagctattggttggtagagatttgctgtggtagatgagcctggttctcgtttgcttactttgcaatttctgtgcactttgaaagaaatagaagatggtatttcttttcgctttttccatgaagagtttacatttacatggaaaggcttaagtacatttcttggttttcacgattcctgcaaaatcgatctccagaaaggaatttctgggttcgagaaaaataggttttgggaagacatttctggtgctccaatttgcaagaaaccaagaacgaatgatatccttaatcctacacttaggctcatgcacaaatggattgctatgactttgtttcctagaggtgatctgagacccattaagggagatgaattaattatcatgtttgccatggttagaaaaatcaaaattgctactgtgaaatgtatgataaggcaatggttagaaagtataaggttctctgctcctgttgagtgcacttctctgattacttgaatagcaaaagggctaggggtcgttagcgaccaaattgcttttatcttagccgctcgtccgcgtattgatgaggcttatctagtgctagcgcatattttgaaacatggagcagatggatctttgatatactttttccctggttgtacaaatgaaatcccgttgccaaatgcggggtatcatttgtacaactgccacgaactaaccattcccctacagaccatagaagaatctcgtgcaggtggaacattcagggagatgcacaacatgacaaggaacgaacgagaaatttcattatcctcgacacccgtgcagatgtatgaggcaggttggacaccaactggggatgcacccggatggacccaagctccacgccgcagcatcggagtctcaacctgggcaagcgccagtgaggaccggtggcatgcgcctcatgacatccaaaggggggacaatcaacctcccagatcaagtgatgtgtcttcatctccaagtgaatggcgctcaagttcctctcgttgggacttgggtgaaatcactaggagaatggacacccttgatgtgcagacgggggagatccagtacaacctcacggaacacatggctcaaacgcaagaatggcaacaatctgctgatgctcagttcgccaacatcaacaacatgatgcagcaacagcatgataacctttaggcgtactttcgatttcagggcttcaatccttatcaaggaccctgagcgaaagccaagcttggggggagacatcgctccccccactgaggtaacttgtatcacattgcatatttccctttctaattgcatatttgctttcaaattgcaccctataaaaaatgaaaacaacataaaaatttgcaaaatagaaaatacccaaaaaaaagataggataggtgtgagtcatgctaggtaagacaagctagttctctttgttgaaatgatgaatagttgatttgttttatatcttcgatatatgggttcttggtaagtgctctcacgaagattaaatataagtagccaacaattatccgggaacttgaggtaaatgggctgcacttgctgatctaagtctaagttgttgcgagatatgagatagtaaatatgagttgctacgatcctgatactagtttgacttgaattccggatgatttgtttttcaaaatgataaattgaaagttcctcatttgatataaattcctaccagagccaaaaatatgctatcatgatttaaccatttacatttttgttgcttttcattccattgaactttgtcaaactcttgtgacttgtgtagatatttgtcatgctctatgatcaagatcatacacccacatatatgcacatgctaaactcctacactgggagctaagcaatattctattccatttccatattaccaccaaaataaattctccatgctttcatgtgctttcttctcctaaaaaggaaaagtccttttgaaaaaaaaagagaaaagaaggagggaaaggcatggttatggaaaaaataaaaaaaaataaagttatgctccatcaagcatgagcatgatgttaaaaaaaatgtagccatgccctctcctaatcaataaaagaaggattttgggagaagaaagtacacacaaaggagaagcatttttcttttatttttcctcatataccgtttccactatataccacacacacattatacacgaccttgatcttgagtatgtttagttatctgctttagtctaagattttgacttagtaataaatgtgaatgcaattatgtatgtttgatccctatcgagctccacatatcaaaaccttagagtaggaattaaaaaggcatcatttggtgaggaattcaaattgatacacttagagagacagagtgaattatttgaggaacttggctttatttttcaaaatcatttgaaaactttcggaataagagttgaataaagatcaggtgattggtgctctaattgctgttctgtctttcaaccgcccgaggcaaggagaagcagtgtctcgtgggaatcaggggtaagagcaagccaccgtgccaaagattatttaatctgagagagagtacatataccttgcacctgtatctttgagatatgcagcatagtagcaacttctgatcattgtttcctttcgtccttcactcgggacaagcaaaggttcaagcttggggggttttgctgacggtcgttatcgatcagtttcgaccatcaatattaccaaaatagaggagaactagtgatgcttgcaatgcatatatctgttagaataataaaactccactagtattaggtatactaacctcttgcggggaatgacactaaagtggaggagaatcgacatcaactcagacgatacatcaatcgaacgatgtcaagaaccagacttgtgtgtgaataggccaagaactcagaactaacatgatgaattaggccaaaattctcaagtctgcggagtggagcaatagaggaggccaccaggttttggcgtggacgtccaggattgcatcccaatgacggttggagggcacttcggacaattccccttccacaaccgtcataactacctctatataaggagctcactctcttcacttcaacacacacctcaagcaatagctctctcatttctctcaagtttagtttagtagtatctagctggtggaatagaaatagaataggagtccggaagtcttcggaagagttcaggtatggctctagcaactttcctttcctcttttgtaagctttgtacttttattagaatactcttctatatatatttatggtattgaaatactttccgagtatatgagtacctactttacattatgttcatgttatactgaatatacagctagcttatctgggagatactttggtgcgggtataatgtttgcttatgcaattactctatgtcatgacgatgatattacagtagtatctgatagtttaggcgtgatgtctagattacgggatatcattatttggggttatatattgcggatgagaggtgggccgctgatggtaacagctcagtacgggtattccttcgcgcctatatataatcctaagttaatttcctggggagggtattcctccgtatttagccccggttgtatggtcatgacggactgtcataaggaactcggcattcaggggtggcttctcgaagtaccaggagggcgttggatagagagtattagctagtatatcagttaactagaatatatgtatactatgtatattagaagtataggaatatattctttctcttttctttccatttagtttagataatttattatgagaatgagtagtaatgcttgtgtgtcactctacccttggattatcttaacccctgcttacaatataattatcacaagtaatatataaattattagttgagttctctctacatgatcttcccacgggataaaataaatacgatacccttggaatactctcgggtgacatgctacgatagtatatccgtgcgcttgcggatgaactctataaccataatataccagaagtatttctgcgctattactgggaattatatttctagtaatgtcgttaagaaataccaacagtaggcgccacgtcagccaaaaccgccttctaaaccgtagagggaccttgtttgcaccggttttgatagttcagggaccggttatatctggttttggtgttgaaggatgaaaatcggattcggtgtaaagttaaggggactcagatgtacttattcctatactaatttataggctgaccaacgaattacctgcttatttagcccataattggctttgtgagacagcccacttacacccctaagttacgaattgctttgaatctttgcttgcaccggcacgcgttcaattatttttaaagaaatacaaaatatagcaccgctcaacgtgtggttcatgggcacagcataagttggttcaacatgagctctcctagctagtaacgtccaacacacaccaacactgaatggacgaacacctataggcgagaaaacagtgcaagaaacagaaaccgatcgagttggtgctgccaaaacttggtagcttttgtgtggttctttcattgcttaaaaaaaataaactgaaacacaatatcgtggtggttataagccgccctaaacgcacgccatgacgaccattagtccattaacatcgaccatatatcctatggaccaggttacaacgcatgtaacaacgcgccagaagcagaaaaacacagaaccccgcatcaacagagcatatgtgtcgagcacaaacagatgagcccgcacgacgctcacgcgaattcaaggggcaaggccgcaagcatccttcaggaaaacaacattgcatgctttcagttcaggctggacagacaaacataaccgaacacgcccgatcgattattgacttccatcgtccacccgagcacaaaacaaataatagcccataaattctacccctacatttctacaacagagtaaagtgaaatgttactacttccgtccctattgcctttttccgttatgaacctagagagtgatgcagggatggagctaatttggtgagctaatttggagagtgatgtaggggaggggtcggagacgagtggttttttttctctctttagcctggtcacatacacaattttcacatagaggccgtttggtttatgaaagatattttttagtgggatgacttttatgtggatggattaatatgctaccggcaaaagtgtggatggtgtggagattatgggtaccccatacccacacggcatggttatccgactgttataagggatagcttatatctatggaatttgtaacagatcataacttgggtattacgtttccatgtatattatggaacggcctaaagtcctggtttgataaaattgtaaagtagatttaggaaaccgataccgtattgattaagatttctatcttgtaatcctggcccccatcctatataaggtgggcaggaggccctctagggggcatgagatacaatcagatcataatatctataatacacccggcggattcaaatccccaaacaggagtagggtattacctctcattgagagggcctgaacctgtctaaatcctttgtctccgtatccatccacttttagatcttgtgcgctatccccttttattattgccgaattcatgtttcgacagttggcgcgccaggtaggggctgcgtcgagctttccatcgagaagtgcgatggaatcaatttctggagatgtgctgagatcgatctcaaagagtcgtcggcttcgtcttcacttcgcttcgggatttttgctttgtcatcgccgctgacaactttaacaagttttcactctctgacttggatccaaaccagtcaggagagattcaatctaagtaagaaggagatggctaaaccctgagaccaatcgccgttgcagtcctccgcctgatcctgttcgtatcggcacgagggcagcgacgatccgatggatcagatggtcatccactaccaagcctactgaaccaatcaatctaccccaacgaagatgctatgatgctgcaagatggatctacagacacgaggcatgacgaaaccgatctaatcggcatgcataggagacggttgcagctgatggacaccgacgacgccggggccgcgcacgcagctacgccgcctgcgcgcggctgcgacctccgcctcctccgctccgacgactacgtcgcctccctccccgccgtcctcctggagtcgcggatctgttcctccgccgcttcaaagtcggcgaggactgcccggctgctgccgcgccgtcatcgtcaactagtcgggcaggttgcatcacgcgaaggagtccgagacgtcgacagatccctgctacgaccgcgacatcgctctcgccatcctcaagctcctcgtcttcgccaccggcgacatcatcaacaaccaaattcaacaaggctgtgaatggcaacatggccaacaaatgatatgatgacacgtcaccagcatgcacaggaccatgcatcggcaacatgcatgcccatcaagccagcaaccaatcacacctcacgtgatatttgtgcatttatctttaattaattccttgctgctgctgatcaatttaattatttgtttgattgcatgtgctactgagacgccgtggtggtcaggccgtcgccgtgccgcggagtatcgacttgatttgtcggcgtgttagcccgcactcactattgccgggcatcttcgcctacatggttggctacatccgctgacactgtcgaccgtctcaacaagttcgcgattggctgcttccacgctgccgagcccgactatcgcccctgcatggctcacgctgacccggctgcgcctctcatagctcacgctgacccggctgcgcctctccattggccgttgctgatgggaatcgtcatcttcaccgccggcctgcctctgtcgccgccgactagtgtcctcgtctatacagttggttggtcacactaccgttcatgggcgtccacgtcttcaccgaccggtctgcctttgccgccgcctactggtgtctctgcctacacggctggcctattatgccgctgttggtgggcatcttcgctttcaccgtcgaccgccttcgtcgccgccgactggtgtcttcattgttattgatggacgactttattcccacattggccacctctgctatcaccaaggggaatattacaaagctaagtcatcatttattccttatatgatattttccttttcctctgcctcactacatcaattggttctccattgagtagtgagtcgggggctacagatgttataacatatttttcaataattttcataatatttatcttgattgcttgtgacataatctgagtacaaaagtgtctatcgagttatggagttctatcttcctatgctttccgtttggtttgtcatggatagttgcctttgggccgattcctagcacccgggggctcgttggatagaccgagtaacgcaaggtgctaagtattattcggaataaatcaaaagcatagagataagataatttatttttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcgtggaaatcaaaattaacaagagaagaaatacatatttataaacattttaaaatgcttgaatttttctcgagtattatatttacatcagatactactcatcctatatgtttgttctgcaggatccaaatccagatatgcataaaagggattcatggctttaagcttatctcttacgctccacgaatggatcagtcagaacatcaccactggctcgccgtcgtcgccgccgactggtgtcttcgcctatacagttggttggtcacaacaccgttgttaggcgtctacatcttcaccgccggtttgctttcgccgccgccgactggtgtcaccgcctgcacagctggcctattatgccgctgttgttgggcgtctacatcttcacttactggccgcctcgtccgccgccgactggtgtttccgcctgcacggctggcctattatgccgctgttgttgggcgtctacctcttcaccgactggctgcctcgtccgccgccgactggtgtttccgcctgcacggctggcctattatgcagctattgttgggcgtctacctcttcaccgactggccgcctcgtccgccgccgactggtgtttccgcctatacggttggcctattatgaagccgttgttgggcgtctacctcttcactgactgaccgcctcgtccgctgccggctggtatttccgcctgcactgttggcctattatgccgccgttgttgggcgtctacgtcttcactgaccgaccgcctcgtccgctgccgcctggtgtttccgcctgcacgattggcctattatgccgttgttgttgggcgtctatgtcttcaccgaccggccgcctcgtccgccgccgactggtgtttccgcctgcacggctggcctattatgccgccgttgttgggcgtctacctcttcaccggccgtctcgtccgccgccaactggtgtttccgcctgtatggttggcctattatgccgccgttgttgggcgtctacatcttcatcgaccggccgtctcgtccgccaccgactggtatttccgcctgcacagttggcctattatgccgccgttgttgggcgtctacgtcttcaccgaccggccgcctcgtccgccgccgacaggtgtttccgcctgcacggttggcctattatgccgccgttgttgggcgtctacgtgttcaccgactggccgcctcgtccgccgccgactggtgtttccgcctacacggttggcctattatgctgctattgttgggagtctacgtcttctccgaccggccgcctcatccgccgccgactggtgtttccgcctgcacggttggcctattatgccgccgttgttgagcgtctacatcttcaccgaccggctgcctcgtccgccaccgactggtgtttccgcctgcacgggtggcctattatgccgcagttgttgggcgtctacgtcttctccgaccggccgcctcgtccgccgccgactggtgtttccgcctgcacggctggcctttatgccgccgttgttgggcgtctacgtcttcaccgactggccgcctcgaccgccgccgactggtgtttccgcctgcacggctggcctattatgccgccgttgttgggcgtctacctcttcaccggccgtctcgtccgccgccgactggtgtttccgcctgcacggttggcgtattatgccgccgttgttgggcgtctacatcttcaccgaccggccgtctcgtccgccgccgactggtgtttccacctgcacggttggcctattatgccgccgttgttgggcgtctacatcttcaccgaccggccgccacgtccgccgccgactggtgtttcctcctgcacgggtcgcctattatgccgttgttgttgggcgtctacgtcttctccgaccggccgcctcgtccgccgcagactggtgtttccgcctgcacggctggcctttatgccgacgttgttgggcgtctacgtcttcaccgactggccgccttgaccgccgccgactagtgtttccgcctgcacggctggcctattatgccgctgttgttgggcatctatgtgttcaccgaccggccgcctcgtccgccgtcgactggtgtttccgcctgcacggctggcttattatgccgccattgtaggacgtctgcatcttctccgaccggccacctcgtatgacgccaactggtgctatcgtcttcacggctggctatgtcgccgccaccgcaaataggcatcatcaccttcaatgcaagctgtctacgtgttctaccgactggtttcttcactaccatggctgcatgattttgccagtgttgattggccttatcgtcttcatcgctagtcgtctcttctgctgctgactagtgccctcgcctctacggctaatttataccgctaccactactgatggacgtcatctccttcattgctggtcaccttatctgacgctgactggcttgttcgcctccacggctgcgcgtcttcggtaccggtttgtttctgttgccgccgacttgtgttcgcttcatcacggctatgcaactttgtcgccatggtggagcggcttcatcttcattgtcttcagcaccagcaaactctattgcctttactttgcaagctttcctacttcaccaaccacgacgtctacaggagcttcgacatctcggcatgcgtcaccaaatatgatgccgtgttatattattacagcaagtggtgttccaatcttcaatatttctactcggacatcttcaacatatatcttcactgaagcaatgactactcgacgacaagaagctacagttcttgactctatgttcagttgtttctcaactaaccaaagagtcgggggctacacaaatacaagactctcaaaattcgacaagctttatgtcaagatgaagcaatcaatcaatcaacgagtcaactcggggagttattatcttcgtcttcgcttcagagccgacatctaatttcagcgactccgattattacaccagcaattttggcttcttcacgccgccacaatctattccaaatttctcaagtttgagatttaatttacatgtctgggagtttggagtcatcaaccaatcaactcagatcagattcaatgagttgaacaatagcatatactttcctctaagtggagcatctgcaacaactataacaccaagttctactgacgtctttataaatcaaggggcattgcatcagtcttcgttatgcacacgctcgcatcaaggaaactactcgagcttcaatatcttctcaacagtttgatggattattgtcactgacatcatcaccagcacctatatttcatcagccttgatgtctccgttgttgctaatgggtgactacgtcttcgcctctggttgctttcgtcattgccgacttgttatttcgccttcatggttggcctactacgcaactaccgatagaggatctcatcattatcgtcggctgctacaacgctattgactggatcaccgacatcgtcatcttcatcaacatcctgtcaaacctcttcaacatagcctattctactgttgtttgatgcgcaacttcgttatcatatttgatcatctctattgctgccaatcgtcattaccatcggttgcatttgtcgtcgccgactattttcttcatcttcatgattggtggacttcgtcatcgtctttgatgcgtgtctatatcttcaccgtcggcttgctttcgtcaccaccgactggtatcgtcgccttcacggatggcttattatgtcgccactagtaggcatcttcatcttcttcaccagctgccttgtctgtcaccgactaattatttcgctgccatggctacacaactttattgctgggcgccttcatcttcattgctggctgacctgactgctgccgactggtttctttgccttcacggttgtgcaacttcatcacttttgattggtatcactattttcactaccaccaatatttttgccacctctagtgggcaatattctctctatattggttgtcttgtctctatgccaactgcgtcagctaccatcaatggacaattgtgactacgacaaaaggacacgctatatgctcaggggcctactagctcaaacacaagtatcataccttcaatttggacttgttccggatacattcaacatggattcatggtcatgagttgatttatcctgctcaactactggaccactcattattccccgtaagggctatcaactgaatacttgcaccaatcaggatttaattgttatatctattttggagtatcccataaaggataatcactcagatcagaagctattcatatgagctacacttggtctatatcacccggaagatttattactcgggagcatgttacatgcgtcaccctttaaagggtgtcgaaggcatattttttgccctaggcctaatatgtctgcagcccatattatcaggtgtggcctgtcacgttcttttagggacttaggcactttttgcttaggccaaagtgcgcgtgatcaagtgcccaatacctcaaaatccttttataccgcagttactcaactttttaggagttggtacaatgcatcttaaaaggtgtcaaacagtaaagctttatatagctgctccgctgacttttttatatatagtcaaggcactgtttgggtttatcaagcaatttattggatacaatatcattgctttttgccacgtaactgtgcatttttattgaccaatattatggcttaggctgattatatatcttggtcatttttcaggcggttggtaaattctttatgagtttatttactcggattttacaccacgtatgccgtatatttctgggtgtggtgaaaccatgtgtcttttagggacttaagcacatctgttaaagcagtgtgcacatggcgtatgtccaatactttggaaatttctttattcacagcattcaagcttttttatagctgttttgctatatgacttttcaatgatgttgtcagctttaggttgcacgcattatattttacaaagctgtcggtatatcactcggatcatgttatttggagattcacaccgcatatgctgtatattgatatcaagtcacttggttgactataattatcgaaaaccactctgttggttggattatttattccttgactatatgcttggtttgttcaactaaccacatagtcgggagctacacctattaggtgcatctagtcgatgcacctaagtctacattcaatttttgttcagccctccgtagtcttcagatttggtaaaagtactcgggggaccatgaagaagatgattgaagcactcggctttggagtaatctagttcgagagaagattatcttttcaactgcgaaggtctcaggggctactgtggagattatgggtaccccatacccacacggcatggttatccgactgttataagggatagcttatatctatagaatttgtaacagatcatgacttggttattacgtttccatgtatattatggaacggcctaaagtcctgggttgataaaattataaagtagatttaggaaaccgatatcgtattggttaaggtttctatcttgtaatcctggcccccatcctatataaggtgggcaggaggccctctagggggcatgagacacaatcagatcgtcagatctataatacacccggcggattcaaatccccaaacaggagtagggtattacctctcattgagagggcctaaacctgtcgaaatcttttgtctccgtatccatccacttttaggtctcgtgcgctacccccttttattattgccgaattcatgtttcgacagatggcttttatatttttagtattagttttgaaccgctgagaacagacatatagtaatcgtagcttttttttttatttatgttgcatgcctttaacttataagtataagttagaaaatgaaaaaacttacaaggattcttcgtacccttttcctccagcctcccttatttatatgctgtgttctttcatttttgtctaccaaggccatgatcagtcattcgtcaattgcatgaaaccatgtaactgtcctccctatccaagcaatctgtcagcgtccatctgcttgccaaataaaatataaaacaatatcttctttctatctcttcccctcttgcattttcatgtttattaacttctacaggtactctctccgttcttaaaaaaaaaaaagctaatctaggattggatgacacaagattcgtcgttttttttataaagggaggatgtagcatcacatgttactagagttcattcatttgagaaatgagaataggcaataccggaaaagaaacgtggttcacctccatgctatccagcggattacgcgagaattccaggcaacccaaaggtagaggcatggaccgacgaccctggggtgccgccaagcagcgcgtactcactacatcactgcagatcgataggctgtcaggctgccatgacctgcatgaaattaggtagctctagcagggtacgagcatagtattgggcctgactggagttgttgacatatagccgatgcaatataggacattccatagacttaactgcaaattgttttcccaacatgcgaggccttatttcaatggagagaattcttggtaaattttgtgcaaactaaactaattcctaaaaaaaagtgttctaaaattcatacagtctagtttgcaattaatggggcctaaatctgtaacatatggcatgcattgcccccttggcatattaactcgaaacatagtaaatacttgaccgaagcggaggacttgtgcactattctgtatgaagatggttcttatccatatagtgcccatttttgcataatttggggttgggatacgttaaaatcgagaagttggacctgaggatatatcatattctatggttgtataagcgtgcgatactgttaacacaagtctaaaactagatgattataaatcattttatttttgcctataaacttatttatttactataagaaatcagaagttgcataaacatgccaaacaggtttcaaggggaatagatgcgatcctatacaagatcttaataaataagcacatcaatgtttattaagcatattttagcatgatggagcctgcgcgaggggcttggcccttttgttatttcatactaatacaaatagatataatacaattgagctgaaaatcatgagtaaagtgctactccttaaatgagccaggcctgcatataattgggcttagcccataaacaagttgctcactatagggaccttgataggccataagccattttgggatattctttgtcttagataatgatgaaactagatgacaccccgcgcgttgctgcgggatattcatgtacatattactatatattttaatatatagcagttgtaagtcttagtaaaaaaataactaagtaaatagaaaggaaaaaaaagactcaagtagggttggtcagatgtccagtgcactgccactcaggtagcaagacccacagcgctgaaccttaggcacaatatcttgtaatgtaatggaaaatgatgctagtgatcattgttcttttaccgaatacacgcatatttccatgcctggtcttacattctttaataataaaattcctctgacattgtaaaagataaactaaacagcaaaaaaaaaaagagagcggaggaacttaatttttgcagtccattcgatttctatagacatgtttcgtagacagttatttggaagcacgaatatcaaatcaaacaattaaagcaataagatttttctaaaaagaagtaaggatagactaactgtgctgatatatcgagaacacactccgctagagacttgtatatgtcaagaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagcgatgtaccgtggattgaatagaatgagtctacaatctataaagcttgcattcagtccctagaaccgccacagctgcgaccaattaggcaaaagtcataaagaaaaaagattgatcaatctctctattacttactgtgttgctgcaacagcagctccgtcagttcctgaagccaagacatgttcgctgaggtttcgccatagccagcggtgtgtatgcatccgccgcgggctgcttcagctcccatcgtggtgtttagcaaaaggtgatgtaacagatggaaagttaattagcgtgaaaaagaatgagcgatttactcagcatacaaatagctattgccgtcgattcgtatgccgtgttagatggcagccgttcctctaatacggagatgacgcagcagacgattggaagggttccgcatgacttggtgacgtctgcaggggaaggttgaaggtctccatgcctcattgcctggtgggctgagaagaatttccaatgctcctaatcaagtgaatgggccacggaaaggagcatattggagatgatcagatggttgagaataactccctcgaatgatctaacggttgatttttagtggatgacgtagcttcacagaatttgagctttatagcactaaatgatctttaatggataccaattatattggaagaaaagatgagcatcataaagttaataacgaaagaaggatcatcactaaattaatgatgagaaaaatacattttcggtacaaaacatgattagggacgcattttaggtgataaacgaatttccgttacatgaacttcatagattttgaaatgtgacataattctcagtttattgaagtaatgaaccatttcttatcataagaataacgctgatcctcattatatgacatacatattttattatcactactttataatatggtcttatatacactaccggtaagaatgattttgtaacaactttttgtaggaccgaatcacaagaactaagctaaccagagggggggtgaatggttggtatacccaaagacccaaaaacttttagcggaaaataaaagttaccctcgaatcgatggatcgcggtttgaccgaagatgttgtaccggtctgaccgtcgagatgcctccggtctgaccgaggtagaagctccagtcgaaccgccgagattgcctgccgcgcctgcctgacgccgccagtctgaccgttgtcgctccgccggtctgaccgccgccttgccgatgaaacacaaatcgaagaactctcgaagtagatgacaactttattacttctctctttgtttacaaagtgcaacaacagcactccttacaaaatctcgactaaactcgaaaccctaaaacacagcgctatgaaaagcaacacaaaagagataccaggaagcctcacgctccccctctatttatacatgaggtaagcagcccaaagccacgaaccaaactcatactagatgtcctaatccacctaggaaaccttctagtacaaaaaacaaacttaacataaccaatcataccaaatttggactccatccaaattcgactccgcatcccatacgcacacaatacctccatcgtatgccatatggaatcttcaccaaccacatgcatcaactctagcctgagtatcccgcatgatctctaaccaccacggacatcgtcttaccaccaagccgactcccggtccatcaccgcaaaatactatcccgaggcgtcgagtcacctacacatgaaccaaaaaagaaatcatattccgagaccaagctatcaccaacttgactcattgttagcaaacaacagtatcacatacgtatagtatccatctagaagtcataaatatgaaacaaactcggatatccaaagaaacaacccgaaaccgaaaccgaaaccgacacagcgtcggccggtctgactgcacggataccgccggtctgaccggaccacatatccagcaacacttgtaaatccaaacatctccaaaaccacttcgaagattaattccaaatatcaaaactaataatcaccgatgctaattgttcatcacagaataagaatcaaaacaccttgatctaacactttctaccttattagacaactgtactcccttcgttctattataagtaattgatttggtagtgtaaatagatatggttaattaaaaaataggaactctacatttactattactaaataccaccataaaagctattattccatatcggtgttagtacgcaagacgtaggagcggttgcattttacttgacaaatttcatcttctagttaattttgttttctttctaggatctactttgtctggtctagttatctgtgtccattttatacctctgtatatactttactacaaccaccaaaccttgttttcatatacttcacctctcttctcatcttatatatatttatgttgatcaataagcaggggttgattcctatatctctctaccatataaaacaatacaactatctctacgattcttacagttatgtagcatgtctgcatgtacgctacacagagcatgttagaagatttttattttaagaatgggtggcgtcggaaaagtagcacagcagatatacacactatcatgcacatcaattcaccaatccacggaacaactgacccactatctgtgaacccgatcagtggctcgagacaatgagctcatcagaatgcagccatggaatgattgagttgcaattgaggtcaagggatggaaaggggctagggcatgtctttgacactgacatttcgcatggtctagcaccaaatttggcccagtgtgcagccactagcattttgtgcctgaagctggtgtgtggagaaagcgatctacggaatgatccttgaccatgatcagtcgaaagcataatcccaaacttgggcatgtgcggatgacacgaatgcccgcagaatttcgctagcttgcctgagtgcaagggcaattgtgcggacaatgatgccgttgcatgccttggaacaaatctggctattcgtacgtgaaggaacatactgcttcgattcgacaatccttcctctcttttttttgtttgctccatgggtcatagttagctaaatatacatcggtcacgcccagatgcactgctagaacttagattattcacgaccaaccttaacaaacatctgatcgttgatagtcaaagaagccgcggtaggccctccgacggccatgtaatcgctggtcgttactacgtgcgtgtatgtggtcgctaataaggcgtcagttcagaattttctatagataacgaaattggtggaccgatccccttccccgccggcttagatccgctgcactggtgcaccagcaccgacgccccctacatggtcaccactgccgctgcacccagcggtcgccggccatccctgcgcgcctgctcccgctccaggcttttcccgaggacaagatttggccgccaataagccccaagccctagcgcctgcccagttggggcagctctgactcgccgaaaacggcggcttagcagttgggcatggaacagcggcgaggcgtgaacggcagaactaggtcagatgatatcccttgtaactttttctctgccttgttttagcgttgtggcttgaggattatgatatgttcgttccatgatatcccttgtcgtcctgtaattctattttccaaattacggctgggtttaattgtttaacttgaggattatgatatgttccttccatgagatgaaggaatatataagacctgtagtacatagccattttttcttgctgatctgtcaggctagtttttcaaaggaacaatttgtaactatgcccaattgcccattgcagtttaatttaccagttatactgagtgagcttgtgatttgtactactcttgtagatttgaacttagaatttgttatagatggcagtgtgacctccattcatgctctcatgtccattcatccatgaagtctcaacaaggtatattttttttcaacatggcgcataacttcttttttctttctgaatgattttgagtttgatcataatacttgagaggaaagtcaatttttcttgcaggataatctagtcaatatacaatgattggtttatttatctaaaattacgggattcttcttctgtgaacacgcaaatttgtggaggcatcttggcatattgtttaatgtttacagttcagtaacaagatatagcatggccctgataccgctgacaaaacgataatttcattttcaatcaatcatttatcttcccgtactgcaattcatggcttcttgcaggcagttgatagtttatttaacatattctacttattggtatgaatttgccctgctctatgttatcagtagcagagcacacttgcttccatttggatttattaaaatgtgtttagtttctcatattacagctcccttctcttcatggacagattccagtgtgacatagctaaagtgcaaagaaacttattttgtgtgcccagatgttattatttccaatggttcctgcaggatgatttatatatgttgatcaacattcttggatttgatcaacatcaatatgatatgcactgatagtctggtatatggcttgccacttcctttttttttccaagttcaataagatagcatacatccccaacttgtaatgctttggagaaatcaataagaataatcaacagactaatggactattaatgttgaccctaacttagatattgttaggtttacacttaccatagcttggtgtaaaagtagtatctagttcataacataagcattcagactgctctattatacaggctgaattatatgttctcctataactccacatatcgctattacaattcatttgtgtattgattggtttaaaccttggattttgcagtgttcacaacatggatgaaacaagccaagagttctacgactgggttgaagacctttcatgtagttgtagatgtatagtacattatggacgtacatttccaaattatatgtaatgaacgaattaaattatttgcatttgattaataaagagtggtcaataatttcgtttattggtctattaacatctcgttaatctaaatacattaccattactagtaaaaaatgtgatatcgtcattaataaaataaagaccacacagtgttgtcatcgttaaaaaaaaataacgacacaaatcatggtcgttaatgaatataacgatgtcacaatgtcacagtcgttaaagaaatgacgatggcagagaaactccgtcgttagtacaataacgacagaaaaaaagttagcgtgctcgttaatattattaacgacggagcctttaacgaccactgacgatcacaaaaaatatggtcgttaatgacctttaacgaccacatttggactttcaacgaccatattttctgtcgttaataatgatttctctagtagtgatgtcacacaagctagattatgtgaggcggagaacagggggggatccaggatttttgatcgatggtgtgtcatcatcaactctactaagaagcttggtttctaagtacagtcaataatacatatgaaaagtttaaaattaatggtaaacaatagagaaatgagatgaacccacctattaatctagaaatcaagcaatagagagataatttagcaatcatatgtctacatgcaattcaaagttgacgtcaaacatgagaagtagtagcctaaaaatagataaatgaatattttatatcaatttatatctaaataccatgtttaaaaaaatattttcaacaacagtttctatatataccgcatgtccaattggtgaaattaaattatactactatgaactaaatttattagatacacatgtaaataatagcaccgccactaatttgttttactgaacctgatgcatggaagaaaattagaagctcagggccttggctggcagttgcaaacagtagaactgctagctgcggccgcctgccgatgtgggcatgtggccaactaaattagtaagggtaatttatgggcagaacaaatggtgctcaattagtggttactgctgttttcgtgtgagtatggcgttaattggtaaggtgcactggtgtcactcatcgtagactagaacaggttacatgcactactagaaaaattatttgttaccacgaaaaaaatcatggtatcaatactaaaattatggcaatagatatatgttaccacaattttaaaattgttgctagccgttgtaataaatagcgtggtaataggttattgcaacgatttttatttagtggtaataaatttcgatgttgccacggaatggatgtaacaaaaaatcatattgcaacacttcacatcgttataataaaagctattgccaccactccatatttggcattagttctacgtaccaaattaaaggttcaaatattaatttatcatcctatctatttatttttttgatattgtgtcttggctaggattcgaacccaagatctattcttcacgcgtgctttcctttaccaactcacacacgcatcaattcttttggaaaatacatatcgttccatttgaaccttacctaactgagatttgaatcatagatttaaatatctaaaagatttcaaatgaaaatgttgtcacctataaaattgtagatctcatcgacagctataattcccatataaaatttgtctcaatttgtgtccatatgaaaaaaataagttaaattatgagacgataatttttttattgcaacgaatttgttgatcgtggcaacaaaaaatagtgaaaagtaccatgtactatgtaaattgccacaaaaattaaaattgtggcgatagaacatgtttttttttgcaacagtaagactttttgtggcgatatctcattttttattgcaacaaaaatactaaataaaacaacgattgtagattgttgcaaaaaaatataattatttgccacagaaaaattatcattgcaatagtataatatattgctacgaattattttttgttgtaataatttggggggaatagctcaattatcttgtagtgatgggatggaccaaaaggtattggtgtcagctgacaccatagctaacatgatggatccgcccctggtggagaagagaagggaggagaggaaaaaggagcgccaacctgtatataactccaaaagagttaaaatcaacatagtagtggattagatggaaatgaataaatgaagatttattatattttggagcttgtgtattagaggtagtctattgtatatgttaccttttattggataagtagatgatgtacactaaattagagatagcaatcatctttacttttaaacatgcacttaatttcctttcatttgtgaatgatgggagtgtcaacctctgttttagctttcatagttggttaagagagtactagataataatactagtgcacctactatgtccgctccccgccccgcgtcttccctttgtttaagaagatccctttacctctcctaaatgtaagattctcatccataaatattgatccacgatctatttacttatttcatacattgcaacacagtttttagaggcaaggtattaaaaaaacattcattgtatcttaggacacaaatgccatctcttccttttagctttaattctccgaagacctagattgccataatatttttcaatctcgcataacctcaccctatttatatacttcgtagataggtcttctatgataggtcatctagttcatccatcacatgaaaccagagacagatgacgaaaagataatgaggtgtggccaaatggcccatggccatgcttgcaaatttaaaatgagttatctttaatggcattgatattgatattatagtttagtaattagactcaacaagtcaatatttaacaacccatttgtaaacatgcataagaagaagcaagcattcaaaaaatatcactatctaccactggaccatggctaaatttggtcttcaaatactatgcagttctgcacccacaaaacaagagcaaaaggtacaatattttcttagtaaatgcttgtctaaattgattaatgaggatggtgtttggcagtaaatgctctgaaggaaataactacataattagacaattactcaagtggttaaaaaaacaggtgactctcatttctagccgggtctaataaaagttaaaaataaatttctaggttttgaatcttttgtcctcaatgtagattttgggaggacaagtggattggaaactcttcttttaaagggtggtatctatctttatataatattgtgcgtcggaaaagtgcgtcagttgcaactatcatgaatacagttcctttgaatgtttctttccatagggaactagtgggccagaatatagttaattggcaaaattttgttgctcgaattgtacgtattaaccttaatgataataaatatatgtttaggtggaaccttcatcaaaatggtatcttttctgtttgatccatgtatcttgctatgatcaacagtgggtatattgataggaataaagtgttacggaaattgaagattcctatcaaacttaagattttcatgtgttatctagctaaagggtagttctaattaatcaatgataatttagtaagaagaaattagaatggtagtactagatgttgttttttatgtccaacatctattctttgattgtcaaatggctaatttttttagaaccatttttatgtcttttaatttggtttacaatactcatatgttttataattggctgattgggatttactcaaagaccaaaaaacatatttcaattagagcatctgccttttatgttggctatatggttaaataggaatgatatggtttttaataaaataccaactaaagtttatatgcatgtactcatcagagcaatatactggttcggttttgacccaactacaaaggtgtgaagaggacattggtggttattcacgctgtatgtcgaaaattggagacaaccgctatgcaaatttttgttaactttggatggagatttaacaataggattgttcttgaataagtgtctctctttttttaccgtggcatttattattgtatcgtttctttatcctttattaaaaattattatacttggttttcagctaagaactatatatgtggttgtagcttccgttaaagtaaagctcagatattatccattatctaaaagaaacttagcacttagcaataagccagtgaaaaaactgtagatattgacatttattcaaactagctaattaaatgtccataccttgcaatcgtacgtaagttaaagaaagataacttaattatatattgtaaagcgtatattataatatacacgaagaatggatcaaaattatccatattatactactatcctattctctcatttctttcattctaatttgttgtactaacatatattatattaaactataagtggtggaggcagacactaccatcaccgctggcttttaaagtagcagagattcacagtgcagctgctatgtcaagggggccggtgcagcgcctgctttgcgtcttggatgcacgcgcgcaccgccgcttcctgctcctttgctcagctagctagggcaagtaatataatacttcatatattgcctctaagagtgtcacattggattgaatgatgagatggaggagagaagtgaggagagagatgatgagccacccctaaatcaagaggtaacctctacacaaatttcaagaagagtgtgagagtattagatatattggtatttttagtactagaggtgatacattgtataggttgtctcttattttatgagtgaataaaatagataaatttagaggtggtagtcacatctattatagcacttgcccttacctgatggatcgagttgaatcatcatttcagaatgtgtggcatcgggaaaggagcataatgcacccttcaagtcattatgtactttcaggtcattatgtgcactagtactgaagccagtatcagagcgatgatcaaatccatggagtggaggtgcctgcgtccgagcatgagcacaatactggataaggtttaatttgcgtgagttctgcatatggcaaataagcataactttgtttaagggtgtgcttttttgaattgtgctctgtatgtgatggctgccacaagagccacgcagtaacgatcggcagttgaaaatttgcagacacaccccatatatacattttggttaattattcacatgagctctccatgaagaatacgggttcgtcaatagctcgactttaagtaggttgtcagtatgactataaaagaaaaatatgttgatttctattttgaatccatatgtattccattatggccacttttataatggtctttaccgcaagtagaaacgattcgtggcattggttatgaggctcttgctttattgcacaactatatcctgttcactataatatttgttattaaattgatatggtttactaaataaaagagagatcaattgtcaatcatttctactactagtaaacaccaccataaaagtatagtaggcaggaagtaaaagcagctattgtattttactgacaattcttaatgcatctatgtagttctcctgtatatcgagaaaataaatttgttgacagattccatcttccagtttagttttctttctaggacatactttatcatttcaaataaatcaaaccggcccatgattgttggttccttagaacagtcactgatactactctgaaccagcagtgatacttgaatatcactcttggttcttgttatgaaccattactattgtatcactgctagttgttcttgttataaatcggcagtgataggaaacaagcatcactggttcttcataacatgaaccagcatttatactcaattgaccggacagttcggacctatccattgaatattggaaaaggccgacatattcaaatgatagttttttccttttatgaaaaactttatggcaaaatcgtagagttcgacgagttctacaacttccttggatccatttgtgtcagggttcaaaatttccgaacgaaatttcaaaagatttggtcatatcggaccccacccccaccgatacgattttattttttaaaaaaaattctcatgaattttagcaatatttgtttaaatttaactaaattttgtttgaaatttcggaccaaaatttcggaaatatcaccatatcggcacccctaatacaaataccgaaaacgaaagattgaaccatgtattttttttatttagatgttcaaagtgttgggatctatttccacggaagaatgtttaaaattttcaaatgacgtcgtatggggaaaagctatatatgaaatttggactgcccggcaatatctacaacattatagttaatgctttttttttcatttgaagttatatctacaatgccaaatatgaattacctgttttttatagtgagacatcagaataatattattttcatacagaaaggatgttacacgtcgacagatgggtcccaggtacgaatcatatatatacaacagaagcgtcgcatgaaaaattgcataatatatttttcaccaggttaacatcttacaaaaatgatactcccgaaatgatatatatatgctaccatgttttacagttcatcaaacatattaaggaaaaacatctcaagcaattaaacatataaaattaatagggcaaccatataaaatacaagaaataaaaaaaacacataaacaagatgttttacatttgaaaaaatatagtataaaggaaacatcatgcgaggtatattttgttagcaccttaatgtaactgccctaggattcgtgcaaggtgtatatatacatggtgtaactgtgggtacatgctctcgcgtgcaaaaaaaaaaaaatcaactcatatatatcagtctgccatataaaacaactcatgctatttacatgtaattttttagttctgaaacatgtaccttgtaaagagcttgctaaaagatttcattttaagaacgggtagcattggagaagaagaggactggatgttcactttaggatgcatgacagttcatgcaccagcagaaccaccagctggcgatcccgggcggtggctcgggagtcgggacactgagctcattgagttggaattaaggcaaaaggatgaaatatcgtggacctctctcttgatctcagtgactgaatttggctcagtgtgtagctggcagtacaattttgtccccgaagctggtagatagccaagtccctaacttgggcatgcgttgatgacaagaatgcgctgggattctcttacgagcttgcgagtgaagggcaactgtgcatgcaaacagtgatacaattccgatctgccgtaacgatcgtacttttttttttgggactagtaaacatgagaaatgattagtatcttctcaaaatgaaggtacttgacgactccatacagaccacaaagctttagagatgatctcttggtgacaaaaaagaaacaaagtggtaagagaaaatcactaataatatgtgctacaagtataaactacatattctacgtgcatatatatgttagtgagtgaaaaaaaaattggaggaaagatcagtaattaacattacttgaaaagaaaacatttgtggatgtaatagaaagaccataagatctcgtgtcgctctccacatgggcaacacgagaggtgacgccaccgccaactccctcctcccccttcttccttctctgcctcgccgccgcctgagcgggcgtaggcaaagccgcgtggccgcaaggacggcggcggcggggctgcgcccagcgtgcgtccggtggtcggggcaattgctcggggcggcggtggtggcaaccgtccagatccgcgccattctggccggatctcgtggggtggaggctggcggttgggctgagtggtggcagcggcggcggcagagcaccccgaccagatccgcgctgcgccggtcggatctggcggggatggcggctggcgatggcagccgggcttgagtggttttggtggcggcgaccagtggtgctggcggcagcgacggtggctgctagcagcggcgggcgcgaagccggctggagctgcgctggcatgcagggagatgggacacggccggcgcacgggaggaggatgcggtggactggcgtgtcgacgacggcgatagccagagaggaggcgaggaaggaggtgaccggcaatggggaagaaggagagcgacggccgcatgcgggcatggtgggttgtgggcgacagcgacggcgtgagcagtttgatggctgcggagcaaggccggaggctgacacggcgcgaggaggcgcggacgatggcgatggaggccgacacggcgcgaggagatgccaccggtggcaacggaggccggcgcagcacgtcgaggcgcggtcggcaggtggtggaggctggcgcggcacgcaaaggctaaccggtggggagagccggtgcagtgaagcccacgcgcctgtggaggcttgacggtggtggagcaacggggcatcatttgtagactcgcaggcggtaggcgacgggtaaaaacctagcccggccttggccttggccgggctagcaacgacggcattttcgaacgtctttacccttcttgagggcgttgtcgtgccgccccttcacctccagtggggctatcgggtgaaaacccagtcttggccctcttgaggccttgacggacaacggcggcggtgtatccatcgctcctctcgttagagatgccgtgtaggcacccccttgccaaaatctcccaagcaattggtgcaagctctctctaattcatattctcttatgtcggcatcctagcttccgcaagttggccacgttggagggcttagggggagaatggctgcattcttctctctcaccctctcaccctcaatcccaaagatttagatagagctgtgttttgtgtcagttgtaatggtcgggttttgggcgatgtcggctgtgttccgttgtacggcttagtggctgtcggttacacttagcggtggctggtctgatgctagccttctcctgagtctatgtgttggcgttgtgggtgtgtgagtggtagtatactttttttttctttttcctggttaccatcttcaagggttgtaattttgttattttttcctactctatcagtagaactttacactctctagtgcgattcgttaaaaaaaaacaaagaccatctcgttcagtttcctttatatggcctacatggtatatatagttatcaacttctgatcaacttaagtgtatttttgcaggtggacaacgatttcacctcacggttgtcattttcgcaggtggtcatttagctcggagaggcctacctacctgaaaaaaatgtcatcgtctggaaatttgcttttctagccgtgctttcttcaaagttaagaaagtactccctccgggttgataattcttgtcattttggacaagagcatggtctcaaaaaaacaactttgaccattatttttcattataatatgtataagaatgttaaaaaatatatgattttattaaagtactttttaagactaatctatacatgtaatcaccatatatgaaagataaatattttaaaaatgattcataatcaaagattgtaaagtttgacctcacccttatctaaaatgacaagtattatcagtctgaagggagtatacttactacaaccaccaaccgagtattgattcttcttatatgtcccgtggctacttccactctcgtattcataagctttttctatccatctacttcatcctttctatccatctacttcatcctttgcaggaagcaaactatcatcccatccaagtaagtgattttcctcctgtcgtacgtctgtccagactctagatctatccctggcaagtgataggtaatgctttctatttagcactgttcgtgtttgtaacatatacacgtactacagcaacactgttacatcagtttacttgagaatggatggcattggaaaagaaacatactgcatgatctgcctacctcttacgttactctagcaagcgtcggagccaatgtctgacgaccctgggcttcgggctagggccctgggctcactgtgtcaggcagccatggattatttgtgcgacgatggaggtggttgggcccaagcccttggactgagagtgcagctagctagctagttgttgccttccacagagacatggctgaatcatgaattaaattttcgcgtacgtggttacttatgtacttcttttttcatcatcgatcctctcgtcagagttcagacatgattcttattcagatatataagggctggtttttccatgtggatgcatcatgggtttagtagggcttccaaagctcaagcatacagccatggagacagggatacggatagtctgcttaaacattttctaccccagcgatcccagtttgtgcacttggatgaaaattggtagtgtgttttgcaggaaattagacatggatttgattccaatggaacattctcaattgaaaaaaatagcatccattcctccaagtttctcgattttacaagattttgtatgcattctatgcatccttctccaacgctaacatatcggcgcaacttgaaccgcggaaagctcgatctcttccaagttgtattaaatcagctctcctggtcgaattcaacacacacgtgaaactccaaaatggacgacacatcaagttggtgtgctgccaaaaacatcgcagcgctcttctccgagattctctcgctgcatgcttacaaatccgaaacacattatcatgatgtggtcaagccaccctaaacacgtgtcatggtcatcactatccgtgccgtcccacagacgttcaggtcacgatcgacgagcacggcacgacgaagcaggaaaaacacaggcctgcgagcgtgtttccaacacaaacaggcgtgagcagcatcactactaagctcacatgaattcaaacttgtaaaggagaaaactagaagccaaggttgaacaagataggaccatcgtctaagattcgagtacaccacatatacaccatgccccagtccatagtgtccatgatctgttagcactaatcttgacaaggtttatgttagctagatatatgttatgggtgttcacgtattagacatctaataggattcatgtatgtcatgtactggactagcgtgcaagtgtagatggctcaattagtaactgcacgtgcgtgtgctgtatgtgttagtaggagtaagtctcaggctgttatagctagattatatataggatcagcaagtggtgcagtagaatccgtagctgcatgcatatatatgagtggagcacgtagcatgacttgcgaggatggctgatgcattcgtatgagttagccaagtcgttgaagctgcagaatgcatgtacacgaggctacttaggctttgttcggcaccctttgtttccaacccctctccttcgttttccacgtacacgcttttcaaactaataaacgttttgctttttgtaaaaaaaacattatataggaaagttgtttaaaaaatcatattaatccattttttaagttaattttagctaatccttaattaattatgtgctaataagctgttccgttttttatgccggagggataaactctcaaccggcacaaacgaacgcaaccttaagccgccgtgtatcacttggttgtcaccaagtgtgtgaattgcaataagaaaaagtgtgcgtggctggtgtttgtcatcatatcccgttgtgtgttaataatcctcaaaatttatttcttgtgtgcatgctctcgtgtgagttttcgccggaggtagttcattgctccccggcaatttaaagtgttgtccacactactacaaaaagggttattggggccggttgggaatcgactataagtaccggttttccaaccggcacctattggtcggcaccaataatataaaccggcacctttagctttgctcgagaaaaaaaaaagagccggctcgaatcgagccgaactcactgagcaccgtagccatgtgcccaaacccaaatccccaaattatccacaaatcgtcaccaaaattgattgacatcacatataatcattcacaaaccgtcaccaaaattgatcaaaacatctaatcaaaaatctacaaagaagagatgagggaggaagaggggctggccgccggtgggcccctcttgtgccgccgcccgccgcctcccctccggccagatccggtggagggaagggcgctgccgctgcccgccgcctccctcccgccagatccggcggaggggagggcgccgctgccggccatcgcccggtgcctcccatcacgccgccgcccgccgcctcccctctggctagatcctgtggaggggagggcgctgccaccgcccgccgcctcccatcacgccgccggccgttgcccgccgccttccatcacgccgccgccgaagcccgtcgcccgccgcagagagaagacgagagagagacgagaaccaagagaggaggcgagagaaggcgagagagagggagatagagatgaggccgataagtttgactcatatagggcgtcggcatggattggctcggctcggctcggcttggtttagaaaggtgccttttttttaaataagtcgaaacctataacttattataggtgttggttctaaagaagaaccgatacctatggtataggtgtcggttttctttaaaaaaccggcacctatattatattaaagaaaactggcacttatattataggtgtaggttcttctttagaacgggcacctattgttgtttaaaggtgtcggttttatgtattttcagtctatagaggagggaaaagcattataggtgccggttttagctggtccggcacctacagtgccgatctctatgagctttttttgtagtagtgccactaggcatttggtactacgggctaacggaaaccccaagtattataagcataaaaggataacaatgtttaagtataaacatatatgtgtgaactcacaaagacagcaaattataaatggaacaaaaaactgaacgagacaacttttgtatttcaagtttatatattgcatacgagttgggttgtacatttgtaagttcaaacgagggaaacgtaaggaaatccaacctcactagaacgggatcgcttatctctaacgggctgaaagcctcatcactatcgggtaaggcccccgtcagtgggcacaggtcactgatgtgagaaaatatctcaatcgggctaaagcccgtcacggatggatgctatctcaatcgggctgacaaccaagcccgtcatagatgagtatgaccagtcaaaccaccatagttaggaacccgtcatggataactaatctcaatcgggcacaccactaagcccgtcacggataagtagtcatctccatcgggcatttagccagagctcgtcaccgataggtttgaccctacgtgttgagtcaaactagtcccggttcggatgacttatctctatcgggtgtattctaaaagcccgtcacggatgactaatctctaacaggcttgactctatagcccgtcacggatgagttatctctttcgggcattagctaaatgcccgtcagggatgagtttagaaccaaaaaataaataaaatttgtctttttggctagcctcaggcctttgctagccatgcccgctgcaaaaatgacagaagcatatatatacatagtcccattcccagcaaccccattcccagcatcaattcacatataccatcacagccaattcacagccaattcatatagatccattcccagcatcacatcagccaattcacattcatattccatcacagcatagccaattcacaaaatcaaacacatatacattcacatccacaacccattcacatatatatgtcattcacatccatttttctctccaaaccgccgacatgcatcaaaacctgcaaaactaagttataaattggaacaattttatatgtaagtagaaatgcaagtatatacagagacgagctacctaggacattactctaaagaatataatcgtattacaaagaatatttacaaaaatcaaatgtttgtcgcatatgcattgcaaatgttctgccattccgagacgagctacctaggacttcactctaaacatccctttcggtgacaagatatcatctagtatgaattgtgctatctcctctctaatgatttcgatgttgatttccgaaatccttgaaataaattcctgaatgttcagcgccaagttagtctacatacttgtaaatttgtcatcctatgtgtgtataaacaattgaattacacacctcagggtcgagcaatgtcactttgtctgcaaagctcctcatgttatggcagacatgaaacccgcactggtcgccaacttgttggcgtattgggaagtctttcttgtgaccgagtttgggatgcccatccttatgcctcccgcctcttgccacgtattggtcccatgcctcattcaaggtagattcgatggccgaccaatcgtatatttctggcttgatattggagttaagctagtgtatcaaactccacttcggcgttattaccagaagaatccaatattgcctgcgaaattattaaattgccagttacatactacagttgtacgcgtcgagtatttgagtataagtacggtacacgcttactgttgattgtaggcacacatagtgaagtccttgtcttgatgggcaaataagcagtccttgatatagcccactatgtttgctcgatcgtttttcagcgttgtctcattgatgacagctggatcgagtaaggcaacatggggtgctttacgatggacatgcttccaggttaacctacgagcaagacaagagtcacggtaagtgtaatttatggacagtcactaccatatcgcgtaccaagaaatacttacaaggagtagcacttaaggaggttggtatcgatcgctcgcaccctatagaggtctcatagatctttgaagtctacggcgatgaaggcagtaggcctgaggaacggctgaccaccgtgctggcctaccatggaggtctctctattattcctccttgcgttggacttctccatgtagtacccatgcaactccttgcatgaaaggcccatctagaataaggcatcgtctccgaccaatggcatgcccaatgtgaattcggctggaggctttggaggagctcctgacgccttgccaagatcaagcttatttggggctaatggcacctttacttttcctctccccgttccagcagcttttctgcgtgtgtcaagcttgggtggagaagatttcgccctcttgcttggagttatattgatctcaatgttgtgcttgggccattgaataaaggtcccacgtgcagccccaagggtcagaatctcatcattaggtgggtgtgggatagtgtagccaacccaattgggcttcactaagtccacctgaacttcggcattgctggctagcagctgcgccccatgcactcaggtctccggggtaggcttgaatgcttgaccctctgcggcaggaattgcaaatcctggtgtcatcctaatgactagggtacacgatgtgggttcctgcgatagattcattagtgtccttagtatatgttgcaatgtattgtggtgctaatacagtatatgcgttattaagttgtttttaccattatgtggaccaccgcggcagggccttcaagctgttctgcaggagcctcagttgatgtgcagctgctacgcctctgcgtggggctcacttgtactatgggaccgggagtggcatcggtcgacctatccctgatgcgtgcctccatccgagcctccatacctaacagctcggcagtgagctcttctctaagctcttctttaagctcctcccgaagttgggccttaatgcgtgcagctttctacgccttggaaagcttgtgcttcttgtactgccacacgtattggggaaacccaaactttcatggaacattggagccaatgccccttgttcgtccacggtgttcttcgtttcccaacgctttcgtgaagatgtcatcctcgcgtttttgtgagcagacctcttgggaggcctgtctctcagcattcagttcgacctgcggtacagttaggacgcgttaaacgaagaatacgatacaacataatgaaacttattctatgtgttcaacttacaattttctggtacaccgcttgatcttcgggatttgggaacgaaagagtttcgtcactattcttcttcacccatgcccttgcccagttccttgcccgctggaccgggatatcagcaagcacttgcggggtgttagattccgctgcagcttcatcctccttgtcctattcagactgtttccccgcgtagcctccggtgccaagccggtgcgggtgaaggttccttgcctgcagatcacggtaggcctggctttttgcccgagactctttcgttgatttggaggcatggaactcatcccacatgggtcgggtgatgaatgggtatttcccaaatggttttggctgggcggggttgaggacgtactccatgaccaacgttgtcttgaaatttttccaacaattccccatcttgcggatagtctgccgcttgagtcctgcctcggcctctgtagggtatcggaagctttccttgaactgcctccaggcctcttcttcttcttcttgagggaccagatcgatgtggtccttcagaatagtgaagtttcgcctccctaggactccgcatatcgtagggaactttttgacagctttcgtcggagccgtcggatatcaaacatcatccacctctgttatggtgtagacttccttaggaatcttattctgggtcctaggattccggctcgaagtagtcccagtagtggtcgtcgacattggttcgccttgctacaacatgtcctatgtcactgttgtacggggagaaagtactttttaaacacaaaattgcatctacacacattctctgatggtttgatatacctctatctcctacctgtgttcgcctcgtcgacggaaccatagcatccatgctcaataaggccggagcagccgaaaactcgacctcgacatcagtatcccactcgaacttgctatcaatgtcactaccataagatagtggcaacggtagcaagttctagtgggatatggatgtccaggtcgagatcccgtctggtccggccctaaggaacatggatgctacatatctgctgacgaggcggacgcagatagaatacacaggcaaccaaaacctttcctatccaagatccctaacgttattatcagcaaactcctagattgcgtccaagatcatttcgttagggaacccttattcccatagatacaacaaccatctttggatactgaatttatgggaatggggtttcctaaagaaatgaccttgaaagcaatctaggatattggtaacgataacagatttctagaaatgttgtatttgaatgaaatgttctgtttaccaatttgtcttggtcagtaccgtgcaggcagtaacccgaccaaaccagatttggcaactgggacacttcgtattctcctaaatgccataatttcagtaacttcatttgataacagatttctatgcatatccatcccatttccctcaaaatcacccaaaacagcccatactacacaagtcacatatatattattttttgtacctaaaaaaacaaaagtcatgacatataataagtttggcctcagttttgctaagaaattatgcatcaattaccatcatttgcaactgcccccacccccaaaagaaattaagaacaattgtagatggtctatcctcatgcaaaaaagaaacatccatataaaaacagccataataattcaaccatcacagccgacatcaattcatccatcccattggacccaaaatatcccaaaaattttgcaaagaactatataagaacaagtctagagggtctgttcttatgaaaaaaaaaacagtcatataaaaatagccataaaaaacacaggtcacataccaaaattcacatttcccccaaaataagtcaaccatcacagcccacaccaattcatccatcccattagacccaaaatatcccaaaaattttgcaaacaaccatataagaacaagtgtagagggtctgtcatgcaaaaaaaaacagccatataaaaacagccataaaaaacacaggtcacataccaaaactcacatttcccccaaaataattcaaccatcatagcccacatcaattcatccatcccattggacccaaaataccctaaatattttgcaaacaactatataagaacaagtctgtccttatgcagtaaaaaaatagacatagaaaaacagcccacaacaattcatcccaaaaatggtatgttcttgagcaatcatcactggccattcatccatcatagcccacaatatttcatcatcacagcccacatctaaacatttttcccaacatcccattctcccccaaattcatccatcacagccatataaaaattcatcactagctaacacatataaaaatgcacaagtcatcacagccatataaaaattcaccactagctaacacatataaaaatgcacaagtcatcacagccatataaaaattcatcattagctaacacatataaaaatgcacaagtcatcacagccatacaaaaattcatcactagcacaattcatatgtagacattagcatctaaacattgaatcaacaaataatcgcactatcacattatcgaatttaaacattatcatcgaatcatcaaatcatcacatataacatgtacacagcaaatcatcacattatgcatcatcatcggtgaggagtacctacctcgcttggggacggcggtcttgggcggcgccgggctcagggacgccgtggagggaggcgtcgggctcggggacgctggtcttgggcggtgccgggctcggggacggcgtggagggaggcggtggccgtcggggaggccggatcttgagcggccccggcctcgggaacggcggtcttgcgcaacggcggcggtcggcaatcagtagagggaggcagcggcgtgaaggaggtcgacgcggcggctaggacgaggtcgacggccgctgggcgtagatctagagaggaggatatgaggcggccgtggtcagtgaggccggatcttcgagggaggaggaggcggcagcgttgaggacgaggaggcggcggcggtcggtgaaacggccacggcgtcggtcttgaggactaggcggagaggaagccggcggcgggatcttgggcatggaggacacggacttggagaagaggccggcggcggcggcggtcttgggtgcggaggaggcgctggcggtcggggaggccagatcttgaaccgggagacggcggcggcagtcggggaggcggtatccacgacgagggaggaggcagcggtggatgttgaaccgggaggaggtggcggcgtcgaggaggaggaggcggcggtggatcttgaaccgggaggcgtggagggaggcgccgacggcggtggatctgagagagtgagagtgtgagagagtgagaggcggcgtcgggatgaggattgactaaataaaccctagtcaatcctcatctctatcgggcagactactatgcccgatgcggatgacactcatccgtgacgggcgttagtactctgcccgataaggatgaaagtcatctgtgacgggcattagcactaagcccgatagagatggaataatctctatcgggcatagtactaaagcccatcacagatgacttattaaaatatttttaagttataaaaatcatttataattaacttctacccgatttaaaatttctattacattttatttatcacatataattaacaaatgtcttatttacatagtttaaaattcctattaattttttaaaatcatataatctacaattgcctttctcacatatagtttaaaattcctattaattttttaaaatcatctaattgacaaatgcctttctcacatatagtttaaaattcatattacttttttaaattcatacaattaacaattggctttctcacatatagtttaaaataacaagtataattttttaaaaccatataattaacaaatccatttcttcaaagagttttaactagaatggcatgaaacatatgcaattcattcattaaggctccaatacaaattaaatacatcattcacagtgatatgccttccgaatggtctgaacgaacgtaagccacttcgtctttgggatcatcgtcaaggtcgatttgaggtctgacatgaagattcttgttgtattcttcttcatcgacgatgttgtccacccccacaattcttctcttgccatccctaacgatgtgcatcttcttgtttgcggggtcttttatgtagaaaatttgttcaacctgcttcgttagtacgaatggttcgtctgcgtatccaaccttggccaggtccactaatgtgaagccttccttgtcgaccttgacacctgtgcggatattcacccaactgcaatgaaacaaagggactttgaagtttagatagttcagctcccatatctgctctatgcggccgtagtatgtgctcgatccagcctgatcctgatatgcatctatacggactccactgttttgcactgtgcttttctcatcttatgtgacggtgtaaaatgtgtatccattgatatcgtacccatgccatgtgtcaacatcccaagatggaccccttgccaacctttgtaatatctcacttgggccatcggtcgaccgtactacacgatccttgaaccattcgttgaaacgagcaccatgttctctgttgatccaaatatctgatcgaccaatattgtcctgtcggaccttcgctaaatgctcctcaaagtatggggttacttcagccatatgttgcagcactgcgaaatgagcctgcgcgtaggaagcttgatctagaacaattctttttctgccagttgtgccgacacctgccaaccttcctttgtggcgagacgaaggaactccaataggatcagtctcggccatgtaatcgatacagaactcaatggcttcctcggtcatgtaaccttcaatgatgctcccctctggttttgctctgttccgaacgtaggacttcagaattccaatgtacctctcgaatggccacatttctctcataaaagctggcccacatatttttgtttgcttcactaggtgaacagtgagatgaaccatgatatcgaagaaagccagtggaaaatacatctccaagtgacacagggtactgacaatatcggcctgcaaaccatctaggtcttctggatctataatcttctgaccaattgtattgaagaaggcacaaagccgttggatcatgtgatggacttgtggtggtagaatgcctctgatagcaactggcaagatctgtgtgattagcacgtggcaatcgtgagacttcattccaaccagctttagatcctccaatttaacgtacttacttattctcgcgcaatagcccgaaggaactttaatatctaccagacatgatagcattgcgatcttctcatccttcgacaatgtatggctagctggtgggaggtacactcttcctgtcttctcatctgtaacaggctgaagttcactgcgaatgttcatctcctgtagatcgagacgcgcattcaacccgtcctttgtcttgccaggcatattcagtaatagccccagcaagctatcgcacacattcttctctacgtggatcagatcaatgcaatgacggaccttaagaacttcctagtgaggtagccgccaaaatatggattttttcttccacatcctcttcttgtcctccttgctacgttttcttttcttcccaaactcattagtaatgtccttcaccatgttgtgtacctgatctccggacaaatccgcaggggcagaccctagttctttcttaccattgaaaattttcttcgttcttctaaaggcgtgccgtagggggagccatctcctatgacccatgtaaaccatctttcttgatttcttcagccacctactgcgtgtatgttccatacagtcagagcatgccttctttcctttcacggtttgtccagaaagattacccagcgcgggataatcattaatggtgcagaacaatagaactcgtagcgtgaagttctcctgaccatatgcatcccaagtttccacaccctctttctacaaaatctcaaggtcatcaataacaggctccaagaacacatcg

SEQ ID NO: 63914 - DNA, 4968 bp, Oryza sativa
gaggcgtacgtgcaaccgaattggtctagttaatcatattcagtagcacatcatgcgtgtttcaagaattgcgtctatatcacctatgaacgctccatccgtgcattgatggacttaactaaaagatggagaaaatatgtgttaacacgtcacatggattgatcttctccagtgttgaaactgccagtgccatgttgccgaccgaaaaattgattccgaacgtggagagtttatcattgacttgttcacaaatgtttccgcaacaaatggcttattttgacgcgaatcggtagcatcagaacgtttgggcttcgcactccagcaaggcccagagagtggacagtttccagtgcaagtcgagttaaggcctcagcaaataccaaatctgatggataccccagatgaacaattctcagggcatataagtacgtaacatgttaacttcctctagcacgggaatgcttttcaacagttgacctttttgcataaagcaacacatacattgtgtatagctgcccatgggcttgcccaatcgttctgagctcacgacattcattattgccctatagttttccaaagataggtggaaaacagcataccctcggcagcactaaatttcattagacaggtaagacaggtttattctgtgggtaattgttgcataggaatgcattaagaagccttcagatcatcaagtccaacactggcctgcaagaatagtatgatggaagacatcacattagaatcagacaattacagactaaaggactaagccttcaaaatgtgagaggccataccagaaaatcatgattctctttgagaaaagggtaaaaggtcgtgcagaatttctcgatatcagcttttatgtcacccgttccactaatgacctccataaatttctctctattaggagcaagcttcattgccacctgccaatttctcatatgagcactcatacaaacggaggaaaagcaaataaaggaagcaaacatgaccaaattaaagaacttctcacagaaaggcaaagcccttctctcacccaattatgaactgaagtgctcttgtacgtattcactaaaagagcatatatgactgaaaacagttgggttataatgattctccactgtattcgagaaagaaaaataatgattttccactagttctaaagattgctaaaacagaaaaattgtctttttagtgaagttcttgagaaggaaccacccttgcattagtttatttaggcgtaaacattctaatttcactaaaataataatgttgaagagattatagtaacaccatgtatatgctgattatgcgggtcaacatagagagaacgactcaactgtaaaactagaactggcaagccaaccatgccatttcttcagagttttggtatatgaatcagtacaagcttgactcatagtccagtcttgatgctcaagcaggttacggaataattcaacaaggaagtccatagccctgaaagtaaaattttgagttaataaggctgcttaagctgcaactgaaaggtgataaattatccaagaaggtttgaagcacctcgtgagccacagaagtccatttgtgcagcttgacgaaccttttgcagtcttgttttgaacctcttcctgaaccatgctgtacaattgctcatattttgatgggtctgaagaatatttattttccagcctctgaagaatgaattagatcagttgttagcaaaacaaactagaaatctgtgggctccaaaagggatatggacacttctaagtaagcaaatcattctaaagtaaatatgatttatgcatctatcacatagataacactagaaatttactaatgaaaatgaggaatgaaacacaatgtattattaacagtgtcatgcagaaaaaggatgcttaccgtgatattaccaccaatgtcactcttcacaagtgccatagcagctccaaatttatctggaatacaaagtcagagaacaaaggagacaaaggaacacttagccacaatagttagagtatgccctgacttaaaactaacaaacgatttaattgaagtactaacacaaccacacaaatgtatgtcaaaacttatattgtttagaaatgtgtatatagcaacaactaagttctaaacccccaaaaaaaactttactgaactcctacattaaatatcatatggtgttaccctcagaaggtcactgaccaattctaccgaggtgatggattggtccaatcaactatttgtagcagcattacaggtaaatcaaatgccaaatgcccacaaaccaacataactatttggtgattttgataggcaaaatccaacaacagtatagaccactgccaattgccaaaagcttgtctcaacttagaaaaccatttactgctccaccgcagtactgaactaaacatagtaaatacaaattaaaaaaggaaccaagctactgatctgaatatggaaatcaaagacagttacccaaaacaggcaagatttgcttgcagacatcaagaaagggcttggtgagtatgacactgctctctgacttaacatgcttcataccctccaacgagggagtgaacactgtctcggccatctctctagctgcaatagaaaacaatgaatgcgtcaacatatcggccgtagcaaacaaaaatccacactaattcactaaagagacactgatcccacaacagtttctaatcactatgacccgtggcaatgaattccccaatcagcaactgctttcagttgcaggatcagttgtgctaactgctaagtacctgtaccaaaacacagatcagggacatcaacaacaagcaattagcccgtgctatccactacgcatcacaccaaacaaactaaccgagcaacaagatttcttctagactttctaccactcagcagaaacaactcgaccctggatcagatcagagccaccaggccacccccgaaccgctaatccaagaagtggaaagcactttctactaatcttccgagcttagatcccaggacccaagaaacacccactgatcacgaaatccacacactggccacatccaaaccggtgaccaagaagccaatatttttcccccttacctcgcgctacctgtcggcggcgtggagacctcagcagagacccggtcgatcggaggagaggggtgatccaaaaggcgccggctttcacccgaggtggagtgcgatggcgagcagtagaagatgccgaggcgaggcgaggccagcgactccgtacagatttattattattaccgcggaatcttactgtgcaccgatccttgtggcgaggccgtaacacaagtcctgatctgagtagctcggaaatgggccggcccattacgcgttgaaagggcccaaacagggaggcccagtaaggtcccccgcagaataaacgctctgacggtctgaccctagatcggacggctggatggcctcgggtggcgatccaccggctcagggaaacccgcgcgctgcctttataggccactcccaccaccgccgccgccgaaccctagttcctctttgcctttccgcttctccgcgccccccccccccgccgcttctcccgaccgccgccgcgagaatggtaggtggatcgccgtgggctcgtcgtcttgccgccgttgccgttccggtggtggtggtggtggtggtgctttggattgcgcgcgtgtgtttgaccggggtttttttgtgcctttcgtgcagccgttcaagaggttcgtggagatcgggcgggtggccctggtgaactacggcaaggactacggccgcctcgtcgtcatcgttgatgtcgtcgaccagaaccgggtaagcatcgtcttctctcgtacgccttgaactgtttccatttgtacccgctttataatttggatctatagaaattatactagtactagctggtgtgataaactcttgctgctattgtaatttgtttctagtgagaaatgtaagaattgttaacgtagtagaatataatggaacgccaaaaatgaatcctttgagagtagcaagtctcttctgtttccgcacagccttaaatggaagaatattctgcatttgctgtggtgtactccctccgtactcgtaaaggaagtcgtttaggacaatgtttaagtcaaacctcgggaatataaatcatgaataactctcaagttgttgagtttgaagatgtaaaaattatatgaatagatttgtcttgaaaaatattttcataaaagtatacatatatcacttttcaataaatatttttatagaaacaagtagtcaaagttgtgttttggagaccgtgtcgctgtcctaaatgacttcctttacgagtacggagggagtacttgatctgaaaaaatgtgcgtcaagtctagaagtttatcagcattagctcggactacttggcaatttacaataatgaactatttattgacaatgaggttttggtttacctatgattgatagtgttgatggtgcctccattggcggatgcattagtgccactattatgttatcgctgctcatttttctaatcggagttaattatattgtagtgctttgattattggatatcacataactctgttttctgtgaatcaccaggcacttgtggatgctcctgacatggtcaggtgccagatcaacttcaagaggctttccctgactgacatcaagattgacatcaaacgtgtcccgaagaagacaactttgattaaggctatgaaggaggctggttagtatgaatgttgtgctaccaatcctatcagcagttatttatttctgtccatgtctaatctgagtggtggttattctatttaagatgttaagaacaagtgggagaatagctcatggggcaagaagctaattgtcagaagaggagagcgtcactcaatgcctttgacaggttcaaggttatgttggccaagatcaaggcagacatcctattctcaattggtttac

SEQ ID NO: 63915 - DNA, 670 bp, Oryza sativa
  unsure (1)..(670): unsure at all n locations
aagtaatattgaaggtctactcgcatgtgcgtaatatgtggtggacaccaaaatttaatccttgtgggtgaagtcatgcactcacaagtcacaactccaccactacaccacctctgcttccccaaaattttggttgtggtagtttttggctaaatatacattagaaaaaaattacacatgcccaccacacgagctgcccacccggcatggaatggtcaatagctcgccggcgacgaccaccacacgagctgccctcccactgcagcaccgagctcaactcaatgtagcggcgaacttcggccgagcgaggtgagtaccagaaaccggcgccggagacccgtcgtgtttgctcgccgccgcttgctcccctgctgctgcttacgtcaccgccgccgcttgctcccttgctgctgttgctacttgctcaccgaaagaggagagggggggggggggggtcngggggcttgtttcttgttgttgttggtcagttagagatgaggcccaaagtaagggaaaaagaaattaagatgagatcgataggatctaacagatgggaaggatgaacaggagagagaggagaagagatgaaggaagaagaaatgggcaatttggtccatacgaaaatatgttagttaaaaaaggattcaaataccttatcaagtgtatagga

SEQ ID NO: 63916 - DNA, 17778 bp, Oryza sativa
ctactttcaatgtcagagcgcatactttgacgaaccacatgaccaaactgaatctcaaagttgtcacaatttgcactacagtcatcttcaagcatcaaattatctagcattttcatcaccttcagtgtactttcttctgtcatggaacatcggaaaaaagcttcactagccactgttcgtagttgacgatagcgttccatctggtctgaccatgtgtaaacttcaccatacctatctgaaggaaatgcagattttgcttgcattgtccaccgtcgtgctatgcagaagcttggtatggcctctaactgtaaataactcaaaactgcaaatatgtgatgacatggtatgtactgacactccattttccggcaaggacaggccatgctacacagtaatgcttcctcaaacatgcaggtcacaatgacaattttatcttttccaatcaaatgcaatacataccttacacattggtcctcttcgatggtatctattacctctcaattgatgcccatgtatatctcaaccttcacctttttgaaaattttaggcgtgaacacacgtgctgcatccttctcaattagtgtagcttcattagcagtaaatggtacctgattgtgaagcctttgcatccaactctgcctcttggtgatggatacgcgacaaacaatgttcataatgctccaccaaaataactaggctcatcttacgatccaacaacctatgaagttttgagttcaagctttcactgcgttgattgctcttcatgctgagaaaaaccctccctttagtgtatgttgctgcccactttttccttaaattatacatcctcttcaaccacttattgtcgtccgataccttatgcttaatcttaaactctacccactttctttcaaactcatcttcatcaaactcactatgcacaagtgttctaaaatctgaaagcatggctggactaaggttccgtgccatattttgctcaatatgccaggtgcacaacctatggtcagaattgggaaacacatgtaggattgcccgacgcattgcattgtctccatcagtgatcacagacttgggatgtttctgacacatacaagttaaaaactggcgtaggacccattcatatgtctcaaccctttcatctgaaactacagcacatgcaaatatcacagttgacccatggtgattgaccccaacaaaaggaatgaaggggagattgtatttgtttacacgatatgtgctatcaaacacaacaacatcaccaaatgcatcataatctatccttgattgcgggtccgaccaaaatagcctcttcaagcatcctgcttggtctatctcgtaatcataatagaactccatatcatccttctgccgtgcttgcatgtacttaagaacatggtcagcatctccacctttaatccgtttctttttcagcttcacaaaaaaattgtacatatccctagaagtaaaaccagtaccctcataaccaccatggtctctctccattatatccatcacttgatgctgatgcaaacctacatctctcaattctaccatcttagcctgttctgcaggagttattctacgatgtgagcggagaaatggcacttgatcacctttacacaacggatggttatgcttcgacacaaacctaacgacataccagttaccttctttctgatatagtttaatctcaaactgagctttgcaaccacaacgagttagtgcctgtggctccctacttctgttggaaacatccatatataactcctttctaaatccttcccttgagcatgtgaatctacgatgaattattatcccactaaaacgatcacgcctgcagtaatccttccttacactaaaacctctctctctagcatacttattgtagaactgaaaaccatgcaactcactaggaaatttcatgcctattatcgtagcatactcttcctgctcctcaatactgctaccaccgccttccattgcacacaacacagtaaacctgccaataagtatgaccactttcgtgactacttcatgcattgcttcaactagaaaatgaactacaaacaacaatacaaatgttgcacatatcatttttagtgcttgctaattacctgcggttgagggcgtactgacagctagggcggcggcgtcaatgttccacagttgtcccagcgatgctggcgtcttccggttggatgcgacagcaatggggctgggtggaggcgacggccgatgtgccgtgctagaggcggcgagttgtatgcgacgccgggtggcggcggcgacggccggaaccctcgatgcgacggcggccgcggcggctcgatgcgacggccggaaccctcgatgcgacggcggccgcgggggctcgatgcgatggccggaaccctcgatgcgccggcggccgcggcggctctctgcgatggcgggtgagggaagacagcgacggcagccactacggtctcgatctacttgcgacagcggcagatgcgaacgaagagaaaaaacagaagcagaaggaagagaccaagtgattggttagcagggcggtgattagcggcagggctcaaacccgatcttacgatcttacccctgctaaattaacggctagattagattggtacctcgtacctcatggcacctgctcaaggacagtaaaaatgctcaaatgctccaattataaaccctgatggataggataagagtggaacaacttttgcaacagtttatataatttagttcattcatttggctctttcgcctaattattctgctctccagattgtcgtaatcaaatatcttatcacatcaaatgcaaaaaggtaatggcctgattttttttagagacaaaatggcctagctaattggtggagagggaatattggtgctgaagctgtttctgcgtgcatcagtgtcagtcagcacacaaaagcacaagcgaagagttattaaaaacattcgatcataaatggatccacataacatagtaccagaaatgaaccagtaaattacatgaatcaattaagtgtcttccactcagataccagtatagatgtaccaagtatagtgatactcgtgcacgctggttaattagatactcgttgccggttctaacttagttggggcagccatctgggttgttgtaaactcaggaggtgttggtaagttgggtgagagtgataggcttgcctgtagcctccttgagattgaaggagctgaagccctcggtgagaggttcaccatctccagtgcctgcatcctgagctgcattggatagtccttcacacatccaatccttggaccagccccagtgctccatttcagggacaacttgtggccaagctgataggatcttgattccctcttggatttcaccctctcaagaatcgctttccgcgggacgtcgatggtggctctagggctttgtagcccacctgataaggttctttggtaggttggctttgcttgctctgtggcagcattgtcgccttcggcaccttcaacttgtgaagatgacccagatgccttgttttctagtaccatgttttgtgggagaatcaattgtggaggattggattcaatgatggcagtgatagggctctgaactttattaggaactggttcttcatactaagcatcatcgtcggatgggcgcacctgaatatatacacaaataagaactcattgattgaaaccatgcatttgatatatttcataaatacttagcctgaaatatggtgtaccacgttgttgagatcaactccattctcctctaggaagttcatgaagttgctgaggttctctgcacttggtttgtagtgaccactataggcccagatggactgaaatcagaatagatcatcagagatagaaaaaagtgctgattaatgcacccaaggaacagaatcatgaacaagtcatatgaaaattatcaaaatgttctcttataatgtgcttgcgaccagaagattagataatccattctgatgtccttgtaagtcgtaactaagtaaattgatcaaagaaaaaaaaatctgaagaatcttgtgggagttatattgggaaaatgcgataatgtaagtagatattttgatttagcaacgataaaagataggtaaatttaaatgaccagtttgatccactatacaaatttcaaccacttacgcgaaaatatttataaaatccatccaggcattgtctaatatttgtcacaaaaggatatgcatgctaaactgtcatatcaggaaagtaaaatgcagtgcacaaacaataatgaaccttgataactccattttctgctgtaaacctcccagcagctatggtagcacctcctgctaaaaagctcgagtgctggaacacacctttctctttctgcatgaataaatcagcttatatatatgagtaaatatttatagagatgctaattaagctaccagcttatatgagtaaatcagcactaacgaacacaaaatccttatggcacggagaaaattaaaccaccttgccagcataaagtctcttcgttgtgctcataacaaaaatccactttgacccttggcttgtatcaaggggttcttcagagtacttatggataatctttccttttgtaatgatgtattcatattgctcacgctcttgctgcaaaacatgcatcagatatatataattgttagaaccatctgtaggtaggaagcaaaaatatagatctcactaacaatattttcatgttacaattttgtaggttgctgaatttaatggtttgtttcagttgtcaaggattatatatgcagcaactatagaaatgatcttaccggaccaagatattttatgcattgcttcttcagctgagctcttggacactcaggaaggtcaacatcttttccctccccaatatcaagcctacatttgcaaaaagaacattactgaaatcactgcacaatcaaaccacttactgaaatttatgtgattcagtgcaacactgaacttaatgcattctatttgcaaattaatctctttttgtcagacacatccaaccagtttaattattccaatgacatggagtagtttgcaaatgcaagcacacaaatcacagtcaacttctcaccagtagaaaaaaggctggccggcctggctttggcaccagacatcatagtagcactgcagattgtgaccatatctatgccgtgggtcaatctatacaacgaatgataattgctgtcataattgcatatgtgcatcaaaagtttcacataatgaacgaaaaaaagcagaagcagaagcttccatcacgccatcatgataagctgtgaagctttctcatgagcgatgatgtattcatgctcacacctgacgaactacaagtccaattaagtcaactgatagcagcctcttttcacgtgtatatatataataaaacaataaaacaaataccattaatttctgaaccataaaggtactagtaatacactaatacctgatcaagtaaagaacactggtaaaaaaaaaacactagtagatttgtactgttgtacttacagcctcgatccagtgctggaatgccagcttccgagccttggcgtctcttgataaaccctgacccacctgcatcaaagctcagattttttacagcaatttcgacacaaacagaagattaatcaaggagatgcagaccagacaaaccaaaagaatgcctcctttttttcttaaccaaaagaatgccttctttttttcttgtggaattttgtggtaggctgcaggtagcagcaactgagaaacggaaggaagtaggagaccttggaagcaatgatgctgacacggctccagcgggaggcgacggtctccgggttagggtcgtggaaggagatggtgctgtagctcagccgcgcgtagtccagcgcttgccaccttcaaacaatccaacccacaaacttaatttctcggttaaaaaatttgattacttttagatttctattttctctacacaaattaaacagtttgaaactttgaatggatgcaggatgctcatgccataatctcaaagtccggaggctaagttccaaacagattattgagcaaatagttgtcaccgattatctacttgattattaagataaattagatatttttgatatataaacttaatagataacttaaaaacaatgagtaaaacgcataaaacggtccttaaatttgtagggttgtgacatctaggttcctaaactcacaaaatacagatttaggtctcagaacttgtcaaagtgtatcatttaggtcccaaatcgacacaatccctatatgatcctatgtggcgctgatgtggcatgccatatggacgtgacgtgtccttttcttcttttttcctaactttttcttctttttcttttttgttttcttctcattcttattttttcccctctcttctattcgggtcacagagaaaggagaaggaaacaaaagagaagatggagaaaaagataagaaaataagaaaaaagaaaaggtaaaatttgttcgtgtggcatgccacatcagtgccacgtaggatcctataggagctgtggcgatttgggacctagatgacacactatgacaagttccggaaattcgatatgcattttgagagtttagtgacctagatgacacatccctataagtttaaggaccgcctatacactttactctaaaaacaagtggtccaagtaatataggtaagtaatataaataatataaaatgcattattcaaagcgtagagtaaatattcacttcatcttaatttgatcatcccataaacgaagaccacgaaaaccaagaacaccaaaacatctaccattctaaaattaggtactccattgtttcgtgtccaacaaaaaaaattaattcactttaaatgttgcgcacatagtatttcaggatgtacatttactctttgcataaataaacaaaagaaacactttgttaattagatgatgattattttggaaaaacctaaaaaatcttaggtgataatccaataaataatctgaaaagaacaactaagtgcacaaagttcgacttaataacttaaaccgatgagcaaagatattccacatgaaggttggtgaagaatccggttaattaatcatcaccagagctcctcgacgacgacggctgtgtcggcgagcttgcgccgggtccggtagctccggtacatcttctgcagcttggtcgccgccccatcctcgccgccgccaccgccgccgcttccggccaccggagaggaaacctccgcgtcgagcctggaagagcccgcgtgatccagcccggccgccgccgtcgccaccgccattctcgtggtctaagaggaagacgcaatagtgcagcaaaatctaccactcccttcaccaaatggagacgacgatcgagagagaaacagaggcaatggcggtgctagctagccttgtcgagaggagagggaacgcgaggaatttaagcagagagtttgtgtcgctgtatgtgacacgtgaaatggagaagaagaataactaaaatttgaggagaataattaaaagatgttttattctgttatatatatattctgttcgcgccaaaaaaaattccaagtagcctagcctacacgaagtcgaaaagtatcgtgctggaagcctggaatgtgtgtaacggtattacagtgatgactcaacgactggctgcatgctcttactgttcaggcccacaatcccacatggttactgcacaaacagtgaaacaatcgaacaaaatttaccaaaaatttaaaattttaaaaacttggttatgttactaatctcttatcgttacttcaccccaatggtaaacccgtcgacacttaaccgtgcggtaagggaaacttgtatgtgtgtgtatatatatttctgtaaaagagggtaaaaattttggctcgtagtattgatagagcagagtgaggaaaatccgttttcacttgcacataaatacacgatgagcccttttttttaaaaaaaaataaagaagttaatttggttcatatttatcctcagttgcctactatatatagtcccctttttttttaacaactatagctgtgattcgtaaatcgtcttcaattctgccttttaacatctcaactactccaaagtgctaccactaccatagttatatacaatacaatactccagtagaccagtacactgtaaaagctctattatatttttaggtcctgcagtcagcacagtgtttaaatcttttttcaaaaaatctattatattgttaaaggaatagaaaaatgagcctctactttcgctctcatggcctagaaattctcacattaatcggagaaaaagaaaaaacagagtccatatagaaatactccctccgtcccacaatataagagattttgggtttttacttgtaacgtttgaccactgtcttattcaaatttttttttgcaaatataaaaaatgaaaagttatgcttaaagtactgtagataataaagtaagtcacaaataaaataaataataatttcaaaaaattttgaataagacgagtcgtcaaatgttacaagcaaaaattcaaaatcccttatattataggacggagggagtacaatttagaaacagctgaaattcggaattaaaaaataaggaatattagaagagaagactagagtccatatagaaatacaattaggaaatagttgaaattcggaattaaaaataaagaatattagaagtagagtatatagtccatatagaaatacaattaggaaataactgaaattcggaattaaaaataaggaatattagaagtagagtatagagtccatatagaaatacaattaggaaataatagaaattcggaattaaaaatagggaatattagaagtagagtataaagtccatatagaaatacaattaggaaataatagagattcggaattaaaaataaggaatattagaagtagagtatagagtccatatagaaatttaaaactaactaaaattcggaataaacataataaaattaaaagtaaaagtagagtttagaattcgtataaaaatacaatttacaaataactaaaattcgaaattaaaaagaaacatgggtagaagagtctaaagttaatataaaaatacaatttagaaataggtgaaatcgaaattaaaaattaatgaatattgaaagatgagtttagagttcacatagaaatacaattagaaataataaaaattaagaattaaaaataaataatattggaagaagagcctagagtctatatagaaatacaatttacagataatggaaattcggaattaaaaaaaagaaatattgaaagacgagtctagagtccatataggaatataatttttaaaaaactaaaatttaatattaaaaataactaataactaaaacgtatataaaatacaatatgaatattacacattagtagttttgtaaagttagtacaaaatttaaaattatgttgttattttaatatatttgaataatacattgaaaaaatatatatgttattatatgagagaaaatataatgatgttagccgtgcagagtcaccatgctagttaaaataatatcaagcaccaaatccaagcaagagatgtaagttcatcagagacagggagctcttctgcgttggattgggtctctgagtcggatcgacggtgccaatgggccaagcaggccggcttgggcctgtaagctgagtggcaacagggaaacctttgctaattagattatgatcattttggaaaatctaaataattttaggtgatgattaaattggaatagtgataataattagttttgacaatctaataaataatctgaaaagaacaaataagagcacaaagtacataaatatgggcttattcctactacgactataatctacacttcgaaatacagagattttgcacaggcaacagggagaaaggaaattgtgaaaagagctcagattcaagagtcctctaaaacaaaagggatcagctaacaatcactggactccaaaattcaccttcttctgctgagacaagttcactgaattagattttccacaaaaataagatgggcattatattttggatgtgtgtaggagcaccatcggttacccaagtgatgattatatgccaaatgggttattagaaaaatcaatttatgggtaatttttttatgtgttcacttaaaaaaacataaaaaaaaagaaactacgttcgaaataccttaaaatcaaatctaaaatttagttttaaaattcaatttttagcagcgacgtgttgttcatgaatgggttgcaggaatgatctggggggcattggtagattgaaagtgggatggcaatcacatgttcatacgataagagtaatgtgcaacgaatgagcggaagatacgcgagggagacttgagctgaaggaggagaatggtctgtggtgacaaaggagattgagcgatggagatggggtgggttatacttgaggatacatttggtgttaaaagatgatgggcttcactggcatttgctaggtgaggatggtggtgtagtggggtaggattgctgattagcgcgtctgtgtcacgatcttacacttctagctcataagacgcatgttccgccctttcctttttcctttcattttagttgaaggttttgcaaatagaagttttttaacaaattttgctacaggatactacgattttgtggttttagccataagacactgcccgaactcacttttagggaagacacttcataaacgtgataatttaccgatggacaccgcgccgattagaataatattttccggttgaggaggagagagaaatcgcgtgaaatgtcaaaaatacccttaggtccagtcagctcttctatcttttctctctcccccctccttcgtctgatgcgcggcggcggaggacgagaccgacgctgcgatggatgtcgagcccgactccacccgcgtcgcggtggcgccacgaccacctgccggtgcgcgtactccagcaccagctccgtattcccggcgcccggcttctacttccgcgtcaccaagagcgagcatctccctcagctcgaggagaagctcaagaggatctgtaagcacgcacgcacatcgaccgtatacgttttgccatttcaaccttttttttttgccatcctattcttattaggaacgtaataacacaactaaagcatgattttcgtggacccatggcattcttttccgtccatgaacgccggctcgccgccgaacacctctacctcgaccagatgcatcggtctcttcccgaacaggtcggcctcaagatcgagcagctcgctctccctcccgacgaagccctcgttgcgggtgaagggaagctccgggcgcaccgccaccgccgcgtgccatgatcggacggcgtccgccaccgcgtgccgcccaagcctcgactcaacgatcttgaggagatcgatcaagcggtgcctctggctcgcagcgtccacctccacggccgattccgcacgggacagcgcgcccacggcctccctccagtcccacttgccgccgtcgtacaccttccacaggtggccgccgaacctcctctacagatcgccatacttctccacgatgtcctccgcgcggcagtcgcccttcccgagcccgacgaacaacggcatctggtcgcgtggaacgggctgctcgtggaacgcccgcacggcggcgacggcggaggcgacggtgccgtgctcgcgggacgtcgtggttggtgacatgaaagaagcagcacgagcgtgcggcggcgcggacgagcgggacggtggccgagcgcgggagggagagctcaacggtcgggaaggagatggccaggctgccgtcgtcgggcagagagagagagagagaggattggagagaggggagagagtgagacgagcgacggaggaagaagatgacgtggagggggatgaggagctgacagccgggcccgggtgacagatgggccctagtgcaagggcatttcggtcactccgcgtaaaatattaggccccctagcgcctcgtcagcacggatttattattttaaaaggcgcggtgtccgctggcaaattgccacagttatagagtgtctttccccaaaactgagtttgtgcggtgtcctacagctaaaacaacgaaatgacgatatactgtagcaaaatttgccaagttttttagattgaagttttaaaatgtatgtttttaaagaaaagaaattgtgcactcaaacatagctgcgctaaatagcaatctcggagagagtttgttcgaagccagcccagtccaaccaatccatcacaggcggcctggtcctccattttgtctcaaaacctgaaaaaaaaactggccgactcgaaatatgcctagggttggcctgtctttggacctgaatgtttctttttgttaggctcgggtcggcaaatttttgctggagcctagggcctgtttagtttccctagcaagttttttcaccctgtcacatcgaatgtttagacacatgcatgaatcattaaatatagataaaataaaaactaattacatagattgcgtgtaaatcacaagacgaatcttttaagtctaattgctccatgattttgacaatgtggtactacagtaaatatttgctaatgatggattaattaggtttaataaattcatctcacagcttacaagcggattctataatttgttttgttattagactacatttaatactttaaatatgtgtccaaatatccaatgtgacacggcaataatttttacccctgaatctaaacacagccctagttacaggatgaatttgacgtgggagttgtgtgggattatctatatcatcgatctgcaatcctatggcctctaattgagtaacctctcaaacttctttcagaacgtcaccttgtgaaagtatttaaaaaatgctcaaattaatatgttcattgcgtagctaaggctttagtttgctctgggctggccgacatgcggctcacgcacatatgttcagtacgtcatagagaataaaaattactttaaaaattactttactggtcaagatccttgtgtagtagtagtagtatgtttagtagtaagtcctaaaatatacagttcaactgcaagctcatcacagatcagttacagcaattgtcaacgctactccatcccctgcatccttttcgatcttcgcaagcaaacagctaacatctgaggatcatgcatccgtttgaccttaatttgagcgaattattctttttcaatccgagttttgttacagactagaataaactcattggatatatttgaagaaattctgaccattggttgaaatggtctgtaaattgcgaacagttattataactgaacgtagaaaaatgataattaaaacaaaaatatgtgatgatagggcatgaatttgccaatagaagtgttggtttatttctacgcccgatattagtaggataatattatacaagagtagctagctagccacgggatcttatactttgtggaaatgtacttaatcacagccggtgactgacacgttgggtcgcttcattccatagttaggctgctaaagcacatgtatctttccttgacggattggttacacactaaacgtggaattaactagtaattaggcatgcaacgacaaaattagccaatacaatgtcctgcgatcctgacctgtaaaaacgctgttgtaccagctgacctaattatcgatcgatcgatcgagctgacccggaaatcctgcgatgacacttcgaataagtggaaagggttgcatgcatgtataagcaaaaataattttgccgctgcaagcatacatgcaaagctattacatagtcatattttatcttgacacatagaccaaggataattaattctacttatcacccatttaaacatgctactagtaattcctcgtaaacaagcgattcattaatatttacatttctcgatgcccatgtagctaatcttgtgtggaagaatggaaagtcatgcattaaattcgagaaagtcattaagaagatagattattggattgaaatatgcctatcaaaaatagaattttcagatttagaaatatgactatcaaaatagatggagggagtattaagctaatcacgtgctgggaaagcatggtatattgcatgtggacatgtacaaccttggaagcaagcaactccatcgatcgcctataaattccatcgcaaccatgcatgcaatcacaccagcaactaaacacatcactagctacttaattagcagcagctacaatctgagtgtaattaacagtgtcgtgatggcgcctaggctgagcgccgttgcattggcggcgttcctgctgctcgccgtcgtcgtcgccgccgccgcccagcctaagcctaagccggccggaaaaggcggcaagccggagaagggagagacgccagggaaaggtaagccggaggagagggagacgccgccggggaaaggtaagccggaggagaaagagaagccggagaagaagaagataaaggtgaagtgccaggagagccgtaagctctacccctactgctccgccaagatgatggagtgccccgacacgtgtcccacctcctgcttcgtcgactgcgacgcctgcaagcccgtctgcggtgagcagccgccgctaccattgttaccaatcgggattaatctttagttctaagtatttaaattagagataaagatatcttagattcttagattcgtatttctggttgaaaaaccgggattacacaggaggttaccaactggaagtacgaagcatttctccgccagtggttgcacctccatcttgtctctgacgtatactctctgttgttgtgcagtgtgcaacgtgccgggggcgtgcggcgacccgaggttcatcggcggcgacggcaacgccttctacttccatggccggagggacgccgacttctgcgtcgtctccgaccgcgacctccacatcaacgcgcacttcatcggcaagcgcggcgccgacggcatgtcgcgcgacttcacctggatccaggccattgccgtcctcttcgacgacggcggcgcccaccgcctctacgtcggcgccaggaagaccgccgcctgggacgacgacgtcgaccgcctcgaggtcatcgtcgacggcgagccggtgctcctcccggaggacgccggcgccacctggacctccgccgccgtgccggcgctgaccgtgacgcgcaccaaggcggcgaacggcgtgctcgtggcgctcgacgggcggttcaagttgagggccaacgccgtgcccatcaccgccgaggactcgagggtgcaccggtacggcgtcaccggcgacgactgcctcgcccacctcgacctggcgttcaagttcgacgcgctcaccggcgacgtgcacggcgtcgtcggtcagacgtaccgctccgactacgtcaacaagttcgacgtcagggcgtccatgcccacgctggggggcgaccacagcttcgccacctccggcctgttcgccgccgactgcgccgtgtcgcgcttcggacatggcggccgcgccgccgccgtcgccatggccgcgtagctcgctgcactgcgtataccgacttaaatcatcatgccctcttgagtctgatgctatgatgggtatgagtgttaattgttctgttcattggccatggctgcacgcctgcactgcatgatcgtcaaagtgcgaagtaataatcttgtgttcgtgttgattagttgatgtgttgatattcgcatcagctgcactgtagtattgaactctgcaaagaaataaatttcatgatttttcgtaaatatttgggtatgttcagaaatggatgcatggtaaaccaattcagaatgatgttaagaatacaccgtaacactttgtcattgcttcgaaagagtgatcgatactggctcaaagcaaacaaaatacggtttttcaactttacaaagttatttttcgtacaaatcattgagtagaaactatagtctaattcagtcttgtatctacggtacaaggatttgcagacatgtctagagtttaatggcacttccattttcaagtgatctgaagacactatcatcgtgtctttatagaaaaatgtaatcttttttccacataaaagcaacagcacacttggtgattactaagaagacaataattagtagtagcaaccactcaatgcaacagaaaatggcctttggtataaacgtactaaaataatactagaatcgatgttacttgcagttacagaataaggctctgcttttatagcatttccctttttgtaatatacgaaaagagacttgcagaacgaacataacaggcaagacataataattctgttttgctaacctttgggttatggcaaaaaggtgtaatcacctgaaaccaatgcgtcaggattcatgtaaattcaaaaaaaaaagaaacttagcaaaaaaaaaactttattctgaacaaccaaaattcagcagcaagcattactcatgcatcagcttgcaaagggtgcgggtcacattcactttgatgcctaggcctgccccaatgctttcccaaacgcaaaagccagaaatccccaaatgaaggaaaacataagaaaggaaaacgagagcacctcagactacatattccccaatgcttttcttcactggtaacctcatagtgcaaggatgagtacggatgtaacatcactggtgctctcggactcaagaaaatgaaaacagaacattgggtcatcgggttaatcttcagtggcacaatcaacccagggacatttaaatccacaaacaacgcaataatctaactgaggagggaacagagcatctcagacaaaatattcccccaatagtttcttcaccggttgactcatagtgcaaggatgagttaagatggatgtaacatcaccgatgctctcggaaaataaaaccagaacatggaggaatcagctgccaaatgcctcatcagctacaatctacgtgactctgaacagggccttagtacaacacaacggcataaccattcatgtgccctgtattagcagtccacggtagcaaaacagcctaatattttactgtctagttataacagaaatgtagtggctaatcctacatagatatgcttgacacattacagctaacggcggtaacagcatcagtcgcctgagtccttacagatagtagaagaaccatccattctagctggcatcttcagttacaaatcaggtattatacatgaaaatggtgcatcgggttcaaatgcattcagagaagaaaagacaacttcaatgcttcaacttatacaccaaagaaacatcagcagcattacttatgtaatgcagccaactgatcaaacaagactaaacttaaaattattctgtgatctttttcatgaatcttgtatgagcactgagcagcagaatattcctcatacacaaccacaagcccaatatttttctaagactaacagaaatagaatggtcaattggtcatttctgcatagatgcttgaagcattacaactactggccataacagcatgagtcctcactgatagaagaactggagctggtcgattctagctgcctaaatggtgacgcattgccacaacaggaggcatgattacaacaaaaaatgagaccattcagcatgagatttgaacgttcactaaagcatgagcaataaaacatgtcatgagttcagttcttgatctatcaaaatccaaggcatcagactagatccacat

SEQ ID NO: 63917 - DNA, 53738 bp, Oryza sativa
  unsure (1)..(53738): unsure at all n locations
gtggttcccctgcgtcaccatccatggccgcgcgctcgccagcggctccacgaggcggccgtacgtgtcccacctcggctggtacaggtcggcgtacgacaggtcgccggggagcagcagcatgtcgtagtcgtcgccgccgatgtgccggagcgtcgactccgtccatcccgtctgcccaagatcacctggaacgtccgccatgagagacatgtcagtgctgtgtctagatttcaacttttccgtcacatcaaatgtttagacacaggtatgaacatcaaatgtggacaaaaaaagaaaaactaattgcacagttcaactgtaaatcgccagacgaatcttttaagcctaattacgtcatgattagctgtaagtgctacagtaacccacatatgctaatgacagattaattaggctcaaaagattcgtctcacagtttacaatcggaatttgtaatttgttttgttattagtctacgtttaaacttaaaatgtatatccatatacgtcaatattttcttttgacaatgaactaaacacgatgtcacgaagctcacacaagcattcgaacacatgcagtgcagctaagcttaccggcgacgacgaacttgaaggggaggctcgccggcggcgtacggaaggagagctcgcgggaggtgtcgttgctgcagcggtagaagtaggtggtgctgggttgcagtgggccgatgacgacgtcgtggatgttgccggagtggtagaggacgtaggagtaggtgttggtgcttccggtcgccgagaacgggtactggccggaggtcgtgccgtactccacggtggccggcgcgtcgccgccggtgatccatgtcactctcatcttgtcagagcctactgctgatatgtgcacctgaaaatttccatccaaaataggaagtttcttcagagaggtcgtcaagcatttcagttatctgaagaacatttcagtggaattctggtccaattcagtgagaatctgaactgtacaccgagttcaggctacctttcgaattaattagcacattttacttgtcatatattttttttactatcttgctgaaatgatattcatggattgcattctactgacatgactgtattttttgacaagatgagagtgacatggatatatccatgtaacttgatgatgcctgtattgtcagtagatgagagtgacatggatcaaaaaatacaggcatcttgctgaaatgagattcatggattgcattctactgataagttgtattcatccatgcaacttgatgatgcctgtattttttgaaaatttgatgatccatgaacaagacagtaacctatattgtaatttaagatatccatgtttgattaaatcataggtgtacatctgtctaaacatgaagtaatatgtgtacatcaataaggaccactgttttaataaattattgtactgactaaatcatgaacagaatgataaattgaggtgaataaataggagcacatagtttcgtgttgacttttgttcactgactcaacattggacagaacattggtccaaccttgatttgttctcttctctgtcagtactaagccatgtcatacagtactgacagtgactaaacttgggaagcatatttttgcttcttgcttcatgcaactgcgtaacagaaacatctagcatttcttcaccagatcgactaaaaccggaccagccacctcactatattaacaggttgttgaagagtttgaaacataaactcccaaggcaaaaacgaacaagaaacgttattgagtgttagatttggagtgtttggttaggccacctttaccatttatggcttgaagaaaaaaagagcaaaattaaagtcagcatcatgactgaacatatcgtctgtctcttcttgacatatctgaattttgcaattgctgcctgcaactgtctacaggatatactaccaatgactttctttcttcagcttctatattgttgcagtgtttttattccttttcataaatactttctcttttcttatctcgagaataaatactttctttctttcctacaaccataacttgcacaaacacaaaagaacccttatctaatctctaatgcaaacatgagtatttttaagagtgcctcctgatagtgtcatgagctgtcccatggcagtacagtggagtagtatgtttgcaataattgtttccacgaggaccatactgaaatctgacacgtacgcgggcggcaggccaattgaatactcctactaatggtttaatttgctggaaaaagaagaagaaaaaagatatggagaatgcatggctcaagagtttgaagccgtgtcaatggtgattaattgcagtatcagcaacactaaccaccgaaaggggctcgtgatcatggagcaggaaacagccaagcactagataacacctcggccgaaccagcatgccgacatggccagaaatgataaacaacaagacgagtgggaaagcaagaaacccaaaggagcttcttgttccttgtgtgtggtcgccttatcgatcgaggtgagatttagactaaacagatgccgattaattagttggcaaattaatcggtttcttgttccaggatatactccaagttggtaaatttaaaccatgaagcataatccgttcctactttgcactttcctaggttaatataatccataatcacgagggactccaggctgtgtcacatgaatctcaggttttccttaaaaaaaagaacaggttgctcaacatgagactatggttgggtggactcttgcaccaaagatgaccaaaccatttctttcactcaacactgaatcttgagttagatggccaacaaagagcaaagccacataaccatgcaaatttgagaaatattaagaaattgaactgacgcatgaaaattatttgaagatttcaaactcactacggccaaatccgtcatcaaaaacataaaaaactcagtacctgctccggcttccggccgtcgtcgtcgtccttgagcagagacagcgtggccctcggcttggggcgcacgtacggcgacgtgacggcgagcgacggcggcggcagcgagaggagggatgcggcggcgacgaggaggaagaaagccaatgctgtgttcgtcatcgccatcgccatggctggtctcgccaaatctgaaatggggcactggggatagatatgaaatgaaaaagggcggttatggctagcatggaagggtggcgtcgtgtatatataggacagccttgccaacgcaagcagctaattaatgattaatgatgattgataatgtgccgtggaggaatccagtttcggatgcatctgatttcaggtgcgaatctggggatttggatatgtggtttagtcaactttaggtgactaaggcctatttagttggtgaaataaaaattcttagatgtcacatcgaaagttgataggatgtcggaaggggtttttggatacgaataaaaaacactaattttataactcgtttgttttaaagattcgaaatgatgtttttggtaaaagaaaattttgaggaactaaacggtgcctggttttactgcactctgttccagcctctccagtctgaactctagaagaaagaaacagagagagagagagaggttgcgcgttgttcggcaggcggttcggttttgcgcgtgaggaacgaaccgcacgcatgctcagttgatcgacacgtaccaatgcaacggcggtggtggctgcctggctctcatcagtcatcacctcgcctggcccccacatctgctagccacgggccactgacagggcccacctccccctgggttccattttggcataataacggattgcttttctttttttttttggtccgtgaaaattggtgtacgtcttcgtctctgatctgttctgttcccttcgttccaagtcctggctggctgcgcaatcgactggtttctcgagttacaggcttacagcagtccatgcgtgacttcgtccagtggcggagcagaagaaaatctaaatcccggataaatatagctgcattttctcatggaaatggagtccgacaggaacgtattcctccggttcggcgtaccatgccatcttcataggaaggaaccgtttccaagaggcgccaacttgaaagtttctggcccctcctcgctttctcactttcttttggttggtcacaatgaataggtgttagactgctgatcgtcttcgtcgtcgtgggctgccccactccgtccgatgtgttctatgcgattaacaggatgagagtatagatcacatcttggttggctgccctgaatcccgtcaactcgatctggtggtgggcatcaggggtggagctagaacgaaatggaggaatgtgcctcttgcttaatttactccatctaaaatcaagtttaagttgatacgtgtgcctaagcttgtattgaggggatacaaacatgatgaaaatctgtgagttaaaaaatttacttgaccgggtttctgggcaccccccctcccatactctacctccgcccccggtgggcactctcagtgaccggattgcctcccctgcaagaggcttccttccatcagtggctctgccttagcaggaagaaagtcttgaaggatcggcgtcggggattcggcaccattgcgaccttggtagaatggacgatctgtaaagagaggaacaatcgggtgttcaatctccagcagcgacctgttaacgaccaaatttggtaatatcagtatcggagacgaagattagatcgaagtggaattaaaaacgaagatcgttgtggaaacagagtaagaatcggctggagtccaaattggctacaatcgggatcggctaagtccgagtcagactgggttagacgatacagccgattccgacaatacgacttggtatacgtcatcgggttgagttgatatgcttcaagatgattgccatgcatagatagagtcctgagaaggcaattgtatctattaattagaataatttatgtaatttccttagagatatgtttgggtaaaagtctgccgcaaagacttatggtatcttagagtttgttagagataagagtcgtgtccgatatggacatattgtgtaattctcgggtataaatagaccccgagccccatgtaataaaattaacacacgttcaatacaatctcggcgcatcgccaccctttttgctttcgttttatttcgacgagttcttgctttcgggttgagctgcatcggtttcgatcttcaacaagaggtaaaacttgttatggcggcttgcgttctcgggattagtgcttccatctttatgatactctaattttgtttatgtaattcgtcgagttatcatatatcttatataatctatggcaatatcgtcatctaacctacaatcggctaacatctgctagtagagggcaaccgattaggttaaatatcgacgttggtttagattatatatgatatctaccactctataaaactttcaatggcttgattgtctagatatcgtccttcttttcatacttatagctgcatcagttgtttgatcttatgagtcgtgattagaatcttaatctctagcctgcttcttggttgccgattagggtagtatcggagtttcagccgatcttacctgatttacctaccttttatcttatgtgcttcgctgatatattgaatctatcctttatgttaagatcttgttgcatttaagtatattagtcttttgtttgatatattctatttgctttgatatcttagtatagagcggtatcggagtattagccgatacatgctagatctatctgatcagctatgctatgaacatatataatcttattattaatatatatttcgatctaagtgatttatactgtctcggcatggcgaccgacctatcccaatcacttgatttaagtatatatcgatataagaattatatatcgttaatatctacagccgatcgagtagatttagttctgttttatttattaatgcttgccgatcgatgcatatatgacatcggctcaaagataaatgatatgtcattggcacctagccgatcggctatcgtttatggatttaaccgcggtttctttgtctttgtttcttgttgattgcatgatcaaatcaaccggcacgctagcatacccgaaggcgagttttggacctgcactggagttaagcagatctcccaggcctcgtgtttttacatcaacatgaccctgggcggaaattgcaagagctataaccgcggaggcggagctgtggcgcctagcaaaggcgacagttttggcgcttggtctctagtttctagggtcgctaggtcgttcaatttggttgtgagattgtactcttaagtccctgttgcattctagtaccctgttctctttaatcttgtatctcttgtaaataacttttatttctcttaataaagatacacttctagtgtattcccaaaaaaaaatctagctgcattgggtcatgctttgctaccaaaataatattacttcccatgttttatattatacaagttattttgattttttttctaagtaaaacttatttaagtcatccaacactaaattagttttattaaatataacactaaatatatttttaataatattttcgttttatgataaaaatattttatatttcttcaataaatttgatcaaagagatttatcaagataaaacggaggaagtcattcaaactttatgctgttatacaaagtaataaacatggttgttgtggacacatacccaatcctagaacagggaaaggttcgtactgacaaacgcctaactacattgcactactatgataacgttggtatatacctcttcgatcgtgatgcctccaaactccaaagctagcagcttgccatgttcaccactctttcaaaaatacaccagaagacctcggtggtgaactattagaattctcgaagaaaagagttgagcatttgtcgatataactttttttttcaccgggccgtatttttataactttttttcaccggtccagtaaaagcggacgaaaattcattaagatggaaggaataaaagggtaacaaagcaacatgcagggctgttgaagaaaacacagtaaacacttctcctgacactagaagggaacttaaaaaatatggagggagtatatatttacaccgtcatcctcatcaacctagcttcgccaattccttaactatttcataatcctatcaacgtcggcctacaacggataactcctcggcaccactgctaccaacttcaataacctaatttagaaagcctggacaccacgtaagtgcaaaacttcaccgggatgataatccaaaatagagtttggacctccgacaggttggtgattagcaaattatattttaggacggaggaagtattaaagaggttaaaaaaagacacactctataaaatcttttaagttagagcattgctcccatccagcaggtaccacggtaccagcaggtaccaaatctcagccattcattcagctcgattggacgatggaaattatctgatatctgcaggtacaaatttgtccatgaagcggtggggtctgcatctagtgggtggtggcggcggctccgcttcccgtcccggcggcggcagcggctccatttcccgtccgcaacggcggcccattgcagcggcatctccccatgcccgccgcaacggcggctgctccggttctcgtcgcggcggcggcccatcgcagcggtgtctcccctgcccattgcagcggcggctgctccgcttctcggcgcggtggcggcccatcacagcggcggctcccctgcccatcgcagcggcggtggttccgcttcccgtcgtcgcagcggctcatcgcagcggcgtctccccttcccgtcactgttgtggagcaccttcatcccgttcccgtcgcagctgcggctccacatccgctcagcaacaacgaactccccggtgacagaattcccgagctctggccccaacccattgccgaggagcatccatatatccttgaggaagtcaagtcacggtaccagcgagcagagcgccttctttcctgcctgaatcaattgatgcaatgtcattatctggtttgctagagctgaagcatgcatgaaggcaaagaaccaccatctgcttctgctcttgacattgcatgcggggcgagcgcgccgtgaggtattctccagtactgtggccaccgacagtagatgatggggatcaaatcggccggcgggaaaactgctccgtttctgcgctcgtagggaggaacagatgagaaagaagcgatgcggggagggaggaaagaaagagcgcagggaggaaagcggcggcgcgactccggaattgttccgcttctcttgctctttctgtttccaatcgtatcctttcaagatggatggccagatttgatcttctacctcccgatactagttacctgccggtacatgctgccagacgagagtaaatctctttaagttaaatgagaatttatactggataagacaaacaagctaccagtatctccagtgatcatccaagctccatacctgcatagaacccacatccgttcagacacggcacgcataaaaaacgtacgtgcacgcattctgccatgggcgagcatcgggcgttcactttgttgcaggttttgctgctttccttttcagttacatccggtaaatcatgacaaacgcatgtattagccatttcagttatccggtaaatcatgtgttcaacaataaattagcaaagcacacgtttcatgatcaagatggcttaataatatactactactattgcttccaaacttagattttctcagccacccaaaacagcatctgataatattccgttcacccatcaaaggttcaaaagcccgtaaccacatccctgtcagatgcacctagaaggctgacgtgtccactgccaacttcacaaaaccgtgacaacccctttcatcacaaatcgatataggcactgttcttttttttttattttttaattaagatacaaattttatctttattttcgttaaaacatttttcataccgttaacgatgtattttgtacgaaaactttctgtatataaattcttttaaactataagataaatctaatttttagatttgtaataattaaaatttaattaattatgttaatggtttcttattttcccgtatcttataactttattaaaaacgaaacactacctatagaaggagaaaaaacagagacaccacacacacaaagtgcaaaaattcctgcatcacgcagcaaaatgccaaccccagcctacctatttctttctttcttcttcccaccttcaccaccaccaccaccgcacacggcgggctccttcttcttttcggcaaccaccggcgacgatgtcgtccacgccacatgccaggtgcacgcacgcacgcacgacagcaagagagagagcggcaagaaacaccatggcatatctccgaggatatgccctaatccaaagtcttcctaattgttattaaaatcctaatgacgtgcaattatgctctcctctcccaggtcgtctcctcctccgggctcagcccaggctggccaccgatgatgatggcgacggccgcgatggcggcgagctcgtgcgatcgaggcgacacgcgtaagaagctgcagataactgtagttttcctcgtccgcacgctactgctcgcgtgtataatagcccgcggggtgctcgcgctgatacgggttgcgttccgcgtcgccgtggttgctccggcgagaagcctcgtcgccgtcgcgggcgccgccttctccgccgtgaacgcgcggtgcgcgtggtgcctggaacaggcggcgctcgggcggagctgcacggggacggtcctcggcgacgcggtggtgggcgccatggcgagctcgtggaggctgctgctgcaggggatcacgtcgctggtgttcctgtgcgcgcgtggcgccgacgagtacgtccggccgccaccgagcccgctggtgctcacggcgcacggcaagccggcgtcgcatcctcagcaggtgcgggttcatctctgggtgttgcagacttgcagtgtgcagagtctgacagagtttggcacttggagttttcttgttctgaatgcttcattgcttttcccgtcttttttcaataaaaagttcatccatgatccatcccaagattgatcagtggcaaacgaattctgtttgtctcatgatttcatcatcattctttgcagagttcttttatgcttgaactctgcttcttttttttttcttcagaatcagaggcaaagagtgtcctttgtttacagtaacatattttcaaactttcataatcagacacaaatacaaattgacacctaatacagtagtacagaagatttaattccacgtttcctatcaacctgtcaacgttacaatgtgaagtacagacaacaaaattacattgcagtatgacatagtagctgggagctttacataagttttaatcaaagagaatttgcagctgaaattattatccagcataattctgattcctaatgtttcggtaataactttgacatggttgccaatgataatcaggtgcacatttcgatggtgggggagaagaacatgaggatttcatgggtgaccgacgacctgaacgcgccgtccgtggtggagtacgggacgtcgccggggaagtacacggcgtcggcgaccggcgaccacaccacgtaccgctacttcctctacaagtccggcgcgatccaccacgccaccatcggcccgctcgaggcgagcacgacgtaccactaccggtgcggcaaggccggcgacgagttcaccctcaggacgcctccggcgaggctgcctgtggagttcgtcgtggtcggcgacctcgggcagacgaagtggacggcgtcgacgctgtcccacatcggcggcggcggcggcgactacgacgtgctgctgctccccggcgacctgtcgtacgccgacacgcagcagccgctgtgggacacgttcgggcggctggtgcagccgctggcgagcgcgcggccgtggatggtgacggaggggaaccacgagatcgaggcgctgccggtggtggggatcgcgccgttcgcggcgtacaacgcgcggtggcggatgccgcgggaggagagcggctcgccgtcgaacctctactactcgttcaacgcggcgggcggcgcggcgcacgtggtgatgctgggatcctacgcggagttcgaggaagggtccccgcagcgggcgtggctggagcgggacctcgccggcgtcgaccggcggcggacgccgtggctgctggcgctggtgcacgcgccgtggtacaacacgaacgaggcgcaccagggcgagggcgagcggatgcgccgcgccatggagagcctcctctacgaggcccgcgtcgacgtcgtcttcgccggccacgtccacgcctacgagcgcttcgtaagtcttaacacttgcatgatgttaattaatggtgaagttgagctcttaatcatggtgattaatgatttaattagacgaggatctacgacaacgaggctgacagccggggcccaatgtacatcaccattggcgacgggggcaacagggaaggccttgctctcaagtaagcttcacgatctcatcatatgtcggaaaggggtttttggacacgaatgaaaaaactaatttcataactcgtctgaaaaccatgagacgaatttttgagcctaattaaccattattagcacatgtgggttactgtaatacttatggctaatcatggactaattaggctcaaaagattcgtctcgcgatttcccctctaaccatgtgttcaaagattcgatgtgatgtttttaggaaaaaaatttgggaactaactatgccttaactatttatatctgcgtagttgataacgttaattatatgtgtgattagcttagttaattgaactttgattaattaaatttgatgaaggttcatcaaggggcacaagtcggcgcacctgtcggagttcagggaggcgagcttcgggcacgggcggctgagggtcctgaacgagacgagcgccgtctggacgtggcaccgcaacgacgaccagttcgccaccgtccgcgacgaggtctggctgcacagcttggccgccggcgagccagctgctacagtagcctccgccgccggcggcggcggcggccatccggccgacgagctgtaggctatatatatctcacactgttaagaatgaatggaagaaaaggaaacttcaccacatttagcattgtcttttattttttttctttttcatcagccataaacattgtccatttgtccttgtaaatcaatcgtgatatcgtgtgtttcagctagtgtacagtgtttttcttgtgttagacacgtggtgaaatagaatttcagtgtacaaggccaacactgatgggctcatcttttcgcttatactatttatacttatcatccaaaatttgaagtttcagctttcaatttggagttgattttgggtcttttcatcaaagtttattttttagcttttgtttttatatcgctaagaacatgtgtataaaaaattatttataaattatgtttcatctgtaaatatgacatttcacataagcgaaatgatgggccgtgatactgtaattaccactgtgtattttgttttgtttgtgtaacttttctcctcatccgtccgatcgagaaagaacggtccagatccaaacacgtcacaatataccatcactgcggccgccggggcgcaccctctccggcttccgccgccgagcagggctgcgccgccgtcgtgctgcttccgccgcaatcccggtgtccggtgagcatccatccccgtttatgcgcatcctcttcctcatctctctctacccacgcatgcgcttttttccccctcgaattcgcgttaaaccctagcctctcttctagatctggaccccaatgtcgcaagtcagatccgcccctgagctggacagccgtcgccggaggcgggactctgacgacgagagcggcgagcgcgacctcgacacccggcgccaccgccgccggagccccagctcagagtcgtgttcgtcctccggcgatgatgaccgtagccgtcggcaccgccatgacgagagctccaggaggcggcagagagaccagagccaccgccgggacaggggtggtcatgatgagcggcgccggaggagccctcagaggaggaaggagccgactccgccgccgccgcttctaccggagatgataccagggcgcacaggagggatctacatcccgcctttccgcatggcgcagatgatgagggaggtggaggacaagtcgagcgccgagtaccagcgcctcagctgggacgcgctcaagaagagcatcaatggcctggtgaacaaggtgaatgctaccaacgtaaagaatattgtgccggagctgttcgccgagaacctggttcgtgggcgggggcttttctgccaatcgtgcatcaagtcgcagatggcttcacctggcttcaccgacgtgtttgctgcgctcgtcgccattgtgaataccaagttccctgagattggtcgcctgcttcttgttcgcgtcgtgcttcagctcaagagagcatataagcgaaacgacaaggtgaccttcctcaattctccttttcagcttgacatgtaaaatactgctattgcctcaagtacaactagtatcatttggaaaatacttggttaatttttcaccatgttagagtaatgcatgtttgtttacctatttgtcttgttgattgcagccacaactgcttgcagcaaccaagttcatagcacacttggttaaccaggcaggtcattgctcatgagctcgtggcactggagcttcttactgtactgcttgagaacccaactgatgatagtgttgaggtgcatatcttgtttcttatgtccttttatgttgatcatgtcttcatttatgcaatatctgaagcatatggatatgtttcttatctggtaggtagcggtgggttttgttaaagaatgtggggcaatgcttcaggacttgtctccacaagggcttcatggtaagtttttcagatcagctgttaccataagtgcttattatgacttttgagtgaatgacttgttaaaccttttgactagctcatctgtattcacgacatatttttggacttaggcggtttcatttcatctgtggaatattggatgtgtgaaccttagtgcaggtctagacccttttttttacactagtattatgtttagctttacctggatgatctggattttgtctgaaattcaatacactttctttgggatacaattttctggggatatctttttgttctatatttgtctgtctgcttaaactgtgatatttgaacacgttttctgtttctaaatgtagctttttatttgtttcaaagttaactaacatgaaccattggttatttgtttgatctccttatgacttctctatttttcttattttgttccattttcattctcaatggattcgccttcttaatctatacagctatttttgaaagatttcgaggcattcttcaggaaggtgaaatagacaagcgtgtgcagtttctgatcgaaggcctttttgcaattcgaaaggctaaatttcaggtaaattcatatttttcctaattctttaccttttctatgcattcctataacaaattctgacaatatgatatcatatctgtgaagggattccctgctatacgtccagagttggatcttgtggagcaggaagatcaatttactcatgagatatcccttgaggatgagctagaccctgagactaatctaagtagggttttatttcatatgcaaacatttttcagtttactatatttatgacataaaagcctcagttattttgaaatgttggtattttaatggaattttaaacaccagttcagttcccataggaatctggaaattttcttgcatttactatgtatcttaacacttccgtgttgtgttgcacttacctttaccaacctgcagatgttttcaggggaaatccaaattttgctgaagatgagaaggcatatgagaacctaaaaagaagcatccttggagcagaatcttctgatgatgaagaagggtctgatgattcttctgatgaggatgctgaagaagaatccgatgatgaagaggacgaagagcagatggagattagggatcaaactgagaccaatctcattaaccttcgaagaaccatttactcgacaatcatgtcaagtgttgattttgaagaagctggtcacaagcttctaaaaattaaacttgagcctggtcaagaggtaagtactgtaggttgactctttttctgtattataatattgtttttcaatttctatggtatttttaaatttccttatttttgtgttttattttgctttcttgtacacaacaccttctgtgagcattacggtttgttagaatctattttccaatctttcaattcatgaacaaactagaacaaatttttgtgataatgcacggaatgttgtgtctcaacagcgcagtcacttgccattcggatagttctggtgctggtttgtatatcaagaatattgtgcaccaagttattagattaacaaaaggcaccaatgggtagttattagttaatgcatctgttttacgaatggtctataattaccgttttctttattgtgctcctttcatgtgacttagcttcatgtgtacaagtagcgacttagactactgttatatgtactacatggtcatttgtcatgtatctttcaggttcagttactaaactgattaaaattatctgctagttttcacatattgcattgataaaacctaattggtagttcagttgctaaacttatttgttagttctttgaatttctgaagtcactgaaattgcacaagctattttgagcttctagaaatttttgaagtgaagcaaaattacttacctcattctagatcctattactgaacgacatgcaatacaaaaaatgatggtgaagaaacattcttatgctaagacaggcacatgttttgcacaacacaatactcgatttcaaacagtccctcttcaattcatataatctgattgatttctttggcccttcagttctgagtttgcaaaatatagtgatttttagcaaagctaactgtttatttcatttaacagatggaattgtgcatcatgctgcttgagtgctgcagccaagagagaacatacctgcgatattatggattgctagggcagcgattttgcatgattaacaaagtttaccaagataactttgagaaatgtttcgtgcaacaatattccatgatacatcgtctggaaacaaacaaactgagaaatgttgctaaattttttgcgcatttgttgggcaccgacgcgcttccttggcatgttttagcttacatccgtttgacagaggaggacaccacgtcatcttctagaattttcataaaaatactcttccaggtatgctgttaaaattatgccttttctttactacatatgtcgattcatctttaccaaagcaagcaattgaaggttttgtttcttgttatgcaggaattatcagagcatcttggtattcgtctactcaatgaaagactaaatgatcctaacatgcaagattctttcgattcgatcttcccaaaggatcatccgaagaataccaggttttccataaatttcttcacttccattggactgggtggtatcacagagactctgagagagtatttgaagaacatgccacggctaataatgcaaaaacagaagcctgcctcgtctgaatcagactcaagtgattcagggtctggttcagacagctacagctcagaatcggaatcaagttctgatgagagtgacaggaagcgaaacaagaggcggaagaagtaagaggtggaagaagattttcatgtaaattctaccatggttctgggattctcctgtatttttatctacgtgcagtatctgatctagctgttggtgcttactaaattgagaacccaatcatattaaccgagatattggttcctacttcctaccttcagatcatgtgagagaccgaagtatgttgttaatagtgcaacttcactatgttaattcatccttaacaaaatcagacaattgaagtattttttttcgtgctatgcaggagttatcagagcatattggtattggtccaactctaagagattggatgagcctaacatgcaagattacttcttttctatcttcccaagggatcatccaaagaacacaagtttttctacaaatttcttcacttcaattggtcttggttgtatcactatgaccatgagcgagattacctgaagagcattcctcgccatctaatgcaacagaaacctgcctcatgtattggtatccatgtgttctgatcctaactgttttgtttttgttggatctccatgtgcaatataatcagatcttagatgctgttcagagggcttgttgaattcaggacccaatcataattagaatccccaaatagggttttataagatatcagcagagtaccagctggtaggaacgtattcatgtgcaataattaatggtgaatcctttgctcagttgaactttttcatccaaattcaaagtggttcatttgggactggagattggaaggggagaaaagcggccgggcgaaagcgatttatgcaagttgaaagtattccttgtcaaattggggggaaaactgcaatatttcctgaattgcaagttgaatatattggtttgaaatggtccccacaaattgaatgaaaaaggtcaattgaaggttgaggatgagacgtggaaattaattacttcctccgttttatattataagactctcttgtattgtccatattcatatatatatatgttaatgaatctagacacagatgtgtacctagattcattaacatctatatgaatacgggcaatgctagaaagtcttataatctaaaacggagggagtaagctggaaggggcagcagtggtgaagatggctgatggaaggtgatgggggcaattacatagtctgcatcatagacatcacacacccatgtttcttacattttgtaacgtcatccatgttgctgtgaacaaatatatacactacagaaaaacctaaatatcctagaaaacattaaaaaggaccaaatgtataatctttaaatggaaaaagggcaaagatacataacaacaagttgaaaatcttgtcgcccaatcacttttgtgtgaaggcaataataatataatgttgctttacagcaaaagcaatgtgcttttgtgtttattagctgcaggtggtttttatcattgaccaaacgctacaaacaaaagcataataaccataggttgaatatataatcaatcctggccaaaacaatcggattaatctgccttttgggcggtcggcacttgctaaacaatggaaatcatcaacaaaagcactcaaacaggacagtgacatgctctaattatatttgaagctggacctcacgaatcatgctgctcttggccaataaaaccaacagattaattaggaagataaacagggagcagttactggattaggagacactttgttgaggtgcaggtgcagaagaggaggagacaaggtgaacatggaggagaaggtaggaggagatgtgagggttctgaagccactgatgcacctgctgcttggactggtcatgtactgggtcgccgaggagatgacggtgcctgtgctcgtcgacgtcaccacccgagcactctgccccggcgccgacatcgcctgcccggaggccatctacctcaccggcctccatcaaacggtcagctctcatttgatcatctccctcttatgcagtggtgtccctcctttcctgtaagacattattgttgttcagtgatatacatcgtagctatgcagaggtcgggagtattatcggaacaattgtaccaccttggtgtaattaactgagttcgctaaagttttcattatctgaaaaatgaaatcacatgatgatgcctaaattcagtttctttcttttgctagtttcagaagaaactttgactcgatgcattagggattatattactactggttgccaatgcttatgctatatgattgatgcataacattttcattgatgaaaatggagttgaccattttcttgattttatctgaaagaatcagtctgcaagtgacaactgaaagtgaacaattgattggaaactcttgtgttaatgcaggtgggagggattttcagggctgtaggatacactttgatggggcagctagctgatgaatatggccggaagcctctcctcctactcactgcctcaacttccatcatcccttatggtagctatacctgttctatcttattttggaagcttatatcagttaagtgttagtctctctgcttgcaggaatttgacattagaatgtcaaggttttcatgagtttcacaggatattaatcatatgtctttaattggtgtcatattgtttattcctgcaggtgttcttgcctgcaacaaatccaagattgctgtgtatatcttccttattctgcgtactttgtcattcatgataggccaaggaaccataaccagcctcgcagtgacatacacggtgagagcaatcacagatgctaactcttggtttcactttatccaagtcgtataattctctccttgagcctggaaacttaaaccaaattggacaaacggcaaattgacagcgtttcttgttattgcatagctatgcacaatgcggtttgagaacaagtagtcatgcacgttgcatgctggacagttaaaattcccttttctgctaatttaattaggccgatgtggttgatccatcaaagagagcatttgcatttggctgcataactgggatactatctgcttcgcatgctctgggcaatggcttctctaggtttctgcccgagcggtggattttccaggtattatatcatgaagatttcttacagttcatcaacaatgttatttttcaatttttatgctaattaatgtcattcttacaagtatgaaaccacgcattatcaggtctcggttgctttgttgatctcttctgtcatctacatgaaaatatctctggttgagacacttcaaagagcttcttctggttcgtttgagcatatgtcgttctcatctttggttgtcaggttaccactgcggcgctgggagtctatcaaggagaatattaacataatcaggagaaggtaatgttcctcaccagactcctttatggtctaagtaatttaatggtgtaacgattcatgtcaaagcacaaagaaaattaataagtatcggattcacggataataattctggaaaagaaagcctgatgagacttctgtatttacacttgaccaacatttgaaaattgcaaatgcaaattttgttgatgtcaagagatacctactaatgcaaattttgatcttctctatcttcatgttttgttagtgaaacacttagcagaatcacatacatttccttcttctacgagttgggcatgatcggcattagtgatgtcctaatggtaaccatatgctcagatttattttacgacattgcgttcaaaagagtactggttatttcattcttcgcccctttatttgcagtactatctgaagtcagtatttggttttgacaagaaccagttctctgaaattcttatggtagtaggcattggttcaatcttttcgcaggtagtacttagtctataataacctttgcttgatgttatattcgaaaaaacaatcatcctttaagtgccttgcctgattaacaaaaaaaaattgtaaaattgtagattttggtactccctgttattatcaatacagttggtgagaagggagtcctatgcgttgggatacttgcatctgttgcctacgtgagtgtatcacatctctttttgctaatatttttgttatcacttttactgatatcagatgcagaactaaaacctttttttttcctctaggctgtcctgtatggtttggcatggagttactgggtatgtatttgggcgcatagttcagtaataaattttaagtccaaaaaatgctgcagtgactaatgtcgttactgaacatttttgtttgttttgtttgacactgattatgcaggttccttatcttacttcctcattgggtgtcatctatgttctggtcaaaccagctgtaagtgatcaccatgtctatatacctgtaacttttaagatctgtgatatatgagatatctgagtatattaactacaaaataaaacgccaaatgtacaatgtttgcatcattaaaatcaggaatcatgttttgtgttttgtgtgcatttaagtaacaattatacacttgaaaaatctttgaatacacttcaaaattgttgaacatgtgcagacttatgcaatcatctctggggaagtggactcatctgaccaggtaaactcaggaagggaaaaaaatatttcttgatttgtaaatccaatcttgatatcccttagctttatttactcagttactgatcaaagtttggcataaaattgactttacttttgcagggaaaggcacaaggattcatttcaactgtgaaatccacagctgtactgttggcaccattgttcatgagccccctgacctgtaaacaagcaatttttttttgtttcatcttacaaatgttgcattgccatgtcgccaactccatgtagtattctgaatgtttgatttctcccttttctgcaactctgtttcagcttacttcatttcagaacaagcccccttcaactgcaaaggtttcagtttcctcgttgccggtttcttcttggtcagtcctattaattcttccatgtgtgttcatgaatctaaatagtgcctataactgcatgacttgactgaatacttctgcaggcaatatctttgggcatttctttcatgcttaagccagaagccaaatgcacaagagttgcagttccagatcagcttgatcatgaagcagtgcaagcaccactattagctcaaccatgaacaaattggcaaggaactgaactttgtacctgtacataccattctacctggcaaacatctgaagtttgaagattgcattggttgtaacgccacaatcttgaaactcatgttgccaaagctgatattgggtttatagcaaagatattaattgtacatatagcggatgttaatgttatgtctagtactaattagttacgttttagattcaatagtagccaagtgaagtttgtgtaagaaggtaaagttgcaggtaactttatctccgacttaagttaggtgactttaatatcactggcatatgggtccacagcaatggcacggtattacaaaagtgtgcctgcactttatagttgcaactgactgaaccaaggctgttctcgtgaaattaatatatatagcacttgataatataagtacattttatgagacaatattgagtttttcagttgaagtgattatctgaacttgtcacttcatacaatactagaactctaaaaccgaaatatataaaaaaacgagatttggcgggagaaatgtccctccaaacatttttaaagaaagaattatgaaagtgccggggattgaacacgagaccttggggttgaaatcacacacctcttaccattgcacgatcaatattcagttttgaaacaggtgagctgttcatagtgttcgtatggctattatccactgcctgtttcgtcagtcgcaactcggtcatcgcttacgcaagtttgatgcttcaacaaacagttttatatcggcatctttctccgacagataatcaagtcactgatggagctagagagacatgatagggaagcaagtcaatatttaaacacaatagtcgacaacttgttgctcataacgtgcgcaagcgcaatcgtcttgattatgtattattggtggtcacaagaatgggaagaaattttggggccaacatgtggcacacaaacagttcgacataaatggattggagaacatcaactctgaacacgcccaaagaaagtgacattttatataggcctaatttaaaatagattattcatcaaattattatcacgaaaaatatacttgattatatggatgaattaattattttaagaaataaacttaacaaatatctcagaacaaatggtctaagcaatgaattagataaaagtatcttaaaaaataattttagaggtatggagtcccataaaaaccctacctagaattgggatgtaattaatcccatacaacgaatctggacaggagcaatctaaatttgttgtactagattatatttcatcacacttctaggttagtttttttagacggagggagcatgtgacaataatctggcgaagaaggttcatgacgtgagtgcttactgaaacacagaatagttgctcaggattcctttttcttttgtgtccatttcgcatgaggagaaagcaaagacggatagacgattgcttgatatggttgcagcacctgtgatttggtcgggaagaaagcaaagatggccactgtttcgcaactctctgaactactgcagatatatcttgtctgtttgtttgtactactcgtaaccattatggcattctccttctttctttttttacatcagaaaatctgctgcaatgcaaatctgcaattctgcatcctttcttctcatcataacgcagacaagatctggcctacaaaatgtgcttgtgcttgtactgtaactacaattcggccagacagcctgaaactgccgcacttactcataccctgttcaactgctggctcaattgcttttttttttcttcaagaccatttgtagtataagtgaagtgtccatattttctcgcaaccttaaacttttaggttaaattagtccgtgaatgcaactcaatatgatatcacaaataaatgtctcaaatttgaaacctaactagcacgcaactaaataaaaaattacggtctatttctattatacacttgagatttgaggagtacttgtaaattgtctgttttttctgataagtttaaggtgccataccatttttttttaaattgtcaaagatgctatccatttagtttttttaccaaacttgatcaatacaaaagaaatcctgtccaaacctggcaatattaccaaattgctaaaattttagtgctaaaatttgataagttttattttggctgcaatctgaattgcatataagctcttagagcaggtacaatagcaagctataagctagctgcaaacatattttaaggagataaataaggagagagagaagagcagcgggctacagatttgtagccagctgtagcacggactccaggacgcagtgtgtgtatgacaggtgggaccaagtattaatagtatagtatgtaactattatatggatgagctattagattggctatagatgaattggagctagtagttggctatactattaaacttgctctaatatctagcactagtgctgctatggcatgtctgcatccactagtttatccatgcatgtgtaaaaattgatgaacagcagaacaagttggtcacagtttcagagtaaaagtagtaaaagaggccatcatcattcatctgctgggggcagtagtccaaatgaacagaacaggcagtgacacacactgactttctgctcatcttttgagtagagatcaaaagagatcatccatgatccatccatccattcacgcatgcgtagcacaattgcaaatgaaaaacgccgttttttcaacttgtttaagagcaaagctgcaacaatctgatttctactggtatttcaagctccattattgcttgtgcaggtgtgctgaattcttcttgcgggcacacaaattcatggccattggagcatgtgctcgtgatctctcctttttctctttatgcgatgcagattgtacttatcgttttttaggtcaagattggaggtgagggatcaggggatatgctgcactgcacgagttgtgatgtgatgggatgattgagcaccagccatgttggtcgattgattcttggggttagtagttttctaaagctttggtagcatcataccatatgtgttgatgcatgttgcttacactggagtgcaatttggggacagtgtatcatgaaaaatctgaagatacaccttcgtggatctgtggatgcatgaatcagcacatccaaaactattcacaaatagtagcggtgtacatcgtattagatatagaagttgggttttaatttattattagaaaatatgcacaaatacaattgtgtgcatttctagctgtcggcctgccgctataggcggtaagtattacttctataatattaaaacttttacttccctgaactctttagtctatcatttttttctcttaagtaaaagttttctcactttgatcaagtcacaaaacaataattaacatcaggagagaaacaaccgggatttcaacctgcaagagtggccctgagtcgatgtagcgaaagctatggctacagaggcggagttatggcgcctggcaaaggtggcaattaataccggcacttggtctctagtttcatgagtctctaggtcgtcccaatcggttgtgagattgtagcttaaattcttttttccgctccggtatcctatccccttttcaaattttatgtttgatttgtaaataacttttattcctcttaatataatgatacgctccttgcgtattccaaaaacaataattaacatctacaataccaaatgaacacactatcgaaactaacttgaaactaatacccgattttaaagttaaaagtacgaaaggtatactagctaattaaagaattcagggatagacattagtagaattattttcgtagtacgaagaaagtacatatccgttttgattctccccgtacacatttgcaacgtgctgtttgtattcctaaatagagaataagagcaagtttaatagtatagccaactactaactctaaatcatctatagccaatagaagagccaatttatacaatagttgcttactgtactattaatacctggccctacctgtcatatacacagtacgtcttgaagtccgtgctatagttggctacaaatctgtagtctattactcttctatctctttatttatctctttaaaatatgtttatggctggtttatagcatgctattgtactgctctaatagtagtactaatcaaggagatgtatgtggtacaaactgaagaagaagatatggataatagtatatatgagtacgacagtcacacttgactctctttacatgattaacaagaagagccgtaccgtaccacagctttctactactagcttaattagcgaagataattattaaccgggggctcatcttttgcgaaatctgtcgacgaccgagttggccgacagcgacatgtgcagagagacaaaccgatcgaagaatatccgtcgaccatcgatgagtttggttttcagaaaaattcagagaaagaaacagtgaacgaaacatgcacgattgatctactagaacatagtagtacaagaacaaattaaattaagttaatgtaaacacgtgcatttgtgtggtttaggttaggttcgttttggtttttgcggcgccgcacggccggacgaattttgaccttgcactgacgaaagttcaggttaagttggtacgcatatgcagctagtgagctcctagtgatattgatgatgatgatgattcagagatatatatatatatatatatatatatatatatccacccgtttttggcgccaaacacgcagatgcaggcgcgaataagttggtgggttagctctcactggaggtaggccggcgccggcgccggcggggacgagaattaatccggccgccgttgacgtagacgggtcaatgttattttatcttacgataatgaaaactttactgaactgagccagttactccctccttcccggaatgtttgacgccgttcgtcttattctaaaaattttgtgaaatgtgtaaaattatatatatacataaaagtatatttaataataaatcaaatgataggaaaataattaataattacttaattttttttgaataagatgaacggtcaaatatttttaaaaaagtcaacagcgtcaaatattttggaatagagggagtacatcgagatgaaataatcgtacttacaatactttcgacctttgtatggttaagatgcatagatagataaaaacacacattcgctctagtttagttttgaaacgaaagaaaacataatatacagcaagaattaaggtccatcaatcccataactaagatcactacccatgttcgcaaaacgattcctggccatggcgttccaataatgtcaggccatgccctgagatttgtgtactaatttgggtagtatatatatgtatacccactttgccactgaatttacttttagttatttacgtttttttaccttcaatgtactctacggaaaaacacataaattgaacatagcaaattaaaatttaaaagttttttcttgaaattgttcatttggaaatttttgaaaagctaattataggttattctatccatcggaacaatagggccgttatacttattatttttgaattgctctattaataaactttagttacccaacgtactctctccatctaaaaattaggtgatttatagagtttgaagtttgtcttgaaaaaataagttgatttttatactattggtttagtttacctggccatatatatatatatatatatatatatatatatatatatatatatatatatatattgatgccgtgatgcgattaaacttttggtaactaacctcactctatatatgcatgcatcattatccaaaaaaatatatgcatgcatatcatttgcatagtcaaggaccacacaattagtagctagcatgccttgaaaggccagtgtgattattcaaaacatgccatttccactgaactataatctgctagtgatttgtttcagctaatctgtgcaattgattccggctttttgtgcaagaagttcccacgtacaacacatggattgattaattaaccaagcaaggaggccgataattagaacaatagaatcaatcaatttgattaaagagaaaacatatgcatgtgaccgcaaataaacagtctgcttaacaatcctccgccagggattttacctttccgttctcaaaataaaaaccgctccaaccagtttacaaaaaaccaagtgaaaaccaatataacctgcagataacttttagtcaacttcgtatgaaaattaactaaaacggaccgatttataaattgaccaccgtcggtttcaaaaagacagattgattttgttgattttgtatgcatgtatatatatttatatttatatgagatcttcgcggtgtcaacaagtttgccataattcaattaattgacagatgatactctacaaatagatcagtactttttatttttagataatggaaaatcccggtcttttcaattaaaactataggcagttattataatgtttgtagcagatagcaaggccacgataatcgaaaacaccaactatagatagatagagacaacattcattcatgaatctgtcctattagtgaaccttcacccatcattatttattttattagaaaagatatacattgacattgttgtacataaatttatttctctgccattctagaatctagaacgattctggaagattcagactattaaagtctaagaaactcactataaaagtcagaaacttttctagagatgtttcttaattaacatcaacatgcatgaaaacatacatgtggtatcttgggactgttctttttgagagggaaatcttggaactattctaacaacccatttggttggccctcatgtcaaaacaatatgtttatgggaatttcaagcaaactgtccaataaagtatatggctcatttgattaatttattgtaggggagcctggcattgaactttgtttctgagtaaagataatatattatatagtaaaagttgtggcgtacgtgcaatttacaactataccaataaaaaaacataaacatgcagaaattctcacaatgagtaaaacaaaactgccctgtggcatatatgtacccatattctaatttacaactgccaaactctaattgacttagattctacggctaactcttacagatattttattttgaaatagaattccgctcagaaatcctgtcccacatagggaagaaattttctagacataaaaagtatcctttgtggcatatatatactccatctgatcataaatgttttaacttttaggataaaattcagtcaactttgttttttttagaaaattcagtcaaacataactttgactatcaataacttagttatagttataattatgttggatagagggaacaggttgctagcttgtaactctgatatgttataattatgttggataaagaggagcatccataatcaatgcttcagagatataggctttggctgaacctcgttaacaaatatcatgccttgatattatcgtctgtttttttttgaaggaaaggcaagaagattgccttatatattgatagagtagggaagcaaagttatatataagtcatgggagttatggtcgtcctagaccagtcagaacactccattctcgtaaagggtacatctcacttaggtttttttttgcccccgcaactgcccattggagagcttcctcctttattctcaagaggatgaggaatggggtgccggccaattttcctgaagatacacgagttccattctttccataatcctagaagaccaaaatgaccattaacttgagctgttctcgcgaagtgttatcatcatcagttttggatctcctatgacattcacaaatatcgatctatgtattatcggtaccggttttataacactatttaatttctcttacttctccatttccctctctcttagagatcttataaagttatctcttacatactgtgtaccttcttcttatcctcttatattttttccctacaagcatatacaaaaatatctatgtactctaatagtcaaactatcggtagatacaatatgcaacatataattaagcacaactgcattaagtctagatacccttttttttcagattgggcggtgatgccatcttaaggggaactactactaatgataagaatcgaagagtttctaataattaattgagtcgccgacatgcatggtgccctcgtgccctagacaaagtgcgcatggcgccgagccgaccggccgatggaccatttgctgttgcctgtcaatggccacagaatattgcccaacatatcgataagtgctgtacacagtaagccaacattgcacatacccacttcctctcatggttctatattcagattaaataaaaattaagaggtgtttcttttcgagaattacatagtacaacacagacactcacaacacacgcacgcaaaccccacaggtgcctcgttgttgagtacgtcgcctatcactgaaagcacaatgtcgtcaaaccactaggttacagccctttcgctcctttcattttttttaatatatgacacatttaattttatcgtgatgtttagctattcgtcttattaaaaaaatatataattattatttttgttacttattttatcattaaaaaaactactgtaacctattctttttacatatttatactatatttttaaattagataaattgtaaaacgttataaaaagtcaacatcatatataaaaaaacggaggtacataagtatatacttaattacggtgggtacaatccgaaatacaaacttataaaattcacatgtatatacacgaacttgtatactgcatagtaaccatgataaaatagtacactataactaatcttgctaaagtaaacagtgatttggacaccgtgcgcacatctaaggtgagcatgcatggttcgtttaccgtcagcgcaacatactcagaatttttaaaagcaatagtaaattagagggagaaaattttgaaacagacatattttaacctgatttgaacaattcctattatattcaaactaattcaaaattgccaaccaaaaatttcggcatcaatttcggtccgaaaattgtggacatcgccgccgcccaataatcggcctccatccggagcgaaatgacgaggggagagagagagagaggccccggtagctagcgaacagcgcggggggggtgtcgctagctaagctatcaaacagcagggcaaaacgtgcgggaaacttgggcggtagctcgcggcggcgacaaccgcggcgtgtgcgcggcagctgcgctgctacatgcgtgtagctaggcaagctgtccgtcctggactaggaaaggtagcggcaagcacggtggagcccctccctccggcgagacgcggtggtcggctgcgggaacaggacaaggacggacaggcaggggccaaggggaagggaaagatcggtttatactgcttcatccgtacctaaatacttgacttcgttaaccttttttaaatatttttaaccgttcgtttcattgaaaaacttttgtcaaatatgtaaaactatatgtatacataaaagtatatttaacaataaattaaatgatagaaaaagaattaataattacttaattttttaataatacgaacggtaaaaaatgtttaaaaaagttaacgacgtcaaatatttagggacggagggagtactattttgtatttttccctccattttgaaaagcaattttttaacaaaataagtgaggctcaattctttttattattactagcaaaatgctcgtgtgttgctataggaaaatatacatcaaatcctagttaattagagaaagagaaaggtgaataatactacagtaaagtaagtgagagaaccagagagactcaagattagtaactacaccacatttagctacttacgtcaaactacgcatgtaatattaaaagtcaaattaatatcgataattgatccgaaacgagaattagagctattgattttcttttttaaaattatagatctctgacatatgttagatctggaattcagacttgacactatttatttagacgatatagagagctagtcggatttggttgaaccaatctaaatatgaataaatacatgaaaactctctttcgcctcaagtttctcatggacgacacgtatttcttttcggatggtctttttttttttgcccttttttagagtcggacttttatttttttttccttttttatttcaggggaaactattggcgttggatgacagaaacactacagatcttttaaatatgtaaatatttattagattattgaaatggattatttacctcacgctttgaaaaaatatattttctcaaagaaatatttatttcctactattgtattacttaaaccacttgtttaaattatttggaaaatttatttctcaaaatatttgatgtatccttataatcaaacagataatctacggtaccaatctgcttaataacttgttttaaattgaggcaagtccagaaataagtgacttataatttctaccgaagtttccatgtaaacatattgttcctaacttaaatccaaggaagacaggcggagactttaactcaggatgtacacatactttgctaggcaatttccatccaaaatcttagacaaaaacggtctgactttgaggaattatcatgtgattcgattattcaaagaagttgggtatattgttcaaggatgtcaggaccatcccttttcttttgacaaatgaaaaagtagctagctcagcccataagctgtttaggacttctttgaagcacatgatttttatttgttttaagaaacacaatataatcgtaggcgctcgatcataacgtgagcacacccaccctatgaacgccttacccctataagcacattcgacagatccgactgacatatcttaagattaacgaagttattatgggcgtctcactgtcgacgggtacaacactgagctacgcttacttagcaaacacatgatttttaaaatgcagaaatagaaaaaaaaacacatgaattgattgtcacatgctatgcaatactacatgattacaaaatagaggaacaccacagataatgccttttgatggttcacaggaattgaaacacaagaattttgcaagaaaccatatgtggaagagagatagagagaatgtgcattgaactagcaaaggaaaataaaatataagacgtgagatcatgttaaatttcctaatagaatttgcattccataggaatttttaaatcctatttctttgatcgaaagggtgttatatagaaattctttcctaaaggattaattataaccctccaaaattcctttgattttcattcaagaacttagcttagtccaggaatggttgccttgtcacttatgctgaagttttatgtaaacatattgttcctaacttaaaacacaaatgaggagacttgagtgaggatgtacttaaacataccttgctaggcaatttccatgcaaaatcttagcaaaacggttttgagtccaaggaattatcatgtgatttcactctgtgagtgagtctctgagtatgatcaactacttaggggtatgactcaaccacagagcttcgtgttgatacctcaacttctttcccgttggtttcacatcgccatcgcttctcaggcatgggctaaatgaaccgagggctcaacgacggcgacctaaactgtgaggtgtaatactctactcccggtttcatcgtcatgggatttttgtttttcataaaagtttctttcaaaagggctaaaatgaaattacaatgtcacaatcagcacacttgcaccactgttgccggacagtgcgctgcaccggaggaggctgatggcgatgccgtcgctgataacttgtgaccttgatgtgtacatgtcggccctcgagtctaattgaccggcagctaagcttgttggctactagtagtagtagtactggtgctttctcctttatctcatgcttacttacaacctaattattagatggctaaaagctgattatatgctaaaacgatttattaacaaataaaaaatattgttttagtagaatttttatatgtgtgtgtttttagcggcttagatggtaatgctgaaaaagaaaccacgttaaaaatactgtagaattataatttcaaaattaagatttaaaatttaagttttgaacagcgactgattctttatatatagagcaaatgatgaggttctgaagcattgacatgtattgtcattaggacaccagagcgcattagtttggtattagctcagctgtaacaagttttgttgttttgcacaattgcacttaggcttgtacagctaccatgcatgcatggtaccacactacctgtcagatatgtgctaaaaacataaatatgccacgcataaagctagctcctccaacatcagtatatatgatatgaaattacagatcaatgacaaattggtcatgcattatcgatcggtagtcagttcagtcagttatgcttttgtgtggttcagaatagagtttggtgtgagtctatccaccctacatcttgcaagttgcaagtgggcttagatttgtggtgtaaagatggtccatggtagtatagtatatatctttagttctggatttctcccttttgttttttaaggaaactgtctattatgttaagttcgttgtgcttgagaaaaatgcatatacaattaaatttagagtaaaatacatggccggttcttaaacttgtggtgtggtgtcacttaggtccgtgaacttgaaaattgcacgattagatccgtaaacttgattaaatgtaccacccccggtccaatcgtcatttgactacgtttgaccgccaacgtggcatgccacgtaggcaacacttttgttctcaaccccttccacatataccttcacacataacttgccctgaccagtgcgcatttcaatccaaatccctcaaaatatccctaaatcggctagggtttcgacggtgagtttagcggaaggaggtcgagaggtagcggctgtggcggcctcggcggtgagattagcggtaggaggcagtgcagtgcagcgggaagctgcgcaattcggcttgcacgctaggcatccccatggattgtctaagctcgtccttgtcttgaagtcgccggaagaaggtgttgttgatcaagtgccagttgcgtaaggataagatcattttagagtgcagagcaatgtcaattgctaatcgggactgcattttctatacatgcaaggagaagaatgagagagaagaacaatttgaaaattatttttgggggattctggtgtctctatatagctacaaggagatatatgcgacatgttgtgatgtagaggaggctgggagtaaaattgttgcctgcgtggcatgccacgttggcggtcaaacgcagtcaaaggatatttggaccaggatggtacggggatcttaaagtcgagttcacggatctaaacgtgcaattttcaagtttacagacctaagtgacaccaccacacaagtttaggggccggccatatattttactcttaaatttatatggagataaataaagaaatttaattatatgctgcattagctgtttgcacatgtgaatatattttacatgcaaaactttgatcttttttcaaaaaatatattatgaaacgaaaattcgttcgataagtctatatatgtttgatgtttcattacctttaatgctactagttacctcttacctgcggtacattgcaacgggacataatccgataaacttggtttaatttttctcttctcccgtatttttctctcggttgatcaattgtctggtacagcagttttttagagcggctttttatatgtgggattagggtggaattccacctatatgaggttgccactaaccatttcttaattcacgatcactttatttgtaattaatctagaaaatcctaaaatgcaacaagcttatgaattttctccaaagcttgatggaattaatatagctagctcgctaccaattgaactattgaaggacggcgagccatctgattcactctagagacatacctatctaccagctcacagagatctcgacaactcctcaaatatatgctttctcatctaattcaggccatctattaattggccacttgagagagacgacatagctagctagtatctcacatgatctcaagtctcaacaacaactggaatatgctttgtgagctactccctctgttctatattataggtgtatttggagagctttagattcgaagaaacaattgatgggaatcctgttagtaagaatttgaagaagaaaaaaaatcagtttcaggtttctaatttattttcataatcctacaactataacattttagaatctgaaaaaaaaacctatattgtttggatgagcttttaattttagaggaagttacagctatcaaaagcttccccaaacaggtgatataagatttttaagtttatcataagtatttttttttgaagtttgatcaaaatttatagaaaaatatagcaacatatgtagctccaaatataattcattaatctatcgttgcataattttttaagtatatttgttttgtgttgaagatatgttacaacattcttctatatataaactgatcaaacttcaataaatttaacttagaacagccattgtcacttgttttctctcgtcgagtgacgtctagctaaggtccgagaaacaagaaacgagtgagtgtaccatgtatgtgcccatgccatgagttgttggaaagagtctcacaaaaaagacaaggaactttacctagtcatatgccaaataatcacaaaagatgtctctagtgtccagttgaacataaatagctagccctactggataaaggggatatgatcctgcacattggattgcaacaatccatgtggcggttttgttcttccggtgatctctgcaaaaaaacaataatgccaacggtgtcgaacgacagtgaaaccattgtgcttatgagatctctcccgtttccaagcccatggtttggagtagcctccaaccaacaggaatgtgacttgttggtgtacgtatgcaatatatgtgtgcaacaatccatgaaaaattttgtatgtatatatgctgatgcaatgatagattgatatggtacaagtgtccacatgcatccatgaaaatttttgtatgtatatatgctgatgcaaggaccgaatccaggctaatgatggtgatgatggaggtaatcacgcaactaggctatcaactagctatttaatctctgtctcatctgggattgattagaaaaagggaaggatgatatatttgttattgtttatagaatttagggcgtgatctagcttaatgattgatatggacagaaaaaaatgatcgtatgaatagattaaatattgtagaactaattgatagcttgaaaaacgttatgtaagtaatgttgatgtaggaagtttttagagataactttattcatttatttttttaaatgaacagcacaaaaggtaactttagaaacttggcacgaatagcccataccttcattttaactatttagaactcgcctagcagtaagactaggagcaggtatggtgtttttgttgtagtcttgtcattttgatgaactaatttgatgacgccaataggccggatagataacaatatacaaagaagtagagaaaaatttctactcccttcgttcctaaaatagacatttctagattgtttagtaaatattgaacataaggaagcaagatttcctttcagtcaataaatgtgcacaacatgtggctatgttaggcaaatccaagaaatgctttgttcaaatagatgcataatagagctacgaatttttacgtggaaaatctttacgagaaaaaactacaggcacaaactggcaattatcagtattgaggaattaattataatgcaagctagggaataaatcatcatctcacccttcccgtatttctagtaggaaaaactttgagtcctattgaaactataattaatccgaatatatagtaagctgaaatattcatatcacattatttaacataaatgcttatataatatatataatttaaattattgaaataattatatttgaaaatggatggcgattattgcaccatacaggcatgaggatggatcaacagtagtagtcaaatttaaacacaatgtggtggccgtaactatcacaagacggaaagacagtacagtaccgaaactgagcattcctttcagtccttactaaccatagaccattcccacatgtgctgttgtaatgttttatttcctcaataataattgaagaaagtgatatatatacatatatatgtggtgtttttggtctaaatgtttacacgtagtagtccccgttggcgttgagtgtaatattattaatgtttgttggcatgcatgaaaatattgttgctatctagagaagaaatttcacatgcatgtgcgtgatgaatcaataatggtgagaagtgcacatgcttatatatgtcgatcgatcgagtcgacaagatgaaataacagcatatgcaacatgcatgtaaccacacgagtccgtttctcacgctcactatcaaagggacacatctgcagtacccggcttgtgacagatgtacttagggcccattcgagaagtcagtttgtggaggctttttcgcgcaatggaaaatgagaaaaacatttgtacatgattaattaaatattagctattataaatttaaaaaatatttttattattttaaaaacatttatatagattttttttacggaatgtaccattcgagaagcgtgctaacataaaaaagtttgtgcttttgagttgaaaaaagaactcagttttattggtagattgggagcaggggtagtacatgccagttgcaacttgcaaccaagaaatttgagccaaattcagtggcaaacgttcacatctgacatctctttatcaatcaatttcgttttccattcgtcggttttaattccgtaccatctagtacgtagctgctaattaatggtttttctctataaattctttataaaaatatatacaaacatacatcttcagaaaaatattttttacggacggctaaaatagatttggagagaattaaggcaggaacaactgtctctaatgaaagcaggagcggcacctacattagatctctatggagagaagggaagagagaagaggtaataagggcatcaccaatgtatatgacaaagtgatccatatagatgggacccacataaatagtttatccctatggcaatgtccataatgtatagatacaaggtatcattaggagaagagagatgagtagagatagataatataatttattccatatgggtagtccatatgcatatggatatcttttgttattttttctatatagactagttgcacaatgttaataggtggctgaatggaatattctattgcttatggactacttttacaccacattgtggatgtcctaagagtaggaggctggagaaggaagaaaaatatgagcctccctaaacgaaaaggctttaaaaaatgttttcccatagtaaactagatgttgtctggattttctcatgtattcatatcatgtcgttgcatttaagtctaaactatctattatcttaaaacaaaaggacttgtcgtcaggcatacgtgtgcgcgagttgcctgtgaccggggatttttttttttttggagggggtagcaagtagctaggcgatgcatactgtcgatcgtggcgcggccggacggaccaccggcaaagatggagccatggatggatggccggccggataaagaaaaaccgtgtgttatggatgcgtggttggctatcgtacaaatacaacaacatcctgctgtcattttgcctggtacgtacggcggccaagaaaacagcgaaacggaacggaattttctgccgccctggaccaggaggaccacgcgtacgtacggcgtcgtcgtcgtcgtcgatgatcgacgagaaaaggtagccgatcgatggctaatcggggactaaatttgagttcttatcatatcggatcggatgtttgacattaaataaaagtattaaacgtagattaatgataaaaacttattttataatccttgactagtatgtgatgctacagtaaacatatgctaattatggattaattaggcttaaaaatttatctcgcaaattagctcttatttatacaattaattagttttattattagtctacgtttaatacttctaattagtgccaaattaatatttgatatgacaagcactaaaatttagtctctggatccaaacaccacctgagtaagggattgatgcatatatgtccgagcattcacacgaacaacatatataaaaaaatattttctaaagacactaaatatagaaaagaaatatcattaattttttttagaaaagagagcatacattaagttatgatcgattacaatcttacaaaagacgaagctgcttaattaaataatacacgttggatggtgcatcctctcgccacacgggcggagtgagatgtaccaaatgtttagcaaagttagcaagttcatcagctaccttatggcacgcctgcatatcaggaagaagacccatgtgaggccctttgtctctgggatgagggagctcagcttgatatgttgcccatcctcgatagtaacaagtcggcaaccgaggagcaatcgagctgactactgggatgctggtgttctacatatgctcccctttttcaacttctactccctttttcttcgagaactcttttctcacactggtaaacagtgttactttttttaaaaaaaatctatagaaaagttgcattaaaaattatgttaatctattttttgatttttttaactaatacttaattgattatgtgctaattcattattccgttttgtgtattaggacggatggattccgaacccataggttcaaatggaccctaatatactccgccgccagcttcaacccttctttgcaagccatagcctccacatccttcgcagcagcactaatatctattgggaacaaaactgaaatccacactaaaggcatgctcatgcctgctatatgaattagctagataaccagattttttttttactttatgtagatcttcaaaaaaacattgaaagttatatatttcaaagtaaataatgtgtataaaagtgtgttctgaattgtaatggaagcaaagaaaaattattttaaagtcacatacgtgttgctcctatgtaacaggaacatgggtatgttagaaggcacactcatggtgagtatggtgatgtgtgcgcgcgccattcttgtactaaagaatataatgttgtaaagtattttgaaatataaaaatgaaggtagaagagaatgtgtattaatatagtttatccactattaatttgagggaagtaaagttaaagatgtcagggttatggataaggtatacctcctatcctacaatctatagaatatacggatatgacatactttcacgtatacgaattatccccataaacgctattggaatctgttacaaattatgaaagatatctcctcgagtcaagcgatttccaaagtcctacttggaagggatagagtttctgttgtaccatgcaagatccaatgtctctaggtcttacttggggtcaagatagtccacggtataaaagggatccctagggaggggtgtaaagcatcgaatctcatcgccaacacacccaccatagtttacgaagccagagtacgcggagccaagtcgtcggaaaatcttgcgagtacatcgactacgatcttgtcggtatcatcgagttcgtctacttcctttgtaatctgtggttttccatcatcaatcccatataaactggagtagggctattacttgataaggggcttgaaccagtataatccttgtcttctgtttgcttgatgtcgtattacgtagatcctcgttccaacgtaccataatatcctaatcatccggtctacgagtatcactcgtcgacaaaagaggctgaatttatactatttacattattaaatattataatcactattgttttgtgctaataaagggaaggaaagttaaaagaggacgttttgtatccatttatattaaatattgtagccattattgatttgtgctaataaaaggaaggaaggttaaggagggtgaatttgtattaatatagtttaatcacaatattattttgggcaaatagaggaattaaagttaaaaaggacacatttgtacccatttataataaatattgtagccactataaatttgtaccaattttgcaatttggctatttgcattaatgtagtttatcccctattagtttgtgctaatcgagggaagaaagttaatgatggtgaatttgtaccatttatatagaacttctgttccaaaataagtttatatttggcttcttcagttcgtcccaaaataaatttatttttaagcaattattgcattgggatttgtaaaaatagaatatatatatatatatatatatatatatatatatatatacatcggagtagttaaagagagaaacaattgcattgcgatttgataaagtgagagtatttttagctcttttttttatattttatattggtatgtatatgatggatgaaaaagaacttattttggatggagggagtagtatattgtagtcactatcaacgtgtactgatatagggaagacaagtaatttggaaggtgcattcatatcaattcatatattaatatagtgttgcgcttataatttgcgttaataattgtctgatggttgttgacaatcaaatcgatggcattggctttagagtcgactgggttgccaactttttcggaggtattgcttcatcccaaaatataaaaaactagtaccagattagatattttatagtactacgaatctgattatattgtctgtcaagattcgtaatactataaaatgtttaatatgatcttagatttttatattttaaaataaagggatcgagtaatgaaggaacaaagatgcatggtagttggcaatatttgtccattccacatgccggagatagccaaacattatggttaggctcatttgctcgcatctctaggctctagctatgttttaagatgtggaaaaaaaaattttcctcttctattccttaatataatttacccagtttcgagaaaaagaaaagcaccaacaaagtaaaggaaagttaacgaggttgaagtatcatctgttaaccattgatctcacaacaatagcatgtttcatcccaaaaaccagctcggaagcaatatttagcagctataagttgtactctgattttttagcacacactttggacccagctcagcatgcaaaaatcgctgggacatagctgtgtacgcgcaaaaaatagaaaaaacaaaacacacaataaaagaaatatagagaggcaaagctaggctgccgggaaaacgttgttaaatgtttagcgcacgtgtcccatgtgcgccttcctcgtccacacgcattatatatagccatcgcctcctccttgactcctccccacccaagctcacacatctccctctctccctcttcttcttctcctcctctcgccatggatgccaccaccaccgtgtccatggagatggaattgccgtggggcgcgcggtgcgcggggctcgccttcttcgcgttctcggtgtgcctggcggcgctcggcgtcgtgctcctggtggcgaggcggtggccgtggtgcagctgccatgtgtgccgcgcctacctgacggggtcgtgggcgagggagttcaccaacctcggcgactggtacgcgcacctgctccgccgctcgccgacgggaaccgtccacgtccacgtcctcggctgcaccgtcacggcgaacccggcgaacgtcgagcacatgctcaggacgcggttcgacaacttccccaaggggaggcccttcgccgcgctcctcggcgacctcctcggcgacggcatcttcaacgtcgacggccacgcgtggcgccaccagcggaagatggccagcctcgagctcggcagcgtcgccgtgcgctcctacgcctacaagatcatcgcccaggaggtggaggcccgcctcatgccggtgctcgccgacgccgccgaccggggcgccgtgctcgatctgcaggacgtgttccgccgcttcgccttcgacaacatctgcaagatctccttcggcctcgaccccggctgcctcgaccgggaaatgcccgtgtccgagctcgccgacgcgttcgacgccgcgtcgcgcctctccgccatgcgtggcgcagcggcgtcgccgttgctgtggagggcgaagcggttcctcaacgtcgggtcggagagggagctcaggaaggccatcaaggtcgtcgacgagctcgcggcggcgatgatccgggagcgccagaagctgggcgtcggcagcagccacgacctcctgtcgcggttcatggcctccaccggcgtcgacgacgccgccgcggacgacaagttcctccgcgacatcgtcgtcagcttcctcctcgccgggcgggacacggtgtccaccgcgctcaccacgctgttcatgctcctgtccaagaaccccgaagtcgccgccgccatgcgcgcggaggcggaggccggcgacggcggcgagacgggcgccgccatcacctacgagcacctcaagggcctccactacacccacgccgtgctgcacgagaacatgcggctgttcccgccggtgcagttcgactccaagttctgcgccgccgccgacgtgctccccgacggcacctacgtcggcggcgacgcgcgcgtcatgtaccacccctacgccatggggcggatgccgcacatctggggcgccgactacgccgcgttccggccggcgcggtggctcaccggccccggcgcgtcgttcgtcccggcgaacccgtacaaatacccggtgttccaggccggccaacgcgtgtgcctcggcaaggagctcgccgtcaccgagatgaaggcggccagcgtcgccgtcgtgagggcgttcgacgtcgaggtcgtcggcgagaatggccggagcggcggcgccgccgccgcgccacggttcgtgccggggctcaccgcgtcgatcagtggcgggctccaagtgagagtcaggcgccgcgttcacacttagacagctaggagacttcacttctactgcaacaacaaactgaaacaagttattacaggcttgtacatagaaaaataggagaaattaattagtagggaaatttgggtttctaatgagacaaaacagaaaattcagatattgattcgtgttcgtcatggtttcctcgtatggtgatcattctgcaattggacattgttagttgaaatcacaaatcgggtaatcgaaaacaaaagaaaaaacatacaaaattgggtaactggagtagatggtatgttgttgtcactaatatgaaaacaccataatatctgaaagatattccgtcggacaggctttgttgcatctgatttggcacattgttgttccagtacaatgacacatcactgatactgttattgactagcactacctccgtttcaggttataagactttctagggttgcccacattcatatagatgttaaaaaatctaggcacacatatgtcaagattcattaacacatatatgaatgtgggcaatgctagaaagtcttataatatgaaacggaggaagtaatacaaattttgtttcttttcatctaaaaacaaagtattttttacaactaatactgtcagtttgcaggttcccttccctgtttttacttctggttagaccagcttaggttaattttcctgcaaaatcacatttccttgtaagcattactattacagaagatattcgtcggaactaaatatagaatgaaggtatccaatgtaccacatttaatttgcagcagtaatatgaaggtttgccttcaatgcatatcaaaatgtggaaaatttctgaaaatgtgcagaccagtgcaattactgcagttaataagcctcaatttcaggtatactcaaccaatatcacttttattggcataatctgttgacctgggcattcccaaattatcagtgtcattgactcaagtctcatgctttcgcacggagagtcattgcagaatacaggcataaactcacaacaattcccagaatcccagtattgccaactactgccatgctcctgcgttggaatgggattgaaattattgggtttagtttttttctaaccattttttcgggttgatttttcgcgccgaaacactggtttttaggtggaattgtttttttaaggtgggtggggggaggaggagaactgtgttggttaactgtactacaccagaagcaactgggaacctatcttcttactggagtaccatgattttgctcatgtctcatggtattgatagaagagatgaagatagtgaaaaagacagattcctacatttcctgtatttgtctccatctctgagtctgaagaaatgcaatgtttgacagtgctcatcagacgattgtttttttttaaacgaaccgcacaagacagtgcgagtttcatgtattgataaagcaggagaaaaatacaagttatagccctggaagactatagcccagaaaggaaaaaacaaccacaccacgcacctacaaccacaaacgctgcaagagcgaaacaggaaatcttcaagacgacgtctccaagaaggaaacgacaccaaggatgccgccgtctgtgatttttgcgctgttgtgaacttcagaacttgcacttttgtaactttatcttatcttttctcctttcccggttgaagaacagtcgcaacacgaaagaagaattcagttagtgattctggtggagaagcaaaggaaagaccttgaacgtgatgaaatagacagtgtccaattccaaaggatcaaagatgatatatgccgtttctgatgtatcctatgctatcctcatcgaaagctgcatttccatcgcccctcttttccagcgtcattttcagctatccatgatccccaaacaatatatatagccaggttcaccgattactagttcatctataaattctagggagaacttttgctggcattgatcatctaccttgaaaatacatttggggacagtctgttcatattttgacaattgttctttaatctttatcaactgtgttgctcacgcaaagaccgggaatactcatttgagtttagtaaaatgcttcatttatcctaaaaaaaatacgtcactctttgacgttatcttccgttttggacgtcggtcaccgacggcgatgggagcgaaattcgatcaacaaagaccgatcgctgatttcagacattctgcttttctttggtttgaagaagacagggattacatacaaccagagatggaaatgtctatgtttatgtttattgtggtgtactaagtaggaatcttgtttttaatcaaactgtaattttataatacacagctgtttgtcctgcattcgctgcaataattggttatagcatctttgaagcaaaaggacagaacgaattccattatctttaaaaagaccgcgtcactcacaatttgtcacctgcataaaaacctaatatctccattactagaagtacattactgtacttaattccgacataatgaatcatggatgtaataattgaaacatgatgcagacagcacgtcagtattatcttgaccctgattctgatcctagtcgatgcataatgccataatgcacaactcattaatcgcaacgtgcgatgcgtgatcagcgtcttgtcatcgctagtacgacaaggatccacaagaaatttggttgggccacaaatgctgccaagaatccacacaaatatggataaggaattcactagtggtttcagaacaagtccaaatatgatagtacttatttggtatctgttcctgataaaaagaactggatagttgctcatgcttctctctccttttgtgtccaatcacatactcacatgaagaaaaagatactactgaacagactgaacctgagcaagaaattgtttgtttcccctatagctgaacggcttatcagtgagaaaaaggttatggataaaagttttatatatcttaacggtttaaaaataaatgctaaaaaataaattacaatgaaaaaaactaactttaaaattaatttttaaaatttaaattttgccagcagcttatataagatgaaaagggctcctctgctagagatgactgaacagctcgttcacaattcctttcagacaaaggcagccgtggttttgaagggctcctcaagatttgttttgcgattcccaaacattgtcgattaattactgcaaatttcactcaaacaatgcgtctttctcatcaaaccgagatagggctgctgttgttttcataatgcagagacgtcctggcctgcaaaacgatgagtggatatttctgttgttatatatactatatatctacctcttgcatgtgccaagatgccaatggaggaagatgcaaacgatttacaagaataactaactactggcaactcgaattgggcgtaaattgcaatagaaataggcgtgtagatggttgactaaaacactagcaggggtagatccctatagaatgactaaatcatgagtgatgtggtcggtcaattgcagcgtcttatccaggatcacccaattacatttctgtatttttattagcaaagttaatttacatagcccaagaacagatcagccaatgatcggtagacacatgctccgatgattttatctctagtcgtgtgcttgttaagcgcatcggccattacattctttgtcaagctgacagcctgacactgaacactacacaaggacttggattcttgtagctcttgtgttccactctgtcagtatcctgattcatatcctagtatcttagtatactacgatcctatcaagccgaaacgataccgatcccatctagtatcttaattttcatagtatcttgattctactatttattactatacgatcctacaaaatcttaggtgatatctcgatcctacgatccctacgatcctacaaaatattattttaaataacatggtttggaaataatgtaaataaatatgctcaattttatataaaaatcagttaaatatatcaaaaccagcgtggtttctcttgataaatgtttctatttgcatgacatatatcattactacatttattttatatagaatggctatatataattaatatagatattaattaaacttaaaaaaatatcatagtatcccgatactacgatacgatcctacgatacgatattactttgagcaaaacgatactacttagtatcctgatcctgacaaccttagttccactcctgggctactctattcagctattgttggttatgcattaatttggctttgtgctcagcatgcatgatatgtttgtaggtctggcggtgttcgatcttgcatagtgatggtaggtgtggtgatagtttttgtgtgtgtaaggcttgaatctttggacacatgcatgaagcattaaatatagataaaaataaaaactaattgtacagtttgtatgaaaatcacaagatgaatcctttgagcctaattagtccatgattagtcataaatgctacagtaacccacatgtgctaatgatagcttaattgggctcaaaaaattcgtctcacggtttctatgcgagttatgaaattagttttttcattcgtgtccaaaaaactcttccaacattcagtcaaacatctaatgtgacacctaaaaattttcttttcgtaaactaaaagcattgttggtgtgtgatggtggttttgtctttttctaattctagtctcataggacggtagtcttgtcatttttttcctactatatcatttttttggcactatccgatgttatttgttttttaaaaagcatgcatgatacgtagttctccttctagacaatagctaccatgtttttagtatttaattgggatatatttgaaattatagatcagatttctctcaaaagtactaccattagaaaaaaaataacatataatttgttggggtgaataaatatgtaataatagaaactggtggttatagttgtattttataagtggggtcaaatggtcaatatccaaaacatgaacagcatgtatttatgcccggagagactagtagctactactatgttcttaaaaaaaagataacaccttagctacgaatatagacatagctatgaaccctagctaggattgagttttttttttttttgaaacggaggtggtagatgatatataaaaagtaagttttttttaagatagaataaatcttggccttacgaagaaagtaagtggctagatgataggaacaaagtgtcatactgctcatttggacggcaccgagaagagaaatggaggccgtgttagtgtctccttttgcttcgcattcaggccaccacttcaatcttgaggtggacatgctcagttaaaggaaattttctagccacaatttgaaacggatggctgcatgcatatgcaatgaggctcaattgaggagttgtgaacgtatccaactccatgaccgtaatagttcagaaaaaaggagatgaaaaacatgggctaaatcctttcttgtcatacttctgtgcacgaaatggataagaactttggggcagctaaccagagttatggcaaagctagcacacatatgccaatgcagccaaagtgccaggtgatcaaagaggctttcattttctttgacattctgtggaacaatcaaaaccagtcgatttgatagtttagcggtattagtttttttagcacgtttcaggcatatatacatcagtttaccatccagctgaatcacttcaggaaagagatagtgaagctactaaatcacttcagaacagttccaaaattcagcatcactttaaatgtcaagcattagagctgacgaattggagatgaagacaaatacatgagttctgcagagtcagtgaggtaggtgttcatgaaaattgagtagccaagaatctgcgcatagactgtggaaacagatagccgtgatgaagcactgtaacctatactacagcaactaaaaatgcccatgtatggagcagtttcagtctgaaatggcggctttaatagtaatgtaatttgccttcgaattttctaagataaggattcgtgtgaagtactccctccttttcaggttataagacgttttgacttttgtcaaagtcaaattgctttaagtttaaccaaatttataaaaaaaagtagtaacatttttaacccaaaacaaatttattatgaaaatatatctaattattgatttgatgacactaatttagtattataaatattactatatttatgtataaacttagtcaaaattaaaacagtttgactttgaccaaattcaaaacttcttatacaagaacaaaagtatatctcatcctccccggctcatatgcaacatggtgtccgtattccaaaagtaaaatttaaaagttaattatgctatcgacctttcagttttacgctaccgtttaattatcagtcttattaaaatattaatatagatataaaaaaacatgagaacttacctcagcagatccgcacctgttggtagcgatcggtcgatgccgcgaagcgggctattttttccccccacgtacttcgtgtgcgccacacgcacgcacgctcgatcgatcactatctctctttctctttcttcgtgtcgtcgacttcgcatgcagccgtcgcgtacggctacagctcgacggcgacccaccggagctggctgcccatccggcatccactccatcgccgccgatgctcagctcgctactcgtcgcgggatgagcaagataacgacgagcgaaatccagctggactggacggcgagtcaatactatgcttgagaagagacagttgtattgtgttgtgtgggttgacgatgttgagatgtaaggatagaatatggcgatgcatgtccaaatttctggttacagttggcacagaggtgatctcataacatgcattgtatgcaaatcatggtttgcaaaaataatttggtcactgatgaaaaccgttcctaattaagtggattttagttttatatattatttaacttggcccctttgcctagcggtttctcaatttgtaccagcttgacacaagttcgatgaccagaatttccgaccggtcatattcatttgtcaacctgattgtaccgtggttgactatttattattgaagccttgcaacatggacattttggattagaattagtaccttgagctcctttcgaaagcaacaatttctgtagaattttaacaggatttagttgagttccttccaaaaaaaaaaagaaaactcatttcaaacttctctgctgccaacgaacgaacagaatgggctggattccaacagaggggcctttccctgctagatcagcacgtccggcccatccaagactagcccacttaacatatcttatctatggcccaaagctcacaaaaccagaaaagacctcggcccaattaccccattccgtccaactccaactcatcctggccgtccattcccgatcagaatccgctatataccctctcttccacccgcgccacccactcatccccttcctccgaaaaccctagctccaccacctcctcctccgccgccgccgccatgaagcgcaatccgcgcgtgacgagctcccggcgcaagtgccggaaggcgcacttcacggcgccgtcgtccgtccgccgcgtcctcatgtccgccgcgctctccaccgagctccgccacaagtacaacgtccgctccatccccgtccgcaaggacgacgaggtgcaggtggtgagggggagctacaagggccgcgagggcaaggtggtgcaggtctaccgccgccggtgggtgatccatgtcgagcgcatcaccagggagaaggtgaacgggtccaccgtcaacgtcgggatccacccatccaaggtcgtcgtcaccaaactcaagctcgacaaggaccgcaaggccatcctcgaccgcaaggccagcggtcgcgccgccgacaaggccaagggcaagttcaccgccgaggacgttgccgccgccggcgccgccggggcctcgctccaggagatcgattaggctcggggagatatatccctttcctctctgttcgtaccgtctctcctattattatcatcatctagttaattttaatgctacttgaaatctgctactttatccctgatgaaactgtttgtcaacgtgagttttggaaccttatgtggatctagtctgatgccttggattntgatagatcaagaactgaactcattacatgttttattgctcatgctttagtgaacgttcaaatctgatgctgaatggtctcattttttgttgttatcatgcctcctgttgttgcaatgcgtcac

SEQ ID NO: 63918 - DNA, 78876 bp, Oryza sativa
tcctatagcaacgatatgttttttttttagtttcccatgacaaataccaaaacactgcaatgtcttgtgataaaatttgccctaaattaagtatagatctgaaaacaagttccagtcttacaacctgagttcatatgccctaggagccagcaatacatgatcaagcaatacatgatcagaaagagctggatctcacaggaacgccagccagagaagcaatgggccgggcatgctcttttgtctcaaccattgtgtggaaaaggaaaaaaaacctactccctccgtttcacaatgtaagtcattctagcattttccacattcatattgatattaataaatctagacatatatatatctatttagattcatcaacattaatatgaatgtgggaaatgctagaatgacttacattgtgaaacggaggaagtagatggtaagtatgccagaaaaatacttgcctgacaatgacatttgctagaatgctcgtcactttgctagccccttctcctctgatatttatatatagcacaatgcattatcctttttgtcattgttatcacagatatatatatagagagattttatgcctacagtacaaagggatatatagagctgagtacaaaaacacttaatcttcccatgcctgacaagaatatgaagctactcttcccacagtggtgaatttcttaattgggaatgggtaccgtcagggaaacaacatacaaagcttgcacaattcgtgttgcgagcggcttcatcccacggtgttggtgatgcttgaagggcgagggattctttagttgtgaattaggggtaccaggataaccaaattttgatggatacaatgggctattctgaacccggtttggcagaaggtaaagcagtatacacacagtctagcatcaaacacaagacacagcagttgaactagcttgcaatagcaggctctcctgcagctggtatataattcatttgctttggtcaggaactcaggatgcctttcagtacgttatccggaaaaaaaaattaaattggtggcagctcagtacatgattactctgattattttccatcatggtcgtgcactgaaaaaacaccagctgtaaatatgaaaccgaaaagccctaaagttggtcgctgtcgtcttctaactatacagtgttgttcactcagctagaacatataaccacaaaccgtcggaatgtcatgcacaaagtattgatcaggctgcactgtgcacagcagctactcccaaaaggttcatgaatctctcccaaaatccaagtttgtgattattctgatttgtttctccatgaatatgaaatattgatttcctagcccacccatccatattttgaataaacattgtgaatctttaaagcacaaagtgcatatgaggggttactatcctttttgtgttgtttgttggtcctactctagatcacttcttattgaattaaaaaaaaaatagccacgctagtactccaagctagatacaaaatgattttttctactatgttcatgttataaattaaatactacatgttcatctcgatcttaatacacattgatgtgatattctcaagggggttaattttggaagccaataataacaaagagaagcaataaactaaataaaatacatattatgtagggcagaaaaaaaatctagtcatcctctttacctgtatggacttgttcagctaatcccccaaaaaagagattggatgggattgagggggaacaattccacaccacaataggtgcggatatataaaaccccctccgaatccgtaacaatcccctctgggagtgctaatcgaacaaggactaaaagaattcatcgctttgtgcttgttttttctctaggaatacaacttcgtttgcagcatgcatgcctgattgtatgcatcgttcattgattaaagtgagctttcaccacaacaatgtacatggcaccaggaacatggatccctattttcattattgcacttttgaaaactcaaattctacctgtcatgcttcaatttattctatggtagtcctattttttttttcagagcatgaattgaaccactacaacaaggcactgatattgtttaatacccctcggtatggcatgtgtctaccctcttgccataggcttgtgccatggtagctgccgaaggtgttcgtgtgttgggtccgctagtgaatctctcttgcttatataacacatttcttaacttcgcctctagctttccgtagtttgtttctccattgatataccttctctgtatcgcgtaagaaatgagctagcccttctctagtatactgccataaaccagtaacttattatcaggggtatttgtcactttgctggcccttattttatatagcacaatgtattcatctttagtgttgtcatctcgcatatatagagatattttacacctgcagtgcaaaggaccaaagctgagcaccacaaatagcggtctcacacactttcctcctcactagcaagaatacgtgcatagccactctgtttacacttgcttgtatctgtgaattcctttacataagaatgggtggtgtcgtggaaagagcatacaatgcaccatttgtgttgtcaaggggtttcgttccattagagcacggggcataggtactgctcgaacgacatggaatttgagctagcagtgtttgtgggacagcagctataaatttccatagcagcatggtatcatgatgctatgcacagatatccaaatcctgtctcgtacgttatggtgctgatcaattaacgcacgtatgttggattgtgacgatgacatacatgtccatcttatgtcagccaagaaaattcagtagtacctactcaaacagtaacttcaaatctttagtttcggtaaaaaatcactagcagcaggcaatcaaatatggctgtcaccattgaaaaaatatcaggactaaactacttagtaacacagaaacctggatttaacaacactaaattaaaaagcaatctgacagaatgtttaagcactagcaaccatagagtcctcccattgttcaccaacaatacatgaacaaaaagagttgaatatcacaggaactcaagccagagaagcaatcaccagccatgctcatttgtctcaaccaactgacggtaataaaaactttgagggaagatgggatcatgccatcgaccatgatgatgtggcagagaaaaaacctctcatagacaacaagtacaccagcaaaagaaaaaacccaatccaataataaggacatactgtaccaaggaaaaagatctttttaacttaaagagagatgtaccaaataatagggacatattacaaaataggtattcacatggaactctcatttggatgggtttcaaacatgttctctaaacttgtcctttacaccagtctgtcacacacctcatgcatgatactaatgcccatgccactacttgtgcagaagtgtcacacctcgacttggcacaatacaaacaatgtttaagagggtgtgccacgtagaacagcgaaccatcctctacagaaccgcgatgatggtaccaatccgaggaaacactattgaaaatttttatacctatatgtaaccacgggtaatcatgggtagcaaccttcatccagaaacagcaacatgtaaaaccaagtgtgattttggtttatttgtgatggaaaattggcaacgaaatatttaaccatgagttggttttgagtgagaaatttggtttggattattggcgattttaggcgtcagtgcttacgactaacgtgggtcaggttgcgataactgtgcctagaatcggatgtttggtttacgtgtgtgcaggtgatcgaagtcaaccgcggtcaatgacgaggaccgggactatgctcagggaggagcagaggtccagcacggtcaagaggccatgtgacaaggttggactgacgtcatgatccctgatggtcaacctgggtagacggcggatcgggtctagactcagggggagttgaggtccagaacgatcgacgaagccgtgtgacaaggttgagatcaagatgacgcgcgatggacgaacaccgtgtcgggaagacttcgcaacgggcttcacaaggtcaagtgtgcaagtgccgtgttcgcgaagaaaatggagaatagaagaggagctacagtacttcgaagtactgtagcatgcaggcatgcactggcgtgtgcatgagatggcaagtgcagctagctgattggctagctagcttacacatggggtcggttggcatggaggccaagccgacgcctgattggctccaggcccgagtgcttggctggcagggaggccaggccgagcaggcccaagacaagacgacggcccacggcatcggcaccatgcgtgggcaagtgcgggagatcgcgcaaggtgcgcgcgcgcggtggacacgcggcggcaaggaattcggcgcgcacgggcgtgggacccaagcggtttccgcgagcgcgcgcggagcggctcggcgagacgcgtggcggctccggactgggcgcgggcgtgcgtgcgcgctgtggaaaaggagacgggacgcgcacggcacgactgggcaacgtggcaagcttcgattcggaaagacggagacgacgcagatcgatctcccgatcggtgcatgctgattggctcggaggagccttctcacggatcatggggcccacgttgaggagcacgcgggcgcgcacatgggaggaatttggtgcggattctttgtgaaaagaggatcccggtgtggcaagagacgtggcttcaatccaggctacttccttaggatgtaaggaacaacgtaaggcctagattgcatctgagttgggggtttcgccctaagggcatttgtgacaatgtcttagggggtcttaggctataaaaagagaggtggatgcaatggtggagttgctccttttgtaatccttttgagatgctcgatgagagagttatggtgtgagtttggagggtgtttgcctgagaggcttttgtattaggattagtttggagtgtgtttgtccgagagattttaaatttgtgttaatgttcctctgaaggtgtatgtttgctcctagttgagcagttattttgcatcacctatgaatgaaatgatttgaaggatttcgttttttccttgttcatttacactccgcaatttaaattctgcttgcaatttgaactttgcgatgacgagtttttgctatctcctcctcacctctcttctagtttcaggaattccttttctcttcctcttctagtttcgggaattccttctctcttcttttctagatgcggcttctcaaatagccgcggttctagtaaggattttaagaaatccgtcttgatgagtattttcgggggcaagttttgaattgctatattcaccccccactctatagccgttcttggtctttcacaacaacaatataagggtgagtactttcaatggcttaggtgtagggacatggcctatccttcattttcttcaacctagactatgtgaaggggagagtgagtacatgataataagagagagagagtacgtacttccatattcccctagtcactagaaaatgtgaatcatgcaagctttgcaaattctttattttaaaaatatttttcaaaatttaagttgggtttttaatataccactgaaggtatcgagggcactaatattggaggttaataacaaagagaagccataaaacaaaataatgcacatggaaaaatattacaaccatgaacggatccaggaatacatgatcttttctgcatcatgcacgatcagctgcattgttcattcataaagtgagcattcatgacaaaattgtaacgagcaaccggcacatgaatccgtgttgttttattggtgtacagtcaaaagctcaaaactatatatgccataccaccttctatctagcagtggaactattgtctctatttttctaatgcatgacacacttgacttttttatttggattattctccttctctaaaaatatttgtacaaacgacaaacatactatacatgcttaaagtacttttgatgacaaatctagtgatgctcttttcagcttacttaactaagtaaatagaataaccatttcagtcaatgcttgaaaagaattttaattgcgcatcatatattaaaaaacagtgatagtacaaatattccagagacgtgcaaaacccactaatactggccaccaacactacttgataccagcctcctcctcaattttactcaatggtgtcctaggaaaaaaaattcaattgcctcagaggtgtaaagcagggagaccctatctctccccttctgcttgtccttactgccgatcttcttcaatctataatcaacaaagctctcaacctgggagtcctctcccttcctattcctcaaattgacataaaattccctataatccaatacgctgatgacacgcttatcattatgaaggcatgtcaaagagaagttttctgtcttaaaggcatcctgcaatcttatgccatatccactggattaaaaatcaacttccacaaatcttctatgatcccagtcattgttaatcaggataaaattgaactcctggcaaggacttttggatgtacaattggagcacttccgtttacatacttaggtcttccggttggaacaacaataccaaaaatctgtgaatttgcacctctcattgatagagtggaaagaagactcccggctataacgatgtttttgaatcagggacagagactaaccatggtcaactcagtcctgtcatccctgccaacattttacatgtgcactcttaaaatccctaaaaaggttctgctgcacatcgacagagcaagaaggcattgtctttggagaaagtctcatgaaattgatgcaagaactcactcactggcagcatgggacaaggtctgcagaccaaaaaaaagaggggggggtgggtgtcatcaatttagaatttcaaaactgtaccctcttgatgaagcatctcgacaaattctttaacaagaaaaatctccgatgggtaaaacttctctggacttcattctataccaatagatctatgccaccgcatgcattacaagactttggatccttttggtggaaagatatcactcgactaatacctctctttagaggtatcagctctattcaagtcaactctggagacacagttctcttctggaaagatctctggtcagataaattatttcaaaactccttgcccgctgtattctcttttgctattaatgaagatctatctgtcagagcttttcttcaaaataatttggctcaaaacttcctcctgcctctatctcctcaagctattcttcaattcaatgaattatcagacctcctggagaatattcttctcattgatcaaaatgatatttggacttactcatggggaccaatctacaagacaagaaaaatgtatgacctcttctttgctcacattacccctcaccctgttttgacatctatttggaaaagcaaatgcagcatgaaagggaaggcattcttctggctccttcttatggatcgattaaacacacgagacatgctacaaagaagacacctttctattcaggatggaccttcttgccgaatctgcaacttagatattttggaggatatgtctcatcttttcttcacatgcccatttgctcaaaactgttggaattcccttgcaatctattgggatgtgaatcttgatctttttgacatgatccaatctgcgtttggaaattttggtcaaagcttcttcatggaagtggtggggactgcatgctggcaaatttggttgaaaagaaatgccctcatttttgacaatgtccaaccatcacttactatttggaaagctgatttcaaggaggatttcactcttcttttgcatagagtgaaggaggaggacagacctagatatcaatcatggattgacaacattttttaatctttccccctttgtaaatattttttgtaattttgttgtaactcctatttatatttaatataattaccacagtaggagcctctcctactgtttacagtcaaaaaaaaaagtacaacatgtctacccttttagttgacatcgacgtgcgaattcaggtagtggcggagggtggccatatatgtcttgggctgtcggttcctctctgttgtttatatcattccttacctccccaatggctttctgcagcctgtttctctattgacataacttatttgttacaaacatagcaaatatgagttggctttaactgttgtacttagctagtgctggctgtggaagcattgtgttgtttgcctaggatcggaatgggcatcattagagagaagacaagcatactgttctttgtcatgaccatttcgatacatcggctcgatcgtggatagtgcctgtgttgatctcacacacaatgcttcagaacaagtctcgttgaacttttgtcatgatttgagaataacatagatacagatgtcctaattggcgaaaaaaaaaactcgaagtggcatttgatttgtgcacatacctacgtgaagctatattgtgtcgaaaaaaagctacattaagctatacccactaaacaaataacaatatgacaaacaagtgctagcttaacaacgtgaatgcataagccctagtacatatagcctcctccccccttagatcatcagcaatacgtgaacaaaaagagttggatcttacaggatctcagccagagaagcaataaccagccatgatcttttgtctcaaccaatcggcacgtgataggaaaaacttcgataggagatgagagcaccatcggccacggcattgtggaagagaaaaaaaaaaggacatatgtcacacaaatgtctagacaagtaaaaaaagaacccaattaaataataaggacatatattgttccaacgaagaatatcttgataattaaaatatacatatccagaaattggaatggattaaaaaaaaccatatatgcacagcatccctcatttggatgggtctaaaacatagcatatacacatgtgtataggcctatagggcaggcattgaaaaaaattccaataaatatggattgacatgtatggccttgtttggatccttcgggctattaaatagccctatggaattttgctatttagaattattaaacgtagattaccgacaaaaccgattccataacccataggctattttgcgagacgaatctaatgatgtatattaatccataattagcagctgattactgtagcatcactgtagcaaatcatggattaatatacctcgttagattcgtctcgcaaaataggctaggggttatggaatgggttttgtcagtaatctacgtttaatactcttaaatagcaaatagccctccggatccaaacagggctatatatatgagccggagaaagcgtatcacattttcattctacaactcatgcaccacatgaacaaggctaactaatggtccttggctccttgccacaacctgtagagaagctagcccacctctaccggcctagcagatcaaaagcctgttaaacagccgaagcccctgttgaaaatatggtcatattcagcatattttaatctaaaatataaagacaatgaacatgacatttttaggaaatgatttgcaagtgttaaacagtagcaacatcatgaacatgcttaatatacagtaagcataggaatagatatggcaatgcaatgctaacattgcaactaacagtaccagtaaacactaaaataagacataaagagaagatgtgaggagattatactccaagaatgaccctccgctggagtttggggcagtattgcctccattggtgttgacgttcccgttcacctccttgtctccaatgttgctgttgtctttggtattgcccgacatgttggagagacgatgcagaggaagccagagcagttgcgtcgagacgctcccaaaaaaccttatcgcctgcctacccgtgcaggcactgaagcggacgggttccggaggctctactcgtcccgtacacctatgcgcacaggtgaacagaaccggggaaggatcttgcagcacaagaggaagaaccgaagcaagagtcaggaagaactgaagaacatctgtacttctgttcattcccattggcggagtatatgtgcacgcgggagtaacgttcgggatcatcaaccgcgcgtgtttaattcagtaaccgacatgctctttaatacagaatcgatttccataaccgacatgctcgttaatacagaatcaatcaccatgtgttattaccgtatgttacaaaaagagagagagagagagccgcccacccgcccctagtccggcacgcgcgcgtgcggctgtctgcccacaatatcaaccggtgagactctccactagctccatgtttaagttgagacctcttcacttagatttctaaggtggtactattacccatagcactaaatgtaggccattggaatatattgggacttaattgggcctagcccattaatctaacagcccctagcaaggcaaagctaaaattaaatcgtcgtcatcatgatttgacagataatgtttaagaacaagtctggtcaaactttaagaaaagagtaattttatggttcttgaggaggtaccatgaggtatcactttttctattgttaatttgatacctttaggtatctaggtaccatgaggtatcaaattttacactaaacttttgtacctcatgctatctactcaagaaccgtagaattgctcgctatatgtaaataacagaggagaatggctatatataaatgaacaaatagtaacttattgtcaggagtacttgtcactttcctagcccttctctgtcatttatatatagcacaatgcattcatcttttgtcattgtaatcacatttatagagttcaaagggatagaactgagtaccaaaaaagccgatcacaaacacttgattttctcatgcctgacaagaatatgtagctactccgccgatctacactgtttttttgcattgcgaatttcataggtggaaatgggtggcgtccgagaaagaacatacaaagtttgaacaattcatgttgcgcgtggcgtcgttcgagcagaagggagaggcctgctagcgatgccgatcagacatgagctggagattttctttacgcatcatgacgctgcgtacagagatcgggtaaatcaccctgtacccccgtctgatcaccatcgcactactactcgtaggtttagtataactccaacttctaaatttaactttaggagcttcaatttctaaatttaactccaagagttagttctagagtggtgttatgaagcagtctaaacccagctctatctttctagtttattttgtgagaacgtttcacatagctccactatcattcattttaggtagaactgaaagttaactgagtctaaataaagtttccattatcttaaaaaaaaggtagaactgaaactatttggccgggctccaactctaaaatagataaagtttaaactgaagccatgccaaacagaccctacatatgtttacattggaatatcaccaagatctgtagcagccaagaacctgtagctaataaacaccaggcgatcagcgagcgtcctaaccatatgtcccattggttcatgacacggcatctgccaagaaattccagcacagctagcgaattactaactccaaatctcttagttcggtcaaaaagctctagcggcaagcaaacaaatatggcggtcctgtcgcactgaaaaaaaattgagaattaaatttattcagcagcacacagaccaggatttaattcaatagcaacaacataaaatgcaggaacagaggaaacgaaccaaccaccagccactctcttgtgtctgaaccgcttgcaggaaccaggttgagcacctcgtgtgcacactgtagcaagtacggcaaaaacaaagcagagtgcaaacagagagatgaggagcagagttcggggcaattttcgttggttttctcttctccgaaagtaaattgcgtgattacaactaatgcatgagctaaactatttatggaccatatgccatcgtcgatcccacgttcaccacgcaaccaactcacgccacatagatcaggtgcacacacacgcagctggtcgacacggtcaccttgcgatcatgaaactttggcttcaataacacattagtttttctccatacttgtctggtttgatggccgtaaaggatgctaatgccttcttacctgagaatcgaaatttgctttcatacggtacgatcttgattcagcaaaatgtcataaaatgccttggctcaattgaccttctgtgtttccatatgttcagaaacttgacaaattcagggtgttattatctttctataataaaatgtaacgtaccacttggttcttcgctatttctcagactcaacaagcacaagcagtttcaggtaaagcttgattcttctcgtaagtgcttcagaacaggtttgccgttcaccatgttgtttgagatgtttgcttgtcaggtatatatagacgtatagtaaaccatgctttggcctgatcctttttcttcgtgaaaatcccactaaggatttcagcctgtgatgcaaaactctgatccaaagtctttgaattgcgtttaatgtatagatgattattatgaatagtagaataggtgctccttgtgcgcttgtgcccccaaatgcttctcggtcatgtttttacctgcatgcacatttttccttcattagcattaaatttctgggttaattaggttcgtgtcattacaaattttctgatatgagaaaataccactactttcgtgaaacctgtcgtgtgccattgaaattttttaaaattcgaaatataccatcaccattccttttttgggaaattttgctacagaacacttgttatatgtgattttagccctaggacactatccaaactcacttttgggggaaaacactccataaatatggtaatttgccagtggacaccgcgctgattaaaataatacttttcggttgggagagggagaaatcgcgtgaaaggtcaaaaatgcccttgggcccacatatcagctctatctcccatctctcttctcatctctcagaggcgcgctcgcacagggcagcgtcggtcgcggcggagatggcgaggacggcgaccggcggagtggagcggggcggcggcggcggtggacgacgagcacgcggccggcagagcggcagcgtcggccgagcggactggcggcggcggcgagcgagcgcgcggtaggagccacagcggagggcggctggcgagagcggtggaccccatggcgacggcgatggcgatgcaagctcccacctcgctcgccagatggtgttcaccgagaagcctcgcggccgtggctccgtcctccccctcctctgtggccacccctccacccacatccgcctcgccgtcggctgccgaccgccaactgccctccgcgcgcagcagccggcggcggcatccgcccacgccgcgcaccccgtctcccttgccgtggcatccgccctcgccgcgcaccccgccatcctcaccaccgccaacccgctcaataccaccaccgagatcgccaagcaggtcgccgacgcccgtcccatcctcgcctgtcgcgcgctcactgtcgctgccactccgctaggccaacgctgccactccgccagccacacgctcgtccgccgccgccggccgccgtcctcgccatctccgcgcgcgaccgacgctgccctgtgcgagcgcgcctctgagagatgaaaaaagagatgggagatagagctgacatgtgggcccaacggtatttttggcatttcacgcgatttctctctccttcccaaccggaaagtattattttaatcagcgtggtgtccactggcaaattaccatgtttatggagtgctttcccccaaaaataagtttggatagtgtcctaaggctaaaaccacacataacaagtgtcatctagcaaaattcccctttttctatcagctccttccatcgtcgggcccacttgtcagggtgtcttgagtctccagctgagctgctgcctcctctctccccagtaaaaacctagctagcctagcgcctcctccagttcacctccctcaaccatccttcccaacgaggccttttacaataccttccactaggagatggtagtagtgtagtaggaataaatccaattgattaaggggaattactcctctcaactccctctgcaatgcccccacaaatcccctttcattagggtcccgaatcgtttgccaatgatagtgccttaacccgtcatcttcatggccaaccattgagttttttttggcgcagccactagttcgggcgcacttcgttgctgttcgtttccaggctcttctcctcactctgctgcatcctggaagacatgggaaactgtggtccggtgttggaattgacctggtatatgatggatttcttttagtccatgttcttggatttcttttcatggattttttttacccatgtgtgtttggatttgatcgatgctatggttgaggctttgagcaatccacgaggagaaatcggaatccatcgagatgacgctttagtgaattcaggagcaaaaactggagtagcaattcatgagtagaaactacatagttggtgctttcgctttgcccaggcacgggagatggctttggcagagacgttgctgctggttcgccgaggcatcgcggagtcagtcccttcacacgagcataccgcggctcgaggtggcggctgaagattgaagacacctgacgagtgcatggatccatcgaagacggaagaggatgctaacagaaaagatgacggagatggcatggttcgaattttaaaaaatatatatatagtgacacataacagatttcacaaataatactggtacttttttaaaacggcaaatttctaatggcattgatccaattaacccttaatttttcgttgtagtttaccgcatgggtcttggacacgattcttattttttgttatattaaatgttcatttttccttcatttcaggaataatagtcaaggtgttccaatttgggaaaaacagagcagcagcataatcaattttgaagataaaaaatggaatatgtacattatcttgacttccacacaaatttatataaaatggaacttcacaacgagggtttcatgtgcatggttacaactttagtaatattatctaatgctgtagtttactgtgcatgtcaatctactgtaaaatgaatcctgattcagtctgtgtggattatgctaagcatatgtcatcctatagtgacgcataggtgaataatagtgaagattattaacctagaaccatgaaggatgttaagcatttggtatcaagtttcgttcagttgctggaaatcaagtttctaagcaataggtgatgaatgtttcattataaatttcacacacctggaattgtatatagaaattttatgaatatatagtcaggttatataagtgtcatgtcatgtaatagagagatgaataatgatttccattgcttgttgatactacactttgcagaagtaagaacaatgttgttaaagttagaatgttgctattagatgatattatagttttctgaagttcaaaatcaactaaaacctgaacggttttcttatacaattgactttctttaatatgatctgttgccaggaagtggtatttaatgtttgtgttgtggtcaagcaaggataaaatatgtagcttcaaacggtaatatttagcttctagcattggaaaggccagctgattaaagggttaggttgaattaaaaaaaaattcctttctcccccctacgttcactatttatcctttactcccaagagctttggttatattacctccatccaaaaaaaaacaacctaggaggagatgtgacctctcctagtacaacgaatctagacaaaatgttgtgggacggaaggagtatatgcttgcagggccatctatattgtcattccacagtaaacagcaatatcgttaatgatttggaaacaattgcaaaccttgtgtcgttaatgtgtttcttttcttcttaaatgggaaatgatatgctaattgtccaagagtttaattaaaccatgtgtaattcttgttatggggaatatattgtcaagatattaattagtagtcaacctatgcattgtactgctatttttattgattatttgatgaaggccaagattagattaaaagaacgttcttttccataaaccttgcaacttttttaatgctatatatgttcccttgtcaaaacatatatttttcagatgtcttttagtcatttcatttacaacatcaattattgtcgtagcattagcacggacatattactagtcaaaatagtatatacttcattaattgaggattgtagtatatattgaccaaacaaaaaagatttagtacaaagtacaaactcttttaacgagaaaacattttggttaaaatgtcaaaatagcactaaatttttgtactagtacgtctgtaaaaagaaggacatttaaaatttccatgcagacatgcaagaatcaattatagaataaatatttttttggccaattttcaattgaatagttgtcatattataactagttgataaatcttagaggggtaaatgtgttttttttaagagtaaatgtgtttttttaactatggatgtataacgtcaacgcacggtataagtcgatggcatataagaaaaagagctaatttcatagcatgaaagagctaatttcaagtggaatataaggccaccgataaattttcagtggcatataagaaattccctcgtatattaatttcatcactctaatggaattatccatgtgcctgactacccacagggagaattctactagcctttagttcagttcatggtaattgccatggaattattcatgtcaagtgcaatttatccgataattaattgtatgtaaattgatcacgtaacacagttagtaataataaaaaccaagcatcatatacagaactaataattagggttttacctcgaattgcacgcaatgatagtccgactgaagaccatgcattcctccatcccatgtccatttatcgtgtcgactacaggaataattccatcaacatatgcagataaacattgagcggaagatgtaacagccaaaatggacaaacgagatagaggcatagagctctgcaccaatccagcaacctagcttaaaactcgagacaattttgagatcgaattggcaattatatatctaactataactctaactttaatccctatcacatcagatgttttggacattaattttgagtattaaacataaactacttacaaaaattaattatataaataaatgctaattcacgtgataaattttaatttttaagcctaattaatccataattagcacatgtttagcatcacataggctaatcatggattaattaggctcaataaattagtctcgcaaataagtccagaattatgaaatggattttgtcaataatttacgtttaatacttctaattaatgttcaaacatccgatataacagggactaaaaaatttagtcccaaccaaacagtcccataatgaattaagtagggaattactacaacatatttagtttttcctagcacccccactactacatgatagttttacctggacgccaccccttttgtttccatgcggcccataactagaaccgcacgaaaaattgggggggggggaccggcgctggactgtcgcccgcacgggaaaatgcattttcccatgcgggcgtcttaacccgaccgcacaggataatctttattatcccgtgtggtcgacttaagagggctgtacggaaaaaatcgattttcatgtgcagactttttaagtggaccgtaaaaaaaatatctctcttttccctctcacccacttcaaattttccacactctctctctctcttcctttttcgtttttattctctctccccctttactctcctcgatctcctcccatcccctctctcggcctctttttctcctccccacccctctctctctactctctctctctgcgcgctaccgtgtcatgacgactacttcacctgatccacccaaaggcacggatgatcaaggcgacgaaccaatctcacacaatgggcagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacaatttggtatcagagccgctaccctggagaagccacgctacacatctcgattgcaactccaagtcgaagctatggagaagcagaacgtggatttcggcaaggtgctcttggagatccaggagtcgttggtggcgctgaatcatgcacaagccgagactcaagcggcggtcgtcaagttggaacaaggagccagcagttggaaacctcaagtggaagccgcggttcaagagctgcgtggggaggtcgaagagatcaagcagcaattggatctcattggcaaatcacagcaagcttccgcatcggcgtcttccccttgggttccgtcgacagacggggaaaggaaggcgccactgctgcccacgccaccgccaaattctcttatggcctcggtggagggcggaagcaaatcggctcaaagccatcatcagcttcagaatcaccggggaaagacttcaggaggaaacatgaccctaggtccaaccccggtcaagggtacgtatgactcacactccttccagtttccaaaatttgagagttcgggggttgaaggtggagaaattgacttcgaatttggggagagacaatataatcaccgtgttccaaagttggatttccctaaattcgatgggttagatccccaggactggcgcatgaagtgtgagcattatttcgatgtgaataacacgtttcctggtttgtgggtgagggtagcaaccatctactttgtgggaagggctgcatcttggttaagatcttctagagctcatttgcgttttcctatatggggggatttttgtgctgctgtgtcggaaaaatttgatcgcgaccagcatgaaaatttgattaggcaaatggatagtattaagcagtcgggaacggtttgggagttttatgagagatttgctgagctaatgaatcaactattagtttatgaccctggggtgagtgcaaaatatttgactcatcgattcattgaagggctgcgaagagagattcgtaatcctgtacttttacagagaccaaagaccctcgaaactgctctgtctgttgctttgttacgggaagaggtgttggagaatcctcaagtttccagtgttaaggaagtcaagagaatggaaggcaactctggttttcgatcggcaggcaagggaccgtggccgttgccgcaaccaccagggaagagtggaagtttctctttgatgaatcgtcctaaagagaagagaagcactgatactgttcgcagtccaacaaattcgacagataaagtgactactctcaaggcttatcgccgagcccagggattgtgttatatttgtgcagagaaatggtcccctactcataagtgttcagcctcagttcaactcaatgtggttcaggagctgttcagtctctttatggaggagggagctcaggaaagtcgggaaacctcaattatatcagatgctgaaacgggtgaactaatggcaatttcagtgcaggcagtacaaggttctgagccagatggaactatgcgcattttaggacaagttcaaggaaaacaagtgttaattctagtggattcaggcagctcagtgagttttatcagttcacagatagcagctggtctaaaagggatacaatctcttcctcgacaattgtcagtcagagttgctaatggtggtacactctgttgtgatgctatgattcctcagtgtgaatggcaagtgcagggtcacagatttagaaccactttgagaattttgcctcttaacagctatgacatgattttgggaatggatttgctgaaggagcacagtccaatgttagttaattggtctcagaaaactatcagaattaatttgctgggagcaatggtgactctaacaggggttcagtctgaactgtctaggtgtgaattgttatcagctaaggagatgcagcaattgcaacagaaacaggcagtagcccatatggttcagctttgttctctctctcaagatgaggaatctgaagaaataccaaatgaaattcagttattacttcaggagtatgcaactgtttttgctgaaccaaaggggttgcctcccacaagacaattcgatcacacaattcctctaataccataggcacaaccggtgaatgtcagaccctatcgttatacacccgcccaaaaagatgagatcgaagctcaagtgactgaaatgttacagaatggcatcatacaacacagttctagtccttttgcatctcctgtactgttggttaagaagaaagatggatcatggcgattctgtgttgattatcgccatctcaacgcgattacagttaagaataagtatcccttgccaattattgacgagttacttgacgaattgtcaggtgctcagtggtttacaaagttggatttgcgagcgggatatcatcagattcgaatgaagactgaagatgaacacaaaacagcatttcgcactcataatggtcattttgagtttagggtacttccatttggcttgactagtgcaccagccacttttcaagggatcatgaacaatattctatcctcattacttcgacgctgtgtgcttgtgttcgttgacgacatcttaatctacagtcgcactcttgctgaccatatcaaccatttaagggctgttttccaaattttggttaaacatggtctgaaagttaaacagagcaaatgctcttttgctcaacagaaactgtcttatttgggtcacagaatcagtccaaatggggttgctactgaagaagataaaataaaggctgttaaagattggcccactcctaagtcactaaaggacttgagaagcttccttgggttagcaggttattaccgaaagtttgtgcaaaattttggtattttcagtaaaccattgacaaatctgttgcgcaagggtcagcctttcatttggaatactgtgacagatgcagcttttcaaaccctcaagcaagcactgatgtcagctcctgttcttgcaatgccggatttctccttaccatttgtggttgaaaccgatgcatcagataaagggattggcgctgtgttgatgcagaatgatcaccctatagccttcctcagtaaagctttgggacctcggcattggggtctttctacctatgacaaggagagtttggctatcatgatggcagtggatcactggagatcatatttacaacatgatgaattctttatcaggacagatcatcgcagtctctcatttttggctgaacaacggctgaccacgccttggcagcataaggctcttacaaaattgttgggacttcagtacaagatcatttataaaaagggtgctgataacaatgctgctgatgctttgtctcgctgtcctgtacctgaatctgttgctctatcagctctttctgtttgtgttcccgaatggacacaagaagtaattgaaggttatcatcaggatcctgattctgccagtaaagttcaaacgctgtgcatcaatagttctgccattcctgacttcacacttaaaaatggtctgctatacttcaagggcagaatgtggataggacataatgtgcctgtgcaacaaaagattttagccaatttgcatacagctgctattggtggacattccggaattacagtgacttatcaccgaatcagacaactttttgcttggacaggtcttcgtgcagatgttgcaaaatttgttcaacagtgtgatatctgtcagaaggctaaggtggaacatgtcaagtatccaggtgcattacaaccgttgccggttccggaacagtcttggcaaattgtttctttggacttcattgagggtctgcctcgctcatccactttcaattgcattttagtggtggtggataagttttccaaatatgcgcattttgtggcattggctcatcctttcacagccttggacattgctgaggcatacatgcagcacattcatcgcttacatggattaccagaggctcttatttcagatcgtgatagaatttttactagcactctttggacgacactattcaaattggctggcactcaattgcgaatgagttcttcttatcaccctcaatccgatgggcaaacagagcgagttaatcagtgtcttgaaacctttttacgttgttttgtgcactcctgtccctctcaatggagcaaatggcttgccttggctgagtattggtataatacttcatttcattcttctttgggagccacaccatttgaggtattgtatgggcacaaacctcgttattttggtctgacagctgcagctgcttgtacagcaccagagttggttgattggctgcatgaaagggataagatgcaaactctcattcgagaacatgtgctgcgagctcaaatgagaatgaaacatcaggctgatttaaagagatcggagcgctccttctctgttggcgattgggtctatatgaagcttcaaccgtttgtgcaacagtcggtcatcactcgcactaatcgcaaactttcttttcgtttttatgggccctttcaggttttggccaaggtgggaactgtggcttaccgtctggcactgccagattccagtttaattcatccggtggttcacgtctcccaactcaagaaggctttggctcccgtagaacgggtacagtctcatttacccgttttgcctgctgatgaagctgcagacatttcgccttgtcaggtgttgaatcacaggcttgttcgcaaaggagctaaactggtgaaacaagttcaggtctgttggtcccgccaagatcccgccgccgtcacctgggagaatcttcaggaactacgtcaacgctttccacaggccgaagcttggggacaagcttcatttcaagggggggagaatgtcatgacgactacttcatctgatccacccaaaggcacggatgatcaaggcgacgaaccaatctcacacaatgggtagagaaggaagtctgcgcgggagagacagcctaatagattgtataactcgagtgtgtggacccagtgatgttgggctgggccacggggagtgagagaggcccattagcgcagtgctataagaggccggcagggaacagattgaagcgaacattgtagaaacacttttctgaaactacttcaaatctctccctgttcttgctattcttccccaaattcctcttcctctgctgctctcgttctcatctcaatcccaaaattcctcctcgctaaaccctaattcttagaagtcgtgacataccggctccgagatcggctccgcgtgcacacgtggcgggcgcagacggcggcggggccagcagctcagcggttggcgcatgtgacaacgatgacgatgaggcggcgccgccggctccgcgtgcacgcgcggcgggcgcggacggcggtggggccccgcacggctctcggcggcgggcgcgacgacgatgacgacgacgaagcggcaccaccgactccgcatgcatgctctggatctcaagcatctcctactctctttcttctctatggctgctacgatagcaaagtggtgtggttgtgatgttgaactacaggcttccagtctcttgacaattgctctcaagcttgagttgaatccccagccaaaccgctagtggtggctgctattgctaatgttctggtagttgagactgctgtgctactaagagcatccacagtagtaaagtaaggtgttctctataaaacatgtatatctcagcaataaacttgattaataataaaccaccttaatagattgtctacattgatatctatagctctctcatgcattgcctcgtttttctctataaactatctctaaattaatagatagctttgctctctctcttcatttaatatcttaaaagtagaaaaatatgctgacatggatctcttgtagagagcctatagataaccattgtgggtcccctaatttctccatgccgatataaacggtgcttgagttcttgctctcttcttgctttgatctcactcggctgtttttcctagagagggtttctctggctgtaactagtactactgcaggctgcttgtttttggtttctactaccaaaatgacttggtcacgcggacggcggcgggcgccacgacgacgacgacgacgacgaggcggcgcggccggctccgcatgcacgtgcgccagcaggccgtggctggtcgcggcggtggcacccgggtgcgtgcggcgcccgcggtgattttcgcttttttttaattatttttggttatttttgttccgtgcgggtggtataatttcaccttacgggataatcgattatcccgtgcggtccacttaatccgaccgcatagaaaaatgattatctcgtgtggttgggtcgcaatatttccagacgttttggtgtagacggacaaatcctccacacgaaaaaatcattttaatcgcacggaaaaatgcttttcgtagtagtgtcgtgttactacacagattagcagaaagtagggtaacgttcccggatgaaattaatctttaggtgacaacatcaaatcgatcactcctaaattgaaccaaattaatatgtagtatgtgtagttcatgatagtgaccttttagtttcccccactgctggaaaaagcatttttataggcggccaaaagcaatttttgcaggcggaggggaggactgcctgcaaacagacaacggtgaaaatcatccattttcgcaagcggacaaatggcccgtctacgaaaatccaataaaaaacaaaaaaaatcgcctcgccaccgctgtagcattaggagccgccgccgctgccctcccccggcctccctccggccagatctgggaggggaggccggggagccgccgccggaggggagcagcccacgtcgccgccgctgccctcccccggcctccctccggccggatctgggaggggaggccagggagccgccgccgtcgcactaggtcgccgccgcgtctgcgcgccgccgcgtccgtgctcgccgccgccgccctcccccggcctccctctggccggatctgggagggaaggctggggaaccacgtcgccgcagccgccgccgccctcccccggcctccctccggccggatctgggagaggaggccggggagccgccgccgctgcaccgggtcgccgacgcgtccgcgtgtgcctccgctgcgcgtccgcgcaccgctgccgcgcactccgccgccggtggtgggagggaggggaggggaggggatggggagctgataagaagccggtggtgaagggagagagagagttgagaagatagaaatgagtagtggggaggggggttggagtagtagataaggatcaaagtttttttttttggtaggtacaatttttgcaggaggaccatataaggtgcgcctgtgaaaatctattttcgcaggtgcctcttaggtggtccgcctgcgaaaatagattttcacaggtagacagcgaacttcaccccgatttatatttttgtaagcggtcatttgactcctaggcttatgtccgcatgtggaaaaagactcctacgtttgaaaaaaagctttttctagtagtaccctttgccagggtatctttagctacaagtcattctttcaggtgatcaggtctacatgtatatatatagtacatgaaagaatcagagttctcaaaaatacaaacaaccgcaaatcctaattggtgtgtacgccctcggcgtgcacgcgccggcccacatgtaccggcccacacgtcccatcctcagccattctcagcgtatgcgctggcgagacgcgcgtttatttttttcggaattttttctctataaaactgattcaaaactgattcggttaagataagatttgtcttttttccgaagattattttaagtaatagattgaaaagaaatctatacgtgaagtcaaattctgaaaactttcaatccagatttgaaaacattcaacctaaatttaaaaactttcaacctagatttgaaaactttttgaagttaaattttaaaaacttttaacttttcatcccaaatttaaaacttttcatcctagatttgaaaactttcaagccagatttgaaaacttttaactcaaatataaaaactttcaactcaaatttaaaaactttcaactcaaatttaaaaactttcaatacaaaatttaaaaactttcaagtcaattttgaaaacttttaactcaaaatttaaaactttcaactcatatttaaaactttcaatacaaaatttaaaaactttcaagtcaaaataaaaaacttttcaattatacatttgtaaagaggtgtgcaaaagattaaaaaaaatcggaaagaaacggaagaaaaaaacacgctcagagacaaaaaaaaaaaagaaggtgcgaacatgaaaaaaaaacgcacgccgttttttcacacggtactaaacgctagggttagtaggggaggccaaaacgcgcgcggcttcccgttctggctcatgggcccgcagtaggaacgcaaaaacgagcctgtacgtgttatgcaaccgtgattaggcttcataattcagcttttctaaatacaaaatttttaactcttatatctatgctactaaaattaagaagacggtccgacaccaccatatcacctatatgtccatgcatactttgcttacttgtttctttgtagtttttactctctagctaggtttcagatctttaattttgtaaatatgcctttttttctttctgttttttaatgaaagattttatttaaatcaattaaaaatacatttttcaacaagtacttaatttgtacactttcaataaccttcttgaaacgcccgagcatttagctagtgttcaatagtacagcaaagagcgagcatatatagtctaaaaccatgcattcctgttgaaatttattggatatatactagcatattgcccgtgcggtgcaacagaattgcaatttaagaaaattatctttaacatgttattaacatctctcatttgtcgtatatattttttaatctctttttagttctacactaatttttttcttcccacaaaaaataaagagttggtgagagtagttgatatgtgggccatctagcctcacatgccattttttcgttgggagttgcagtggaggcagtggcggaaccaccaccgatactaatcttttctgtacggagtatagatttctaaatatgcataccattattaaaaaaaagatttctaaatatgcattccagtatatatgaggtcttacatgtttcttttgcagctttaatttttacagtaagtgggtatataattacatagaattattatttcgatgggattatcaatgtacgtgctagatctatcttactataaagttataatgcacaaaacatcatcatacactatggcacatcatcatccactatcaattattacatttaaacatcatgcaagcatgctatattatctataattttataatttattaaattttagagttttaaaatgcaaccatattaaatcatcatcccacgtaattccattaaattctaaagttaacatgttaagatgtcacatcatcatgctgtaacaagatgccacatcatcatccactaacatttattacaattaaatatcgtgtaagtatgctatattatctataattttataatttattaaattttagagtttcaaaatgcaaacatattaaatcatcatccatattattcacatattttttaatatatctcttcattatttcttataatatcatatgtacgtatatagttcatccttacttagttagtgttatttctctctttttctcgttaagtcatatcatatcaatttttttaattttagataattaatctatggtccaaactatctccctcactttcttttttcataaagcgacatcaccttatttttacatacgaatcgtagttcaaatttaaattattataaaccacatcaacttatgtaagttgttgtctagctatgttacatattatttttacttgagtattgctatatgtatgacacagttgtccaactcaggtacaactagagacatgtaaccatagatcaatcaaaggagagcatattcatatgcactacagtagtttataatcgttgatcaaattcagtcgtacgtgagtcagacagttgggttgggttgtatgcatagcaatttccttttttacttatggttactatactaaacttccatagcaacgcgtggggtttcacctagttatatatatataattccattagtctacttcaattacatttgaattgtagttcaatcgacacaattgtttgtagaatgattaccgtaattagaattaaaaataaaagatcatgcgtcatagacataataattaaagttaggagggtaatatgggttttgtcgttaaagcgtaagcaataatattctgaccggacatgcataatttaaatttcatcctttgatgtaaggtccatttcaatccatctaagagcaggaacaaatctattaatccctccgtattttaatatatgacgccgttgacttttcgaccaatccgtattttaatgtatgacgctgttgacttttcgaccaatatttgaccatttatcttatcaaaatttttgttcaaatataaaattttttatgtcatgcttaaaaaacattttatgataaatcaagtcacaataaaataaataataattacataaactttttaataagacgaatgatcaaacgttggttgaaaagtcaatgacgttatacattaaaatacagagggagtaacatttagggaaaacttataaaacgtgatgtaagaaacaaaacaaataaaaatagaggtaagtgtgaccggctgcaccaataatccagacttctctaaaaattcaagttaattaactagctgttaggtttggcccattgttaagtgtcaaactatcaaactacttgacaagtgatcaatgcactgttttaactttagaaaatacagccaaatatctacagtggcatgtatatatcaaacaattaactgttagggttggcccattgttatgtatcgaactatccttaagcaactcatatcttgttttgttggatgcaagggagtaagtattgtcctcctatctaatacttgttcccttcttccaacaaaacaagtagataggagttaccaacaacaagcttctacggctagctagcaatgaaaagttcagaaagtttaaaaggaagatttgaaacttcaaattattatttttaatttcagccataatagatatacatatttgcaaaactacaaatatacatggtaccatgcatgattgtgctttcaatattttaatttttatcagggataaacgaaataatatttctcgaactaatatatgtaaaatatgtcttaactaggaacatgaaaacaattaacatgttgatttttcattcagttaacgtaaatgggaaacgaaatttcaaactgataatcgtaaatctgttagaagtggagtactattctgcaatgcaagcatatgtacggttatgcaaaaaaaaatttggtgatgcataatttggtggaaacacaggtttatttttgtgaattcgttttgtcttgagatagggcatcacgccattgacaccgctctcgatcagcatcactattactcctgtttctcaatgcatggggatccactcaacaaactccaacaccagaagcaaactaatcgtcatcaaatttttattatagtgtttctgggtacaattctatttcagtatttaatcgttcttccacttgcaattacaggtgtaatgaaatataaacccaattgatgtcacattagtttactctcttggagagaacatgcatgcatgcatgtatttttcctatggagtgcgtgcgcggtaatgtaaattgagaaacggcccttacttttctaataaaagaaaattagaatgtaaattctatcacggtccacacacatatgcatagaactgtcaaatgatgtacgcctaatttcgttcccatcttcttcctcttctctctctctctctctctcactcttttttttttgcgcgaaaccaccttcgttaatttgactgggtcacagcatcactctctaaactcatgttttttaccattcttaactcatggtttcgtacctttagtagttttaaattaaacatctgtaggtgcatacatatgtacatggttttcgtcatgatcgtgtgttttatgcgtaaactacaacgccgcgtaaccaaactttcttgtctgctgtcaaggaaatttaatagcattttcccttatcactaaaatagtactaaatttttatggcaatcaattatttaaaagtttcccccacccaaattcttctgctctgggcacgacaccagcgtcaacccaagccaccactggtttaagcaaaatactccaagtcccatttgaattttcttgcaggtattttattatttgagatattttgtaggctttcaataattttctataattccttgtagaaagtgacttttaatttgggataaatttatcatgggatgacattatccaagggccaaggaaacccgggaacaatattaatgtgtatgcaagggttgatgttgagcttgtgaagcccaaggcccaagcacatgaatgagcaattaactagatatcccaactaaggaatacatattatcatacatattatcacaactctgagacaggccatacatattatcatgtggcatggcgaaagacggaaagagctaatatcgttccaatgatgaggagttatatcttctttgatacatcttgggtacatatcactagaagagaaatcacctaaaccacggaagaagagtccgaccccaccgccccctccgtcgtttccaaccaacaaaaagagggagagtggcagtacttcgaccatgatcgaggaaattaacatcatcacaaaagcgtgatccactctttagggttcctaaggagatgagtaggaacataatgtcgctcctcatgctagaagagaagaaaaaggaagaaccggtggatcctttgggcggcggaaatttcttccatgccatggaaaagagatggcgctccggaacctcctaagtcagattttacatggattgtataggaaaacagcacctgcaaacgatggtccacttgataaaaatccaaaggccaacaacgaacctgtttataaatatcgattcaaatcttctttagtagtcaagccaacacagataagcggtctatagaacgagatgaggattgagcagatttgttttttctttttgacagtaaacaacaggagagactcctaatatgctatatcaggtataagtataacaggaatattacagggttacaaagaaaaagaaaaggaaaatgaatttacaacaagaggattgagcagattacatggtacatatcagacttagaaaaaccactgccgccaagcctccccaccgccggatccggcactgtcaagactccccaccaccggatccaccaccgccaaggctccctaccgctggatccgccgccgccaagcctccccaccgtcgccgccgcaattcccgcccaccatcgccagatccgcctcccctaccaccgccgctgccgaatctgcccctctcgaggccagtctgctgcggatctgcgagggaggcgtagaggcccctccaccgtcgccatggttgacctcatccgtcgccaccatcgcaccactagccaccaccgccgccaagagagagaggagaggagtgggagatcgaaggagatgagtagggcagagaagtggaggagaggagaggagcggggctgtgggggacccgacaggtattttttttaaggtggagggaggccggctggacttttcgtaggcaagcctcttaacaggtccgcatgtgaaaataaccctattttcgcatatagacatgttaagaggcccgcctataaaattattttttatatacaggtctcttaaggagcggtatgtaaaaatgttggtcaattttgctgacgcgacaagttactgtccatctgcaaacaaaaggcggtctcatccagaaaaatcgtttttaagtagtgaaagatgctaatattgttcaaacatattatgaattctgttcgaattacattgcactcaagatactaattaattaaggcactattactcaattataataccttatccttgattttcaccttgtacacacataggtgaacaaacaaaagctgtttttatatatatatatatatatatatatatatatatagccatgccttttctgtcagtctttgctactgatttaattgcagtgatgaaaagtgacattgctgtggagagagggttgaaggtagcattgagcaaaccctaccctaagtaattattgctttgacgagaagaaatttcagctagttgctgtaaccgcgatatttgcataaaacatgaaaaataaaaagaagctaaaaaaatggaaaatcacttaaatatgtgtagaaattggggaagaatatataggacacttgcaaacctagcttgttgatgtaaaatacaaaaatgaagctcaatacattttttctatttcccaaacaattatcggttttgccctcaaatttaatttttttccttactctttttaaaaaaatttcttcaccatctaccattaaaaaacaagaactacatccataattttttttattttttccataaattgaatttgctcaaaatttctcaaaccctaaccgccggtaaccgatccccttccccgcggtaagcacgataaccgtgattaccgcgcgataacgtgaaagcctggttacggtgcgtatacctatattgtatatagatcatgttaaagttacacacaaaaaaacaggtagcgatctcaaaaaaatatacccaaaattaactaccaaagtcattcttatacagtacacattattataatattttcaccaatttgtgtatggtgttgtagacatacttgaactatttaacatgccctatattggcatatacttttgaattttttttcttaagtatagaaaaagagagtagctatataacattgaagacttttttgagtcaaaaagttgcaaatataactatattacaattgtggagtgtaattatattataaccataataacttatatgtaactggaatataacaatcacaaatgtgtgctgacacatagtagttaagtgttcgtgatgcgaagtggaggtgctgagttcaagtcttgcacggtttttattacactgtttctatagagaatacctaacggtctagaaattgaaagttctacccaaaaaaaacttttgacagtaaactagcgattccgtagaaaaattctaatgagttttcgtgcatacacaaaaaacaaacaaatctctacccatactctgataccatacaatgaataattaacgcttattattgcatatattagtacgtattattacaaatagggaaacacacacaaaggaaatctctcacataatttatttagttccgaatgaacatgaattactaatttactgctcaggaagcacataagataatatcaattatgcagccttgtaagtatacaaaatccttggcctgttaggatgctgccttgctcgtgtttcccaactttcctttgtgtatctcgagacctcagagtccagagttacttctttaagttctcgaagatcttcgatttcaataccagccaaacctactaggtgtctgcagagcagctggagtgacaccaggtcccgcagtgctcctgcttcaatcctcgggaagacagagacttgcaccttgaagcacaggcgtcgcagactacggaacgccccttgtggtatcacaaattcgtcaaggcaatcgctgatcagtttgaggtataacagacactttaggttatacagatcagagagaacatcccgtgtcacggtaattgatgaaaggcacagctcaacgagacctgtatgccatttgacaaaacggggcaacgaacgaagctcgccatgtagtttcagcgaagtgagctcacagggagtatcgagagaattgaggaggctgccggagaatgtttgcaggcagattgatagtttacggttatcgccaatatacaagggaggattgatgtactcctggatggcctctgaaagcttacgagccaagatactatcatgatctcctgcagctgatgactagcaccatatcttaacctttttcaaattgctcatatggcccaatatctcaagaaatccttggctcttgaagtcggcgataaatcccgataaggtctccaatttactattttcagataactttttgagcgtactcttgctatagccatgatattgaatcctaaactttccaatcagatggagtaagaagggcaaactaataacttgcacaggtagctcctctacactcgtcttacttagacagagcgtttccaaaagtttcagttttgctatatctttaggaatacttgtaatttctgccccaaggctgagatacctcagattgaaagaccaagaacggctatagagggggggtgaatatagcaattcaaaactttcccccgaaaatactcatcaagctggatttctcaaaatccttactagaaccgcggctattagagaagccggatctagaaaagaagagagaaaaagaagagagaaggaattcccgaaactagaagaggaagagaaaaggaattcccgaaaactagaagagaggttaggaggagagagcaaaactcatcatcgcaaagttcaaatttcaagcggaatttaaattgcggaatttaaatggacaaggcaaaaacgaaatccttcaaatcatttcattcataggtgatgcaaaataaccgctcaactaggagcaaacaaacaccttcagaggaacaataacacaaacttaaaatctctcggacaaacacactccaaactaatcttaatacaaaagcctctcgggcaaacacactccaaactcacacggaaactctctcaccgagcatctcaaaaggattacaaaaggagcaacctccacccttgcatccatccctctatttatagcctaagacccctaagacattgtctcaaatacccgtggggcgaaaccctagccttgataaaatcctggatgtccattgttccttagatccgaaggaaacctcctggatagtcgccacgttgttgatccgagctcttcacgtcgcgtgccctcgtgcgatccgcgtgattccactccaagccaatcagtgtacaccgatccgcgtcgtgctcctccaagccaatgcatccgcgccacgcgtcccagagagcccgcgcccgctcctctcgcacctgcgcgccacaagtcagaagccgccatgtcgccgttcctcccgccgagccgcttctgcgcgcgctcgcgaaaaccacgttcccgcgcgtctccgcttccttgacgaacagaaggccgccacgcctccaggtgccgtacgatctcccgcctccgcgcgcgcatgcacacgcctgtgcatttgccgagccgagctgggccgtcgtcatgtctagggtctgctcggcctggccttcaccatcttgagtcagcaacgtgcttgggccgaccgagctcccgagctggacaggccggattggccttcatgccaaccgagccaatgatctccttgggccacgtggaacggctggattggcttggcctccctgccaaccaatcacagcacacatgcacagcttctgcaagctcctccttgcacaagtacattacgtgtacatgcaagtatgctacctacagtaagtccatttactgtagcagcaatgcacttgcacagtcccttctgatttcttcgcgaatccgatgcttgcacacttgaccttctgaagcccgttgcaaagacctcctcacacggtgttcgtccactgtgtgcaaccttgtgtccaatcttgtcacctggcatccttgatcactttggacctcaactcctccctgagtctagtcccgatccgccgttgaccaagatcgactccgatcacctgcacccacatgaaccaaacaaccgttgtcttggcacagatgtcgcaacctgaccaatgttagtccacgcacacacttcttgcacttccggtacttgtcaatttcccatcacaaaagaactataaccacacatggtttcacaatctctctcttgatgggaacattgacaatctcaagcaaaattttgaaaatttgatttttgattcacaaagcaaaccattttgcaaaagtcgaactttggtcattttgaattcttgaaaaatcaagaccaagtgacaagaagaaaagggatgcaaatgcaaatgcaagaatgctccccctatgtgccaaactccccctttcaccgagatctaaagcaagttttaattttcaataagtgcaaatttctctccccctttgtcaatgatgccatcaagatcaaaagagacaaaaatgcaagataaaaatgagatgaaacttgcaaattttagtgttttgagagctttgagagttatctaaaggcatcaaaaggtagacatggatcacacagatacaagcatgtgctcaagcctagctaagcatgtgcataagaagtatgaaacatgtcatggatatcaagttagtatccccagcaagcaaaaagctttcaagtgaattagtgatttagtgtgcaaagctatttctagaagaagcttaaaaggaagcaaaccagctcataatcatgcaagatttacataatcaaagcaatgaatccatgctaatgtgctaatgcccagttcataaagagtatcaacatgataacaaagcatagaacatgagattttaatcttttctcatgacttttatttttatgattttttttaatttctttaaagacaatagcacaatcacgacggtccacctgatcttatcagtcagcaagtgatggttgtgccaaacactgccgtctgacctcaatcaagttttccagctaaagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatataaacatggcatgagtatgagatggatacttcaatttaaacaaacttctagagcaatcattgcacattgattaagttcaaatgaatagtcaatttaagcaggtttcaacaagcttgaacagcataacatgatcacataagctacttaagcaaatgaaagctagacaagagatcaaactagcataagagtgacacatgcatagcatagtgatgaccaagagataacaagcaaagctcaattgaagaatgtataatacaatgcataaactaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaactctagcacaatggtacctttctcaacattgtctcggagaaagtggtaccgtatctcaatgtgcttggtcctggagtgttgaactggattttttgcaatattgattgcacttatattatcacaaagcaaaggaacaccagagaaagacagaccataatcttttagagttgaaatcatccaaagaacttgactacatgtactagcagcagctacgtactcagcctcagctgttgattgagcaatagaagactgcttacgagaggaccaagagaccaaagaagtgccaagaaaatgacaagtgccagaagtacttttgcgatcaatcttacacccagcaaaattagcatctgaaaaagctcgaactgaaagggcagaagagcaggagtaccaaataccgtacttaagtgtagacttgatgtagcggaagatgcgcttgactgcttggcgatgtgatgttcttggagaagcctgaaaccttgcgcacaggcacacggagaagtggatgtccggccttgacgcagtcaagtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaagagctctttggagtacttggtctgatgtacaaagattccttccttggtttgcttgatttgaagtccaaggaagaaagtcagctctcccatcatgatcatttcgaattccctgctcatcacatcagaaaactgggcaacaagtgcatgagaagagccaccaaatatgatgtcatcaacatatatctggacaagaagaaaatcaatgccactatgaagagtaaagagagttttatcaactgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataacaccattcagaaaagcatttttcacatccatttgaaaaagcttgaaaccttttgaagcagcaaaagccaaaagaattcgaatagcttctaatctagcaactggtgcaaaggtttcttcaaaatccaagccctcgacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaatgctgaattgacaagatcataagaccgatttctagttaccctttcacccaggcggatgtcggttctagatgtgtcggggagctgtcggtcctgatgtgccaccattaatctcctcagctgctgaagatgatgtagttggtgcatctcctgaaggcgatgtagttgaaggagaacctgtttcttgcactggtggtgtactgtctagaggtggaggaatggaatcatcgtcatcatcatctgaatccttatccacaaagatgctttcatctggaacacctgaaatttctggtctagctcctgggctagcctcatgaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagtagaaatagcttcagtccagaactttcttggagtcgtaaactcatcaagcatagttcgtgccatctccacaagggtgcggttcttcctctcaaccaccccattctgttgtgggacatatggtgaagaaaactgatgttcgactccagaagaatcacagaaagattcaaatgcagaatttttgaattcagagccattatcactgcgaatggctcgaagagcaccaggaaactgcaaagccaaactacgagcaagagactgaaagaagccacatgtttcctcctttgtttcaagaaaatagacccaagagtagcgagagaaatcatccactacaaccaagacataccacttccccccaactgactggacctgagcaggaccaaccgtatccatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtaaaacagagagcaaaatgtacttaagcttacttacaagcgcgacatcctttagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtctacaagccaagaattacttctccccactccaaaatcctacaagaaagacacagcagatctcgatgattcagtactggggttagtgagaaatgacttagtaatccagtactgaaccatgcgaggagtacaagcatctttagtgttatgagcataattatatgcaagatgaccatgtctgttttgccccaaccctgctaggtcacatcgagggtgcacatctcggcgaggaaagcgagatacaccacttgaatgacaatgacacgcacactcgaacctctcagggactctagcagctcttctagtcctaagacgttcttgtcgcttttttctagcctttctaaagcagaaacctaccaaatgaccagctttcccacaataggtgcactcatacttggttttctctacaggcttggtttgtttctggttttgcttgtgctcaacttgttttggatttttgggtctaggtaactctacagacttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtacgagttctctctcttagcggactcaagatcaactttcagagaaatgcatgatgaacatgaatcaacagatttgacataatcaatgacaattttagtatcttttagttcagtttccaggataacacaattagcacatgaagaatgaacaggctccttagtagcataagattctagcaaatcattcttggtcctaagcatgtcaacttgttgtcttaattcatcattgtcactagtgagaatgggacaattttcacaactacttatcctatcatgaacaaaattttcttttagttctttcaattccatctcaagcaaactcatatcaactttcatttcatagcaagtagagcaagcagcactagcactagaaggattcccagctcctaaagcacatgatttcaacttatccttgaggagattaatttcagaaagatatgaagcacaagtagaacaggtatcctcctcaggaatcatggatcgaagcctagcaatttctagcgccattccatcattttcatattttagtttctcaattttatacttagaagacctatacttgtcactaatttcaatcatcaagtgtgtcattctttctttgcttagttcatcatcaacagagtcattatctgagcaagaatcatcacaaagagaaccatccaaggaagggatatcatcaagacatacctcatgatgctccgatgagtcatccttatcctcaagtgccatgagacacaggttgatgaagtcctcgttgttggcgagacagtacatcccggagaagtccttgtcccccttttcttgatcatcgtcgtcggagtcgatgtcgctaagctgcacctcctcaagagccgccaagaccttgtggatcgccttctttatcaaatccttcttcccctttcgcccttgtccctcgagcttcttggttgtcttgtcactcttcttcttcaacttgggacaattcactcttatgtggttaggctctccacactcaaaacacacaaatggttcattggtttttcctccttttctatctctcacatttttgtaagctcttgagaattttctagtaaaaagagcaagatcatcttcagggatcttctctaattgctcctcagtgactgagtgtaaagcggcaagagagaagccaccacacacaaaagctaagtcattagaagaagtactaccagagggatcagctaccaaagccatcgagtgtttgaggcctttccgatggaagacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaacaatttcttcaaaacgcttgaaataagaatcaatggactctcctgggtgcatctcaaatctttgatattctttatgaaattgattctgacgaaccaattgaatatcattgtttccctcatggaaattgcacagagcagtccacatgtcatgagcggactggtggtgttgaacacgattaaattcaccagaagaaattccaccaatgattgcatttcttgcacgataattaaaatcaacttgagccacatttgcaggcgtgatgtcagcatcatcgggcatagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgatactaattgaaagaccaagaacggctatagagggggggtgaatatagcaattcaaatctttcccccgaaaatactcatcaagccggatttctcaaaatccttactagaaccgcggctattagagaagccggatctagaaaagaagagagaaaaagaagagagaaggaattcccgaaactagaagaggaagagaaaaggaattcccgaaaactagaagagaggttaggaggagagagcaaaactcatcatcgcaaagttcaaatttcaagcggaatttaaattgcggaatttaaatggacaaggcaaaaacgaaatccttcaaatcatttcattcataggtgatgcaaaataaccgctcaactaggagcaaacaaacaccttcagaggaacaataacacaaacttaaaatctctcggacaaacacactccaaactaatcttaatacaaaagcctctcgggcaaacacactccaaactcacacggaaactctctcaccgagcatctcaaaaggattacaaaaggagcaacctccacccttgcatccatccctctatttatagcctaagacccctaagacattgtctcaaatacccgtggggcgaaaccctagccttgataaaatcctggatgtccattgttccttagatccgaaggaaacctcctggatagtcgccacgttgttgatccgagctcttcacgtcgcgtgccctcgtgcgatccgcgtgattccactccaagccaatcagtgtacaccgatccgcgtcgtgctcctccaagccaatgcatccgcgccacgcgtcccagagagcccgcgcccgctcctctcgcacctgcgcgccacaagtcagaagccgccatgtcgccgttcctcccgccgagccgcttctgcgcgcgctcgcgaaaaccacgttcccgcgcgcgccatgtgaaaaaccgcgggggacccggtcccacgagtctccgcttccttgacgaacagaaggccgccacgcctccaggtgccgtacgatctcccgcctccgcgcgcgcatgcacacgcctgtgcatttgccgagccgagctgggccgtcgtcatgtctagggtctgctcggcctggccttcaccatcttgagtcagcaacgtgcttgggccgaccgagctcccgagctggacaggccggattggacttgatgccaaccgacccaatgatctccttgggccacgtggaacggctggattggcttggcctccctgccaaccaatcacagcacacatgcacagcttctgcaagctcctccttgcacaagtacattacgtgtacatgcaagtatgctacctacagtaagtccatttactgtagcagcaatgcacttgcacagtcccttctgatttcttcgcgaatccgatgcttgcacacttgaccttctgaagcccgttgcaaagacctcctcacacggtattcgtccaccgtgtgcaaccttgtgtccaatcttgtcacctggcatccttgatcgctttggacctcaactcctccctgagtctagtcccgatccgccgttgaccaagatcgactccgatcacctgcacccacatgaaccaaacaaccgttgtcttggcacagatgtcgcaacctgaccaatgttagtccacgcacacacttcttgcacttccggtacttgtcaatttcccatcacaaaagaactataaccacacatggtttcacacagattccataacttgtgtatatttttcaggtgcttgttcttgacatcattgcattcttcgagatccaggactctcaaaaccttgtacctgtgaaactcgcaaatggtgtcacctgccgtcccgaagatcgtcaaagaccggacgcatgacaaatccatatctgttgtagttctgcgcttgtgaggtgtcctatgatcgatacagagatgacgaactttccttcgccagtcaggaaaggacatgatgaacctctcaagtctcgacgccttgtacaacatatactcgtgcacgatactgcgagtcttgcacatcttgacatcgccattattgcttgtgtcaatgataggatgaaagatgtcccagtctacaaacgtctcaaaattccaacgtgcaatagtctggtcatcaatgtccacatcttcgctccttgcgaatccttcagctatccaacgcctgattatcactttcttctcgagcggaacatcgtttggaaatatgctcaaatatagcaagcaggccctgacaacgtggtttgaaagacttgtgtaattatccatgatcacgcctttgagtctttcaaagttaccattgtcatgtatttttgaacctaggtagcgacacaattcgcgacagcgctgcccagtaggctcatttaaacctcccaaataattggccacacaaacaagggaaagtggatggccatcacatttcttaagtagttcttccgagcccatctgcaactcaggtgaaggtgcctccccaagagctattgtcttgcagtattgatcttcaagattttgcatttggtatatgaaacctttgccattgccacagcaggtattcgcttccgacttaatggttgtggtaactattatcctgcttccgttgtttctactattttcttcgaaagctgattttatagaattccattgcccattcccaatgtcatcaataacaatcaagtatctgacaaatttctgacaaatttcgggtaagagcaggtacaatagcaggctataagccaactgcaaatatattttaaggagataaacgaggagagagaagagcagtgggctacaaatttgtagccagctgtattacggactccaagacgcaatgtgtttatgataggtgggaccagttattgatagtgtagtatgtaactattatatgaatgagctattagattggctatagatgaattagagctagtagttgactatattattaaacttgctctaaccaacggccgggcgcaaggttcagcgaatgagtggttttacgatcctcaataaagtactcaatgtagtacgtaaagttccaatacattctgaatgaccgtaaaggtgtggatgggtaatgcgtgcaactgggaaacagctacagaaattctctcaccttctacccctgaggtagtccatgagctgggcttggagatattgctcgtcatcgaccaataatccctgaccccgatagccaaattgctggagtaatgatctgaaaatctcccccgcatttttctccttggctcgatcaacccatgcacggcaggaacgaaacacccggattctatcatcatcagttgagcggaacactgccttagcgagggtcgtcttgccggagccgccaaaacccacgatggcgataaccctcagctcctccggactttcctccagcatcgcgaggatgtcccccttggctccctcgacgcccacggggttgagttgaacatgttcgcgttgttgtgccgccgccggcgccagtggcggcggcggcgggggcttgtcgtagacgaactggcacaggcgttcattggtcagctcctcgaggcgcctgttaagcgccttgatcttgtccccgaaccggtagcgtgtgcagatggtgagcaggaagcgccccagccggcgcgcccgcgacgctccctcggcgcaggacacgcggtggaggaagcgctcaatgcagtcctccatgtcgtgcgtcagctcgcgcagctggtcgccgaacaccttggcggcggccgtggggttcttcgtccgccggaggtcgtcgtccatggaagctgcgagcagaactagtttacgtctcattgagtcgctatcatcgatcacgttcatgaccatcttacaactgcctgacagcaccttaaacagcggcggcatgacagtgttcacgaaggcagttatcaccgctttctccatggtctctgctgcctcaatcatcgatcgatacaacactaaattttggtactaacttgatctagatcttttttgctcggtatctgagattctgaagtggtgaagtgggggttgaaagtgttttttagtgaatgaatggtgctagaaagacgatcgaccagaagggtataaatagtggagaaccttagaccgggtcagtacatagttggttgcttggcaaaccgaatctctgatacataatccatgtcccacagaatcacacatatctaacccatgtcacgcagaatctcttgtatttaataccatgtcaaaccgaatctcttatgtatgattatagctgagatatttttagatgccgtacctttcggatccacggagaccatgagggacagtaggatttttttaaaaaaattacacagtacaacgcagacactcacaatggaggcacgtaaactctacccctatgagcatcttcgaagactgcgcaggcaaatccttgagattgacgaagtcaccacaggcgcctcgctgtcgacgggtacgtcgcctaccactgaaagcacaagccgttaaatcatggaaaatttgctcccatggagagtcaaacccagaaccttatgtgctactgagactcttgtaaccactaggttattgaccctttcacggggatagtaggattgtgataattgaagagaaggtgttgtcgtacctttacaagttgtgagggtgtactattacaggtgtagaccagaaggaaacagtaattgggatagctattgcttttggtagcggtgattctggcataggctcatcaaccatctcacgaggaatctgcaagaagaaaaccccaagtctagtggattggtgaatccacatgataattctactacttgtgggtggcgttacattcagtgaggtggagcatgttaaaataggtgccgaatatacttgtcctaataggttgtagttaaacttaaagttgtaatatatggtagctagagggtggggttagcatcagactccataacccggtaaccctttaaataaaaatgggggcacccactactagagaaacgattttttatcctaaaccccaaaacacaaatatcctgactagatcaagaaccggtactaaatatgctttagtaccggttctaaaagttgaagttcctaaaactatgtttaattccggttggtgttaccaaccggtaataacgatgcaattttagcaccagttggtaataccaactcatactaaagatatttttagtaccggtcggttggtaataccaaccggtactaacgatgtctctgggatcagttcaaaaagaaagcatctacattcaagtcagatgtgtatagtagtaggtggaatggtaacgtgtgtgaggactgagttgatagatcttgagttcgaatctcacatcccacactttttttttttgacttagtatgcatcttttgtactcgttctttctaccggtactaaagatagtctcgatttactggtctcggttgctacagccggtacgaaagggggttttaactagtattaaagattgtttctcctgcagtgaccaccaatgtaacaatcatgtcaataatgtaacataggcacgcagaaagagaatggcggcgagaccatggactcatagcagcaaggggtgctagctatgttgattacagaggaacacccataattagagtcccgtgcattaaacgtatactaataacaaaacaaattacagattctgtcggtaaactgtgaaacaaatttaattgttaagcctaattaatccatcattagtaaatgtttactgtagcatcacattatcaaatcatggcgtaattagggtcaaaagatttgtctcgcaatttacatgcaaactgtgcaattgattttttttatctacatttaatgctttatgcatgtgtctaaatatttgatgtgacagaatttttagaagtttgaagggatctaaacactgctatagtccttatatatgcttcctaattagcacctgtacgtgtatgaaaaatcaatgttgagactaacaagctagcacaataattactggagtatctacttgctaccttacccggcccacgtgttatcatgggaaaatttggagtaaaagaattaattaacagaattagaggaaaaactcaagttgcaaaatactatcacatatacatagaacctaagctgatgaatatataccatcagtccatcacaaagagaatttgagttgaaaaataccattaccgtgatcatttccacccagggaagaaaatgactaatttgccccctgcttttttttcttctttgtttcctgtgcttgctatacttatggctctcaatttcataatattttatacagactgcttgccttatacgtactcccttcggtaacaaataagtgacattttagaaagcaacaagattaccgaaatgatcaatattgattgctagtataaaacctataaaaatatagcaaggacgttctaatattttgaaactcctttttgttttcaaagacaaatatacctatatcaatttttaaaattaaatcgaaatattttaatagaaattgatagtaaaagtttaaacacaaaacacattgacttgatgtattcaagaacatcaattattgttgatagggatgcagtaaaaaaataatatatttatttaaaaattatgaactgtactatttccttgaaaatgtttttattgcttatttcttaaagactaaattttataaaactacagatattttggctaaactatcacaaaactataaatttaaaatgtgtatcataaaactacagatttaacatgaaatttatcacataactacatatttaaagcattgtatcacaaaactatgcatttagaaatgaaattatcaaataactacaaattttagagtttatatctatagcactgttgatgttacaaaagttgtagctttctgataaaactgatgttatactatatatatatttaaatctgatgttaaactgatgttatatatgctcatttataaaattgtagttttctaatgatactttcaatctatagttttgtaaaaaaatatggttttaaatctgtagtttaatttgtaatacactttcttaaatatatagtattgtgatatattgatcaaagtacattaattttgtaaaatttactctttcttaatttttgcattagctgattttctaaacatttccaccataaattaaatgcgagatttgttaaatgcatccaaacgcgacttggaatgttgagtattacaactgagtggaaaaaaaagggtagtgttggaattttcaaaactctctctcctaaaaaggtattaattgcagttttggatgaaacagtaatggtaccggcattttccaactcaaatttccctgtgatggtattttgtagctgatcttcttgtagtggtattttccaacccaacattctttgcaacggcagtgatcaaatttgcagaagatttaatgtggacaagtagaaaattttcagaaattagttaaagattggaaagtgcatttagtaagatgggtaatgagatcataaccttcaacacaaacagctagatcataacctcctcttgtgtttccaaaaaaaaaaaatgttgtggagaattttatctgactaatattttttttagaagatgtattaaaaactcggtctctacaagtacatagccaaacatacattgtcaagagtatttagtttttggggcaatcgtatatttgaccctattttgaaagcaaactaccaaccaatttgaccttatttttttaactttgcttttttttaacctacttttttgaccctgctttttaactatcgacatcagacatgaccccatttcgtgaaaccaacttgacagtgttaatttgaggtcgaaatacctttatatccttactcatttgaccctaatttttttatacgctttggtgtacatgatgcaatttctaataaatttcacttggaattgatatgtcttgtgcgaatttgaattagatttgaattttagccaaaaaaaaacaattgagaacgcaaattagatcaccacaacaaatggttccggaacaacatgccagcatcgattcaaatccatatcaacatgcaaacaaatccctgctaagaacatcatccaacaataacattcaaacaagatcacaaaaatcaaacaagcgctggcaccggcgcatccagccacagccgccgctccctccacatctcgccgccatcactccctccatgtgtcctcattgtcgtcgctccctccgtgcaccgtcgccgtcgccgtctgatctgcccatcgcctccctccgcacgccggcgccgtcgccgtcaccgcgcctcctccttgcgctgccgtctgatctgcccatcgcctccctccgcacgccggcgccgtcgccgtcaccgcgcctcctccttgcaccgccgctgcctcctgctcgctccccacgtcggcgccagcgccgtcgcctcctccttcctcgtgccgctgccgccgagatgtgaatgagagattggttgaagacttgaagtgaaatgtatgagggtattttggtcactttgaatagtaaaatgattctttttcttttcttttttgaaaccctaatggcatagtgtaaatagggtcaaacggcatgctcgattttaaaaagcggggtcaaattagcaaactaaaaaatgtagtatcagattagtagtttggctttaaaacaaggtcaaatgagcaattgtcccttagttttttctagaccaacatgcttattgcttgtgctttttctctctctttttttgtcggaggagacttagaatcgggcgcccgatccaggcgtccaaaaatcgggggctgacgtcagcatgatgttagcgccacgcatgtgtgaaaaaccattttaaactattttttatcttaaattatttatcgaaattatgatctgattatactattaaatttgttgcaattaaatcttcaaaacaagaccacacatggatatattccgacgaaattttttagcttattattgaattatattttaaatgttgcacgatgttacaccaagtatatcggaattatttcactaagtagatcgaaaatgttcaatcgtttaaatcgggcgttgtttcaccttatataaaaacaatgtttcagcaaatagcgaaagaatatttcagttcactgcaatgttagatctatacatagtaaaacattataagtacactggattatttttggtggaacaaaaaagtgaaacgaattctcataatagagggttttgaaaatatgttggtgatctgttacaaaataatgtttcagttcattgcaacattagatctatacatagtgaaacattgtgagtaaactaggtgaaacttttttttttcgaaaaaaaaataaaacgaattttcttaacagatagtttctaaaatatatgggtgatttgttgcatggagttgtgtgtggacaaatgattgggagcaggggacacgtgagtgaggcctagaggggcgtgcatcttggggcgagggagcgcctgatttcggctaccttcccccaagcgaccgattggaagaaatttcgtttttttccgtaattattgcggggcgtcacacaccaccaatccaccgtgcaccatgctcccctccggcctcgcagtcgctccgcctcccataagcctccacgccgccgcctcccgcacgggccgacagcggtatgcacccgtcgaccggcgtgcttcgatgggccggagcaatccgccgcggcccacccgcgccgcgtggtggcggacccgacgccgcgaaggcgtccctcccctcccctccccgccgactggtacgacaccgccgcagtcatcgtcgccggcggccggagcagctaggttcggtggtagagagaggaggaagggagagaagaggggaaagagcctgaggaggaggaggcctcggtaggcatccctaacgccaaagggggaggaggcgacgaggccttccgccaagtgaagtcatccgaggagccatccgccgcccggaaaagtccggtggcgaagaagccgagccggccgcatggggggagtggggggccccaaccggcgtgttccccgccgacatctccccgcccgcggccgcgaatcatgttgctctctccctgtcacttcacaacacgcggaggcagcagcggccggtggtgcggggctgcgggcttcgtctcggcgggacggacggcagcggctgggtagcgtcgcgagcttggaccccccggcggcggcggcgtggggagggcggtgagatcgagtcctgcgacgtcggggtcgggctgtggctgggaaagtgcgacgagaacgagcacgcccggtggcggttactggaggagcacgtcgaggtcgggcccttggcggcggcaaggtcaagccttggcttcctgtaatcaaaggtaaaattttccgaaattcagcgaagaaacggtagaaatttgcatttctaaaagtggcaaatagttaaatgcccctttgcaattgagcctaatgggatagatgaaaaaaattgagagtttgaagtacaattatttatttctacaccaacggcgtttcttctctatatgttacaatcatatttctactcagggagaacctgtcaatatcttctagttgaattcatataacataaacaccatgcgctacttggcaggtgcctcattgtacttgataatgtgtggactgtatcaacatggaatgttgttagacatgctttacaagaggattgctgtagtagaatagtagtaacaacagaaattaacgatgtggctcaggcatggagtttttacaagtctcaacataatgcatctcacgtgatcaagaagcatattttgaagatggaaccgcttaatgacgatttctcaagagatttacttgttagtagagtttttggtgataaagacaaatgtcctgaagaactcaatgaagtttcatatgagatagcacgaaaatgtggcggtttgccactagcaactatcgctgcagccagtcttttattgagtcggccagacaaaccagatgaatggatctatgtacagaagtcgttgattccagatttgaggatacaacctacttccgaaggaatggcacaactactgaacaatagcttcaacaatcttcctcatcatttgaaagcatgcatgctgtatctgagtatatataaagaggatcacataatcaatccggacgatctggttaagcaatgggtagctgaagattttgtaagtgcgacggaagggaaaagtttggatgaagctgcaaggaatcatttttatgagcttgtccataggggaatacttgaaactgaacatatcagctgtagtgatgaggttgtatcttgcacagtgcatgacatggttcttaactttatcaaacgcaaggcaatggaagagaattttgtcactgcaattgatcattctcagtctggtataagactagcagacaaagttcgacgactctctctccatttcggatattcaaaagatgcaaaggcaccagcatgtattagattgtcacaactacgatcacttgtgttttctggattttggaagtgcgggccttccatttcggagtttcatcttcttcgagttctattccttcatggtaaacatggcgaatttcttgacctcactagaattcgtgaactgtttctactgacttatttgcagattgaaggtaatgtttgcatagacttaccatcagagctccaaggactgaagtatctcaggactctgcatattggtgcaatggtgacctttttgagatcagaagttgttcatcttccgccgttgctgcacttcagacttccacccaatctagggtactttgttgacgcagggagtgtacagagtattgaagaactgaccaatttgcaggatcttcaactcgcatgtcctcagatagccacttctgaccatattaagcacaacatgaaactgttgggttcaattattgggatacttaagagcctcaaatctctaacagttgttcctgtctgcttctctgaagattctaatgataacgaaaattcaagcattgccattttcttggatttcttagataaagttccccccccttgtagccttctgcagaggcttgagttgtttccacgtgtttgcgtcttccatagacttcccagttggatcataactattgagaaactctgtattttgaaagtagcagtcatggaactcctgaggaaagacattgagactctctcaatgctgaatgccctcactgttttctcactgtatgtccggacaacccctgcagaacctatcatatttgacaagtcaggattccatgttttgaagtacttcaaattcaagtgtagtactgtatcaagtctgagatttgatgaaggagctatgcccaacctccaaaggttaaagatggaattcaatggtagcacagtggagcaatacaaccttgaaaatgtgggcttcaagcacttgtcaggtgtcaaggtcagcgcaaaaatttgcattgccggtactagtgaagctaacagaatggctatagcctctgtactgaacaatgccatcaggcaaaatacaagaatatcaagtgtaatcatacggttcatcaacagggttataaaaggtacgaatttacataccctactgtaacaataaacatgccctcttttctgtgtttatttgcgcaagatacactccttgccttaacattggaatttggacgagatgcacatggtcgattttttcgctattcaaaatattttatttgagaatttaactagggtaatcatttgaaccacatatctattttagtatgccatttggacatgcaaatttgacctgcaatcatccatttcatttttgttttaccaatcaaaacatcctactacctgctgtagtataatgtctttagttaggtcgatcaacagcagtggatatcccatatcctactacgtaattcttttgtacacatcatactgattttattatataaaagaggcccaatgatcagatcagtgacattgtagagatggtactgttgcaaagataatggaagcagcaaccagaaggtgtacacagccacattattacaagcgtgtgtgaaagttcattaaaatgataaaagaagtattcgacaggctagttaactaaaaaaaaaaaagatacataggctagctgttattaaaccaccatccaatatggttgaaaagttctgtgactacgctccaaggtgttgcctgcatcaaataccagatcatgcaactcctcacgctgaagagaccaaaccatagccagttggagcccataaagatgtaagattaggataattccttttatagaagaaaaataagtacattttactgtccgaactatttcattggaccatttaaccccctaattttgttttggctcattttacacctggaaatattaaaaatggttcactttactccctaacgatattaggagccatcgtttcgcttattcgcggaataagtgaaacggcatatttacaaacgaaaaattatttgtaaataaaacttttatatacgtgttctaagcgatctaaaagcaaaggctgaaaaataaactttgatgaaaaaacctcaaaattagctccaaatttaagattaaaaattcaaattttggctgataagtataagcataagcgaaaagttgaggcccattgttccttttcgtttctctctatataagtcatattttgcattgaaattttggtagaacgatagatgcattacaacatatgtcttgtgacattccggtccaatcaggattaggcctgtgtggtacatgagagctgtgtgcgcatgtttagtatcaactgcggtagtgtagcaaggttggaaccaacttataaacacggttttgtagggcgggctgttacacgtctcaacattttttagatttttccccactctttacataagtcggaaacagctaagactgatttaaatgtggagattttaaagttcaagccaacagtcaagaaaaaacttaattttttttttgaagtttgataatggtatcagggatggctctaaaaaaattcagcctaaaatacaacttatataaaaaggaaaaaaaaagagaaatgttataaaggagtaaggtgaaccatttttaatagtttaggtggtaaaatgagccgaaaaatagtttaggggtttagtggtccaatgaaatagtttgggggggggggagtaaaatggacttctttttctaaaaacaatatccttatgacgtaatccaatagataataaccggttggccgcaccaacgtacaccggcttattttaacttttagtccaaaccaactaatcaatttccgaataaattggacaatactagtggctggatccaaattaaaagctgcatgtacctcacgccacacagtgtgctgtatggcaatgaaaaaacaaatgttgaatagtctcattgtcattaaaaaacatttctagctgtgtcgttaatttctcttagcaaagctaatcctgtgctatatacaaacccacgttgtaagcaccagaaaataaggcttgatatttgaatgaacagaaaattcctttttctgatgtaagttcatctaaaagtgtcgatttcatgtgtcagtttaatattcatgagcttagaaactaattccttccaagcttatactttatcaccttctggctgtgggatatgatgttctaatatcgtgcttgcccatcatggttatggccttatggatattcagttctagaattatcctatacttacagatttgattgcctagttattcttctacctgattctaaatactaatcattttagacaagctcgaggattaagagtataggtgaaacggtttggttgcccttcattggtagcacattggatgacacataatgttcaatatattctgaatgatggagaaaataatattttattctggtactccctccgttccaggttataagatggtttgactttggtcaaagtcaaactagttcaagtttgactaagtttatacagaaatatagtaatatttataataccaaattagtttcattaaatcaataattgaatatatttttataataaatttgtcttgggttgaaaatgttgttatttttttctacaaacttagtcaaacttgaaacagtttgactttgtccaaagtcaaaatgtcttataacctgaaacaaagggagtagcatttatttagtaaaggcaagaatgggagaaaagcgaacataccatatgcaaatctgagctttaggtcacaagcatcgaaaaacttgaacattaagacaccttcattttcagactaagtgggagcttttgttagatattttgtgacctattaatatgagaaacctttcacctcttagtgttaactgtttatatgggattttaagaaaaaaccttcaattagccattataaagaaaagatactgtattagatctttatatggtcatctggtgtgctaattcttcgggctttggcacagatcttccgattgtccccacccctcacacggatcatatgcatgaaaatctgaggctggataagagtgtcaggtcctggcctacccagtgcgatggctgcaaggagcttggtgccggccacaggttcaagtgcgagcaatgcaactccaaggtgtactatgatatgtgctgcgcaacagcgcctcacaccctgaaacaccctctgttcccaggctccgtttttcggttcctccgaaagcctctggcctctgaatgcggtagggcctgtgatgcatgtggtgacctcatgcacggcttcgtctaccactgctttgagcgtggcctcgacctccacccacgctgtgcgaggctgcctgttcgcactgcaaacgtaaagggctatgtcatggagcttcgcagggtgtcggcttgcagcagatgttgcatttgcatgtgtggcaaggagggttatcgcaacaagttttggtcctaccgctccagtcaggaaggccaggacattaacgtgcatatggcgtgtttaaaagacttggcatcaaaatcacatgaaaccctaactaaactgtatgagatcctaatgggtgaatcacagtggacgccaacagaggttttaggcgaagatacatccgaccaattagttgtcagcaggtatcagttcataactagcgatcacaaaaaaccatccaaatttttgttctacttcgtccagttagtatacgactattattacacctgtttcagtgcggaggatggtgatcgtacgccactgagacaagatgaaattacagaggagtttcagcacaaggatgaagtatgtaatgttctagagcatggacgggaggaactccggaagaaagaaaccgataccaggtaatatatagttgatttcattactaaagaacggccaccatcaaatacaactgctattgcacagttggtcaattccagagctaatggtccacgctcatcgcagccactttccaccgctgcgggttgttcactttatttcttaaccctaatactctagtaattactttgcactcccacaggtttattttcaatttaccatgaaccaacattagttcaactcaagaacaattatcacttaaaatttgacattgaaacaacttaatctaaacaaaaatttcaccctcaccaaaaatttgaactcagccaaacatgcgttcatctattgactcataaacatttttcttttttagatgggattgttgtaatttgggtgacaccagctgacaagaaattcagaacacatagatccctggaattgacttaggccctgtttgattcagcttaggattattataatctggattattaggagtaagctgaaacaaacaagtagattattatgctagattgttataatctataagccagattagtataatccaataatctcctctagaggagtagaggagctttttctagattattgagtggctaaagacccactacccttagatgtctctaataattcagagaaacaaacaactcgcagcttattctatgttagcttattataatctaggttagaataatctaatttaataatctagattacaataatcttaagctgaagcaaacagggccttagaaatacttaaaagtcgataatgcaagagagcaggccattgttgatgagattcgatatttgttatgtctatgtccctcggagccaagtaaggtgactccggcctcttaagaatttatttgatgatatattgaggcctgagggttacatcggttggccatatagttatactccaataacaagaatccacatgctaagaattactattctactcaaactacaataccatagttttgcctgtaacagccattttgtaccttgatggggttctagtgtttgtatataactctaaaattggtcgacctacgattacccagctacccaacttatccatcagattacataacaaactgcctcggatcaccactccaatctgacttggaccacccatctgctcaagaatatttattctgacgtctgtttggataactttatctggctttagagtaaagatcgccaagacaaactcaatgtgggtttgcttagttgttctgttatgttgattgtggcctttgcagttctcttatcatacagttgacaatttgacatgtgcattttgaaagcagaataaagaaagatcataatacctagtatgtataaacaagtttgagtctagcatataattagattgaaactattatttcgtgtaggaaaaagcctagttattgtctctcaattatcttgttggtctagttttcgtcgctcaatttataaaccaggtaaaactattccctcaactatgcaaactagacaagttatgtcccttggctggttttgggtgtgacatgtcatcgactttgcgcgcccagccgtcctccacatcatagagctagccccacattagggcccttatcatcttttctcccttccctttcatatttgggtgttggtaaaaaggttcatgagtcatagccactattcgtcagagccggcatgaggtcctggaaaatgatgagttcagttgcaggtctgtagcctctccgctggtgtcagcaaagtggccaaccacagcatacacctacgtgcaatccatcctggtgcctgcaccagagctttttctttttatgaaggagcagccacgattaacatgaaagacaactgagcaggaatcggctgaatatctacttggtggcctcatcatccttattggccatgtatgccagcacgtactgctttcagtgagaattccagtattttgctaacgtgcatagaaaggtgatgcaaacttgtaaagtgaatgtcagacccagaagaagaataagatgaaaatagatatctagtgtagctgcaaagcaaacaaaatattgagtcaaaattgaactgaactgatcatagcagcgggaaaggtgggcagcagtctcaccaatgggacagttgaagacagattccgatggtgtatactagcaaattggcaggcagccatggtgccacttcagcagctgctggaagaagacagggcgcaggagtcgccacaccagtactactctcacatgcatgttggattgtgtgcccatcgctgctggtgagctcacaatggggaattttgggagtgagggaaaggaatagttagagaagagaggtaactgttagctgtttcatccatgtcatcattttttttggtaaaggaagcttttattaatctcagtcgattacatcaagctgatagaaccatactaaaaaaaactcccggcctctgcataactaggatgcacatagccaaaacacacacacacccacaaaagagtttgtaacaagtgaaggaaagtagtaaaatctagggagcaccaatcttcagcctagaccgccatccatgtccttgagtaaaacactccctgaccacctactccaagcgttgacatgccgctgcaaccaaatcttgtgaatcaggcttctgaaggatagcccatgtacgaaggaagtggatagtttaaaaaataacctataaaggagaagagatgtcatatcattcccgcaaaaccataatgaccaacaaatagtggttacccttaacaggataagcgacttaaggtctttcctaattccccgtagccaattaccagacatattggatacaccacgaggcgggaaaagccctgtagccacttgtatagtgcaccacacaaaacgggcaaatctgcattcataaaacaaatgtaatattgtctcatctgtgtgacaaaaggaacaattcttacttccttgccaattgcgcttggccaggttagcccttgtcaaaactatcccacgacgtaaataccttaggaagatcatgactttaagtggtatttttactttccaaattactttatttatgttgggcacatctgaatgtaccaaggcaagataatgtgacttaactgaaaactctccattctggattaaattctagtggaacttatctcggtcctgagtaagcgctagatttgccattcgtggaacatggttattccatgccactaattttggctcaataagatcccttcgccaagatacattcggagggtagttttgtagcacatttgctatagtatcctgtttattgtataggcaagggtattgttctcacagtggtgcttctctcataatgaatttgccaaaacgtagaaaatcacgcttgaccttcataaggctggcctagaagtatgagtccctagctttccactcgacttgtgacataggttttgagcccaagtacttgttacgaatcaattgttgccatacaccatccatcgtgagtagcttaaataaccacttgctaggaagggcaatgtttttcatatataaatcatgaattcctaaatcccctttgttctttgggtcggcacataatactccacttcatcaaatgacactttttcttttgatcatcacactgccaatagaatctagagcgaaaacaataaagtttcttgagtacacctctcgatattgcgaagaaaaacatcatatacaggggaagactactaagcactgagtttatcaatgttaaacgtcttcccgtggaaagtagtttccctttccagctaccaagtctcttctcatagcgttcttctacccatttccaatcattatttcttagtttcctataatgaataggaaagtagcataacgggaattcgccagaagaacaaccaaagagtttggtatattggtcttccatggttcgagcatcaccaaaatagaacaattcactcttatggaagttaatcttgagacctgagagatgctcaaaagcacaaagcaaaagcttcatgttacgagccttctcaaggtcatgcttcataaaacgaatggtatcgtcagcgtattgtagaatggaaatgccatcatccactagatgagggactactccacaaatttgtccatctactttggctcaattgattagagtgaccagcatattagctacaatattaaaaaacattggcgaaagaggatcaccttgtcgaaggcccttttttgtttggaggaaatgtctgatgtcatcattcacttctattgatacatttccacccaaaacaaaagactcgatccaagaaatccacttggttggatattgagatttcatacgaaatccaaatcaaaatttgatcctttcatacgaagtccttgtcatcaattgtatcaccttagttgccatgtggactcaaaataacctcaaaccagctcgagggattaaaggtgttcggttttgatagtttgaggacatagtttacctggtttcaaagatgagggatggcaactagactaaccgaatagtttaagagtttagggatggaaattatacgttgatgtagcacaattatcggaggaacttcttcggtgtgctgatatgtagatatagcacaaaatgttgtaggaacgactttaatgtggtactccctccgtttcatattgtaagacattctagcattgcccacattcatatagatgttaatgaatctagacatatttaatatctatgtgaatgtggtcaatgctagaaagtcttacattttgaaacggaggaagtagtagataatgccctaaggcagcccgaatccacggacaacaagagcttagtccaaagctccaaagaagatctaatccatgttctgtaataggaacatctagttctattgataaggtggtaagcaaaagtaagttccaaactagaggccattgcctctatttaaaggctacaaagccatctacaactcgatacaactatatgacaacctgatgacatcctaattgacaactaggatgctactcaaaacaactcatctattactcaatgacacttagaacacaactcattggacatacaagtattttctagtgatataatgacatatgcaatatcataattattcttgagttttcatgaagtatgtactatagattcaaaactcaaattttgacttcttgttcttagtagagaaaatccaattctacttgtaacacctatactttatgaattggtcaggtgatgttcctcatcacgttctcttgagtataccacttcactaaaaactatatatgtacaagtttgcaattaataagaaaaaaatcattttactccctcgaactatttagccggaggatttaaccccgtaaactatttttcagtcattttacatcataaaactattgaaaacatttcactatagatgataagagaatctactcagtaccactgagttcgatacacttcaacaatatgccactgactttgttgatatcaataatatgccatcgccttttccttaacctctacgatttaccatcgccatctacagcctgttagtttgcgttggagaaaagacaagtatgcccttagtgaagatcagcagcactgagaccataccgtgcaaggtaccgagagttataataactataaagagaacatacaacggtactaaacatatgaaaaatatctttatttaagcagcatgattataaataattatgagcacatattttaagtattttgattatgaacaaatatctccaaggctacaggagggggtagagctttgatttgccgtgactgttgaggagcggttgagggattgcactgacgacagtagtagctctccaacagggccagggccaccatgtccccttgcatgcaatgccggcactgacgacggcggcggcaccagcagtagctccagcaggggcgtcgacgtcgtgtccccttgtttgcgacggcaacgctgatgacgatggcagcaccaccagcagccctccaacaggggcgccgtctcccgtcggatgtgacgatggtggctagaccaccgctgacttgtgctacggatggtggcactgggtcccgaaggtcgggtcggcgctagggatggcgacgttggcgaggcgtggcgctgtggcggcactgggaagggtggtgatgcggcgctgggagatgcgatgctgggaaaaaaggggccctgggccatgctagggttagatgattcaaagggtattttggtcataactaagaaaattaacaatacaaacggcgcgacgatggcaaatcatagaggttaaggataatgcgatggcatattatggatatcaacaaattcggtggcttattgttgaagtgtgttgaactcagtggtactttgtagattctctcgacctatatatataaatggtattttgcattgaatttgataggactgatagatgcattacgtcttacctcagcattttctttagaactttcatcattgtttacaaggttggaagcacctaaaactaacttaaacatcaaaatttaaatgttcaagcaaacaatcatgaaaaaaattgaaaatattatggaacttagataatgatgccatctatggctttaaaaaattttagcttaaaataagacttgtaaaaaataaaaaaaagataaaaaatgtaccccccatctcaaaatatagtgacatagtactgtattagacacaacttagtactatgaatctggaaaaaagagtattaagcagtataatgaaccatagttaatagtttcagttgtaacatgagctaaaaattgtttaggggtttaagtgacccaatcaaattgttagagtgaatgaaatggacattttaaatgaatagtaaaataaaacgaaaattgaacccgcaaaatttatttaaaattctatactagaaaattttaagcataataagaaagggatgcttcacagtaaaaaaaaaaaattgatgtgttggccatatgcggatacacagcttgagaactggtgcactaatctgtcttatttgtacatctaagttgaattgttgctcttaataggtctcaaacggtgacggagcctttgttctcaccaggtcaaggtaatacacctcattgtcatttttatctattccaacccttactttgggcaaactttgtttggggtaaaaggtaatgctagtcatacacgcctaaattttgggaattacgtgtgtacagataattgtaagctttccaattgaaatcatgtgcagcacatctttttgaaatcgataaattaattgaccttttggaaagccaaaagttatatgagaagcctgctgatgagtggccatgtgaaataagctaggcagatatgtagtactccttccatccaaaagtctaaggcagttttttttcaccaagaccaaggggggaataactcatctaccatgtgataaaaccaaggaactatatgtatgcatgcaaccaatgagtattaagatgactgcttgggttctagtcaacaatttaatttagcgcatcaaaactacaaatatgtccatctcatttagaaaaccagaaagtgaaatatgtcttgactttttgatggagggggtagaactgaagtcacccctgtttggagaaaagagaaggtacgcaactttaacaaagagttttggataggcaagctgattgttgaaatgttatatctcaaagggtgtctcatgaggtaatggcattaatatatgaggatcacattacggtagagttagctttaaaagttttcatcccttttgggagagaagagaaggtatccaactttgacaatgggttttggctatgaaaacggatgggtgaaatatcaattattatctctcacgaggtaatggcattaatatattagtgatgaaattaggatagagttagatttaaacgcaaacaacttgctccgcataatccaaatagataaacaagctaggattaacgtaagataaatacttaactggattaattaactacgagatatatatgctttggttacgaatatatacactggcatatagtgctaactgcatcacacatgttttatagcaccggaggaggaacctgtggcagagccagagatgatcacccaccacgaccacccgcagcacaagcttcgcctggtgaccacgacttgtgacatgccgttccgctgtgacggctgcttggagccaggatacgctcccagataccgctgcgacgcctgcaactttgacatgcacacgttctgctccaacctctgccggccattctacagcaccctatgtacaaaggccgcatattcaggttttgtcccaagcctctgcctccctcgggccgcagggtctgtgacgcctgcggcgatcccgtgcgcgggttcatctaccactgcttcggcgccaacctcgacctccacccgtgctgcgccagcctgcacgggccgatcatcctcgacgggcttgccttcgacatcggggcaccaaggaagtgctgcctttgcatgcaggaaaagggcccagaacgcgatctgtggtgctatcactccaacatcaatggcgagggtgtgtatctccacgtagcttgcatcaagcacttcgccggaaggagatggcaggcaggccgtgaaaagaaatatggagggcagatcatgctggcaagcgaggagctcatgatggagggtcccctcaagagcatttcatcggaaaaagaccgcattattgttggtggcgtcatgcgcatcatcatctcagtgatatttggagacccgactgccaacaagggagacaacgctagggtcgctttatccctccaggggctggcagatttatttagcattcagagctaaactggtgtgtgatcactctccttgaaaagaacaaaagacctatcggtgtgcattggcttgttttgtttgtacttttgtttatttcctggaattggcaaggacttttatttccttcggtgtaaaataattcgtgtgtgtatatatattggcatgcagtttgctactgagtactgattaaataatttgataaagagtgataaatgtaataggtatatatgtatagggtttatttttcaacctatgtgcttgtaaacatgttgcattataaattgtatgaaatcatgaattttgattggtgatttgaacttaattgtaaaatctttggttcatgattatactttggtatatgcttgttatatattggatgggttcattttctttttattgcaacacatgatatgatgtgctatatatatatatatatatatatatatatataatgctaagctcttgaatattaataaacataattactatgcttgatgaaatcattatcaaaaggggagaagagatacaagtgcatgtttttcaggtaaaggaaaacgaaagaagttttcttctggatttttgagtactccgatgctttttaccacttttgtttttatttttccaaacactaaaacatttttgatgagtttgccaatgtgctcatcaagggggagattaaatcaaagtttgtttgattcttattctgtgatgaacaattgacatatgagattattggttttaatatttgaggattattggagtggttttggagatgattgaatttgcaggtgaacaagagatattgctgacaggtgataaccggtcagaccaggcaggtgctgccggtcagatcggagctatgtgtgcggtcagaccggccagcccgcggtctgatcggcttactctgtgtcagtttcggtttcgggttattttgttggatatcagtggataatttatgtgtcagttttggtttcgggttgttttgttggatatccgtggataatttatgtttatgacttctagatggatactatgcgtatgtaatactgttgtttactaacaatgagtcaagttggagatagcttgtgctcagaatatggtttcttggttgatgcatgtgtaggtgatcttaatgcctcgagagaatgttgccgatgatgaatcaggagtcaacttgggagaagatgacgtccgaatgatcaggatatcatacggcgtgcttaggctaaacatcaatgcatgtggttggtgaagattctatatggcatatgatggagatattgtgtgcgtataggatgcggagtcgaatttagaaggagtctaaatttggtacaattgaagtttgtaaagtttgtctatcactgctccgtgcgcggcttcgtctaccactgctccggcaccaacctgaacctccacccgtgctgcgcgagcctgcaggggcccatcacccttgacggccacgacttcgatgtccgggcacccaggaagtgcagcctgtgcaagaaggagaaagggccggaccgtgagctgtggtgctaccacaccaacatcaacggcgagggcgtgtacctgcacgtggcctgcgtcaagcacctcgccgggaagagatggcaggcgggccgcgagaagaaacacggaggccagatcatgctggcgagcaaggagctcatgatgaaggagggccccctcaagagcatttcgtcggaacaagaccgcattgttgtcgggggtgtcgtgcgcatcatcatatcggtgattttcggagacccgactgccaacaagggagacaacgctagggtggctttatccctccaggggcttgcagatttatttagcattcagagctaaactaaaacaagaacttaatcggtgtgcattggattgttttgttctagtttttttttttctagttaatttgtgcttttgttgatttcctccaattggcatggacttgtatatccttgggtgtaaaataatgcgtgtgcatgtgtatatgtgtgtgtgtatatatttgcatgcggttgctactgagaactggttaaatatatcgttgtttaacttattgtgttctgcccaaatatcttatgactcaagtatgaatcatagttgtgtagttgtgactgattggcacacactaatacatagtaccgaaaaggtgtcgggttgcaaacctgacaaaaaaatcggttttgcaactggcaccctttatctactagtaccaatgaccaatggttatttggtgctggtggtagaaccaacaccttttgtacttcccacaattaaaaaaaacagagacagactagaagcatcggctcaatgaaccgatgcatccaactaccttcttcaagccgcctttaatccccatacacaatatgtacagatcaagaactctatattgatttagcatcaataatctccattcacatcacagatagaaatattcaattattatttcccatcagtaacaaagcaacaccagcaagatgaagaactacacaacatcaaaaactacacaagtaggataaaaaactcatcttaaataaaataaaaaaaagatcaagaactcacaaccttcccgctgccgcatcattcaccaccagcaccgtcacatttgccatcttcccgtttatcacgatcgcctatgcgtcatccccggtgaccccacccccaatcacctcccaccggcgagagcagcgtgatctccatgcatgcgtgcgtcgtcaccatctccacactgaggtcatcgccgccgatccattggatgcggtgagagtggatgggagttgccacagctgcaggaaaggtggaggaagtgggaagagaggatgatgggcggtgctagtggtgaaggttgtgaggattgggacggcggcgacgatgcacgcagaagtgagctggagtggatgggcggcagcaacaggccgagagaggaggggatgggggcgatgggagagtgcgagagacgataaggttggtggggttaaaaggagtctcacccgtgacagctcagctcagtttcataaagttgtcaatcttttaaagaatcggcacctataatataaatactaggtgaaaccctgcgcattgctgcgggaatttagtatgaagatatacattgaaacattatgtgaattatgttggataataatttaacatgtctgtgtttgaaaagctcttaaattataaaaaactataaagatatagcatgtttgcatgatgtttaaatgtgatgattgttagtggatgatgatgtgacatcttgttaattagtggatgatgatgtggcatcttgttagtgaataatgatgtgacatctttgcatgttaagcttaagtagttagtagggggatgcggtgagagtggatgggagttgccacagttgcaggaaaggtggaggaagtgggaagagaggatgatgggcggtgcagtggtgaaggttgtgaggattgggacggcggcgacgatgcacgcagaagtgagctggagtggatgggaggtagcgacaggccgagagaggaggggatgggggcgatgggagagtgcgagagacgataaggttggtggggttaaaaggagtatcacccgtgacagctcagctcagtttcataaagttgtcaatcttttaaagaatcggcacctataatataaatactaggtgaaaccctgcgcattgctgtgggaatttagtatgaagatatacattgaaacattatgtgaattatgttggataataatttaacatgtctgtgtttgaaaagctcttaaattataaaaaactataaagatatagcatgtttgcatgatgtttaaatgtgatgattgttagtggatgatgatgtggcatcttgttaattagtggatgatgatgtggcatctttgcatgaagatacacattgaaacattatgtgaattatgttggatgataatttaacatgtttgtatttgaaaagctcttaaattataaaaactataaagatatagcatgtttgcatgatgtttaaatgtgatgattgttagtggatgatgatgtggtatcttgttagtgaataatgatgtgacatttttgcatgttaagcttaaggagttagtagggggatgcggtgagagtggatgggagttgccacagctgcaggaaaggtggaggaagtgggaagagaggatgatgggcggtgcagtggtgaaggttgtgaggattgggacggcggcgacgatgcacgcagaagtgagctggagtggatgggcggcagcgacaggccgagagaggaggggatgggggcgatgggagagtgcgagagacgataaggttggtggggttaaaaggagtctcacccgtgacagctcagcttagtttcataaagttgtcaatcttttaaagaatcggcacctataatataaatataggtaccggttttctaaaaagtgtcacctatattattaatgccatatcatataaatataggtaccggttttctaaaaagtgtcacctatattattaatgccatatcggcacctatagctgcttaaatgtgctggttttatatattttttatccaatgtggaaacggttaaatgagctagtacctactagtgttttgtagtagtgacacggaggattcacatttccttattgttagattaggcatcaatatgcatcatattcataccatgcacactttgttgtacggtaacacactttttggtggcaggaatacaccaaatatttaggataaatccaaggtaattaaataacatggaaccattctatttataccagattgcttttacataaatatatgtgtttttagtgtatttgggtgctcttttgtgtaacatgtcactgttgaatttttgctttcactgaccatacctattttcactagtggggaacccatctttagttctgattggtaacccctttagttttgggtatgcaacccagacatccaattcaggactaaagctgggtatccttagtctcggttgaaatatctttagtttcggttgataacactaaccgggattaaagatggtagcaccaaccacttggtactattatctttaatttcggttggtgttaacaatacttttttttctttttttattcttatttgctgcttgcatcccacgtcaagttgctcctgacattcctaaatcaaattaaatccccacatcaaattgacatatcacagatcaaatgaacataatcatcaacaaaatcatccacaaatttacaaatcgaacatcgtacatcgaatgatggcagcaacacccatgccatggcagcagtactcggacaagagagacaaggaatagaatgaagaaaaaaagaagaaaaatgataggaaggcttcacaccatcccgggatagtcaacagaagaggaagaaaatgttagagtgcgcagcctgttccaccaaccgtaggcgtctggtccacagacccaaccggaggcacaagtttaggtcctgggcctacacaatccaaaagacagtctgatggatgagaactgtaacaaccttttaattcgtgctcccccatcatcaattaacaatgtgggactaacccaacagaaaaccattaaaaaaagaacaaaaaaaaaggggggagcgtgcagccactgcatggccgtccacccccgccggccgtcggcctcgccgcgccgcgctccaccgcgccattacgtggccacctcaccaccgcacgggcgcgccgccgccgcccggctgagccacgccgccgccaggacgagctcctccgccgtctagcaaagcatagctgccacatgggcgcgagccgcacccccgccgtcgcatggcctcgccggggcgccactgcttcgccgggccgcatcagcacgactgcgtggccgccgtctgccgcctccccctcgtgcgccgctgcgtgccgccttccctcccagcggacgggagggcgccgccgcccgccgtcgttttcatcgcagctgtcatcggcttcgcagagagggaggggaggagggggatcaagaggagagggaggacgacggcgaagaagatatggagaggtagagaaaaagagatcgcgtcagagttaagtacgcaaaaatagcgatttttgtagacacttgggtgcatgcggttggcccacccatacgcaaaaatagcaatttttgtagacacttgggtgcgtgcagttggcccacccgcacgtgaaaaccatttttgatctcacggaaaattcctttttaagtagtgtcctttctatttttgggatcaaattgttgtgtaaatgttatgtcaatatcacgtgggacgaagaccaagtcataggagacacgtaattagctaaaactggagataatactgctaagcgatcttgtttacaccggtttgtaagttggaggacgggttatatctggttttttggttcaagcatgaaatggctggaagacaaattgaggacctaatgtgaacttagtccgacctgtcgaagtatatcgctcacagtcacagcccagtcttcactaggaaaacggaaagaaaacgaatgtgtgaaacaacggcccaaattaactaaggcaagtttccagtagaccggtctttctcttttttcttcctctttttttttttcttaaactcagtagtttgtcatagcagagaggctagttacattttgtgccgcgttaattattccagtgggtataacacatcaatatatttcatctgcttgagttatccatgtgctagaatacccaccggccggaacaattccattagcctataattcaattaatttgcatgcatggtaattatcatgtaattattccgtgtcaactgcaattgaactgacaatactcacaatagtatatgtacattgaacacttaacagttcttttagataattgaccacgtaaaaggttaataataaaaaccatacatcatagaaagaattattaaagctatatatagagggaatctacaagggttttgcctcgaagtgcacgcaatgacgatatcccgatagattcctgcatccaatgtccatttattcatgacgactgcaaaatcaatattattccattaacatttgcggacaaactttgagcataatatgggatatataactaattaaagggccaaaatagataaacgacctagagtcgttattatgtataacaacttacaaggtgtggaattttgaagtggtcagtaaatttgagttgacaaatgaaattacttcaaaaactaaagaaataatatgtgtagacagtgactttttttttctctttgccagggtacgatgatagtgatctactgtaggttgtagatattggttcttttttctggtcttatatacattgtatggttcgacaagtcaagaaagaatcagagttctcaaaaggaaaaagagaaaaatatcgtagaacgaggtttgcacttgtttttttttggtaaaaattaatggagatttattccactacatataatcttgcttacaatcattatcaaggaaaggtaaaataaagcctgcaggaacatataaacacaggttgtaaagcaacacgagaagaaatactctccttcgctacacaccttcgctaatggctagcatgtgtgctgtaccgtgttcgccgttcgacgtacccaacaaaacttcatctcttggaaattaaccaactaatttgaacttcaaatcttgattcaatgtagtatggattgacctatcaaattgtttgctaaccaccacaagggaatctgtttcaaatataattcttgtagcttcctaatcataagcaatcaattatgtgcttgcaaaagggtatgtagccaagtggttttaaagggctaagtttccaatttaaaaggctgcatatattcgattggcgatatagaggctgggtaaaaaaatacccttctctgatacaaaaagttcttatgtaagtttgctagtaggtaactgaagacatattaggcttggtattttagtttatctcaatataattacttttctctgttgttcgataattgtagagctaggaaacattattctacataaaaagtttctatataccagttgatgtttcttgatatttttataaaatttgtgtatagttgtgctgcgttaattattccactcggttacatctggcacatcaatagttacatatttttccagtgaaattatcattatgtgccagaatatgtaattctattactccatcaatgtaaagtgcatttcatcattatgtatgaatataataagagccagtgcaagtccattaacattcacggaatttattttttagtatacgatatttataagagccaaaattacaaataaacaaaaaccaatataattgacgggctgcacagtaatccattcatttctctaaaagttcaagtgaactgcatgagtttgtccatgcattgttatatatatcaaattaacaagagatgaaagttcaagctcagtaaatatgagatgacaataatattcatttacattaaaaaacatgtaaatatctgcaggatgaccacatatttatctaaaagcactggtggagaaaccatctttcgtcggtcggccgaattccacaatagtcccggatacaataaaaaccagggctaaagatgatctttagtcccggttgatcaaatatgccgggtctaaagatcaaatatgcccgttaccctttttaaccgggactaaaacttgatctttagtcccggttcaaatgctgtcagggcctgtcaggccccccgggatctttagtcccggttagtaacaccaaccgagactaaagatcgtaacttaccaaccgggactaaagagctcggggatctttagccccggttggtaacaccaaccgggactaaagtcccacccctatatatatgtcttctttctcctccagctgcccgagcaagtttcaaaatttcttcaaaaaagaggggaggtcacgccaaaatttctagtgaatttattttggtgattacatacaaatcggaggtgcctaaaaggtttgcaacttcatcctccagtgttttttttttgtcatattacatttgcagctatgttttgcacacttttttgtctccaaaatttagttgtaagttgatgagagagaaaatttgtgtggggaagaaagaatatatagaaatttagttgatttgctaaagaaggttttataaaatagttgagaaagaaaatatagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgtggaaagagtttgtaattatcttataattattgtatgactgtcattattgtaagaataattatttgtgtatgattttttttgactcatgtagatggatcggcaatggatgtacactcggcaatggatgtacgctgaccggcggtccaaagagttcattgacggcgtgcactattttttgagagtggccgaagctaacgggcaaaggggttttattcgttgtccatgcaataagtctaagaatcagaagaagtattctgcatccaggactattcatttccacttgtttgagtcggggttcatgccaagctataattgttggacatcccacagagagcaaggtgttgaaatggaagaagatgaagtggaagacgacaatattccggactttgctcagtacgttggatttgaaggaaatcaaacaggcgaggaggaaagggatgctgatggtaacgacgttgcggatgatctcggtcagatgttgcaggacgccaaggaggactgcgaaagtgaaaagggggcccataaattggacaagatgttagaggaccacagaacgtcgttgtacccaggttgcgagtaggggcacaaaaagttggataccactctggagttcttgcaatggaaggcaaaaaatggggttagt

SEQ ID NO: 63919 - DNA, 671 bp, Oryza sativa
ctggcctgagagatctgcttagctccagtgcaggtccaaatataatgagatgcgggcgtgccagtcagtttgatcctgcaactgacaagatatgtaaacagtagataaaacagcctatcggctgacaagccgatggagtagttccagccgatagccgataatagccgatagcgatagggtttaagcaatcggctatatgtccaatgtagataatgatataaaggcaatcagatgatgatgatgatgtaataaaataacaatataatccagtataaaccaatcggctagcattgatatgatagaataagcatcgatccaaaggttaaagcacacatcggctggaggtccgatgtcatgaaatccacaagattagattaaacagtgaaacctttgttgtcatcggctaaatctaacttatatgtatatgcaatccttatgagctgatgcaacgtccagataactcaccggctgaaaccccgatgaaacccttattgacaatcaagaagcaagctagagattatggttctaagcacgacttagtagatcaaacttaactgatgcagcactaagtatgaaaagaaacataatatctagacaatcaagccgttgactgagtcttcagggtggtagatgtctaagctaatctaatctagcaacgcaatttagccgat

SEQ ID NO: 63920 - DNA, 605 bp, Oryza sativa
attaggagctgtaaacttcaatatagacatatagtgagggaaacatactattcccctacacatatattcccaggccaacttcctttggatcagtctctatcatccaggaaggcctgtcaatcaaaatttacggtattgtgtcagctagcatactcattattgattattagcttactaatgggtgttgaaattgagcagagaggacatcacttgttcatcacgaagatcgttgttccttgagacgcccgctcaagaagcaccttccttgattcaattgctactccctctggctgcattatgaataaaagtggtgattttagaaaattaaaacaatactcccactgttatgggttaggattcatagggggtaaacaccgccgagaggatagccgggcggcgacggctgctagggatgagagggggacttaggttgggagagactaatcttgattcattgcttaattagaatgatgatacaaaccatccttatatagatggagggaggacccagtctaatcctatccaaccaactctatccttatccctagggcctcgacccctcggcccactacctatgacacccaccgtccctaaatataagggat

SEQ ID NO: 63921 - DNA, 5362 bp, Oryza sativa
cgtcatcatcggctgcaaaataatcagcaacgccgtcgtcgtcgttgaactccggtgacaaaccaataaaccattgtgtggagtatacgcgaacaggacattaggctcggtgttttcgaccaccctagcgccgcggatgggcggcggctgatcagcacgttgcagcctatgcagcagttcggcgtcggctggctgccggcagtggccgtacgtgacggccatcaatgtcaagcaaaacacagctcgctgttgctcggacatgacgatggactgatcactggccatccgtgagcaattccgtggccaatcatagcggcgtcctccgtctttctacttgatcaccaagcgcgtgggcgtgggcaggatgagacgatgagtcctccatagtagacatgaaacgatttatataggagggggtggcgaagtggagtaggattaatccgattccgattcaagatggatgttatcttggtgggtatcgccgtttgcaccttctggttgggatccccctcggattcgttccttctggcttctattctggccacttggcgctgcgtccctgctgctgatcactcttttagttcaactcgaaatgctgaccttcaattcagaagttctcggtactgtacaaccgtaggttggtctcacgattaatttcttacagtaatagttttgcaatactcatatgtcaaacaattatttattattgtcttattgtaaatacggttttcaaatatgaattatacactgcatatcccaaaacgtcctggatgttcaaccttaagtcaggctccaccaagaaacccagaacatcctccagatgcactaaacggaaccatgttttttctggacggaaaaaccatgtttcaacaagcacatactccttgctgggaatgtgaaacatagaaccatcggatatgaaaacccaaaaggaagtcaagactcattctgtggtttgaactctttggctttcagatacttcactactagccttgatagccccaacaaaactggacatcttgttcagggcactcaggtaagctcgcacactggaaacaacaatatccagtgcggcaccactcccactgagatcaataggcaaagaaattattagttcatgtgaaaaattaaattgataataacaattatagatgttggaaacaacatagaaggaaggtgcccagtgaaaaaaaaaaggtagtataaaggactataacctgaatgcccggctgaaggagtgaccagtcaaagcatgtttagagtcgctaacatctccagtgacaaccactctagtagttgcaattgcatcaatgccttctgtgaccgatgtcatgctatattctcgaagaacagttgggatctgtgaattgcaaattattcttagatgtttcaaaatttctccagttttactaaaatgaatgcagatagtttacaaatcaagaaagtagatgtaggtaatttctctgttaacatcaaaatagtgcattcattttgttgaaagcatgctcataagtcgtaacacatcacacgctaatccttattaagtatggaatctcctattcttgtgattcttgtatatttatcatggaggcaacatgctgaaagttatgttaccagatgcaggatgtttcattctcatatattgaaaaaacacatccatattccatcccattaaactggtatattagtgcaagaaccatcaagaatattgcaactgtcacctgtattatatcatcaacagccttgtaagctgcatcaactggacctgttccaactgcacatgcaatcttctcctctccatccggacctatcagtttgacagttgctgtagacagaccaagtgttccacaagttgcctgcaaaaaggcttcatatcaattttaacatatcaacttctccattagccaaatagtaaaatgtggcaaaattatacctgtacatcagcaagggaccaaaaaaccttgggctgaaatatctcatcagacaacagcgcctcaatgtcttcatcagttacacgctacaatgatttaaaacacataagctagaagttatcaaaatgcttactgttttacagaaaaaaaatggttgaatatgtcaatcgagcaacagagcactcaggaaactgtcacctttttcttctctgcaacctctttgtagcgtttaaagaaatcctcaaattccttgtcagtgatttcatatccaagctacgtgttggatgacaaggtagtgttcagcaacgataactgaaaagaaggcatttagtcctaactagaaaaataaagacaaatacaatacctccactagtttagatctcacagcatgccttccactgaaaaaaaaaagacaagaaagcataattatgaacttgagtttgataatctcaaatcagatttaagtaataattgcaagcctatcgtaagtatttgagcaggattgctgcatcaacctcacctaatatacaagagtaaagatgaaaaagaatatctctattctagagaagtacagaaaaacatatgataaatagataaaaaaaatgaccaggccaggtagaggtttcctcaatgtcaagtgagcaaggtttaacctaaaaaatttaaaaagaaaagcaaattcactaactttaagcaaaggatggcatcacacaatttctcaagtaaaaattgtactgtgacatgatctgcatacatatctctaggaatttagaccttacatggagtatccatatgatatggccattcgacataaagtgtttgatagttggaaagtgtattttgcaccaaattagcagaaagtgcataaagtagaaaaaatatctcctcgagaaacactcagggagaatgttgcaacttgcaagaaatcaaattatgggggaacatatgtatggatgatacctgagtttcccaagaacaataccaaactcgtttgcacgtgttagaccaatatcatcaggagaaattatttcataagttcctttgtatttaagcatcccatcctgaaaacagaataacaaaagtgaatatcaagatcacttcactctagaaccaacacagttaatatgagaatatgcaaggcaaggttcatataaaaccatgattgatctatcatatatcagaaaatgaattcctcggagctgagattaaaaaaaggtatccataaaaataatttgacttccctcagtatgtgatactataaaaatgtgagcaaaactttttcctagtgcaaatatgcaaactgagaactagaaacatttctgaaacttccaaattttagataggaaataaacagtaatgctaatcaattccttagtcctaaaatgtaaattgatggcaagaaacacttttagagttataaaatatagataaatgaaaaacagaaacaagaacctagatgtgacattgtggtaccaccttcagcactacggagaacccagtcaagaaatttgatggcaatattaggacaagaatgcaaatttagttacctgatgaattccactttcatgtgcaaaggcattggcaccgacaatagctttatgtggttgtacatgaagtccactgtgctcttgtacctagaataggcagagcatttgcagaagtgcatgaaattttcagtcacctgaaaaagacaaaagataaaaaaaaaagagcaagaaaacaaacataattgtaccattttgcttgacatagtgatatgttgggtattgattccagtatacagacctcctaagagctctcggcgacatttaattgccatcacaacctgaaaaagattttttttttaaaaaaaagttgcacatataggaaatcaatattacttgcattcattcttctacaaaccatttagatgaacatgtgcaaaataccaacaaacaacataaacatagtatacgagctcacctcttccaaagaagcatttccagccctttcaccaataccgttgatagtcacctctaattgccgtgctcctgcatgagcgccctaaaggttaagtcacattagtgacatgattaaaccaatgataatggatcaaagagacatggaaaaggtagtaccgctaatgtattggcggttgctagaccaaggtcattctggcaatgagtagaaataatagcattttcaattcctggagtgtttgcttttatatcagcaattagcttcccaaattcataaggaagagtgtatccaacagtgtctgggatattgagtgttgttgctccagcttttatgacttcctctagaatatgatatagaaactctctgtttgacctgcaagacagagtgaataatatcatgccacagtcttttgcgcataaaaaaggaggctaattgattgtgactaataaaccacagacaatagcttggcatgagctaatgtttagtcattcattttgcaccaacatgtttgaaagcaaagaatgtacagtaaatgatatgcaacaataagcttcgtgtgtagatttaaagatgaacacaaccacaaaatttcagtagctggcagacatctaccagcagtacaaggatgaaggtatccaagatacaatatacataatactttcctttacagaccaaagtatattcagtacttgatagtaagcaactaggcatacactgcacgcctcaaaatcaaccccacttcactaaagttggatggacctcttacatgcacagtacttaggcatatatattactaggtatggtgtcaattccaacccacatcataatgactgaaattgttggacatttcaacgctgactattttaaaagtagcctaatgatcgaacgaatttgcaattaaaagttggatagacctctttcattcacagtactttccaatatctagattattagctaattagtcagatgccagttccgaaccacattgtaattactactccaggtatgaaacttttggtcatttcaagggttacagtttaagggcccctttgaaacgcaggatagaaaaaacacaggaataggaaaaacacaggaattgaagtggtgtgttttcctaatcctacaggaatggaaaacacaggaaatatgaaaagggtccctttgatagcatcataggaaacaaacaaagaaaatgatagtttccaagaggttgaacctcttgcttattttcctatgaaattgagctataggaatgcaatcctaaggaaaatttcctatactttcctatgaatcaaagggtttcgtaggaaaaattccttgggaaattaaatcttccaaaattctgacaatcctccaattcaaaggggccaaaaatagtgcctaaaaatcaaacaaatttgcagttagaagtgatacatgccagcatcactgagtcaatgatgaatgtgttcaaagtagggggtacatgatgc

SEQ ID NO: 63922 - DNA, 940 bp, Oryza sativa
  unsure (1)..(940): unsure at all n locations
cggcctgatgcattgcacgccagtctnnnnnnnnnnnnnnnnnnnnnnnnnnnnnnnnnnnnnnnnnnnnnnnnnnnnnnnnnnnnnncaaagctgtttattttaatcttcaattactagtacaatgcttatgttgctgcgaggcatatggagccaatgttttgtttgtttcagttgacatcgtggctgttgttaaccagcggccgtgccaataatgcttatgttttgtccattgctacaatagctatttttgcatgccgttgttttgatttttgtgtgcggtagattcgcccgtcgtgcgggtgcgccacccgcacgcgaaaatcttgcgggtgcttatgtcgccagcaagggaaaataaaaaatccaaaaaaaaataaaatttcaaaaaatggaaaccctaaccctagatccggacaccccgccgtcagatccgggcggtgggcagccgtcgccgctcccaaccgcctcgcgcgagtagagatggcaatgggccccgttcaccgtttcccgcggtgaattcacctattaggtgacggggatggttaatatgtattcaccatggggaataaaatggttacaatactctcaccatcggggatgacggggtgcgtcttcttactcctaatttttttgtatatagagcttacatatataaagtctctctaataggaagtctgacttagaaattctccccggttattatacatttaaaaaaattccgtcttcattttattaattctaaggaaaattatatgccctaattttttaactacacacgtaattttttctatgatttacattttcataggcctttattttatataaattttacatttctaagttcttatatataaaacttttttttttcaaggtttcacgggaatggtgttttacaaatttctttaaaatggtattaaattctctttcgaaaaatatc

SEQ ID NO: 63923 - DNA, 688 bp, Oryza sativa
tttccgatctgtaccgacatgtttccgtccgtattgtttcgtttccggttttccgatatttccgatatcgttttcgtttccgactttaccgtttccgatttcgtttccgagaaaaatatggttacggaaatggttgaggctgttttccgatcgtttccgaccgttttcatccctactcgtcggcacccgctcgctgctcgccgtctcgccgcgcatgtggaaggggccgccgcggacgcctggtgatggaggaggggaagaggaggtagaaaatagagataaggtggtgacggaggatgggaggaggacattccatctttgcacatgggctcgctttcaatgtcgatgtcgtcgaatatcaacgattgaatagactaatgagttaatgaaatactactggacgctgtgctggtctagaagattcttctcttaaacaataaatattgcaacatactaataccttctatttgaacgggatttaccgtaaacttcttttactttttttgacacgggttatctaccttgacgctaactatatgcacctaaaggaaaatcctcacactttctccttgaatttctatggttttgaatcaatactttatagactgatttcaaaactaatatggggcattagctgtttttatattgtttaatagcgatcaaatgttcgagccggccggcttactat

SEQ ID NO: 63924 - DNA, 6401 bp, Oryza sativa
  unsure (1)..(6401): unsure at all n locations
ttaaaaaaatcaaattaatccatttttgaaaaaaaaattagctaatacttaattaatcacgtgttaatgaaccgtttcgttttccgtgttactgtagcgcgctgggaaaacgtccaaacgaacacagccctaatccgtggcgtcgccgatggagcgcacggacgatgcggtggaggcggccatttgggtacttcccaatccgcccgactggagcgtgttcctgttacctcccgcaggagcacgggagggaggcggctacgacaacgacagccgtgtcgagatcagcatcaccacgggcacggggggacaccaggagcgaggcgcctcctcgtctgccggcgggctcagggaaggcggcgctgcgcgcgaggtggagcgcggtggcggagatgtaggcctcacggccaccgccatctcaggacgccgccgtggagatggaagcctcgcagcaggcagcagcatcgctggaggccacggcggaggtactgcggacgacgagccccacagcgagggcaccgtcgcgggtgcagtccaaggccatctcgctggagtgggaagcctccccacacccacagacgaggcatcgcggtttgagggcaggtatgaggatgactataacccatatgtggatctctacaaatttgggcgaccggctcctgatttctggtatagcgtctggatgcgtggccccctcgttttgcatgataagaaactgttactggctagtgattctcttggtgttcatagaggtggggagattcctgatttggcagatgctataactgatgttctagataatcatcctggaccagtttcttacttcagagtagattccaccacatggactgatgacaatcaactagtcaaatggtttgaaactctatccaacaagtctgttgtagagatcacattgctaaacattggttgtccagttagcacaatacttcctatcagtgagctcttgtctcctaacctcacaactcttcgtgttggttttatgaagattctcgattctgaccttctgtcatttgagtattcgtcgttaagcgtgcttcaactcattggttgctcatatcgaggagctgatctaaattatcttgtcagtactagcaatacactaattgagctcaacattggctattcaatggaagatctcacagttaattcacagagtctacaagaactgcacatatggaatagcagggggggctttctttccgtggaatatgctccaaacctcaagttgttgaccacgggccttagaccaaagaaaggaaaatctttcatctcgatcacattaaaaggggctccttccttgagagagattgattaccttctgctgccgtcatcgagtcaccctaaatgacacaatgatctcaaaggtataactcaactaatcatcttgtaacagcctttcagtgtgtcctttagattgttagtcatacataattttgtttgttgttgcaggagatacgatgtgtttcatctatcaggcaactccaagtgggtgtgaactttgcagaacgaagtcacagagctagtcttcgcaatatacttgaatgttttccagaattatcaatgcttgtgatttgggtatgttcaatcttttgttcaatgtatatccaaattatttggatatctgtagtagattaatggttgtttttgttaccctttttttttgcagaggatggatggtattgtctatgataaaggatctgatgtactattcgatagctcttttgtgggtcttggtagtgtctcttgtgtcaagacacggatacagtattttgagttagaaggttttcgtggtgggccagctgagatggacattgctcgtgggatcttaagacatgcttccaggttggctaaatttgtcctctcacatcacaaaaactacagtgaggaagatctggtggagcaacttgaagagataaaaacttgcattcgtgcttcagaagattgtattattgaagtccacccactaaaagactcaccttattaaagcacaaaggaaaaggtatactctctccttgttttttcttttttttttctttttggctatatggggttggatagtggcactcagtctcaaattttattgttttgaaccctttcccgtgctaagtgattttggattttggacttgttgcttatagattagttccccttgtagttaaccacttaatagttgtcagaactgggctgatgggtcatgtgtcgtgcacagcaagatgtgttggtcgagtcaagtagtgtctgaggtgttgatttagaatatggaacgatcacaatggatcctgtggatgttccattaagatgactcaattagcagtagctggctagcagttgttcatataatggttaaaatgacagataaaagtaatgcacagattgcttgaaatagaaattatccattcacaaaggatcatccaatttggttttatacttacgccctgtttatagagtcacaactgcctctatatctattctcgcgacaaaaatggagaaaagcatatagaagaaaacaaagactacatggcactgacagtgcttggcaatattaactatttagtgctttgattgactgcagtgtgaaactatgagttgcctttgtagtgccatgacttattgattaaacataagaagcattacaatcttcaagcaagagatgcttgacacagtctggagcctcagctaaccaaacagcactactgccgtagtgtataatagcatgctgagctagctcatgtgctaccttattttggtctctcttaacctttgctacacaaaccccacccagtaaactcatcaactcatttgcatcacttatgcagccagaattacaagaccaataaatacaactcatttgcatcacttatgcagccagaattacaagaccaataaatacttggtttgcaacgactgataagctaaggtgccttctacacaagctgcaaatccggtttcttccagcattgagcaatttactggccatgccaggaagataactgagtattgcctgcactatctctaatcacaaatccttcaccagctcgcccaatgacagccatgaaaccgccattcacatttaacttcaaataactaggatcagggggtccccatctttccgaagggttgggagtctgtatctttgcctttagttttaaattctccccaaaatcaaaattttcctttcctgtctttcccttcttgttcacatatttacattagcaagttatgcattgcttccaacaatcttatagcaccctctaaattaattccccttttccatgagtaatatcatttcttacattcccgcaaaaaaaatcatttcttacattccaattcttccaaaacacaaacattaattagctttttcatcgacagatattctatccattaataataagaaccaatctggaccagaggtttcatcctttggcaaagtctagtgctaccgcataccacgtagtaaatgttctagagtggggacaattaaccactgcatgataagttatcctccatagcatcctccataacactgccagagaaagtattagtagccacggtgttcatcacaagccaacctccatgcaaaattttaaccttcggtggtacctcagcttgccaattatatttgtaggaaggtctgtcccttcttaaactactaactgtatgcacttttgactgaaaagatacctgttttctcaaaatgccatgccactacatcatcgactggcctcttgtggatccttatcttaagaatttcttcagcatcaattggcaagaactcctaattaatcacattaggtaaccattcacaactagtagggtctataagattcgaaactacattaggtagccattcacaactagtagagtctataagattcgaaactattcttactgttgaacaccgctggcgagtaatcaaattcaggaagtgttcttgtgttatccagttatccagccacaccctaaccatctctcctgaaccaatcctcataataatgccctttttaagcaattgcactgttcaatactccctccgtttcacaatgtaagacattctagtatttcccacattcatattgatattaatgaatctagacatatatatctatctagattcattaacatcaatatttctagtgaaaatactagaatgacttacattgtgaaacggagggagtagctctctaggtgagaatgcattgccagcaaaaactgtatcaacaggttacctgatggaaagtatttcacttcagaagcattgcagtaaactatctagacagaaaactcggcatgcttgccgagaggatagagtttggttgaaaagctgctatctctcaaacttaagcctcccacaccgttggacaataacatattctcccaagagcaccagtgcgctcttattttaccattttctgctccccaccaatattatctttaccatgttctgctccccaccaatattatcgtgtcatttgcatgaactcctcttgtaacgatgctggcaatttgaaaatcctcatcgtgtaggtagacaaggcttgaataatagatttaatgaaaagtttcttacctgccactgataagttaccttccactcctcagctaatcttttccacaaatgtgcctgaaggctacatactactgacagtggttggcaatattaagtattttgtacttcgattgactctagtgtgaaactgagtttcctttgtagtgccatgataaatttgatatgactgtattcggtcaacagtatcaaacaatggcttagcaataacatttttggtgggagcatgtaagagcaatattagttttaagtgaaaattatgtgcccgttaattcattgcgataccatatctaattggtatgtaaggtgaccacgaggccgccgcacgcgaaccggttgatctgcaccagcagcacatgcggcgtcggcgcgtccgtgttgaccggcgggtggaggcgcgcgagctccggcgacggcgcgagcgggaggtggtcagcgagctcggacgacacctcggcctccacgacgagtgcgccggcgccacctctgcccgtgacgaagaacgggcggcgacgggcgccgcggcgctcgaggcgcgcggtgaggagcgggaagtgcgggagcatggcggagagagcgtcaaggagggcgcgggtggtcgggttgggaggcgagaaggcgaagaggacggtgacgtggtacgtcggcgcgacgaggtcgaacacggtaagcggcacctcctccgtctcgcatgtcggcggcggcggcacgaccaaagtcctcttgacctgcacttccattgtatcaatctggttagacagatagataaacgatgctcttgagtgatgaatggatggtggcaatggttcatgtatatatagcatggccggtgccgcttgtgtacatgtattgtatagagtatgtcactaggagtggattttgattgctcgaggggccctcgttatttgcgtattactcaaatggttataaaaaagttttaaaaaaataagaagatgtgttattatgtgatacatcactctacaaatattctctcgagggaaactatcttgatacatcacataataacacatcttcttattttttttaaattcaacttctacatctcatagaagaaagacgagcggacattctctcgagggatcgagatagtttcccgtatgtcactggctcagctgtcttgcgattaacatttgaagtgtgtacgtgtcaatccgttgaggcatgcaatgcttgatttgttgggctgccaggaattcaaccgtgcatacgtgcgatgggtcttagttgtacgggagacaaaaatacctactacgagtactaggaaccggacgtatatacgttcagatgaagcaggtatacgtagacagtgatcaagattgcgtggattactccgactccgatcgaatccgagtcctaatcaatctcgttgtccctcacatcgtcgactataataaaaatctggtactcatccagttgttgcaacaacgcaaaagctggtctgactgctgcaggcgatggatccgccggctcgcagattgatggattctcgggcggcgcagttggcggcgccacttcctgatccatactcggcagaaacatttgaagacctactccgagaattgggagtcgaccctagtatccacaccatagtccgtagcgccgggagatggatggatccggcagcggcagcagcacgagttccagtgagattccaccgcacgctccaacccccacggaatcgaccccaatagcgaaaaacgaagcatccgcgacatgttacaagaggggatcctctagagtcgacggggaggcgttcancattccatttggnggggtgtccaatagactgcattatcgc

SEQ ID NO: 63925 - DNA, 1687 bp, Oryza sativa
caggaattcaaccgtgcatacgtgcgatgggtcttagttgtacgggagacaaaaatacctactacgagtactaggaaccggacgtatatacgttcagatgaagcaggtatacgtagacagtgatcaagattgcgtggattactccgactccgatcgaatccgagtcctaatcaatctcgttgtccctcacatcgtcgactataataaaaatctggtactcatccagttgttgcaacaacgcaaaagctggtctgactgctgcaggcgatggatccgccggctcgcagattgatggattctcgggcggcgcagttggcggcgccacttcctgatccatactcggcagaaacatttgaagacctactccgagaattgggagtcgaccctagtatccacaccatagtccgtagcgccgggagatggatggatccggcagcggcagcagcacgagttccagtgagattccaccgcacgctccaacgcctaggaatcgaccccaatagcgatgcccggagcatccgcgacatgctacaagagttctatcgagtggtgtaccatggagaggtgtactgggctggccgagtcatcaggcctcgtccttcgtccatgccaacgcccgtgataggacgacgtcgccgcgccgccgacggggatgccccgatgcagccgccgagcaagtacgctcgagtacacgccgtgtcgcgcgatgtcctcctgggcctcgcgctgacgaaggcgtgcgacgcgaggcaggaggagtgcgccgtgtgcctcagcgacttcgaggagaaagacaggctgaggacgatgccgtgtaaccactccttccacgagaactgcctcttccgttggctcagggatagctgcctctgccctctctgccgctacgcgctgcccaagcagcagcaggttcaaagctgctgatgatgctatttatgtttcggttcaccaacagatccgtttgtaacttgtaagcatattgccatcgatgtagaagtagaatcatgttctcatcgatgtatagcagggcagttcatcatcagaaggttcctaattaaaacatttcttatcctccactggatttaactagtattgcctgcaacgcaaggccctgtcttggctaacaagccgaaacaacttgccactcatgtgcctagctatccctatcatggccaggcacacggttcttcacaatatataatttaagaattgccttgatcttcaaagtaattaattagtggattgatagaagttcaatcgacttgacattgcaattataaattgctttggagatccagtgtcccagtatataatgccagatgaacactcctcttgcctccatccacaggtcaacctgcaggcaacccagcttgctaccaagtcgatcaatggcaatggacacttactactattccatgctcttcgtcctccctacgatactctacatgtcctaccacctcaccagaatcctcgccgacaagaagaagcccaccacccatggactcaaggcgcacccgctgctcggccacctcccggcgttcgtgaacaacagccaccgcttcctcgactggacgacggagctcatcgtccgcagcccggagatgaggatgggcttctggatccccgggatgcgcaccggcatcatcaccggcaacccggccgacggtgaacacatctgcgcaccact

SEQ ID NO: 63926 - DNA, 25581 bp, Oryza sativa
acaaggtattcagaaatgaagatctcagcatcacctcacaactattcgtcgtctgactaataatcatgtctgattaaacattttttaatactatgattatctctgattaaccaatgcttgaccagcaattccgccaacgtttcagcacttaatagaaaactgactcaaacatgcagaattgcagattaaccagagtatgtactgacaacaactccaacagacataataagacaactaggcactaggcactagaaataattgacataatagacataattgacttaatagagtaggcactaggcagcgacaactgacatagtaagactgtaatctgcacatggagactgtaaatcatgcaagcaatattccattcacaacagcaaaacataattcaggagttcacagaatgcgtcctgttagaagaagagccactcaactcaagacgtcaagaaactcagattctttctggtatttcagaaaagtgagagcttgagaatacagtttcgacttctgtgattgtaccctcaggcccgttctttctccaacaaaagttagatgaaaatttggatatttatgtcacatttttcaaactgctaaacaatatgcttcatgcaaaaaatttctttataaaagcagttgaatatcataaatatatttttcaagtttataataattacaacttaattaatcatacgttaatatcatctcgttttgcgtaaaacacttaacttaatcttcatcttcatctacggcataaaagaaagcctctccaatctcggcatcatgttcatttgactcgtccaattcaacctgcaaacggagaagaaaatggttgcaaatttcgaatttcactagtagcagcttgtatttcacattcactagtaccagagttgctttcagatctgaaagtggagttccaagtcgattatatggcagtccgggatcatcatccttgactctgctaaaaaacattctcctgcagatgcaaaaccgcgttaagagacagttctgtgattacctatggttatgtttagttcagcgtaaagtttagattttggttgaaattaaagatgatgtgactgaaaagttatgtgtgtatgacaggttgatgtgatgaaaaaagaccaaagtttagatccaaaatccaaactttggatctaaacatagccatagtaaaactagtatctatgaagaattcaaactccaaattcctattctgtctgtgattctgcatataactatgtccattgagatgctttattgcctagattacataagctatacatacgagaaatgcaaaattgtttccaaaggggaaattttttctgggtgagtagaaatagcttgtgtcacattaaggctgtgtttgatacttggggttgggaacccaactccaccgcacggaaaacggagcggtccattagcgtgtgattaattaagtattagttaattttttttgtcaaaaatggattaatttgtttttttaaagcaactttcgtatagaaactttttacaaaaaaacataccatttagcagtttgaaaagcgtgcacgtgaaaaacgagggaaaggggttgggaaacttgtggaaagaacagaggcctaagtcactcacattgatagaactaaaagatgggtactacagccaaccaccaccgcaccgcgttcagcgagtcatgatagatgctggaaactctgaagccaatccttcagagttcagaataggctgggtttagatcctaagtttggatccaaacttcattccttttccatcacatcaacatatcatacacacacaacttttcagtcacatcatctccaatttcaaccaaaatctaaattttacgctgaactaaacacagccataattatcagaatttggatggaacaccagcagagcctaacctggcttcaaactgtaaacaaccatacagtttggtggcatataatgattccaacagtaaacaaatgcacagatttatcacaccccagttgtggatcacgtatgcaatacgaacaaacgccaaaaacattactggcactactcaagccaactaacctgcagctaatcatcacagcttcaaaatgattaggttaacttgtactatgctttactcattccaatggtacactcgtacactatcataactaaacataaataggcaattctacaagcaaccattcttgaggagagaaacaaacaagcaccctaattttacaaaatttaagatatgccacccgtatcttaatgacatgtagcactcacatgagtcaatgacatatgggtcagggtggcatatcataaattttgcaaaatttgtatggcatggttcaaattttcccaacaaagacaaagccgaggtccacaagtatcgaattatacagatacgatccattaccaccaaagttctgcacttgctatcacgagagtactaggcagccaagatcaaccatgacggcccgtttagttcgcgaaaagaaaatttttggacatcggacgtttgaccggatgtcggaaggagttttcggacacaaatgaaaaaattaattttataactcgcatggaaaccgcgagacgaatcttttgagcctaattaatccgtcattagcaaatgtgggttactgtagcacttatggctaattatggactaattagactcgaaagattcgtctcgcgatttcccctctaattgtgcaattagttttttaatttatctatatttaatactctatgcatacgttcaaagattcaatgtgatgtttttgggaaaacgttcaaagattcaatgtgatgtttttgggaaaaagtttttggaaactaaacagggcaaaaaaaaaatggaggggaaaagaggctggtttttttttttttggtgagcggaaggctttcacctgctgcttgaggtcgtgacgcgcgcgcgtcagatagcaagcaaaaaaaaaataaaaaaaaatcctcccatttctctccctcctcctcagcctcaggtggtcgagaggactccacctctccgctgccgctatccccgcctcgcgccgcgccaccatgccgctcctcgccgccgccgcggcggtggcgccgccgttgtcttccttccactcgctctccctctcctcacgcggactccgggtcccctccccctgcgaggcccgcccgcgcgcgccgctccggcgcggggacctcgccatccgcatgggcggcggcccgcgcacgttccccggcggcgtctccaagtggcagtggaagcggatgcaggcgaggaaggccaagcagctgctcaaggcgcgcctcgcccgggagcgccagctctacgagatgcgcaagcgcgccgagctccgcgacgccgccgcgcacctcgagcgcccctgggaccccgacgcctccgactccgccgccgccgcggcggcggcgcccaacctgctctccgtcgcggcggacgaccagatgaaggcgctcgccgaccgcttccaccgccccggcggcgtcgacctctggaacgaccgcgacgggccgcgggtcttcgcggccccggacaccggcagggcctccgcgcgcttcttccccaagggatccgtccatagcgttcagccctacggtcttgtcaatggtggccttgagagcacactggctgctcgcggtaacccttccgatgcgacggaccggagtcaccgccaccgcctgcaaggtgttcgtgagaatgcggccaagaaggaaatgcgtggtgttggtggtgatcgtagcctgcggttgagtacatcgaaaggggtggagtgtgggagccagtgagtaacttggatggtggcgacgacgacgattctagcgacggtggatggaacgatgacattgttacctcggacttggaggacatgggggatgtcgatttgcgacccgagcaaagagcaatggttgggagagatagaaggaaagataatgtggcaaggtgggaagctacaacatctgtagccatcggtagcgatggtgttagggatcagcgtggcaatggcttctctttggaaccagaaggcacaagtgaatatcatcttggtcaaagctggcaagagagaaatagtgggagtagagggaaacgtcccgcagggagaaggaaggccttgaacaccgatggcggtagcgccattgggaaggatcgagtggtgggtggcagttcattctccgactctgaggtaacacgcaatggttttgaaccaaaatggagatccacgactagagggcgcacaacgaatgatgttaggaggtggaatccccccaacgaaggcggtaggaatgttcctagaaagggttggacggatgatgagtttggttcaaattcagacagtggaatggatcacaagttgatgccaaaatggaaaactcagaacaggttgaaccgaagcgaaaatggcagagatagaccggagctgaaatatatggctaataccaacaatggggagaggactaggaggtacatgaggggcagcgatggtgagggaagaagagatcggtttgttaatcgcttcgcctcagatttggaggagccagaatggaagccaagaagaaagagtggagcaggcaacgatggtgatggaagaagagatcggtttgttaatcgcttcgcctcagacttggaggagccaaaatggaagccaggaagaaagagtggagctaggatgaacattggcaacagagagtacatcgatgacatgaatgggagattcaggaggggtagcgatggagatggcatgaatgggagattcaggaggggtagcaatggagccgcgagattgttggatgctatggacagcaacagagaaatcggcagtgaggatgatagctacaggatgagcagaaatggaggacagcgcaggggagacgggtactcgctacgcccaacgtcagaattgcacaactctcggaggctgagggaatcaaatgaaatgtagttctttttttcttcttctgatagaaagatgaaatgtagtactagtattttacaatgatgataaacaaataacacacgccctgtgcagactaacttctaggagtacaacccattcatctgttcaatagcagtgtacagcacacgccacttgcttttgttcagattatgcgacgcaacgcagaaatcatcgccttgctgacttccatataaaaaaggccaaaccaacaaggctgatcaatcaagcgcatcgcggatttggtagtttttatctgaaagttatcttggttgcactgatcaggtagtgcaggtcataattcaaacaagggcatggaagaattcacataacttcagaattataagtgtcacttccaatttccaaatgctggattataagcacagaacattgatataaaagtacatgattcatgtctccctggttgcaaattacatgatggtcatgggcctcatggcagaccttatgaactcaaactggaaaagatcaacaacattggtgcttggtaaagattgctccaaccacttcacctgcagcacataatacacctgttaggcaattaatcacggaaataccagggagtgcaatagacataggacaacaaacagcgcagaactttgctttagctcctccgccgatgtgcttgagcaatgttggagggaactaatcatgcatgcaaaacatataaaaaaaaatacataaaaagcttaatcacaaaagaatacatcttcagaaaaccagattttgaagtgacttccttaattgatataaactatagattccacgatttccattaaggagaggtataaaaaactgctctaaacaaacccaaaacccaactctttgtgaaaaacgggtatagagagactgaatcatatttctatctttcgatcccgttgcaacatgggcatctaactacttatcataaaatgtaactatgcctttgttagaagttgcccctttcaaattaaaacactaatccgtatgaaatgatcaaatgaatctgccagaggataatcgacttatggaagtctgggaagacagtggcgtgtgacagcaaacaatgctaaagttagagtaacttcggcaaggatgttggctctcatttcaccacaatgcacagaaaaaggacacctcctaactatgtaactcaagtatctaacacaatgcaacaaaaatagtggtgcactgacaagttcttaagttcacattagaaggtgaaaaacataagattctgacaatgatcatgcagaaaagggaagaaaaaaaaggtgatactaaattatgtgaaacaagcttatttgcatcttaaagtgaattcaaccaggactgagaaaagaataatgtttgctccaacatagatggcaacatgtcatatagtacagaaacatgcttcacatgatagtctagttagggttatagtaaaacatatctacctagattaaagatgcaattttcaagtatcacagcttaagatgcagctaaaggggaaaggcatccagccatccagtcagttatcttaccaagtgctatccacatgtgttgacttgatgaccaaatcaatatacatttcgttggcacaacatgcctcttcttagggcaggtatatacttatacggcagaacgaatgctaagactagaaccaatgatgttcagacttcattggcacctagtatatacatttctcaagaattttgttctccaccgatcgtacgtgctaaatacattcttagtattcctatggatgaaatatttcaccatgtaattagacacctaatcttttgaaaaaaaaaaaagcaaacatgaattgtcatgggaagcaaacgaacaactagccagtccaaccccgcgccacagtttcaatatgcaaattactaatctgtttcacatgaaaaagctctacataatctccaatagatagatcaaggtgagcacttccgaacaaccctaacgcctccaaatcgatcccaaatctaacgaaacgaacccatttcagccggaggaagagaacaaggggagcttttacaccgggggggcgctcacctcggggaggcggcgcgggtctccgcgcgtggccgccgacgcgatctagtggtggtggtggtcgccggaggggcggtagaggcggttgtaggcggcctcgccgacgaggtagatcccgaaggcgacgatggcgatgccgagccccggcgtggcgtggcgcagctggttccccaccatcgggtgcctcctccagtcgtcccgccgccggaagaactcccccgtcgcgttcaaccccttccccgccatcgccgccgccgctctcctcctcctcctcctctctctctctctctcctcaacgcgcacagccacacacacacaccaacacgaaagcccaagtggtagtagtatgcgatgcgtggttccagcccgttttgaatcgggccttacaaagcccaaggaaataacacacgcagagtcagagaggaacagagagggggaatttttagtattttttgaacctttttttatttttaaattttacaaacataaatattttcaaaacttattttcaaaatatgaatcttttggccacacgtgacaaaataaaattgtcatgccacccacagcgggtgcgatagttttgtcgtcacgtcattcagatgagtgtgactattgttttaccacagttcggctggtgtgatcaacaggttcaattttctaaaaagaatagggttgaaaatgtttgttttaaaaattagaaatataaaagttcataaaataaaaaaaatcaagagatagatagagagagagagctcaagccgcaatggagccaattacatcgcatgtatcgatcaaaacaccgtgccaattacaccctagtatgcaggatcaaatgcatgaatggtatagaatttcaattccttcaattcaaagggggcctaaagcactgatagaaagtaatggtttgtattgtatagtgtatttctttgttgttctgctcacacatataatctatctacaaatatacaatgtttctgcctctctgttttttcttttcctttcgaacctgcttgaagaaagacatgcacttgacgatgggttcctgaacttgtccaagaagctggtgttgtcaagtcttgaactgtcgaacatcagcaaccaaaagtcccacaaaaaaaaaaaacaaataaaggagccaagacagggtagaaacctcatgaaaggggaggcagttatcatagaatcatacacactaacccataacttaatcactactgaacaccgagagtatccaactctctcatagaggttcacatcacactacgaccacagcagttagcctgcctgcctgctaaatacaatagctacttaccatgtcgggtacaacacaatgactgaaactaatacaacaaccggcctgcacgccgggtctgctgctgcacggcagcaggttgcgggtgaagcggttctccgcctcttcaccaattcctaacgattctaaaacatgtcaaccgggagcctcccgtggtcattctcggctcctcttgctgctgcagccagggcacttgtactgcttgatgtgctctgccttcgcaggggtgatccgaacgcacttgccatggaaccacttctcgcagacgtcgcagcagatccagaactcaccgttcgcgtaagtctctccgcaagcgccacacatgtaagcctggtcctcatcctctgtgccttccgggccgctgtcttcctcatcttttggctgaggtggctttgcaggcttgctgttagaattggattgcttcgatggctggaaaagaagggaaacgaaaaggttaaacgttgtgttgatatgggcgctagataatgcatgttagacatgcatatgatcacatgtacatactttagggttggacttgttgcttttgctgctgccgttggagacttttgtttgcttcttggcaattcccgtcacaacttcatatacagtgggaagaccattaatcatggtgaagagccgtctcctgaaattcaaatgccagttatggactattgtcattttctaccaaacaatataatgttgattgttgagtgacaatgcactggataatattactcagataattacacaaaagatgaaaaatcctcttgtaaactttgacaaatggaatcagaatgcctcatcacagttgatttctgtaaataagaaatgcatcgacagctgcaacgaaaactatgcaaacctggcttccttatcaaatccaaagcgagccccaaagtaaaatgctacagacagtagccatgcatcgctatgaactgcaaccagcgacaaccaatctttttcgatcattccatcacgagcaaagtttatgcccagtgctggttctggaagttcaggaggtacttcctcagctggaagggtcacgtcccaggtctcattgggcaatccataaaggcacaggttctctttctctgaaaaaataggagatcactatgtcattactatgacataaacaagggaagataacttcattcaacagactacttgtgatgtaatgtaccattcatcattatttcaatggacagtacagcacaaaatggctacatacagttgaagattaacccacacacgcttgaagcacatactggggctatgcctagggagtcgacaaaccaatttactcaaaacaaattattctcacgtaacccctaaaacattaaacccgtcttcaaacatcaacaggacagtaagttttggagctactgttgtttttcacctttaattgtagtaatgatgcaattacagtatactagcatattgacttacattttgggaataattaattatttgccactcttacggatggtgataaatgatttgccactggacccatatgtcatagacacatgagggctcacatgtcatagacagcgagcggcaaataattaattaccacatcttaaaagtggccaaaagttaaatgtcccaggatcatatgattacagtatacaattacaattaacttatattttggatcatgctagcagaagctgcttcaatggttccctagcaatgtaagtatgctgttgggcctgtagaatagggtgctttagtgttttaatgggccttgaaaattgtaatgattaatcagtcctgtatgatgtgggccaagcccatgaatacatgcctctacatgctaacataagttacagataggaccaggcgaccagcagtaactgaatttggatatacctttttgtccacttctgtcttcaattcatgaaatttctttactaaaaatatttacttcgaggaaatttcagaaaaccctgagttttgggtcatgggtctcacaaaacacagtttttaccatggaaaacaacttttgtttgctaataaaatgcagtgaggattacacaaggctggagaaagagtatggccaactagaataactcccatgaagccttttcctaaaaatgtgttaaaatttttcaaccagattcccaatcctacggtccaataaccagatcatagatttacatgatgatcgatctggaaaagagaatagttattagcacgatgtgatcaggatttgatttgcagcctctacactgagctgatacactagcttcaatcaaatgaaaatttaattatttaaagaccacatctgattgattgtggttcatatagagtattttgaatgcaatcatcatttaagcatgctctctgaggtcccagatgctgatagtgcaaaccgcaacaacaattgtactttaatttgctgaaacctgaaactaccccctaacaaactgacttaaatggacccaattacaccggcaagcgactgcaagataccagctaagaagaaaaagctttcaccgataaacactaaaaccgccataactaagacagattagttagggctacaactaaccaattattcgagcttttattcttttccccgaggaatcaattattccagctttaaggaactttaagaaacactggagcaaaccctaaaatcgcaaccatactaagctccgtccatccagaaaaagcaaaagcgactccagagcagccgcaaaaaagaccaaagcctcacatccccaaacacaaaaaatttagctcaaacacatgaacatcggggagctagcctcaccggggtcgcactgccggtagaacttctccacatctgcacaaccacacaaaaaaaagaacagcaaatccatcaaatcaatcaatcaatcaatcagcaaagagcatcccaaacaacaccgaagagagctacccaccggtggtgagcgccttgacgatgcccgcgcggcgcgcgcggaagtcgcggaagacgtcctccgcggaccgcgcgttgtggtgcaccgccgcccccgccgcgttcccggcggcggcagccgcagcaccagcgccgcctccctcgtccatccgccgggagctccttgctagggtttcaggcgagtgggagtggggggagcgagcgagagtggtggtggtggtggcctcgtagtggagagcgagagaggattagagaggaggggcaaaatcgcagccaggtccagacgaggacctaaacgcaaataaacaaaattacagggggctagcacgaaaacgaaatcccagtttccaccctgggtggggtggggcccacctgtcggggcggttgatgggctcttctagagttttgtctcgtggcccacggagaagagtcagagaccactcgtcttcttccttccgctcgctcgctcgctcgctgacgtgtacgcttcgcggcggaggcggcggcggcggcttccgatggcggaggcggcgggggcggcggtggcgccggcgaagctgggtctgtactcgtactggcggagctcgtgctcgcaccgcgtccgcatcgccctcaacctcaaaggtacgttgtgcccgcgccgcgcgattgccttcctctcgtcgtcatcttctatgcgtggttggctcatggccgggcagagtgagtgaacctggtgcgtgcgtgcgtgcgggtgattttgatgtctgtctcctgcaggattggagtacgagtacaaggcggtgaacctgctcaagggggagcactctgatccaggttaggtgctacgccacctgtctgtcaaactgctttcctccccctatctatacttgtgtacggttttgtgctgcgtctagagactgttcgtgcaattaccgccgcaaatttgtgcttggatgttgagaggtaagattctagcaggcgatcggcccgaaatccacaaggctaggctctgtgggggaagatgaataggaaggtgttcgatgaaatgcacaactgagaaaattgagatgaacatgagaggtttcggtgcagcatgtggaagcgcctcttttcgggattttcttgatgcaatataaagcaaagtgatatatgcagatcatggccttagtacccttgtaactggacgcatgatacgcacacgatgcgccatgatgtccacccattcgtggcacgcacccatgcacaactagctcagaatcgtaggggaggaaccaaaaaacaggaaactcaaaccgaaagatagaacacatgtgtggtagcctcaactattttcttttttgtttgtgggtggaagaattcatgaaggttaatcctatgaagttcgtcccggcattggtcgatggagatgctgtaattggtgattcttacgcgatagcattagtaagcattcagaattttgagatgcagtagtttatagcatcaaaattggccgcttcttgacttgtttctatgtgattgcagtatttggaggacaagtaccctgagcaccctcttttacctcaagaccttaaaatgaaggccttgaatctccaggtaatgatagattctgcactgctatgcgcaggatgatgacctcaattaaacattccatttgatatacaagtgctatttgtaatttgttgaggttgagcagcgttgatgttcagttagtgcctatttgagaaggtaagatcacatcagaacaataacaaaaagaggaaaggatcagcccacacatgtttcaggataataggaatactgagcacaaggatataagataggcttaggcataatccagaaaatatagcttactgtatgcactagattttttttcctcttaccgattgatcatgcctagtgtgacctttcatgacataatctaattttatggcagatagcaagcattgtatgctctggaattcaacctcttcacaatcttaccgtactggtaagaactgatttgcattcaatttcttactgccatgtaaggttctctgcctggtatttgattactcagtgcacctgtgttccatgtctatctggctgcattgtgcaaagatgcatttttgtgcctcagattaactctatattaaacagtttgtgcttctgtagtaaaattaatatagtacagctcaattagggaaaaaaatattgtataacagaataatttgcgggccacttgtttctttgcagaggttcattgagaagaaggttggtacaggggagagcatcccatggactcaacaacagatcgacagaggtttcgcaggttctcctcactgacgtatcctttattttattaatcaaatgactatattttgcagctttacttccaccatcaaatctgcttcaaaaaaaatgtgttatgcataactcagttgttttgcatgttgtgagaagctcactcatattcctccccttttcacattcctgcctatttagatttgcttttatgtcacaccatgctcacttcgttccccaatggtgtagctgctgagaacctagtaaaaggctgtgctgggaagtatgcaacaggagatgaagtccgattggtgtgtatgctgccctaacaattttatcctttcttgtatggagatcttctctaaggtttttttttttttcgtgtatcttgcttgcaaattgtgtcactttttccctaaaacagagtgaagttctcccatgtgaaaaaagaaaaaactgaagtgataaaataaaaatgcatcctcatattcactgtactcctcatgagaaccatagattgccatttactaactttccctttgtttatgtaatcatgtttgtgaacactccaaatattaacaagcactgttttggcttcagtaactgttgcatttccgttacacatgcaggcagacgtattcctcgcacctcagatttatgcagcagtgactcgttttcaaattaacatggtactgttcttgtgcttcttactctatccatgcatatgcctttatctattttgttaaatctaatgaaatatgttttcttggcagttaaattatcccactctcgcgaggctccatgaggagtatatgaaacatccagcatttcaagcagcactcccagacagacaaccagatgccccttcctctacctagaaaatacagtgtatgttcatctgaaaaatagattaaaagttgtacccaacttatcattggaagctgtaacaataagcacagaacttgttgcgaaaattgaaaataggtgtatatgtttttcaaagcttctgtccaaataaatgacccttaaaattgctagcctatggacaacttcatgttggcatcaatggtgccaacaacatgatacaacttgagagtgggaatacaagatgcacttgaaacgcattggtttgataatcttacagattatgtgtgatgcagcacgaagagaaagaatctcaataagggctcaacctgatgattatccttaaaaacaagtgtatttgattttttgcatacctgagttaaattatcacaagacactgcccattttagtttctgttgtacaagttaaaattttgaatagttttattgtgatcatagccttttctgacttttgcaacaaatttgagcaatgtccgatgggcaaatggcataaacaacaatgtccaaggtttgagaactaagaaccaattaggaaagacaggagggcttcctctcatgaaaccgccaaacttaatagagctacccaacgataaatagaaaaacaagagtcatcaagaatgttacttttcgagcaattgatagcttgaccacctatttatctttttgagcaccccatcctcgatgacatccaaacaagatgcctaacatatctaaaacctaaaccttttatatctcggctcgaaacataatcgagccaaaataaatatgaaactattgagttaagattgatagatggagtctcgaggtgtgtatttggctatgcttcatggattttcgggcaatgtgtgacgacattcaagaacttaaggctggtattagcaattgatgaaactttcttagtagagcaaggatgctcacttcctactattagccaatcttaatagagcaaagataataatagagctcacttcctactattagcccatcttaaagctaacacatataatagattagctacaaggttggctacaattttcttctcctctctctatctctcacttatacattaattgtatttgtattggagcttgtgttaagctagctcttgcatgagagccaacacccttaactttttattacatctctcctccatataagcttatagtaggcttatagcactattatacttgctcataggcaaattcaaagggtaccttgctcacaacaatagggaatagggattgatgccggattacaacttactcccttggcatttgttctggtagagaaggacaatacatccaagtaggagtagttcatcaatatgattacgttatgtttgattggccctaatagagaaatatcataatatctgtttacacccaaatttggcacctaggaataaaataggaaaattgccaaagtttggaaatctgccgattttccgctgagaaagctggtctgaccgtcgtatgttggccggtcagaccgccgacagtgggccggtcaaaccggcggtgtgtggccggtctgaccgccaaagtctgaagccgagtctgtttcgtcgggtctcgaggtttccttgctcgggaaggcatgtttcgggtttcctttggattctatcccgagtcgaacgtggaggagggcctgtagagggcaagaccaacccctatataagggacaaggccggtttaattgtaatctatcaatcaactatcaatcaatcgaatcgttcttttacttttgcttctagttttagtttagtttgtccatctttgtcgatttgcgttgtaaatcgtccgccgccgttgcgagaatgcgacacctctttgtaggtttgttctgaaaaccttccgttttgcccacaagacgggtagttatctatcgttctatctatatctgctccgctagccggtttagtttattaaaacccatcttggtttagcttttgcttgattgaggtggttggcgactctagaatcaccgcaaagctttaggtgctgcgatcgtgcttgtcaacttgtcacaaaaagttgccaacacgatttttggcggctccgctggggaaatcagctcaacgtcgtctcaacttcgacgccgccatgacgaaaatgaccaagccagaggtggaaccatccaatatcatgccaatctcattggaggatcttgatggggaagcacacaagatcatggaggagcacatcaaggcggtcacgcaggagatgctgatgagatcgtgcaccaagacctgtggttctcaagcctagaccgttgcctaaatctacttttgattcggtaggtgctgaagaggtaccaattcctatccaaaatctcgtggcaatacaatagattcatccattgttgcttcaaataataaattagatgcatcttttgaatctcgttttgatgcgcgaattgaagattttatgaggaataaattcggttcttttttagccgattttcagactaaagcctctaccagtactagcaaagcccttgttgatcaaatatacaacaaaaccgatgggggcgaatatgcaaacaaccggtgagggataagctgtgcattcagccggtccgaccgggccagatggccggtccgaccgcgcgtttaccgccggtcagaccggccagatggccggttagaccgggttctttcccggtctgaccgcgcctctggatgctggtcagaccgggccttggaccggtcagaccggcgcaattatcccgatacaggggattgatccaatgacaaataatgggcttttataccatattccagcacatgattcccctatatctactgttagtcctcaagttcccccacatatccctaatatttataatgatcttactagaagatatcctcccaatactaggtatggccaatataattatattgtgccgcaaccacaacctcttatgccaccaaacccaccaccaaatcagcataggcctgagaatatagaggaattgattagtggtattattagggataaattcgggattgaagctaggaatcatgctaaggtttaccaaaagccgtaacctgattactatgataacatcccatatcctcatggctatagagttcccgaatttaccaaatttagtggtgatgatagtaggaccacataagagcatgtaggtcaattcttagcgcaatgggatgaggctagtgattctaatgataatggtaatcatgatatgtatgttgctgagtggttatggactaacaaaaataagccttttgtttgttctaatttaatgccgactcctcgtaaagatcggcaaggtgaggttaagtatagttttaatgtagccaaatgtgataagatttttgattatcttttgcaagaaaagcaaataaggttacctaaaggccatgtcatacaatctcaataggaattaaaacgttgagcttattgtaaatgtcatgattctcattctcattctactaatgattgcaatgtgtttcgacgacaagtttaatcggccatagatgaaggacgattgaaatttacgatggttttaagatgaagcttgatcatgatccttttccggtgaatacaattaattttaatgataagaatgtgttgattcggctggagcaagctgaatctactaaggggaaagaagtggtcattggagagcctaggccaaagatgatggtgccaaagaatccggaggttggtgtttggaaggagaataggagtgaagtttcaagttctaaagctccaaagaagactaaggtgaccttcgatatgcttttgaataagtatgagaagcaaggaggtgaggaagttcacaatgaagggaaaagaccaaaatcacctcctagggagcgatttggtcattcaccaagagacggtcagaatcacctacatatcatcgttcacaaatcatgtcatgggggccttatattatgggacagaaggagtaataagtagtcagggcgttaacaattgtccttctgattagaggagtcctataatgccacataggctaaattaagtgactctagcgccgtgtttagttccaaaatttttcttcaaacttctaactttttcatcacatcaaaactttcctacatacacaaactttcaactttttcgtcacattattccaatttcaactaaacttccaattttggtgtgaactaaacacaaccctagggaggtgactacggatcggacgtccgatgttttagctaaaaatcggacgctcacctccacctccgccaacacatgcagacacaccagcaccaggtgcagcccactgcaagcgtaggaagccatgcatctatactagaaaacaaaagttaggttggtttaagttttttttagcaaactttaaactattttttctcttaaattacttctccaattcatgattcgattgcaccactaaattcgttgcaattaaatctttaaaataagaccaaacatgactataatccgatgaaaaaaatatttagctttattcatgaatttttcaaatgttgcacctattatatttaaatgtttcagtcagtattcatatggtgtttcactatttaatttgcaaatgttgcacgtggtgttcctagaatgttttagcaagtattttataatgtttcaataattatagtttagtgttcatatgtgatataaaaatatttcaacaatatcgggtttttacaaatatattgtatctgtgatatgttttatttgtttcactcattaggactcagtgtttcatataagtggttgctagtgttgcagcctgtatttttaaatgttgcatttctctaaaacattttatagagtgaactgaaacaaacttttattatgggtgaaacatcgtttgattttttatcaaaatataatcgtgtgatatcttgttgttaagatttaattgtaaggaatacaatgatgtaatcatattatagattggataattattttaggagaaaaaacatttaaaggcggagaaaagggtggagatgagtaaaaaaaattacgtgtggacatgtatgaatagacatgacatgacatgtgcagcataactgtgaatgagaaaagaaaagatgtatagagaagctattgactggtacactctgtagttcgtataggctgaaatatacaagcaggtgtccgacgcgtccgattgtttatccgttgatcggacgtctgactttaagtattttctcaaccctaggtgtagctttaattttatatttcagtccctgacactttttatttcagttcttttttttttcaatttaggtggaggtccaaagtttccacttaacaccctgtaatccaaaacaaaaaataaaaatcacttttccggccttcctccccccgagttcacatcgtctgcctttggagcaaacggcaaacattgccgttgcactcatccatgccacacatttttgtatcaacggctgtatggagtgaccccaccacagtgattaattaattaggggcatctaatcaatagaattagttgtttctctcctggaaaaaatcaacgatagaattagttatttctctcctggaaaaattcaacgaatacgccgtggctttggaaataactaattaggcattttttgcatggtcaagtacattgttcattgagttattcactttcatgcaatttcgcaggctaattcatgagtttaaccataccattaagcattctctctctatccaatctgttccatttatgttaaccataggaaatccatttcattatttgacattttgactaaatgttttataaaatataacatgtaacaagatgctacacacaccaacagtaaaaattaacccttattgggtggcaggaccagcagctaccttgaataactctattgatacatgcaagaatgtacggtatatttaattaaaagcatgtcatgtccatgacttttgacaaactagagaatgttgtaggaagaatgtatttgttgtgcagtgttacatgaagttaatttgacctttgctattcatctggcataagctgaaagttctcttccgcaagaaataaagcatctaaattgccaatatactccaacgttccatattatgcttcctttggctaccatttagatgacctatcaattttctattgacttataagcgcgtaggttgttctgatggcattgtgcgagtttgctctggtcatgtctgaatacttttatatgattctttattttttttttcaattctcacggggaaaaccatttgttataagagaatttatagaaattgtgttgtttgctgcttggaacaactcccccttagactttgctgcaaagcaaagtgcttttttccactgagattatgtcacaccctaaaaattcaaaatttataaattgttgtttaaatggaatttttagaatttattttacaagtcttgaaaagaagatctaattttaataaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtttcttttggctttgggctgaaagtcggcccaaaaccgctctctctctctcctcggcccaagtcggcccagtccgcagccgcagccgcccgcgcgcgagcgcgttgtcgctgacaggtgggtctcgcctgtcaggcccgtcgtcttcctcggccgaaaccctagcgcgccgccgccgccgttcccttccaaatccggccgttcctttccttctccggccgaatcaatagaggggaaacgatctccgggatctcctccaccttttctcctttggaatcttcggctaaatcggtttggaaaccgatgggttcgaggtcgactcggatcggctttgagcccgatctttccttctcgtcgccggtcgccgtgggccttcgccgccgcctccgagcccctttaaaaggacccccgagctctcctctacccgtcgctcccttcgccttcgcctctcgtcgtcggaagagtcctagcgccgtgcgccctagctcagccgtcgccgccgtcgctccagccgtgcgccgccgtcgttccagccgtcgccgtcgctcgggaaggccaccgtcgggatcgccaagtcgccgccgtccttgtccgctgcttcgccgtcgtcggagactactggagcatcgtcgccgccgtcaacccgaagagctccgccgcttcttcttcgtcgccgtcaccgtccgttgggtttccgccgtcgttttggtcgccggtgagttcgccgtgtcgtccgcttcgtcctggtgccctccgtttgcgtcctcgtgccgccgttcgctggtgagcttgcgccgcccgagccgtccgagccgccgagccgccgccgccatagatgacgtcatcgctgacgttattggggccgtccgccgtgagccgccgtggacccgattgatctcggccgtccgttttagatggatcgatctcggccgtccgttcgcgtgaaccgccgcccgtgcgcccggtccaccgcaaaccctagccgctgacgcaataaatcctcttttccttttcaaaaacaattcattattgcgtcataattcaattaaaatcagtttaagtgttttaatccgatataatctttaaaaattcataactaattcatcttagctccgatttagttggttcaagtctctaatttttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaatcaacctattctttgttatggccctattgttcttgtttaccttattccttgataccttgggttaatataatttgactggttgaaccttatatattggattggttcaactagatgttagatgtaattgcttagccctgcttagaaacactagttcacttttgggataacttatgaatcattataatttaataatggcttaatgatagttcacgatggttaatcgtgattggttaattaattacttgccaactaaaatttgataatggtgggttgtgagcacatggttttgagagtcgtgctcatgacaattaaggaccggttcacgagtttcggttgtgaaacattaatcgtgccaaccacaagccagcgtgggcaacggctttaccttttgtatagcatggttcattgcggagcaccagactgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtacccgcggttatgggcgggtcgagcaatgtctttcgtgattagtcccacacttctcaccatagtaaatgatgctttaattggtaataatttgtttaattcctggtttggagaatagatctgttcagccgggtgtggttgtcagaatggttgggcctatacaacagggtatgttgtatagtgttggtttaatattgtttaatacttaactgttttattaaattctccaatgtttgctaaatgctgcttttgcaaatgagcctatattatgccatcctttggtatccttgtgcacttgcatatttgctgcgtgacttgctgagtatgtcatatactcaccttgcaatcattcatcagaggaagagttcttcaatgaagctgatggtgtggaggattaggtgtagtcttggtcaagctgcctgtggagtggagccgtctgcgccgtttattttactttccgctgcttagatctttattgattgagaggaactatctacctctgtaataatattttattcgctattagagtaataattgtactctattatcaatttgttattgtgtgcctcggttgattcctggacgagggttcacacacatgtaagcgtttggaattttggatagaaattccgggcgtgacaagttggtatcagagcctccttgaccctaggttatgccaaatggttacctatagaagccctctaaaaatattggaaaagtagaactgttctcctccctttctcttttaattaaaccaaactaatggcacatgcacttcttaatctcttttaatggttctcattaaaaatttattccagtgttattagtactgtacatctattactgtactaatggctcattttaccagcaaaagttttacaatattgttttatttaatcttgctgcaataaaataaatttagcatgatgattttataactttcttttatttcttttaaaacctgttgttcaaaagtacaaaacttgtggccttgtttccaactgtttcaacttatcttgcaagtttggtttactttatttaattaccttttaccttgatcttctaaactttattcaaattaatcccaaaacttgtgctattaattggataaatgtcttaactccctcctttcacttgtctttagatgccgcgctacaagcctgagtacttgtttggtgttgagggttttgtccaggagttgcgtacaatgtcctttgtcattggattcgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttatagtgatcagttggccgatactgagtatcgctatcatcctcgtcaaccccagggaagtgaccgtggcagttaccttgagactgaaggaattgagaatgatgctaccacaaggcatttggttgagatgctgtgggctatggatgaaagtcgtgcggagattgtgttggcagctcaagatcgtgaagaccggaatcgtggtaagatttgcaagctagaagacaaagtggatcgtttggagaaggaactagccgcattgaagggagaagcgccaccgcagaaggccagaattcgtcttaccgcaaggaagagagctctatttgtccctcgctatcaattggcgccaaaggttcgtgtggtggagaaagaagttgccctaactcaagcagatcctccggtcatcatcataagtgatgatgaagaagaagaatccaaacgcaaccattccaagattgagtgggtagcaactcaagatgatgaagacgagccgaaagaaccttcaatcgacctccgatgctcggaagaattagagtgacttgttaagtcgttgttttagatcgttgtgttagtttgcttactttaagttgcttgtgtgtgtctcgcatgtgatttacatcagtggtgggatgtaagtgcatgattagatgctatagatagagttgagcttagtgtatatcaaagctgtgacaacattgtacatttcatatcgttctctgctttgcattttttttatataaaaagtgtctacaaaagagttattaagatattgcaatttacactacaatatatgtaattcttgaacttagtttgtttgcatgttcagtgtaatatataatgtggaaagatgctataatctttgggtgattgaacatgattagtgtgatatgatgtgggaaacgtgcgttgcacgtgcatgtttactagtgatttattaaagcttttgctaatgttttcacatgcttaaccacggcgtattcgttgaatttttccaggagagaaataactaattctatcggtgatttttttccaggagagaaacaactaattctattgattagatgcccctaattaatcactgtggtggggtcactccatacagccgttgttaaaaaatgtgtggcatggatgagtgcaacggcaggaaccccctcct

SEQ ID NO: 63927 - DNA, 2747 bp, Oryza sativa
  unsure (1)..(2747): unsure at all n locations
cgcgtagttnccatgaananctttgatatacgcgctcggnacccaatcaaatccaccctttactaccaacagatacagaaatcacttcgtccatccccttcccacacgtgatctctccccacatgtcgctctctcctcttgtcatgcgaaaattgggagcgatagcgtctcccagcttatagagagcgagaaaggagaagaaaggcggaaaggataattagcgatcgatcgcttgcgggatcggaccgcgatcagatcgatccctatactcctctctcttctcccccttcctcctccccttcttctctttctactacagtataccacgaacttcttttaaaaaaacaaaagttagaaaaaaaattatgtatagaaatattatatataaaaaatttgaattaaaatttaaatttgaatcgggtatataaacttttgacttataaactttgggtctttaaactttaggtgtataaactttagatgtatagaaatactatatatataaaatatttgaattcaaattcaaatttgaatcgggtatgtaaacttttgacttataaactttaggcctataaactttagatgtatagaaatactatatatagaaaatatttgaattcaaattcaaatttgaaacgggtatataaacttttgacttataaactttaggtctataaactttaggtgtataaactttagatgcatagaaatactatatataaaaaatatcaaatttaaatttgaattagatatataaacttttggtctctaaacttagatgtgtaaacttgaggtgtacaaactttagacgtataaatttactaaaataggaaagtaatacggtgccaaaaaaggaaactatgtggagggagggaggggggaatctgatcgctacccctaatgccaaggcgattgatcgcctattagaatcccccattgaagaaagggactccattttttaatacatctatagggaactaaagaagcattttttttaaaaaaaatctcaattttagtgttgttggcaatgcttttaggaatcctcaggttctcaatccgtgaatttgagggagagcacgtaggatcatcgacaggggcgaagctacactcattcatagaggtcagttgaccccaacgatcttttgcgaacctctggtacccctctttattttaccatctatgacctcggtgaagagaaaaactagaccccggtgatatcgttgattctttcgtcaaaatccaactagcgactaggaacggtactaacaaacagcaaattagctagcacttataatttatacattacccgaatatacatatatacgattgggatttggatccaaaaataacattggaagcccacaactccacgagtttctcttcttgcgtcatcgtattccttcgagcactttgtcctgcaccggcattgtgcatcttgatatcttatattccctccatttcaggttacaagacgttttgactttggtcaaagtcaaactcctctaagtttaactaattctgtagaaaaaaaagtagtaatatttacaacatcaccatagtttcattaaatctataattgaataaattttcataatatatttgtcttgggttaaaaatatgaataaattttcataatatatttgtcttgggttaaaaatattactacttttgtctataaaattaatcaaacttagaatagtttaattttgaccaaagtcaaaacatcttataacctaaaacggaggaagtaccatcttatttctagcagaacagaaggcaagaaattagtggttttgataatctttggtgcatttggtgtcttttacaaattaataatgtataatttttaataaatttgtagacatttcattttatcataatgtattgtcattaattttgtcctgtattatgtataatcttagatcattaattacaaactagatgacatattttcgatctagtattggattccaatgtagcgatatgacatttttttacctaattttaataagttttgatctagttttaccgtgaagtctcaaaaaaattcgaaaatttcactcagaatatacttttcgtcccacggcgaaacatcaaaattacatgatttttgatcagttttgatcgaaaacataacccctggttaatactggccccggtgaccatttatcctagctttggccccggtgaccatttatcctaacttcgtccctgatcgtcgataatgggggagatcgtgattgcaaccaccctttcagtttttggtcatgtgtttgaaagatgaatattttcacgcctgaggaaagactcctgtgccgatctcttggaaggcacaggaggcaaccagcctcgagcggaggctcgccggccacgtccagctcgcggattgggatcccctgcagtatgaacagcgactgcaagttaactactgcacgcgattacacccgttcattttggtgatgaatggaccagatcatcagctccagtgtcaccgcccaatacccaatatttttgnttcagtgatctacagtatccgggtgcatgtggaccgttagattcggatctaacaggtggcagtggtctgcataagttgtagtcgcggtnccaggtngnttcaaaaggtttcaacggnnnnnnnnnngnnnngtaatgnaatagaataataaatacgtaaggnggataaggtgaagtatgatagggtgaagagaggcatattacagaaggatgacgatcgaacagtgttgtat

SEQ ID NO: 63928 - DNA, 2076 bp, Oryza sativa
  unsure (1)..(2076): unsure at all n locations
caaccaccctttcagttatttggtacatgtttgtttgaaaagatgacatcatttagcaccgcgcgtgggtgagaaagacatacctgtagcgcgagtctgactcgggatgggcaccaggaaggcgaatacaagaacgtcgtaggcggaaggcatacgcaccggaccacagttccaagcttctgcgcgaattaggggatcaaccctgcaggtatagaaacaggcgagctggcaagattaacctactcgaacgctgattacaaggcggacattttggtgatgaatggaccagatcatcagctacagcgtcaacgcaaaataccgaatattgttgctacagtgatctacaagatgcgggtgcatgtggaccgttagattcggatctaacaggcggcaggggactgcataagttgtagtcacagtaccaactgcacctgatgcaaatccccagctcgcgtcgccgcacactctgcgcactcctcgtgccgctctgcccactccctacgcctgcaaccgttgccctgcgcgcccatgacgccacctaggatgaaaacggtcggaaacgatcggaaaacagccaaaaccatttccgtaaccatatttttctcggaaacaaaatcgaaaacggtaaagtcggaaacgaaaacgatatcggaaatatcggaaaaccggaaacggaacaatacggacggaaacatgtcggtacagatcggaaaccggtaacaaatacggaaacattaaactataaaaatatatatttaactttacataagtatgttatatatatacataaattcaagcttatactatataaattataaattaacttcattttaaccatgtacaaaagttagagattttattgaagagtcattcaatctataagctgtgggtaaagtatagacatgtcctataatatcgacatatttagaatacggtaattaccatattataagaaacggtaatttccgcaagaatacggtaaatacggaaacgatcggtataacagcaaaaccatttccgttttcatttccatattttttaccatttccatttttgtttcggtcgattaccatttccatatggctcggccggtagaaagtcaaaaacgaacgccggtcggccggtaattaccgttaccgttttcacccctaacgccacctacatcgtcgccgtgccgcccgcctttgtggagagccccatccatgagccgcgcctatttgaacgatcaccagcttgtcctctctcttttctcgttccactattgtattcattataattaatttttatagagggccaggcgttttcgcatgcaaattatttattttgtaattaaagggttgttttggattgaaatcaaaatatgccctaccaaaattttagtaacttaaatagtaattgtgcccatacttaatttggctatattttaaaattttcttcaccgtcttactgaaatttagctttatattgggcatcaaaccgaacataggctagctaattttatcgtaccaaaaaattggtaattttggcactatcaattaattggtaattggtagggtagataaccaattaattgaatattttcttgaaaaaaaaagccgtatatacgtggcctatggcgtttcgatccaaactcccctttccttctaggcttctactgcgacgaggaagcccttgccctggcgtcgtcaaaatccctcctccgcagcttcgctccagtgtcctgcctgtcaatcctccgggatcttggtggatctgcgggtagagtcggattccaactacgattcggagtcctaatcaatttcgttgcgtcccccatcgtcgactataaatctggtatgatcaagttgtttcattgcatcgtttggttgcgcatttatcccctcccatctctcccggccaagttcgcagtcncncgcttggtncgtagcagngtctaacaacaaaangtcgcggggggnggggggnnatgtggttgaccaagantggagagagaggtnnnagtagagggttggaatttggagggtagagagagaaagaggtagtcgaaattgttgagggttngggntngtgggcaga

SEQ ID NO: 63929 - DNA, 616 bp, Oryza sativa
ccgagatccccactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcaattcgccttcatggatatcggcaagaagctcgacgccttgttcccgaggaatgcacttcaggaggattccgttagccgcgcgccgatagaaggtcccttttaccagcacgtagcatttggagatgcgctggacgcgttcactcccttcgagggcctgggtagagtcttatctgagagggatgcctggatctcagcgatccaagcaa

SEQ ID NO: 63930 - DNA, 642 bp, Oryza sativa
aatattaaatagtactgattaacactataaacaaatcatgtctactttataccacaaatctactcaaaacgtaaataaaactatttctgtgagaaaaactatttttatcatctccatcatctctcttgtccttagttgaaggacatcaaacatggatgagaaaactttctacgttgttgtaagcgttagcaaaggcttacatttggttgagttgaggtggccctattggaggctactgttggtaatagtgctcaactttctacttaccattgtaatcctctatgagcatgccgatagtgatttaagcgttaaattgccctcaacgccaggtttaagtgacatggctacatggatgtgtgagaaagaaagcttggcggctacggcaagcttcatccgttagaggggttttacgtcaaaatttaacggtgttattccattaaccagtagaagtggtattcttacaataaatatacatggatttggaaataagtgagacctgaacactcagattaagggaaaacctttaggatataaaaaaggattaggcttaattttggggatggacatatgccatttcatccattaaataaggccaaggtttaaaacaatgataataaaaagcctgataatatgggaatttat

SEQ ID NO: 63931 - DNA, 672 bp, Oryza sativa
atagtgtatttagctaccctgaatagaatgcaagaatgttgaccaatttgataacttgacatgtacctgtaatgcaagaacttgaccaacatcctcagacgagaaatttagtccgccaaattgtttgtcactttcagaccatagagaaaatatctaaaatttgatttcaattatcatcaaaggttgaaaaaacaactttactgaaaaaaaattcaaaataatgtgtgcaccatatttttctatagaaaggatgctatgaaattaatcatcgtaagaagagaactcccaagacaaaggagaaaaaaatgcaaataaaaaatattctatacagttataataaaacatatagtagtagagatatattaacatatccatgctatcctaatctaatcattcaatttatatgtaatttccctatgatttcattggtggagaggaacaaaattgaaatcgagtaattcatttgtctatgttcgtattaatgacaagatgtggtgaaattgtgaccattggtaatttcttaaatggttcattataaaaaaaaacaaatatggtatgtgtagagttgcctttaaaagcacttccaaagtattataaacttaatagtttttataaacttgctataaaataaaatcaatgctgtagttttaaaagtttgactgaatgttaagc

SEQ ID NO: 63932 - DNA, 5017 bp, Oryza sativa
tttatgcattgtactgttattgttatagtatggtccaggagtgtcatgattcatgaacgacaactttgaatacagtcgcatgttattttagtgagatggtctatcaaatcagcctctgaactatgatacattccaagaaattttaaaattgcgagacattttaaaaaatatagcactaggaattttgtggctccatctcaataaatttccgttaatgcaggttctcgtgggcacaaaaacgccagcatgcttccttccttccaggtaaattttgttgtcttgtgaaaactttgcatggcatatgcctttgttgtcaaaatctgaatgggatgatgtgtaatattctaaatttcagaatagtacagatcttgtaagaatttatccttgtctaaattaatttcttccactcatacaggtgatcagatggtgttctttcttttgaatctcttcgagttgcttggacttatcctcactttcaaaccctttctggccgtaccagagcagcacgatacaaattagactgttcaggtatactacagatctagattcttcagaacttcagatgttggcaatttcatgagccctgcagcccgctgtgtgaagcaaaggtataacatatgctcatctggatcccccaggagcaatagatagaagcgagagtactactctgtcccaaagaatcaaagctagggtttgattatttttgggacggaggggtaggtgccagatatgcaattgcagcatttcagcgaaaggaatatatatagttggggtaaatggtggccactgatggctaggtttttcatggccagccagcatgtataccgagtagcattctaccagtataatgaatatagtactatgtacattgtaactagtaaaactctgtaagtgacatcagcttgagaatgaaattattgctggaatcgagatcagtacattgctaatattattttgtccctttttcaattggaagttcatcatttataataaatccacacgtgagccgtggagggtggatcccctacttggttggagctgctcttctatggtagttcaaaaccgatgaagatgatgctaaacgagaaaacccgttagtgcatgattaattgaattttaattattacaaacttaaaaataatctttttatattttggagtaacttctatatagcaaaaactatatgcattcttaataatcacaaaagaaaaacgaattttctaaaaaaaaaactttcgtaagttttttgcccccaaaacttttagatttgtgatcatcggatcatctcgagatctttgcatgaaggaaaaaaaatgttagaaattttcacacatgtcacgcgtaccatcctaatactaaccaatctatagttgaatgcaagatctatataagttatagcatagttatagtgcaattataatgtagttatagtacaggtacatgtaattacaatggacacaactacaccgagagtgctagctggatagtgctaaagagagacaccattctttccaaaaaaaagctactagtacactcaatatctatggttttttttcttcttagagaagtttctcttaaattactcatccgatttataatccgattacaccgttgtgttcgtaacaattaaatctttacaacaagatctcacatgattatattttgataaaaaatcacatattacttttatgatatgtctaaattacttctagatttcactaagtcacttcttagacatataaaagtaaatttagtaaagcttaaaagtagtttacatatattatagaagtaacttataacaaaaagaaagtaactttaatttagaactatatctagattcattaacatctatataaatgtgggcaatactaaaatgacttacattatgaaacagggggagtaactctctgtagtagaaataattatattgtgagtgagcttaaataagaaactatgtagagtgaattcgcaagtacagtgtagagaagatttataaagtccacaaaatatagaattaactaaaaataataataataataatcaacttagagaattatgaatgtacagaagtaatttagtcaaatatgaaagtaacttatatatattataaaagtaacttagtatataataaaagtaatttataaatataaatattttttcatcgtaatataatcatgtaagatcttgttgtgaagatttaattgtaacaaacacaatagtgtaattggattgtaaatcggataagtaatttgagagaaaactttataagaaggaagaaaaagacacacatgtctaagaggaaaaacagcgcgcacatcagcacgtgtagcagtaattcttctcacaattggatcgtcgttggttaacactaaaccgagaggcttctcggtttagattttaccaattacaatgcagttacacttcaattatactataattatatctaaaagttttttattaaaaaaatttgcggtaatttttttagatacaatcgctcgtattaggccatgcctctggtattcctttgcatttcgatcgtgtagcccaatacgacggcccaaacccaaactccaatcccagcgggcccagcaagtcagcctcacatcttcttcttcatctccctgtctctgtctctgtctctaacctaaacccacacctcgcgcgccgccgccttgctctcctcctccccgaccccgagtcctcttcgtgtgagctcgcactcgcagtcgcagcaatggcgatcaagcggaccaaggcggagaagaaggtggcgtacgacaagaagctgtgccagcttctggacgagtacaccaaggtgctcatcgccgtcgccgacaacgtgggatccaaccagctgcaggagatccgcaaggggctcaggggcgactccatcgtcctcatggggaagaacaccctcatccgccgctgcatcaaggtgcacgccgacaacaccggcaacaaggacttcctcgagctcatgcccctcctcgtcgtaagttcaccttcttcttccatgttcatacctaacctcgagtccactgtttttcctgacctgtttttcttgttgtttgtagggtaacgttggtctcatcttcaccaagggtgacctcaaggaggtccgcgaggaggtcgccaagtacaaggtataatcgatagccaagtacaaggctatcgatctctgttcaatacatacactgcaagaacataacagaacagtgttcaataaactgcaagaatagaaaacataacagaatagtgttcaataaactgcattgggttgaaggggcataatttgttctgtaagtgaaattggtggatttagtgtgctatcttaaggtgatcatgctgagttatgaaaataataataggatatgctgggttactttgaatttagctctatgttgtgccattttatccatatgcgttgtatatattctctgtgtgtggtattattagatgttctgtgagatgtgaaagtacaattttcaaccttatgtaacttttccaatgctatttatatctcaagtattccattgtttatatcatgatgtgatgccatatataatgatacatatagatatagggtttgatattagctagtattggctattgggtcatgatgttaaaagttgacttgttatggtgtgagtagctcaagtctctagctggtttatgtttttcttttcactgcaatctttttctactacaatgtagtttgtactgactgatctctgtaagaattctaactaggtcattatgtcgtgaacttgtgatgctatccaatgagtgaataaccatgatcttgtttttgttataaaacaggttggagctcctgctcgtgttggtctggttgctcctgttgatgtggttgttccccctggaaacactggtctcgatccctcccagacttctttcttccaggtgatcatttgtcgatgtgttaacatattgtttatcctcagagtcaaatacaagttctcactgttctatcttgttacaggtgcttaacatccccaccaagattaacaagggtactgtggaaattatcacccctgtagagctcattaagaagggtgacaaggttggctcctctgagtctgccctgcttgccaagcttggtatccgccccttctcatatgggctggtgatcaccaatgtgtacgacagtgggtcagtcttcagccctgaggtgctcgacctcactgaagaggacctgatggagaagtttgcatctggtgtttcgatggttgcctcagtgtccctggcaatctcatacccaactatcgcagctgcgccacacatgttcctcaatgggtacaagaatgtgctcgctgttgctgtggagaccgaatactcatacccacatgctgacaagatcaaggagtatttgaaggtaacctagtttctatttcataatttccctttttgatgtctaaatgcgtaagaattgtctgaggtagtctgataattagattgcggtactaagctgtagcatgcccatgtcttggcacaaacttatttgttctggtcttaacaatcaatcaatcaatcattgagaatttcatggtttagtaagaaactgaattatctatgatagctatttcacttagtttgatatgcctttagtgcttttagcactttcttgagactgcagtttacttttcttattcacgatgaagactcagttaaatattgattactactggaagctaagttaatgctgatttttgagaacttgggcatttcaccaccacagtttcttacatatttgtcttgcctattcttctcaggaccccagcaagtttgctgttgctgcccctgttgctgctgctgacagtggcgctgctgctgtagcttcttccaaggaggaagagaagaaggaagagcccgaggaagaatctgacggtgacctgggcatgagcctcttcgactaaagcctctgatgccatatctttgccaagtcgaaagttttgtttcagttctaaacatcaaagtctgtctataatctttagcattt

SEQ ID NO: 63933 - DNA, 599 bp, Oryza sativa
aattgagatgcatgcatcctctcgtttgccgcttccttcgatctactccctctgtcctataatgtaagggattttaggtggatgtaacatattatagtatagtgaatctgggcatacactttaggatgtgtcacatcaaaccaaaatctattgtattatgaaacggagggagtatatatattaaccatccagctttgcctccacggcggttaaacaatgcaatgcgtgcgtcgagtgtggggagtcgaggtagaaatgggcggcatgcgcacgcggagcaggcggtggccatcgtccatctgccattgtccatgagctcaagtattcctgatgaccacggagactccacaaggggtgtgctaacggctgtcggatttcttcatcgatttgaggcctcacccgtccatcgactgtgctgctataacgaaacaaaacggccgtggagtgtggactagagatcggtttgcccatggtagtaacctgaatgtttcttttagaaagttaattttccaatctggaaaattactattaattaccaacatgaatcaggactcctctgcgtgttagaattttttttccaaggctatgtatttatttta

SEQ ID NO: 63934 - DNA, 530 bp, Oryza sativa
ccctcttgggccggctcggcccatttccctctccctctctctctcctctcccgcggcccatcggcctccccgcgcgcgcgcgccgctgacaggcgggcccgcccgccactcccgctgacgggtgggtcccacctgtcatcgccctcctcccgccgcgcccgccgccgcgtccgtgccctagcgccgccgccgccgcgaatcccgccgctcccgtccgccccgcatgcaatcaagaggggggaattaatccccgcgatcccctcccccgtttccccctctttcccctctctctctccctcggattcgctcggaatcaatcccgcaaacctcgccggcgtattcaatggagccgagatctccgcgcccgtttcctctctctccggccgctctctctccctcccgttgctatataattgctccccgagctccgctcttccgtttccgccgctcgccgctcgctctcgccgtcggaatcgtgctcgcgccgtgctcctctctctccgccgtcgccgccgagctccgttccgtcg

SEQ ID NO: 63935 - DNA, 8404 bp, Oryza sativa
gtgtgtaggccctcactgcccgtgtaataattttatttacgctccagcttgttaaactctgaattgtatcaacttttggtgtacctagcctcctgggacaaggattaatgcacgcacgtaaggaatgcccgttgggttatttccggtcgtgacacgatctccgcccattaaagagaaaaagaacagtccagtttggaaagggaagggtgcatgtggtatccccttgaagtataaaaggaggaccttgcccatagagaggggatggattgattcttgccagattcagagcctagaacgagggagaggttggctctcactttgtagtcccttcatacacagatccaccaaaacacaggagtagggtattacgcttctcagcggcccgaacctgtatacatcgcttgtgtttcatgttctcttgagagcacgcaatctttccacatacagagagagcttgagatctcaccctaagcccccggccgaactggcaaaggggggcctgcgcggtctcccggtgaggagccacgagctccgtcaatgattgtttaaagtaattttcttatataatgttcttagaaagaatttttagtagttgagaaagcgtgcacatggaaaatgaaagggtagaagttggaaaaaaaaggaggctaacaaaggtagaagttggaaaaaaaaaggaggctagcaaatgttacaatggtgtgagatgaaacagaactttaccacaaaataatgtcttagcatggtctaatcatgagaatgcattagaaatcttatctatatattaagtttacggttaagtatacactagtccagcataagttacatatagcatgggcttgatgacatcattttatagtactaccctacttgtaataaaaaaaatagattgcaactaacttagataatgcaatcatcaatatttatttcatcccaaaacaaattcatgttctactttcattcagtaaatggaagcaattgagttggaagcaataaaacctagggcgacagatgtctctgatgcatactaccatatcaagcaacatggcccatttaggttgactttcataccacttattaattacagtttatcttgtagtactatatggaaatggttctgaggaacaatattatagcgtatcaaaactcatccccaaaatactcgtcaaaaatatctctccaagacctctctagtttgaggatttcaacctctccacgtgcccaaaaacaaatacggttgtcgcttcattcatggcaagacaaaaacatccaaattgcgaaatttaaattgtggatggagagagaggatgcaagaactgaaattaaatttcataacttcagaaaatattcattacaaaagtgttgaaagaaaacactcaaagacaagcaaacatacaacttcacatatgtttgattttaaactctccgaaagcggcaaactctcacaaagaggcgcgcaagggacacaacaaacactagcattcatctccctatttataggctaaaccccccaaaaattatccaaatgtccttagggagaaaccctaactcatctgaaatcttagccgtcccactactaccaccactaaaagtcatgcaatctttcgcctcaagccctattatcccataaccactcaatcctatagtagagaaccatgatgtagcactaatagattctttcttaaaaaaagtaaaccataaagaatgttttggaaaaagtgtgtgctacattatttttgcaacaatatctattatatattaaaagcctactaaactttctataaactctctcaacctgccaagtgtcactcctacaaatgcttctaagtcgctatgtggcactctaataaataaaaaaaaaatcatagaatgtaaaaacaaaacaaaacatctatctttcgatttccacttaaatcggtgggcccataattttaaccattagattagaaacaaaacaagtacacggcaagaaaaaggcaagcattggtggttctggatggttctttttctctatagcgctaaccaccgcgacgcacttcattccaaaggaagagatacgcggctgtgttcgttacttgagggttgggaacccatctccctgcacggaaaacggaacagtccattagtgcgtaattaattaagtattagctatttttttaaaaaatagattaatttgtttttttaagcaactttcgtatataaactttttttaaaaaaacacaccatttagccgtttgaaaaacgtgcgcgtgaaaaatgagggagagagattggcaactagaatttccaaacacagcctcatgttattaccaaaaatagtaccgtatactctctctctctccctcatgtacatcattcgaaaaagaagactccatgtagttcatgcaccattgcaccactactagtagtattctttttataaaactatttatatcatttaaaccgaatattattttaaagatccttttgaaccatcatacttgttggtatttcttaacgacattaatagaaatataattctcacaaatggcgcagaaatactcctggtatattatgattacagagtttatccgcaagcgcacggatatactattatagcatttcacctgagagtattccaagggtatcgtatttattttatcccgtgtgacggagctcgtggcccctcaccgggagactgcgcaagcccccctttgccggttcgaccaggggcttagggtgcaatcccaagctctctctctctctctgtatgtggaaagatcacccgcccgcaagacacacgagacacggcgatgtatacaggttcgggccgctgcgaagcgtaataccctactcctgtgtttttgtggatttgtgtatggacaagttacaaaagattaacttcctttcccctcagccttccaaaaaggaaaaagtcccctctctaaatgggcaaggtcctccttttatatctcaaggggataccacatgcacctttctctttaatgggcggagatcggtacggtttccatccgggagcccttctgatgggacagcccacacctacccccacctcccccgagggcagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccccagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcggtcggcgagcgtaattaacgcgcgcacgatacaatccatttcgattgccacaaccgcatatccacttcatgcgccgtatgcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgatggcagtgtactaccgccttcccgcatcgtgagcgagaggcacgccggactgccgcgccgcttcatgccggagtccgccaccggtcgggagatagtgatgctgggcgagggacgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagttttttcttactcattttgttcgtcttctggttttttcttctgcttcagcgatgtcccgtcgcatccctcccgccaccccaagtccggccagtccgaggccgaagatccagcggccgcagaggagcggaggcgagaatctgaccggcgtgaagccgcagatcgccttcgggaagctgaagaggccgcccgggaggccgcccgggttcgccaagcggaggaagctgctcgggaggaggccgcccgggctcgccaggctgaggaagctgctaaggaggaggccgaccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttctcctcatcttctgtcgccccgctgagcgccgagccccttctgcaggccctggccgcgcgcaaacaccgcagtgctggatgggttcaacgcccaagtggaggccttgcgtgcggaacgagcggagctcgaggccgcatggacgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctctaccaccgcgatggtcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcgaggaggcccttgaggcccgtgccatggcgctggaagaacacgccggcgccgtggagaggggcttgacggaccgcgaggccgccgctgatctccgagaggcgacgctggcggcgcatgaggccgcctgcgccgaggaggagtccgcgctccgcctccgcgaggatgcactcgctgagcgggagcgagctctcgaggaggccgaggccacgacgcaacggctggcggacagcctgtccctccgcgaggcagcgcaggaggagcaggcgcgccgcaatctggaatgcgtccgcgccgagagagccgcactggagcagcgggctgccgacctcgaggcgcgggagaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgctggtcggcaagcgggcctctggaaaggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggactgaggacgacgcgcgcgcgcgcgtccgggatgccgccgaccacatcgtcaacggcttcgagggctcggcccctcggctcgcgttcgcccccaactccgacgaggagggcaacaccagcagtgcagacgatgggggtgacgaggccgtcgactcgggcgcgtcggaatgagcccccaagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgaggacaaggttgagtacgagtgaccctattttaagtcaagattcttcaaaaggaaataacagcacagacacaacctttaggaaattgaaactgcttctattgaaatgttgaaaaaagagaaataagaatgtaatgcatgtgtggtagcccccggccaaccctgcacacccgaggggggtgcggggttggcctgagccaaaacctgacacctgacctccccctcctcaggggtagaagctaccaaggggcgctatgttccatgggttaggcaagtccgtgcgctcgcccgtggccagcccgaccgagcccggccgggggacacctatcactcgatacggaccctggcggttggggagagttgctcaatccagcacgcggtgcgacgccgcgtgcgaccagttcgtcgcgcagagcgatcgggctccgacgtggcgctgatggtagcgccgca

SEQ ID NO: 63936 - DNA, 4693 bp, Oryza sativa
ctacaaacactcttaagccattatgtggctttctacgaacgctcatacatcgtcatgtgatgcgataaaaaattagagaattctaagaaaaaggtaaaacatctaatacttaaactctggattcgttattttggaccattagattattattagatccattaaaatataatctctcacttctaatatacatttctatacgagagaaaatacgtaagtactatccatctgaaagaagatcgaaataaaaaacataaaaaatcagaaaaattacagattgaaaagaaaaattaacagctaacatataaaacgtccaatccggtaaaatctgctcactgctcaagcatgtatatgcagcatctgttcttttttttcgtaagttgttgagagctaaagcatatataataaaatattaaaagcatttgatctatatcaccaattaaatatagacttctatggttacatttatcgatgtcctcttcatggagagttacatgcatgcgtgcatccttgcatgtattaacttttaaaaaatatatgttggttttatgctcaggttaattcttttattcctgacaatctacccatctatctatcaattatatactgaaagtccaataaacttcgtataaacggtactaatccaccgcatagcatctctataaacggttctaagccgccacatagcatctctataaacgcttttaagctgccacgtgacgctataataaatcacataaattctaagaaaaaaagcatttaactattgattttcatttattttggtagactattgttttatccattacatctatcttaaaaaactaccaattaaattatctctaaaagtccccacttcaaggtgcacataagtatgtacccacgccggtccgatgttcctctctttcatttttttttgtgaaatccaaaaggcaatacaccgttaaaaagtttgtactcagctcaaaagtatagttgggatttaaaattaaaattcaaagctcctttagattataggaaaaaaagtatgcgattgggattcctattgattgcatcttttgatttgcacgaatacattatagtaagtctgatgaaaaattcaaatcctatcgataccatgcaaaaataaacatagaaaagttaaagtccattaaacatcttatgaacactcttaaattcatacatgatactataataaattagataaaatcatagaaattatgagaaaaagataaaatattacatgtttagtagtccgggaaacgttctcactataaactagatgggtaccccgcacattgctgcgggagatttgtgtgataaaatagtagatatgagctgtagaaaaaaaaatcttatttactatatgattttctttcatgtgcttgtatattttgtactttgatcaattattgaaaagttataaatggttgagttgtatggtgtggcttttggggagaagaaatgcaatttgcacccttgatgaatcatccaagggctaaaaacaattaagatgatgtggcttcatgagagaagagagaattagcattagctgcacttagtgggatgaactttacagatatattggacaagggagtaccaatccgataagctatttagaaagctactaaaacgcttaaacgcttaatatgtatactatcaattataacttatgaggtatatccacactaccactatctgctaatccccaaatcatattgcttacgaggtatccatgcacggtgcacctaacgattagctgatatccaaaaagttgcggtatatctcaatggcaataaaattaataaaatagaaataagatgcatgcgcatgtttttttccttcgcatgggatcgagaaaatcaagctgctgatgcaaaggttgtttggttaactgcagtttatttatgcaatgaaagatgatgatttcatctatgtgggttaacaaattttaacattcatattattgctgtactctgtaaaaaattcgtttactgtccaaaattcatttattcgttgtttcacacatgcatttctaacatgtttctgacttatatatttttttcaatcatgtgttggaaagaaccttcaaattctttcaccgagagacaaaagtcatgatattcaaaatcctaataacaaaaattatgatagtttaaataagatgcccgcgcaactgcgcgggctaccttcctagttggataaaaaatggtcgaagctgaaattttagtaacaaaagttgatccaaaccataattcactatatatatatatttaaataaggggtattatttatacttctttgaaacagaggagtggtggtggtttcgccacccccaacctcaccaactgcctactatttgctatactatttttaaatgttggtaatagtggtgacactgaatctatcaccatcacgtgtttcacctttgtatggaccctataatgttggtgaaacttttttgcttctcctatgattaatcaaacagaaatagctctatgcctctactctagctaattcagtaagcatcaaaaactcatggtgaagtatagcttgataggtagatagttttaggatttaaaaatgaatgcaaaagtttattttctaaaaattcagtagtaacgcacgagcaaatcagctagtaacatacggggttagagagcttacatgtggtgaaattgtgggtaataaacagaatgcatcacatcgtggagatggttaacaactagcaaatataaacttactaccatgtattagcactttatgtctggtcccatctattttttaattgtagcatgactcatgtttgaagaatttttcagatgggtcccaccttattatctactttacacatatatatattgtggtgcctcttcatcctactattaccacatggcacgagtctaccttactacctagtttacaataaacattgaggatgtctaaagaaaaaaaaagtcatgggaccaaagaatcgacatgtcagtaataaatatatataaaaagaaaataatggcaacaacatactaacattacttctcttttacataaaattttgttgcaaaacacagtgacacggataaaaaggagtacaccataagtatataacctaacatagagttactttctccgtttcacaatgtaagttattttagcatttcctacattcgtattgatgttaatgaatctagatagatatatatgtctaaatttattaacattagcatgaatgtgggaaatgctagaatgacttacattgtgaaacggagggagtattagctagtcatcatttgttctcttcaccgaccgaccggttgggtcaacctttctatgtacgctcttatacacgatgtcgtcattatgtgattaacacaagaacgcttgttcgtccctcgcctacaatgaaaacagaaactacaggacgcaggtgactagctctgcgtgtcgccatggtcgcgacaccatgttattttcattaccacagaacaagcatttatatgcatatatatgcccgcattttgccattcatcctccacctctcgccgccaagcagcttcaacaacagcagaagggcagacgtgagaacgatatatacatatatccaacatgcagaggaagtcgagcggcggcggcggcggcggcagcggcatgtgcgacctgccgatggactgcatcgcgtgcattgcctcgctgacgtcgcccggcgacgcgtgccggctggcggcggcggccgcggcgctccggccggtggccgactcggatgacgtgtgggggagcttcctcccgccggagtgggccggcgacggcgacgccctggacggtaagccggggggccgcgagggggagagcaagaaggagatgttcctccgcctctgcgacttgcctgtccttctcgacggcggcaagctggtaatcaaaagccatttaattccttatctgcgttgtttgttaattctttttttttacctttggttccataattattgaagttttgaacacggtttggtcaaacatttataattttgactatcaataattttataaatatttagtttataaaggcacttgagcaatatatatagtagtactatataaaaataaaaatgtatttatttattctatataatataatagaaaaacatagttaaatatatattttagaaactatgtcattgttcaaaacattaggccatttccaatccaatgactagaatggtgtcatagcattaaataaactgccacctaggataaaaaatgaggtgacaagtgaataaatgaggaaagagaaggaaaccacgtcttgcatgggacatagtttctacacaacatccaagacatcatgtgagataagtagcattaaacttaagtatggaatagtgatgtttggaagagtagtgtctagtattagtttcttaattatgtgaagtttatggaaactatatctagtgtcttgggttgggaatagccttatggaaccaaaactagagggaggaagtactatgtactactattgcctcttttgtagggcctgttaagatcaatttgctgtggtaaatttttttggtaaaagttttggtggcaaaagatttggcattgaagtttgttagttggtgtctagatgacttagatgcatggtaaagttttaccattttactagtaaagacagatagagcaatgctcccaacgtattttttgg

SEQ ID NO: 63937 - DNA, 9862 bp, Oryza sativa
tctaagtcaaactttattaaatttgatcaagtttataaaaaaattagcaacatctaaaatattaaattaattttattaaatctagaattgaatatattttgataatatgtttgctttgttttagaaatactactatatattttctataaatttgattaaactaaaaaaagtcaaatgacctataatataaaatgaagggagtaatagactagttcataccagttttgccttcacactaacagtactgggcattcagttcactgatatccctgctctcattgcaccagagcttttcgttggagaagcgtagtggtgccaagaaatacatgatgcgagcaagagctctcggttttggatggagcggctatccctacggaggtctcgtctggatacaaaaccatccggattccaggtttgtggttggtgcacaaaaccaatgaagaaatcccacattatatgtgttatttttgcaaggctttacggaattaaatttagaaatatattgtttacctattttttatttaaattgttcggggtgtaattattttgggagaaatatattatcaatatcgcttcgcgaaaacgaggacgtggacagtacgtggcggcgcgagaccgagcggtcttgcgcagccataccgcgagaccccgctgaaccagtcggcgatcccggactgccatgccaattcatatggttaattaattagtgattaattatcatcataaatcaggtaattaatcactaattagacggcaccgttggacaagaagttcggtctcgttggttccttatgcgagaccgttcggtctcagctgtttcctcgcacaagaccgtgcggtctcgcatctttgccgtgcgagatcgcccgtgtcgttacgcctacatcatttttacgcaacggttatgcgaggtcgacggtatatttccgccaaaacatttacattccgaatatttataagaaaaaaacaaatcaacagtatgttttcaaatttaattctggctttatgtaaatatcatttactactatctccgtcccaaaatgtaacacctttggctatgaatctggacgcacggtcatccagattaatagctaaaaatgcttatatttgggacggagggagtacaaaatatcatgcatttccttcttgaatactaagagtattatcatccgtagaaatgatcttaagtgttgatttatgaattctgctatcagtagatatggtccatattgattagaaaatctagattggttctactaccacagaacattgtaaacatgtctttttttttgtcatgggatgtactccttgttgatttttctctcccataaatagcagacaacccttctgacgattatatgtccattattttcccttctttatttctaggttttctgaggtggccatcctctcccacttgtgttggttggacatctatggtatcttcaacacaaagcatctctcaaacggtacatcctacggagcttatcttgtgtacaatgtccaattcttgcacacagaagatcaaaatggaggctacaaagaacaagatgcaacagcatctgggtcatcatccacctccagcatttgcagtcatgaatgcaaccatcttatgccgcagaaacatctgcgctcactgttgttcaacatggattatgatggatcatcatttgtaaaaaccaacaataaccagaagaaagaactgaaatatgtaggcatttgtgtaagaagtgatggatggatggagcaggaaattagtacagagatatcagtggtaaaacagaacaatgaagagaatggagacatttctattgagtttaggggcttaaccggatcgcaccaatgccaaattattgtagaggggatcgaaattaggccgaaaaactaacggttctccagttcatggataatcatgtcagctttcctagttggcgcagacgccaaaaatcttgggtactttcttatatatcatgaaaggtttatatttgggtaatctttggaaataaaacagttgatgatctaaaagtagtggagtattcattttgatgatctctacctttctctcttctttgttcttccaccgctggagaagtgatcttcagatctagtttacaacgcctttagtcctaggttacaaaccgagactccgatgagcattttttaagtaccggttgaaataactgggactaaagattcatctttagtcacagttggtggtgctaccaactttagtccagattggtgttaccaaccgggactaaagttctttttctttctttttctattgttctttgctgcttgcatctattgattttgagccgaaatcaccgacgccgtcaccccaaatccccacaaatcatccacaatttataggcccatctataaaatcatccacaaatcactggcccatccacaaaatcttcccaaatctaaaaaaatctataataaaatctaaaaacaaatcagtcatagccagcagacgggggtgaggaggaggagggccccgcccggccgccgccgccgcctcctccaccgggctgccacccggccaccctcccatcctatcgcctcccctcccgccggatctggcagaggggaggccgccgcctcgtgcgccgttgcccgcctctcccgccggctcctctcccgcccgatccgacgcaagggagggtgtcgccgtggagatgggagagggagaggggaaggggaggaggggatcagacgagaggggagggggaggaggagtggaggaggaggagaagaaggcgtgaagaggggaggaggaggaggaggaggggataaggcgttgttgccgatgccgagataaggaagagagagagagggggagagagagtgagagatgccaatgacgtgggagagagatatctaatcccggttaccaaccgggattaaagatataattttttttgtcccggttggtaacgaaactagactaaagatggacttttgaaccaggactaaagatgaattagtcccagtttgttgaaaccgggactaatgtgattgtggagattatggatatcccatatctacacggcgatgatatttgggctgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccctcccatatataaggggggtccgggtgcctctaggggcagaggttgattttctccaaattatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacagttggcgcgccaggtaggggttgcgtcaagcttttcgccgatcagtgcaatgggttccgtctccggcatcgacgacctcgtcttcccacctgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagttacttcaagaccatctcaatcgagttggcttcaaaccacttgggtgagatcgcatcttctccaacgtcaccagatcaagatgatggggcttacccaccgatcctgatgaagctccccgacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgccccaccgacatcgtggagtacgacgagtttagctctcgctacaacgacccggatctcgacgacttcgacggaagcctagatgacaactacacccctctctacttcggcgtcttcatggccgatgacgagacggaggagcaacgccaagcccgggagaccgaagcacgtcgcgagactgagcgtcgccgactggaggaggagcatcaagcacaagaacaagaacggctacggcgtgagcagcaggagcgtgagcggaccgcgaaggaggctgaggatcgacggcagcgagctttggaagcagggcgccgagcgcgtgatctcatcggccaacaagatgttgaagggacaccggttttccgcacccctcaacagaatgcggttgccgcgatcaccctcctcgacacccttctcaaggaaaacgagctcaatcaatctgatcacgtcgtcaacatcttgaaccagacgaagaccatgattgcggcttcggtcccagttaactccgaaagcgtccatacgccgaccggcagccgagtcccccacttccgatctcatgactaccgtcatccaagcctcagcatcaccggcgcaggatccaatcgcaggagcaggggtcacgacgagcggtccgttcactcacctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccgacgattttccgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagccgaagacgccgtcaccgcatcaaagcagtcgggtcccagttggaagccaaacaagggtacgccggctacgggaggaggtggaagtaacaaccataaggaccgcaagcgtaagcctgaggaacttgtcgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaaaaactctgacgaagaacaaagcacgtcgaggaagaaggacgacggcgacaccccggcaggatttcaagaccaccgcaaggagctcaaccatatcttcggcggccccctggcttatgagtctaaaaggaagcaaaagttgactgaacgggagatcaatgctgttcagcccgacacgccccagtatcttcgatggtcagaaattgcaatcaagtttgaccgctcggatcatcctgaccgagtggtccatccggggcggtaccccctggtactagacccagtggtccgtaatgtcaagcttcgcagaaccctcatcgacggtggcagtgcactcaatatcctcttcgctaagaccttggatgatatgcagatccctcgctccgagctaaaaccaagcaatgcgccttttcacggagtaattccaggattatccgcaactccactcggccagatcatcctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtcagcccgagaggatatccgactggctgcagccacggcgagcgaaggagaagtgcccgctaccaagatctcaaaaagtggagaaagcgaagccaagactaaaaagattcccctagatccttctgattctactaaaactgctgtaataggtgccgagttagattgtaaataggaaagcgcgctcatcacctttcttcagaacaataaagatatctttgcgtggaaaccatctgatatgcccggtattcctagagaggtgattgagcactccttacatgtcaaacaagatgccaagcctatcaaacaacgactccgccgattcgcacaagacaggaaggacgcgatcaaggaggaattaaccaagctgttagcggcaggcttcattaaagaagtccttcatcccgactggctggcaaacccggttctagtacggaagaaaacggggcaatggcgcatgtgtgttgattatactgacctcaacaaatcttgccctaaagatccttttgggttgcctcgcattgaccaggtagtcgactcgaccgctggctgtgagcttctcagttttttggactgctactcggggtatcatcagatccgactgaaggaatccgactgcttgaagacttcattcatcacgccctttggagcatactgctacgtcaccatgccgttcggactaaaaaacgcaggagcaacttatcaacgtatgatccagagatgcttctcaacgcagatcggccgcaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgatttccagtggggacccgaagcacagaaggccttcgaagatttcaagaaactcctcaccgagccaccggtcttagcctcaccatacccgcaggagccgttgttgttgtatgtagcagccacctcccaggttgtgagcacagtcttggtcgttgagcgcgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaatggacggattgctaagtgggctttggagttgatgtctttggacatatcattcaagccccgaatttcaatcaagtcccaagcgttagctgattttgtcgccgaatggaccgagtgccaggaggatacccccgcggagaagatggagcactggaccatgcattttgacggatcaaaacgactttcgggcactggagcaggagtagttttgatttccccaactggagaaagattaagctatgtgctttggatacatttttcggcatcccacaacgttgccgagtatgaggcgctccttcatggactgcggattgcaatttccctagggataaagcgtctaatagttcgaggcgattcacagctggttgtcaaccaggttatgaaagagtggtcctgccttgacgacaatatgatggcatatcgacaagaggtacgcaaattggaagacaagttcgatggactcgagctcagtcacgttcttcgacacaacaatgaagccgccgacagacttgccaactttggatccaagcgcgaggtggcgccctccgatgttttcgtcgaacacctttatacgccgacagtacctcacaaagatactactcaagttgcgggcactcatgatgtagctatggttgaagccgattggcgagagcccctcatacgatttttgacttctcaagaactcccccaagataaagatgaagccgagcggatttcaaggcggagcaaactttacgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccaatttttcgccagacaaattcatctaccagctcaagagttgcagaccatcccactgtcttggccgtttgcggtttgggggctcgacatggttggcccgtttaaaaaggcagtcggcggttacacgcacctctttgtggccattgataaattctccaagtggattgaagctaaaccggttgtcacaatcacagcagataacgctcgagacttcttcatcaacattgtgcatagatttggagtgcccaatcggatcatcactgataatggcagataattcactggcggagtttttaaagacttttgtgaagactttggaattaagatctgctatgcctcagtggtgcctcccatgagcaatggacaggtggagcgagccaatggcatgatacttcaagggattaaagcgcgtgtttttgaccggctaaaaccctatgccggcaaatgggtgaaacagctgccatcagtactttggtctttgcgaactacacccagtcgggccacaggccagtcaccttttttccttgtttatggggcagaagcaatgttgccgagtgaagttgaattcgagtctttgcgctttcgaaatttccgtgaagaacgctacgaagaggaccgagtggatgacttgcaccgattggaagaagtccgcgaaacggctttgattcagtcggctcgatacttacaagggctgcgacgttatcataatcgcaatgttcgatcccgtgcctttctagtcggcgacctggttttgaggaaaattcaaactacacaagatcggcacaagttatctcctctatgggaagggccatttatcatctctgaagtcacccgaccaggttcctatcgactcaagcgcgaagacggtacacttgtcgacaactcttggaacattgaacatcttcgtcgtttctacgcttaagcttatcattgtacttccctatcttgactgtcaacatcaagttttcttcttgacgttgtcagtcaggggctatcatcataataatggagtgtgattttttatcactttaatttgcttacttggtctatcattgccttgtttggtttttctacttagtctgcgaggactgaaagtttttaatagcttatttggttttaggctccaccaaagcttgataaaagcttttaagaaatcaa

SEQ ID NO: 63938 - DNA, 12330 bp, Oryza sativa
ataaaaaatgctccaaataattaagttgtcacaacttcttaatttattgtatcaaaattggacctgccttaaagttattgtatttatacgatcacttataaagttcttatactaaattgcaccttcttgccaagtggttgcactagaacgctcattttttaaattattataccaaattacacccacctaccaagttgttgcactgtgagtgcaatttactcaaaaaactataatagactcagttgaaactcgtctttgccggattgccaagccacagggctaggatatcaaattaatccataccttagcaaaataaaagatgacacggtgtcttttgttttattttaacttcattagaatatgttttatattcagtaacgccggctatttctaattcaggatacatactctatgtcccattttggttctgattaaggtgcagattcttgaggccataatagtataaccagcgatggattagaactgaacttgaaaaagttaaggtttagcccgtcaaggatattatatgggatgctcaagctatagaacaatacaggtaaaggttttcatatatcttatatgtagtgtcgtgtgtatgaaaagcgaaatcaaatttggattggagtcaaatttccatatggcacactctaaattattttgtttatatattttcatgcgacgtcgccaactctcttggtgggcgtccacccgtgcgacatcgccgtggctgaaccagaaggccaccaggcaatcggcatcagacccggtgatgatgtctgctcgacaaccttagccgcgtgtaagttttttaaggctatatgtttgtagtgactatctatatatatttgttgacaaacaaatttgtcagatgtaaatatgatataatattagcgtaattacatgtaattataatttgtgaaattgtatataactttccaaatttctgtgataacatgttatttccgcgaagcggttgtcgtggaaccgaatcccctcacccataagtgtgcaatgatttttttcccttctcaaaattttgaaacaaatccgatttaaaattatatgaaagttatattatagttacaatataattacagaattatgttgtatttacatttgacaacgacaaatgtgcaaaatcgcttttgtattttttttccgctatatccacacaaacttcacaccgtttctgcaatgctgatatactaaagttctctgcatattggccgtttctgcagagcaggcggtagattatattgcgctggatgaatggatccaacgctggtatactgcatagtgcatacatattcttctctaacattactatggcaacttgtactgatgtgctttgacctaacattacatttgacaacgataaatgtatagcaaaatcgcttttgtatttttttccgctatatccacacaaacttctctgcatattggccctttctgcagagcaggcggcagattatatttgcactgaatccaacgctgatatactgcatacatattcttctctaacattgctacggcaacttgtactgatgtgctttgaggtaacattattttccgacattttcattgcgggatataatgaacgaacaacatgcatattaagaagctaacaattatcagttataataacaatatgtaatcaaactgtttcacgatccagattaataagcattgatattcaaattaagcgtggtcttcctctataggatcgatcttgcaaattactgcgattttacctttcttttgtttcttgaatagagagactcgaagccaattttctttcatctctggttgtttccattctctaggtaggatattgcactgcacccttctcagagtataagtccaaagccctggatgcaataggagagacagtccacgatcgtacacggctcaaaacggtccaaccgtgtacgttcgatgcttccatctgcaaggctataccgttctaagtttccacagtatccgaagtagatggtatcagcagcgacaaatggtaaggtctccgccgacacggagatcgcgcgggacatgctgatgaacagggcgcgccagttgaaaccctttaccgggacgaggatcccggcatcgaaatccaccctccacgcctcgtacttcctgctgcgctttgttctgtagctaccatcgtcatgagcataatggtctggccaaagcatccgctgcaccagaatcagctccccgcccttgtcaaccaagtgaagggtgctctgcaacgctcggctggaatggatcaatgaactctcaatcgccatccgcatctgcggcggcggtttccggcgatcatccgaagcgatatcgagctccattattcccctgtcggtggcgcggtagaagcgactgacgaatggcagagccgcgggggaggtgttgtacgtgctgttgttgttgtcgtctattaagttgcatgcaccagccagttgcacctagaagcctaagctgatagggaaaggcggacaattcactttatacactccaacactccccctcacgcgagaccccctcaagtctcaagcgtggaatattggagtgtgctgcaattattttatttaattgcgcgccagccaggatttgaactcgagacctctggctctgataccataaaagtgtgataggctcaacacgatagattggattatcacatatggtagagtacatataggcacatgccttccatatctagcaaccgatttatagaaacaatatcggagaagattaaggaaggatggcaagggataaacacaatctaacacccccgcagtcggaacgtcgtgggaacggacattcagactggaccgaaactccgagaagatggcactgggcaaccctttggtgaagatgtcggcaaactgtgacgtagtaggtacatgtagcactcgaacagatcccgcagcgacgcgatcgcgaacgaaatgtagatcgatcttcacatgcttagtacgctgatgttgcaccgggttagaagagagatagacagcactaatattgtcacagaaaaccaatgtggatcggctcggaggggtatggagctcatgaagaagctgtcgaagccagcaagtttcagccaccgcgttggccacggcacaatattctgcctcggcactggagcgcgatacagtaagctgacgtttggaggaccaggagaccaagttgtcgccaaggaacacaccataacccgaggtggatttcctggtgtctggacaacctgcccaatcagcatcagagtatgcactcatccaatcagcatcagagtatgcactcaagtcaacagtggaggagcggcggatgtgaagaccataatcaaccgtgccacggacataacgcaagatgcatttgagagcagcaagatgaggctcccgtggatcgtgcatgtgaagacagacctgctggacagcataagagatatctggcctggtgaaagtcaggtactagagggcgccagaaagactccgatagtccgtgggatcacgaactggggcaccatcagcggcagagagcttggcgttggtgtcaacaggggtagcacatggcttgcaatctgtcatgccagcacgctccagaacctcgaggcagtactggcgttgactgagatgaagaccagaggactgccgagaaatagagatgcccaagaaatgatgcaagctgccaagatccttcatcgagaactccgactggagagcacggatggtccaccgaagaagtgcatcagaggaggctgtcagaacaatgtcatcaacatagaggagcaagtaaaccgtgtctgagcctcgacggtagatgaacaaagatgtatctgattttgcctcaacaaagccgagtgtaaggagaaagctggcaaaccggctgtaccatgcccgtggggcctgcttgagaccatagagcgacttgttgagacggcacacaaggtcgggcttggtggggtcaacaaagccggcgggctgagtgcagtagactgtctcctgaagtgtcctatggaggaaggcattcttcacatccagctggtgaactggccaatcgcgggagaccgccaagctgaggacagtgcggactgtggcaggcttgatgacagggctgaaaatctcgtcgaagtcgatgccggggcgctgcgtgaagccgcgaaggacccagcgagccttgtacctgtccaggctgccgtcggactggaacttgtagcggaagatccacttgccggtgacgacattggcgccatttgggcgggggaccaagtcccatgtacggttggcctgcagcgcagtgaactcttcctccatggcggaccgccaattggggtcggccagtgcggcacgatatgtgcgcggaactggagagagagtggtggcactcaagttgtagcgcttgacgggttggtgaagtccgtgcttgccgcgtgtcgtcatggtgtgctcattgatgatgggagagatgccgagctgcgttggcaatcgaatgccggggacacgcgcactgcgggcgcgtgtggcagcaccagtcggtggtggtagcaggggagctcactcggtgggcgcgctggccaacgaagcaggcgtcggtaggggagccagctcgatgggcacgccggctgaccaggcaggcgcaagtaaagacagcccagtcggtgcgccagctgaccagggcgaccgaggggcaggcggtccggtcggcacaccagccgaccgagtaggagtgacggttgggcccgacggcccagcagtggttgagcgcaccgaagcctgtgcggggaagctgcgagcggccggcccagttggtggagtggccggcccagttggtggagcggccggccgagagcggctatgctcggtgagggccgtgggcgtgcaggccaccgggtcagtgtgaccagggcggcggcgactgccaatcggcgcagggagaggagctgaaaaatcctcaagaaacttcaagtcagtagcaactgcatcattagtcatctcagcaaaaggaaaacatgtgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtctgagccttggtcctctaactccatcttcagatcaaaagcactacacttctgaaaaagggggaataatagcaagactgagtacaaccaccgtactcagcaagccacaccaacgatgcagacgtgcaaggggatacaaggaggggtttgtggctatttgcataaaggcagttgtaaaatattttattgagcaaaacagtaaaactattgggtaattaaagtaacattaaaaactccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggctcgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccactattcagtcgcattttagttggataattacgaccatgaagcatggccagatgtctcgagcacgcagctcactctgatactaaaaaggtctaatactgtaattatcccatcaactgagctagtggtaaataagcatcgctaagcatatagttctagctgggtcaaataagtaacatgagctagtcgatttattacccaaggttgacaaatgatagatatcaagtaaacatggcacaagcgagcagataggtaaaccctgatcccgtgtaattagcaaaacatgcatatttatttgcaaacagtaaaagatttgtaaattaggatcaacatgctcaaggggaatgtgtgacttgccttgcttcttcaaacaatcttccgaactcttatccttgcgaccgcgatcttccgaaacgacgggaactacacgctggcacgcaaaacgaggaaaaactcttataaaaaccaagcaaacagtacataaaaagtaaacaaacatgtagagctcaattttagatgaattttgcaagtcgacccggtcggacggccaccggcggcggcagcgcgtcgcgaggacgcccgggaggcggccgacgaaggggaggaaaagggagagggaggggagtgctcaccgagatgcacgacggcaaaggggcggccgacggcaaggaacggtggcgacggggctcctcaggaagacgacgtgacggagctccggcgacgggcgtcgctcgggatggggcggacgggctcggcctcgatcggcgaccgaggaaggaggagctccggcggatttccggcgaagaggggcggcggccgaggtcctcctcgtccttgcggagctgagggaggcaacggcgcgggtcggcgtcgaccgaagcggcggcgcgacgcggctggagtcgggggcggcagcggagagaggtggttcgcgtggctacggcgctacggaggtggagaggggaaatggagcggtggccgagcttgcccgggcggcggcaaagctggcggtggcggcggagcagggcggcggcgaccctagtgacgggaaacggcggccggagttcgccggagtgtggcggcgcgcgggagcggcgtggggaagagcgagggagagagtgccgggcccgggaaacaaggggaaatggacgaggggagcacgggggtgctttttatgggctcgggaaggcgggatcgaggccggacgtggcggaatcggccggcgaagtggggcgccgacgtggggtggtggaggggttaaccggcgccgattttcgcggggagagtgggggaaaagtggaggaggtggaggggatcgattccacgcgctcgtggggcggggtgaagcgcgggaaccgcggcgtcgtggggcgaaaccggcggccatgacggccattggggtgacgggaggttagggaagaagatgacaggtgggacgagagagaggggaaaacgggcgagggaggtaaagcagacttgagggagagagagagccgagcgggccgagggaggaggccggcccgagagggagagaaaaggggcgcgcgggccgcgggagggaaggaagacttgggccgaaaaaggcccaaagagaggaagtggaattttaattgtttttttttattttaattgatgcaatgatctttgtgctattaaaactatttctcgagctccgaaaattcacggaaaattccggagagtacattagggcgcaaagaatattacaaaatattcccggccaatgatttttaaaggaaaatttcaaatttcctctataattccacttgattaaattggtttaacttttatttaatttctagaaaatgtattattaattgatttttattcccgaacgaaaatcggggcgttacaaatctaccccccttacaggaatctcgtcccgagattctgggatggctagaaagaaagctggagctggcgggcggtttgactgatcggacggatccgcatactgcactgccccctttctgtctcgaactgactgattgactgattgtccagacttgcacgactgaactgattgattcaacttttctgttcctttgctttgcaagactggactgactggttctacttcaactgacccagacagggctgtggatgcttaaggaacttacttatcttggactgaattgttgaggttagcaattttgataacctgacaattcaccatgctgactcgaagaggatgaagttgttcctgaagcttgcatctgacctttgtaactcattgatcctacgtccgcttgaacgggttctgactcgagtgacacgtaattccaggaaacctgcttgacctgtctttcgtctgaaccgcaactgtcctcactgttgcttctctaagctaagctgttgacctggcctcaccggtgtccctcagaattccatcaagtgacctaggaccggcgtaattctgcatgacaccttgcaattggctccttcaactgaaacagcgacgaggtgagccagaactcatctctgcgacctaccccccttacaggagtagtcatacatttcgcctgactgggaacaattgaactgctggcataactgtcccgcttctagcctgacttcggtgtcgtatgcctaaatagattgcatacccactgatcacttaacagatcaaactcaaaagtccttctcttgacatgacattacacttcgtcgatcgtcctttgctgactcttcctgggtttacggactataggccctgcaattgttttcccaaaaatactacaatctgaacgactgccggaaattgactttgatactgccgagagtttctgctttttgatcataaccacttcgctttcctatcttcggtaaagatgattcgttaaaagggattctatgccatataccctgctaactacacatttctggacttgactctgtatacttctgacccaggtatggaacaatttctttttcaacttctgagaaacattgagatgattcctggagcttatactggctgtcttgaactaaggaaaaatgtaattgatccatgatcgcaccactagggtgtaaatttccgcttaccatcctctaacggcttccaaggtttagaggagttcccaagattctttatatgatgtcactttcaaatattccatcactcttttcatccgaataccattgatactgcctttaaagagatctcatcatgttgggtgttgagcgtctaaccattttcaatctgctagttaaccattcctctatttgctcgcaaacaggttttggagcttcaacagaattgcgatgagttagaagagaaactcttggtttcttgtgacaccgacagattcacattttaacttgcttttgcatgctcaagatgaatcataaaagaagagaaactgactgactcaaactttattcaatattcccttttcattacataactgccataaacatctatgtacagagagaagtgctataaggttaaacacttgtagactgctgctgaacttgaaacgtagggggcttggctaggactgctattgcttccattattcgaacctaaccgacttgtttctttaattcctactggctgaagtctcaccgggaatgttgctctgcttgttgatcttcgatggtggagtaacaactctcttgacagctgcagcaggtaggaacttcttgctcgcggggttaccgagcggtgatttgccgatgggcctttggattggagcaatacgaggtgcattgctagagctgacaactgctgggtgacctggggctgacgaagcttgccgcgggtgctggcgaaggagtgtactgcctctttgtagctgtagcgagctattattctcctggcattgcttaccttgctggcgttggtgttgtaggcttgaaacgattgccggtggaacaatgcgacctttgacggtgcccttgacgataatccgttggggcggaggttgcacatttaggtgtcgattggtgtcatgggcagtgctggtaacttgtgaatcacgacgaactgcctttgctgctcttggaagagggcaatcactgaaacaatgtcctggcttacgacagttgcgacaggatcgacttgcttggtcccagggtgcaggcttctgattatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcattcaactgacagtccttaggcacatgatctgttccttcacacaagaaacatgtgaccttccttaaagggcatgcatctgagtaatgggtatattcaccacagcggcatgtggggaggcataaactagcagtgtgtccgactatcccacatctagcacatgctttgaacttcaactctctttccctgaaactgtcaagggtcgcatcatcattctcatcattatcatcatcgttgtcgtcatcgtcatcagcagaaaaccgttctcctgattcatcatcttcgggtctgggcggaccgtactttatgagatgacgggttagctgacgcgctcctcggaaggtatttcttcctctctgacgcttgggtatccttgctgcgtcttcaggagtaaattctgaaccggtgatgatcatggtcctgccattatccatcttccatatcactgtcctgttcgctccagagttgggctgcaaagtaccatccttcttgtcggtagactgacttggagcttggttactccctgggcactgcttctcgtctttttcaggtgacctggcgaacaccttccatggacagttccttacataatgaccttgctcaccacagtcataacaggtagcacttactttcctttggtctgacgttgacttggctgtcgttatcttcgggaatctggacagcattttgacaggggtcttcggtgccgatattgggaactcctgactctgactctgattcgggttccgggctggcatctgatctcgcacctgcggtgggtgacattgacgtgactcctgacattgtcgttgcatctgttgcatctagtatatttggtaccgacgtcgcatctgttgtaacaactcttccactgtctgagtttgattagccatgacttggggttgaggctgaccttcaagaggctgacgtggaatactattagaattgcactgagttgccccatgaaactgacggggtcttgatccgatgaaattgtccctcatgcggaccatctgctgcaggcaatagagagatggggaaataggaggggttactagagaggaggtactaaaccacttgcctattgatctgttgtgaatggattttatgattcaagttgcttaagcaaacaacctagtatggtcgcatccccaccaatgatgcaaaccatacccctacacacaagcaaacaacacccgatctagcagctaacgatactactcttcagggaaagattgggtttaggaaaactccgggaaaacttcacttgactctgggctgatcttctcactctttgcacgaagcttgacttgacttccgaataggcgtgaagctgacggtttgtcctccaggtttaacaactatgaggattggagggactgggaggagaattttgaaaaaccgtttcataaagaaatgtcgaagggcgagaggagacaatttgcaaatagggtttttcagaaaacttgtccttagggtttgaccatttggctcaacctacagtcaagttggctctgataccactttgtcacgcccagaaatttaacccaaatttctagactattttgcgtattaaatctctgtccaggaccagccagggtacagaaaacgacaagtaatatacagttccaaacgtaaataaagcgtaaaatacttacggaagaggcacttagtcctcacaccgaaacagaacgacagcagcggaaaaaggcgatcctagcggggtttcagctccactccacagtcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaagggatacaaggaggggtttgtggctatttgcataaaggcagttgtaaaacattttattgagcaaaacagtaaaactgttgggtaattaaagtaacattaaaaa

SEQ ID NO: 63939 - DNA, 4314 bp, Oryza sativa
ttccgaactcttattcttgcgaccgcgatcttccgaaacgtcgggaactacacggtggcacgcaaaaccgaggaaaaactctaataaaaaccaagcaaactgtcacatcctgattttcgtttcaggatttataaattatttaataaattattaatagaatttttgttaaatgttctttaatttacaagtgaagtaaaatgtgggaaataaaatttcctaaatataaagcatggatggatttaatttttattaaattctccatgattaagtcaactctctgaaattttctcggatttttcagagctcaactcttaataatacaaagaacagttcagtaattatttgatcattaatgatctaattataattgttaagagcttttcttgtttaaaaatccttaaattataaattgttgtttaaaaggaattattagaaatgattttaaaagcttataagagaagatctaattttaatttgttaaatctcaatataaaattgggctagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagccggcccaaaacctctcttctctccctcctcggcccagccggcccagtccgcagccgcgcgcgcgcgttcggtcgctgacaggtgggccccgcttgtcggatccgtcttcctcgcgtcgccgccgccgcccgcgaaccctagcgcgccgccgccgccttctccttccaaatccgctcgattctttccttctccggtgaaatctttagaggggaaatgatcttctcgatctcctcttccttttctcttttggaatctccggtcaattcggtttggaaactcgatggaatcgagatcgaatcggattcctctctctcccaaaccctaaagtttccttctcgccgccggtcgccgtgggcctccgtcgccgctcgctagcccctttataaggacccccaagctctcctctacccgtcgcctccctcgccttcgcccgccgtcgtgtgtagcgccctagcctcgggagcttttgcgccgccgtcgccgccgttcgtctagccgtgcgccgccgtcgctacggtcgtcgtcgtcactcgggaaggccaccgtcgggatcgccaagtcgccgccgtccccgtccgccgcttcgccgtcgctgttgaccgccggagcgccgtcgccgtcgtcaagccgaagagcttcgccgcttcctcctcgtcgccggcgtcgtccgttgcttttccgccgttcctttggtcaccggtgagttcgccttgtcgtccgcttcatcccggtgctttccgttcgcgccgccgcgccgccgttcgccggcgagcgtgtgagcccgagccgccgagccgccgccgccggtggtgacgtcatcgctgacgtcatcggagtcgtccgccgtgagccgccgtggacccgatcgatctcggccgtccgttttggattggttcgatctcggccgtccgttcgcgtgaaccgccgcccgtgcgcccggtccaccgaaaccctagccgctgacgcaataatccccttttccttttcaaaaataattcattattgcgtcataattcaatttaaaccgatttaagtgttttaatccgatttaatctttaaaaattcatatctaattcatcttaactcagtttaatgtggttcaagttgcaaaagttgtttaaaataaagatctacatattaaaattgtccataaattgaattaaatttatttaattctttttaaatgggctttaaatagatttaatcttgtaaaattcttaataaattcatttgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagctatgattgcttagccatgcttagaaacattagcacatatttgggataactaatgtttcactatcacttatggttatatttaatggtagctcacgatggtcaaccgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggagcaccagactgagaagtggcggaaataagcccacgggggtcgctggggagtccatgccttgttttataagggggtgattatgatccaggaatggtgcgctgcggtggattgtgttatgcaaggggtactgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgagttgagcaatgtttttcgtgattagtcccacacctctcaccataattatagatgttataactggtaataatttgcttagctcctggtttggagttagatctgttcagccgggtatggttgttcagaatggttgggcctgtgcagcatgggtgtgctgttcagtgttggttaaaatttctgattaattactccactgttttacttctcttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcttaagtaagtatttatcggtttagttaatttgatgaatctgtatattaaattgtcagtttgtgtacctcggctgattcctggacgaggatttcatgcacaaataagttcggaaattactagtgaatttctgggcgtgacacaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattattatttatttttacagaggaaatggacctcgctgacatcagcaaaggggcggccagcgccgacacgcgggccccacatgtcagcgagtcaaagggggagggcgcacggtggacatggtccacacgtggcctcgggtgcgcgtccaccacgtggatggcccagatcggcctgagccgatcgggcggccgaggggagcggcagccaggggcacaggcgcggcacgaagccggcccggccgagccaaggcgcggcggcggcaagggggaggcggcaaccggctgcccggcaccaccggcaacggcgcgggcacggagcgcggagcgcggcggcagcgacccggtcggacggccaccggcggcggcagcgcgtcgcgaggacgcccgggaagcggccaacgaaggggaggaaaagggagagggaggggagtgctcaccgagatgcacgacggcaaaggggcggccgacggcaaggaacggtggcgacggggctcctcaggaagacgacgcgacggagctccggcgacgggcgtcgctcgggatggggcggacgggctcggcctcgatcggcgaccgaggaaggaggagctccggcggatttccggcgaagaggggcggcggccgaggtccttctcgtccttgcggagct

SEQ ID NO: 63940 - DNA, 5242 bp, Oryza sativa
agagaggaagtggaattttaattgtttttttttattttaattgatgcaatgatctttgtgctattaaaactatttctcgagctccgaaaattcacggaaaattctggagagtacattagggcgcaaagaatattacaaaatattcccgaccaatgatttttaaaggaaaatttcaaatttcctctataattccacttgattaaattggtttaacttttatttaatttctagaaaatgtattattaattgatttttattcccgaacgaaaatcggggcgttacaacatgtctcatcgaacaccacatgtcgcgaggtgatgaccttgttggtggtaaggtctagacaccgataccctttatggtggagggatagcctaggaacacacatggggtggatcgtggggctagtttatggggagcggtggcgaagaggttaggataacacttatagccgaacacgcggaggtgggagtaggacgggtgagcaccatatagggcaaaaaagggggtgtggtgttgaagagttttggtgggatgacggttgataaggtgtgtggtggtgtgaagggcctcgacctagtagggagcgggaaggttggcttggaagagcaaggagcgggtgatgttgttcaaggaacgaagcatgcgctcggccttaccattctgtggggaggtgtgagggcaggacatccgcaaggagactccattggtgaggaaaaaggagcgggcggaggaattgtcaaactccctaccattgtcacattggatgctgtgaatggtcgtggcaaactgtgtcttcacaaaggcaaaaaaatgagataatgtggagaatgtgtcggatttaaagcgaagtggaaaggtccacacataatgtgagcaatcatcaagaatgacaagataatacttaaaaccagacacactaggaataggtgatgtccacaaatcacaatgcactaaatcaaaatttgccttggcccgactagagctagtgggaaaaggaagacgaacatgacgacctaactgagaagcatgacataaagatgtagtgactttaggtggtgggatgacagatgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagaaacgggagctaagccttgacttgaactgcagcgggaacaccactccacaggcatcctcgacggcacggacgaagcctactcctcggagaacccgccatcggacacatactcgagctctgaggttgggggaaaagtagagcaagactgagtactacccactgtactcagcaagtcataccggaataggggtatgatgcagggaattaacaaagaagagctagagtggttcatttgcataaaaactagcatttataaacaggaattgaatgcgaaaacggttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccactgtgtgctagttgaactaagcatggctaagcaattcctagtccaaagtctaatcatgttataacccaagctaacaaaggagcatgatatccaaaagcatggctgtaacaataggtatccatcccatagtaatattataaaacaatgcaatatttgaaagaaaacaatagagcatttgcaatataggatcaacatgttcaaatgacaagcatgacttgccttgctctgctgctggagggacctcggcgactatctcgaagtacactggagcgtcggagggatcggaatctagcgacatacaaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatattaaccagggctgacgtcagcgagggggcgcggcgccgacatgcggggcccaccggtcagcgaccgggagagagagaaagggggtggcggcgcgcgggcccactggtcagtggcacggggaaaaggaggggcggcggcgccacgtggcggccgaaccgacggcgacggggacctcgcggccggggcgcgcggtaaatgcggccgccggcgcggctcggcatcaaagccgaccggccggctgggttaaacggcgacggcacgcgtgcgacgacggcggctaccggcggcacgggaaacggcggcggcagtcgaaggcgacggccgacgactcgaagcggcggctagcggctctaggaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttcacggcgcggaggcgttggggagctcgggagaggtcggcgcaatggggaaaaagcgagagggggtgccggcgatgcttaaataggggatgggggaaccggacgtggccgggagcggcgggattcgacggccgacgtgggggagtggggaggagagagaggcgggattcggttttcgaatcccagccatctcgggcgcgggcgcgagcgggagagagaggggaacgggcgcggggaatgcggcgcacgcgcgggcgtggtcgacgtggcccggagaaggcggagacgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaaggaggggaatgggccggcggcccatccgaaaagaaaaaggaggaaaaagggagggaaaagaaaaagaagaaaaggattttccctggaattaacaattgcactttagtgatttttaattggttaaaattatttctagagctctgaaaattccactaaaaatcctgttaatgaatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacaacagacgcctacgccaagtgggtgagggcctcatgaccgaggtggccaaggtggcgatgccataggtcggtgttggtggaggaggcgacaaaggcacgagtggaggccgccgaggagtacgcatctgccgggagaggataaagagcacaggaactattgcacctgacgatctcgatcttggttgggtaatccttcacagagaggccaaaagggtcaagttcaacggaacaccaattatcacaagtaaaacggcgtgcggaaataaggctcttaataatctcaggagaaatgagaacattgttaagcacaaaggaagaattggggtaatgtaaatatgcgtgaccaacggaggtaatagggagaagggagctattgccaacaatagtatgagagggagtattgcgggtggggctttgggaagtggagagggtaccggtgtcagacgtcatatgagaagtagcacctgagtccatgtaccattcattggacggtggagtagttaatgtggccgtgttgtacgcgttggcgagggcccgtgggtcccactgtgagggccccgtccactggaatggagattgcacagcggcaacaagagttggaggcgccgtgcttggtgcagtgtactgggccggcctaggaagagccatataggccggcgggaggaaggcttgctgctgggccggcgcgggcgtggtggtgaaggctgtcccggcgaagctaggccgcgcgccaaggaggcctggaccggccacatgtggatgctccttgtccacgggttgtaggccgtgggccaggcctggttgacccgtggtgcagtctgtgccagacggagcatgccgtcgccgtgggagagagcacctcctgcataagagtagaggagatggagccgtagagccagctgaggacgacgcagtccatctgtgtccagtcggcgtgatcagggcgaggtacgtcggagaagacatgatcggtgagggcgtattttccaagcgcgacgaggaaaaggccttgccagcgggagtagttg

SEQ ID NO: 63941 - DNA, 16017 bp, Oryza sativa
agggagccttgaagaaggagcggacggcgtcgccgatgattttaatggtgtcatcaaggacggcgtcaacagtgagggaggagggagaagccatggcggcggcagggtgcgccgaccggcggctggggtggagaggaggtggaagcgagaaggaacctaatctgataccatgaattattaccagtgatagcatcatttattatggtgagtagtgtgagactaatcacgaaagacattgttagaccccgcccataaccgcgggcacggctattcgaatagttttactctggccagaggtgtaccactgtacccacaagacacagccccacgacatgtcaccatgcgcctcaataccaccacggtacctctgaaaggagttgtgacagtacccctcgcacaacacaatccaccacagcgcaccgttcctggatcataatcacccccttataaacaaggcatggactccccagcgacccccgtgggcttatctccgccacttctcagtctggtgccccgcaatgaaccatgctatacaaaaggtaaagtcgttgcctatgctggcttgtggttggcacggttaatgtttcacaaccgaaactcgtgaactggtccttaattgtcatgagcacgaccaacaaaaccatgtgctcacaacccaccattatcaggttttagttggcacattaattaattaaccaatcacgattagccatcgtgagctatgattaaatatccatcattaggtaatagtgaaacattagttatcccaatcgtgtgctactgtttctaagcatgcctaagcaattatatctaatatatctagctgaaccaatatataaagctcaactagtcaaattgtaacccaaggtatcaaaggacagagtaatcaatgcaaagtggccataacaaaggtatagtttcacaccacccggtgacattcgaaaataaatgcacagttgaaataaatagagaatttaaatataggatcaacatgttcaaaggaattgtgtttgggatctgtgtaacttgccttgcaataaatggtcttcaattaatcttcttgaatactcccgacgcactcacggactttcgaaacgatggaaacgacaagctaacacgcaaaacgtggaaaaagactaagaaactccaaataaacagtacatataaagtaaacaaacatgtagatcatgattttagattaattatgagacttgaacggcctcattccgatttcatatgaactagttacgaattttataagatttaattccaattaaacctattaaagaaaaagactattccacattaattaaatcatttacaaatgatttataactgagataaaacattaaagcaacctctggaaatagattagattatatttggtagatgatatatattaaaaagaaataatatgccactgaaaagagagaacatatttatatcgattttggagggctaagattaatcttgacatagagttgaccaagattcaacggatggcttagattgatctggcagcgagcctcacgagataccgactcaacgagtcaattctacgtgacacgggattacccaaatgatcaaccgaaaccggcgaacggaaccggcggctctaaacggctctaaactaaaggacgactcaacacggacaaacgaacgaagcacgggtaacacctcgttcgaacgaacgagcgaacgactcaacaatggctgcggctaaaccggtgggctagaaacgattcacggtaaagccccggtacggcaaacgataggccggtaggaatttagggatgcacctacggctagacaacttgactaccgagcaacggttaaagcggcggctaggttaaagcggcacacagctgcgacacggcggcactagggcgacttggctcggccaggcggcggtgactcggcggagacacgcggctcgggttagggcgacatcacagcgacgacgacacacagcgacggcagatggtggctacggtagcgggacggcagcgacttgtcacgcacgagcagcagcagcacggctgtagcagggagcggcacagcgacgactaggcggctagtgcagtggcgacgctagggcagcagctaagcgtggcacggcggcggctactcgacgacacaaacgagagattaaaaactaaaccgagggaacacggatagacgtctcaccgaaccaaagcgatcggagaggaatagatgacgacggtgaaccggcggcaacacatggagacgacgacgacgccatttattatggtaccaacttgtcacgcccagaaattcactagtaatttccgaactaatttgtgcataaaaccctcgtccaggaatcagccgaggtacacaagctgacaatttaatatacagattcatcaataatacaacgttacatacttacaaatgaaaagagaaaatagcagcggaataacgatctagcgaagctccggctccactgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaagataaaacgagctagccttggaagcttgacttcagcagcgggcgactccactccataggcaaaccttgacggcagcgacgaaaccaacccctctgagacagctccaactgagaagaacttcaactctggtgtgggggaaaagagagcaagactgagtactacccactgtactcagcaagtcataccggaagaggaggtatgatgcaggatataaccaaaggaggctaggggttcttttgcataaaactagcatttaaaagcagtagttgaaagcagtaaaacaactgtagtaattaatcaatattaaccaatcactgtccaacgctacaccacgttgcaacaggcccaaccaaccacctgaactacactagttcattaagctaaactaggggtgagactaatcacggtgaatctggttgatcgcccataaccgcgggcacggctattcgaatagttttactctgtccagagatgtacaactgtacccacaagacacgattccacacatgtcaccatgccccgaagtatcaccataatactgcaaagggggaaatcgtgacaagaccctccgcataaccctcccctaaccatccacaccacgctaaggtttcacctccacccccaacgggcagtgggcggtcccctcttgcgccgcggtgaatctggcagctggacaaccggacaccctggccgacccaactccattacgcccaccctcgccaccggtgcctaggaaagggtcgagctatacttcagatcaagcagttacccactctcgcttgtggtaagcacggtaagtctcccagggtttcccgtgaaccggtctttaattgccatgggtgcgaccagcaaaaccatgcacccacagcccaccattcagtgtattttaattaactaacaccattgcggtggcaccaatccaaaactatgctcatagtcaaagtctatgtaataatgtgatccccatttgtgtactagtggagctaagcatggctaagcatttcctaaaccaacatctaatcattttgatacccaagttattaatggcatatggtaaacaataaatggctgagtaataggacccatcccatatgacattgtaaaagaatgcgacatttaatagaaatgcgggatatttgtaaattgggtacaatatgatcaattgtaatgcatgacttgcgttgctctcgcactgatgagacctcagcaacgtcttcgagaaaccgcggatcgacgaaacggccgaaatctacgcgacaaacaaagtacacaagcaaaacatgctataagactaatgaaacaggaaacaaaaccatttttaatggattctttgcatttttatgaatttactgagacttgaatggacttaaacggagctcggatgaattacttatgaattttagaagataaaactgtgtttttactaataaagaaaaagtccttaatcaatttattgcgcaataatacccagggctgacgtcagccaaggaggggggcggcgccggcaagtgggccccatgggtcagcggctctaaaagggggggaggtggcgacggcacgcgggccccaccggcagcggctaaaaggggggtccaccagctggtgggccccaccgggcagcggcacaagaggagaggaagggtgcccggttggctcggctcggcttcgaagccgaccggcggccatggcgaccggcggcggcgcgcgagcgccggcaacaacaagcggcggtgcgggaggcggcggcggacggcgcacaggctggcggcggcggccgaaggcgatggcgagcacagagagctgcggcgcgtgcggcacatagggaaggagggaggaggggagtcctcaccagaggaggcggtggcggccggcgacgaccggcgacacggacggcggacgggtggcggcggcacctagagaaggggaggtgaggggttaggagtagggagagcgaccacggcggccaaagtggccggccggagatggatgaaaatggagagctcaccggcgacgcgagggaatcggagctccggcggtgatttgcggcaacgaagcggcggccgaggtgcgggcgggctcggtgagcgcgacggcagcgactgcgcggcgcggtggtggctatagtggcggcggcgcgtggccggagacggcggtaggcggcggcgcaaggggcgagcggcgcggcgaggataggaagcacggaagggcgcagcgagtgcgaaaaacgagagagggggacgcggggagcgatttataggtgcgggagggggcggacgtggccggggaggtggccgatttggccggcgacgtgggggtggagagagagagaatggggggattcaaattcgaatcccgcccctagcgagcgcgcgcgcgggccgggagatgcgggggagagggcggcgacgtggggaggacgcgggagcgacgcggcgtgggcacgggaggagcggaggaggcggcggcgcggcggtttcggcggcagcggttggagctccggctccaacggccggaggtgggagacgaccgacaggtggggcccacctatcggcgtcccagagagaggagggaggggcgcatgggctgacccaacaagaggaaggccgagcgcgggtaggagaaaaagggggggtggactgggccgacggcccaaaaagatggaaaaagaggaaaagaaaagcgaaaaagggaaaaaggggaaaggatttttcctgggatttaaaattgcactttggtgatttttaattggttaaaattatttccaaggctctgaaaatttcactaaaaatcaatcctgttaatgtattgtgacatgtggaactcaaggaaaatcccacattgccaattccaattattaaatgcctttattaattagggatttagctctaggttaattaagacaatttcttcggacgatttatttaacaaatttttaaagcaaggaaaaagggggaaacttcagggcgtgacatccactaccacaagtagctcaactggggtacaagccaaacgtcttctccttcgcaacttgtcttcaactgaggttcgattgattattgcaatgtgggcatatgacatactcagcaagccacacaacaaatatgcaagtgcacaaggataccaaagaatggcataatatatagctcatttgcaaaagcagcatttagcaaaacatttgagaattctaaaacagtagagtaattaatcatcaatattaattaacactgaactgcacacccatgctgcacaggcccaaccatcctgaacaactatacacggctgtacagatctatctctaaaccaggaatgtaccattccaaaccaggagctaaattaattaccatcaattaccacattattattaatgagtagtgtgagactaatcacgaaagacattgttagacccgcccataaccgcgggcacggctattcgaatagttttactctggccagaggtgtaccactgtacccacaagacacaactccataatatgtcaccatatcatcatgtgcccatgctgaacatgtcaccatttgtgtagttgtgacaagacccctcgcatagctcaactcaaagcagcgcacctttcctggatcgtagtcaccccctcaaaaaccaaaggcatagactccccagcgacccccgtgggcttatctccgccacttctcagtctggcacaccacaatgagccttgctatacaaagtgtccagccgttgcctatgctggcttgtgtttggcacggttaatgtttcacaaccgaaactcgtgaaccggtccttaattgtcatgagcacgaccatcaaaatcatgtgctcacaacccaccattatcaagttttagttggcacattaattaattaaccaatcattaagtaatagcaaaacattagttatcattaagtaaatgtgaaacattagttatcccaatagtgtgctaatgtttctaaacatggctaagcaattatatctaatgtatctagttgaaccaatatataaatacaactagtcaaattataccccgaggtaatcaagaaataggataatcaatgtaaattggccataacaaagaaataggttcacaccacccggtgacattcgaaaatagatgtatacttgaaataaatagagaatttaaatataggatcaacatgctcaaaggaattgtgtttgggatctatgtgacttgccttgcaatattcggtcttcaattaatcttcttgaacacttccgacgcactcacgatccttcgaaacgacaagctaacacataaaacaaggaaaaagactaataaaaaccaaataaacaatacatataaagtaaataaacatgtagatcatgattttagatgaattatgagacttgaacggcctcattccgatttcatataaattacttatgaattttataagatttaattccaattaaacctattaaagaaaaaactattccaaattaattaaacaatttacaaatgatttataattaagaaaagattaaagcaacattcagaaaagattaggttatatttagtagatggcatatattaaaaagaaataatatgccactgaaaaaagagaacggatagaagtctcaccgaaccaaagcgatcagagagaaagggtcgacaatgacggtccggctacaacacacggagatgacaacgctagacaaatcacggattagattatgttggattaagaccctagggaaaaacctacaccggtgaacggcataggggcagcggttgccggcgaaccacggcacaataatgcaaacggagggcaccgggaggaagagcacgagacgacggtccttaccaacacttacgcgatgacggacagcgacggaagatggccggcgacgagcttcgaagggcggcgaggtactgtccacggcggcgacgactttccggcgatgtgcggcaacaacggaggggtggccgggcttcacttcgcagctgcgaatccaatggaggcgacggcaaagcttggcgacgacggaaggagcagcagtggcctcgccggagatcaaaatgcggcggcgagcttcgggttgacagtgtcagcggcgctctggcgatcttcggcggaaacggaggacgggacgaggacggcgacgacctcgcgatgctgatgaaggagacggcgaccgacggcgacgaccgaagcgacggctaggggcggctggagcggcgccggcgcttggagagagaagaagagcgcggggagagcgattccgacgacggcggaagatggaacttgaggggataggtagaggacgacgagggggtcctttatataggcacaggagctcgggttcgggcccaaatcgacgggaaaaactcgggaaagtttaggatcttcgccggaaaaaggaaagattgatccgcgaaattggaaaggatttccatagaaattttggggatttcttggggaaaaggaagaggagattgagaggattccattcccacaactaatttggaaaaaggagcaacggagaggccggatttggaaggaggaggcggcggcaactgtgcacgggctggagacagtcggctctgtctaggggttgaagacaacactgtagcgagagggacgaaaagcagacttgtctgcgggctgagaggaagggagagaatgggctgaaaagggcccaagctgaggatgaagattttattacttttccaaataaattaaccaataagatgatctttcgattgttaaaaatacttccaatggtcaaataattccaagaaaaatcttgaacatacttggacaccctaagtatttaaaaacattgaaaccagctcattaatgattaatttaatatgtgaataattactgaaatgttctttgtattattaaaattaataattgagctccgaaaaatccgagaaaatttcagagagtataattaatcatggagaatttaataaaaattaaatccacccatgctttataattaggaaatttgatttcccacatttcacttcacttgtaaattaatgaacatttaatataaattctattaataatttattaaataatttataaatcttgaaacgaaaattcaggctgtgacaaatctaccccccttacaaagaatctcgtcccgagattcggaacggctagaaagaaaagggcataggtaaactgcagtctatcttattccataagtctgataattattctaaggctttaaagaaaactactactgctttgaaactggtggttgagctgtaacacttgaagacgcaacttgcactgcattggctcctgtgacgacaatgttgttgacttgaccttgcggctgctgatgctttggcttcgaacactctcttgcaaagtgacatggcttgtaacagttgaaacatacctgctgctcccttccattccactactattattttcttgagactggttctgctgaactggcactgattgagtagcttgcttgatgttaacttcattgcttgcattagtctctgaattgatctcatcaccgatgttcaactgttgcgactgttcttgagatgttagacttgattcatcaacttgggattgcttgatacactgcctttggctagtaccctgtgcttccttgaaaacaatcagtcttctcttacggttgtccatcctgttcttcttgacttcaagtcaaattgctttgtcaaccagctcttggaaatcagcatagtcatgagaaatcaacgtaattgatagttcatccttcaggccttctaagaacttctcctgcctttccttgtcagtacgcacatcttctggaacataacgtgctagacggttgaactcatgaagatactctgtcacggtacgatccttttgctttaatgtcctgaactcacgcttcttcaaagcaactactcctgtaggtatgtgtgtcttcttgaatccttcagtaaactcttcccaagtgattggttgtccttctgctctgttcatccggaagtgatcccaccattctgaagcaggtctatgcaactgatgtgaagcgaaaacaactttctcctgatctgtgcactggagcaattccaacctcttctcaatagtgtatagccaatcacctacttccactgggttggtggtgctagaaaaggtaggcggcctcacacgaagaaaagtcagctaacttgttctgtggcgttggaggattgtcgttcccttggttgagctggttctgcatctgctgcatcattatgttcattaactgagtctgttgagctagaacttgagcaagagttgggttctcatcattgttattgtttccacttccactagcgcaagtgttcaccatctgctataggtttggagaagatagaaggagaggggtgacactaaagacaagaccttaaccatgttaacattgatctagtgtgtgtaaaccattatattgtttaagttgattaagcaagcaacctaatatagttacacgctcatcattgaactacaccaatgatgggaatgcaaccttacctacacacaagcaagcaacaaacgttctaccctactaactattcttcaaagtcaatttggtggtttaggttctaagctaggatccaaacttcattccatcttgacagctggacactttagttcgaccatcatcttcatgtccctcgatccacttgacttggcctccataagtagaccccatcgacatctttgtcgtcacaggagccaatgtagtgccagttgcatcttcaagtgttacagctcagccaccagtctcaaagcagcagtagttttctttaaagccttagaataattatcatagttatggaataagatagactgcagttgaccaatgcccttttctttctagccgttccgaatctcgggacgagattctttgtaaggggtgagggtgtaacatcccggtctagggcttaataggattactagaatactcatatcaacaaattgcaacttctttttcggaagccgatctctaaagaactctgaggttaagcgtgcttggtctggagcaatttaaggatgggtgaccgaccagaaaattcttcccgagtgcgcatgagtgaggacaaagtgcgtagaaaagacttgtgttggtctgtgaggacagtcttatgacctatgaaagctaccagatgtaagtgggcctagcctgggaaaggcgggtcgttacaaaatggtatcagagctgactctcgcggtttcacgggagtatggttggtgtggaccgggagtggtcatacagcatggcacatgcgctggcactggacacacggacgtggccaagaggggacgttcctggcctggggttgatcgacgggggcgtcctcagattaggttccttctcgcttccgcctcctctccaccccagccgccggccggcgcaccctgccgccgccatggcttctcctccctcctccctcactgccgacgccgtccttgatgacaccatcaaaatcatcgccgatgccgtccgctcctccttcaaggctccctctggtcaggacgacgacaccctgaccaccgccgtcgctggcgacgccaccgatcgtgccgcgaccgtggcccgggcggccctcgcccctgttatcctcggtctccttccgacgactcctccacggtgcctccaccggttcctccgacgaccgcgccttcgacgaccgccatcccgccgccaccggcttccactccggctcccgcggcgcaacttccccccgagatcctggcgcttctcgcccgtctcggcatcaccacgacgccggccgcccccacgcaggacgccgccgcgccaccggcggcgcttgacgccgaagccgttgccaacctccacagcaaagccgtcgccgtcctcaacgtgaaggcgctcgtccccgtcaccctcgacctcgacgccaaaaactactcccgctggcgaggccttttcctcatcgcgcttggaaaatacgccctcaccgatcatgtcttctccgacgtacctcgccccgatcacgccgactggacacagatggactgcatcgtcctcggctggctctacggctccatctcctctactcttatgcaggaggtgctctttcccacggcgacggcacgctccgtctggcgcgacctcgagctgcagttcctcggcaacggcgagcggcgcgccgtcaacctcaccgccgagctccatcatctgcagcagggtgacctctccatcggcgactactgccggtgactcaaggtcctcgccgacaacctcgccgacgtcggtgaacctgtcaaggatcggtctctcatcctcaccctcatcggcggcctcaacgacaaattcgacaacctcaagtccctcttgcctctgcaagtcctgttcccgacgttcgccaaggctcgcgcacagcttctcctcgatgagctgacgaaaggccaccggccgcccgttactgccacggccttcctcgctgcttcctcgaccaccgctcgctcggcgacctccaccaacacctccaacaacaactcccgcaacaacaaccgacgccgtggtcatggctccggtggtggtggcggcgggagcaatggcagcggcggcgcaagtggcggcggcggacaagcacacagcggcggcgcccagggcaaccctggcgcatagactgcaccacgggccaaccaggcctggcccacggcctacaacccatggacagggagaatccacatgtggccgggccaggccggtctaggcctccttggcgtgcggcccaacttcgtcgggacagccttcaccaccacgcccgcgccggcccagcagcaagccttcctcccgccggcctatgcggctctatggtctcaagcaggccccacgggcatggtccagccggtttgccagctttctccttacactcagctttgttgaggcaaaatcagatacatctttgttcatctaccatcgaggatcagacacggtttatttgctcctctatgttgatgacattgttctgacagcctcctctgatgcacttcttcgatggaccatccgtgctctccagtcggagttctcgatgaaggatcttggcagcttgcatcatttcttgggcatctctgtttctcggcagtcctctggccttcatctcagtcaacgccagtactgcctcaaggttctggagcgtgctggcatgacagattgcaagccatgtgctacccctgttgacaccaacgccaagctctctgccgctgatggtgccccagttcatgatcccacgaactatcggagtcttgctggcgccctccagtacctgattttcaccaggccagatatctcttatgctgtccagcaggtctgtcttcacatgcacgatccacgggagcctcatcttgctgctctcaaacgcatcttgcgttatgtccatggcacggttgattatggtcttcacatccgccgctcctccactgttgacttgagtgcatactctgatgctgattgggcaggttgtccggacaccaggaaatccacctcgggttatgctgtgttccttggcgacaacttggtctcctggtcctccaaacgtcagcttattgtatcgcgctccagtgccgaggcagaatatcgtgtcgtggccaacgcggtggtggcttcgacagcttcttcatgagctccatacccctccgagccgatccacattggtttactgtgacaatgttagtgctgtctatctctcttctaacccggtgcaacatcagcgtactaagcatgtggagatcgatctacatttcgttcgcgatcgcgtcgctgccggatctgttcgagtgctacatgtacctactacgtcacagtttgccgacatcttcaccaaagggttgcccagtgccatcttcttggagtttcggtccagtctgaatgtccgttcccacgacgttccgactgcggggggtgttagattgtgtttatcccttgccatccttccttaatcttctccgatattgtttctataaatcggttgctagatatggaaggcatgtgcctatatgtactctaccatatgtgataatccaatctatcgtgttgagcctgtcgtcgatgacggtccagctctcgtcgccaggcttggcaatggcgcgcaccgtgggatcggagaaatcgactgccactactgtggaggcatcctcgacgacaaaaccggcggcgttcacgcgaagacccacgccatgggcgcccaaacgccagctcgctcgtcggcgccactccggtgtcaggagcgctgtcaccggcgggaggtcggtgcggtggcgggtgagcgggttcaggaggtggaggcggaggctgggctcgtggagcagcagcaggaggccctccggcgtgagcgccagcatcgtgtggtcggcgagctccgggatgtcgtccgtgtggatgcacccgccggtggagacgttgaaaaagcggtggcggcggtgggtggcggcggcagtggtgcccttattgtggtgggccttgtcgagcatgatccagtgacgagggaggaagcggctgtctaggccaccatcttgcgggcgcgggtgcagcgaggaggagagccgccacgggcggcacacggcacggaagcggacgtaatcggcgacgtcgttggcgagggtgagctccgcgatcttgccggccggcccgtccccgaggttcgtccagtcccttgtgccagttttgctattgtggttgatagagcttggtagcgagcgcctgggcaccaccaccgccaccgcctgctcattgccgccggctggcgtggggcgggagcgtttcgcctgggttctcgctggttcggtggaggcgcaagctccccgcggcgattgtgacttattgaactggctggctggtcgcttttccatccaccgctgcaatccatcggacaccggcgaattaggggattagacgtagcttctccctttgtgcaggcgaagaagggcgcggtgaggggaggatggatcggcgtcggcgtcggctggagacgtaactctggtatttggtattgccctagtttaggtcacaactttttctttaaacttttaatttatccatcatatcaaatctttcctgcatacataaacttcaaacttttataaacttccaacttttttcttcaaacttttaattttagtcaaacttctaattttaacgttaaactaaacacatagattatcgagtcgagacgagtctttaattaacgtggttattatttattgtcgttgggggtcggactcgcgatgcgcgtcggatcgatcctcggatcgggtggtcagtcgtatccgaggttcgagcaatcaccggcaagttcttttctccccacatgtttcctcccaagagaggctgatgcggcagcggccgttgacggcacatgcagggatccacggcgctgtggatcagggtggtcgatcggatcctgagaggatgcaacgttgggcgttgagacgatgtgttggatctgtggacatgactcttcatcatcaagcctcctgctccgccgccactggacccgaccacgtcgccggtcaaggaaggaagggatgacgacagcggctccttttctccatcttattcatcgaccacagcagcaaagagctgacacggatgtgtatgtgggaaagtttgtttctttgcaaatgtttttcacctacatgtaaaaacatttactaattgaataatcaaaattttaatatttgatcaatgacgtataacggaatacacatacgtcaacttttgaaatagtcatccgatcgatttgtgaggctatagaaacgtgtacacaatgacgcatgcagcgaacacaacctagttcaatactatatataatttctgattttgttttgtctttattttgtttctcttgtttcagtttatcgtttaaattagcagagtttttatcgatcgtaaaaattattttcgcatgttacaacgcacatgcattctactagtaataacaacatgtaatcagatagtttaactgctcatggttcagattaataaatattgatttaatactcaaaagagtggtctttcctatatagtgcgctgcaaattataagtagttattgcaattttattggagaatcagcaggaaaaatcgggcgcctctatcgcgcctccagctcgcgcgctgcaagcctctagctcaggtgccgcccccaccacacaccctagcacacacgccgttgcaatatatcacccacatattttagaaaccatctattaagagaattcgtttcagtttgtttccacaaaaaatgtttcatctagtgtactacaatgtttcactatgtatagatctaatgctgcagtggattgaaacattcttttgcaacaaatcacccacatattatggaaaccgaattcatttcatttttttccacaaaaaatatttcacctagtgtacttataatgtttcattat

SEQ ID NO: 63942 - DNA, 3734 bp, Oryza sativa
tgtgtagtcttgttttaaagatttaattgcaacgaatttaatagtgcaattggatcatgatttggataaataatttaaaataaaaaaatagtttaaaatagttttgcgcgcatacatcttgctgacgtcatgctgacgtcaacatgacgtgggcgcccgattttcccaccccggatcgggcgcctgacgtgtagttgcctcccattttattgcttagagtgatgggtttctttttacaaagacacggagtcatcttttcccctcctcttcatttacattctctaggtcaaatatgaaaaattgcacccttctatttgcctaacaggccacacacaatttccttccaaagcccaaaatgtacggtttccgtcggcctaaactgcgaggttttcatttttccatcttcaagccaattcaattctgtctctcttatctgaagcaaggttttcattttcagttttgctcaaaaattcggccatgtcggtagcatcgaaattcccaaatttttgggattttgaagacttattggatcaaaattatttaaatttttaagacaatttgactagatttgaataaattttgatcaaattcaaagaaaaagaaaagaaaaaacaaaagtttcagctgagataatgacttgcccgaggttaccgaaattgtttttcactgatccaaagtagaatattagcagtaacaaaggaaaacgcttctgccgataaaggctccatttggatattgggttatacctattgggaaaagaaaatgatatgctggtagattgaggtgggagattatatgaaagaaagtcatatcccatgtttggtttgatggatgggaaatggaagtttctagagaaatgaccaaaatacccctccctacaataagtggtataacattcaaatgcagccaacgatcacataatatatacatgcacctcaccatcttcgagagccttcgtcccacgcgaggatctcggtggattgctgccagctgcttacaccaaagagcaccctcagatttgatgctatgagctgtggtagatgaatcaacagattatagaagggtcaaaatggcgagggcaatttggtaatttcacctggcaatattaccctcaatccagcatgattgcatatcccattcccaacctatccaaacaagggaaatatcaaaactggaaataatatccatttcccactctctttatcccattttccaaacacaatcaaagagattgtgtgatacatgctcatcaacacgtgtgcccgttaaagcccttggctaggacaagaatccaacttaaaaatccaccacacatcgtactttccactttatactagtataaaataagggattttgtccgtacagttacatactttgtattttacctacatctaatctcctcattttctgtttttattatccttctctaccaaatttctttcctcataaatattttttttaaattatcattaaggtgtgtctacaacaagtttgttactttgcaaatgctttttatctataggtaaaaaactttcactaattgaataatcaaactttcactcatctatagcaaaatacacatgcgtcaacttatataatagccacccgatcgatttgtgaggctaaggaaatgtgtacataagagatttttcgtgtgatgacacaggaagcgagcacaactgagttaactttgttttgccattgttttgttcatcttttctcggtttgttatttaaattagcagagtttttatgaatcatgaaaattatcttcacatgttgaaacataccaaacatttttgctagtcattttaaaaacagaaatgctacttaccgatataccgtttgggatcggtcccggacaggacaatttcccatggatcaaacacacaccctcacggatcagatacacaccctcgagaagcattgagacacctacagctcccaaggctgcggcggcggcggcggagcctgcttgctgctcctcctcttcagcgacgccggtgcgcacgaggtcagctgtgccaatgagagagagtgacgtaagcatgttgatggcggctgcggcggcggcgtctgcggcggagctggtgcgcatgatacccctttctctcattcctccttgatgaggacatcctccactattacccactggcaaagacgctaaagtcgggcggcgaccgtgtgagcctctgaataatcccaccttgcttagcttgggaggaggaatccaccttaaaagggagagccacccttcccttattagactagtcttttagggagattgggcattttcccgagtgagtgcgcctatgaactgttggggtccgggcaaccttaagttattaggcctcggccaaccccacctgggccggattattatcatttggtatcagagttgggcccttgttaagggggtgggaatgatgaggacattctctactattacccgctagcaaagacgctaaagtcgggcagcgaccgtgtgagcctctgaataatcccaccttgcttagcttgggaggaagaagccaccttaaaagagagagtcacccttcccctattggactagtcttttagggagattgggcctttccccgagtgggtgtgcttatgaactgttggggtccggccagaataatcccaccttgcttagcttgagaggaggaagccaccttaaaagggagagtcacccttcccctattggactagtcttttagggagattgggcctttccccgagtgggtgtgcctatgaactgttggggtccagccaatcttaagttattgggcctcggccaaccccacctgggccggattgttatcactcctttttcatcgatttcctgatttcgattttaacatctcttcatttttgtattttctagggtttgttgaatccccaacctgtggatggggctcgtcatatcacatccaaattgaaatcaaagtaagctaatactctctcttttttctatgcatttttgttcattcactggggatgtttgtaccagaggtgaggggtgtgtgtgtgctgaatcatatgatacttgatatgatacttgcagcaaaatgttcgaattggaatagatcgctaaaaatgcttctagttgtatattgatgggaaggcaaatattgcttggagcaattttgtcgttaacaagtacacactgtcttgaaacagagaaatctccattcaactagtagcttactgcttaggacttttttaggtgaactgaagtgtaaacaaaatcagagaaatccgcatcagtcggttgctggcttctagttccgggtatgctttgcttgtcaattgttatcctttttgtcatagagggcagcgcgtggcgacagagatggcagatgcagctgagtcatagatgcagatgatttggatttttttttcctgttgatgtttgtagatctcagtggctggctgggagttttctgttttaaaatgatttgatactttggttcaatctaagaagaatcaccattgaaatgatattttctttgtcctttcacacatgtgcacagagttgaaatagcattgccacctgcttcaagcgaatccgatttcatgcatgtttcaaagaagaaaaggtgctcttcaaggttgaacaagggctcagcttaacccccacttgacaaatctcacactgctcattcttgtcatccatgcaggactacatgaaagaatatcatagggagctatgcaaaaggttgttgtaccatc

SEQ ID NO: 63943 - DNA, 9721 bp, Oryza sativa
ggtagaccttttctgtggactaaatatagtttgagtacgttgtacacaatgaaactgagttcagtatcatatgaaacctaaggaaatgatactgaggaggatcatgatacctcccagggttcacatgatcctactcaagtatcatatgtgaaacccataggaaaccactttacaaggcatgatactggataggatcatgtgatacttcacaggtatcaatcataatgaaacacgattctcctcaaagtttcattatgtatgatacttgtaaagtatcacatgatcctacctacccaggtatcatgatcgacgattttcctaggtaggatcatgtgtgatacttcacaagtatcacaccatcctactaaagtatcatctctgaaacctcacaaggatcatgttaccagagatgatacccaagtagaatcatgtgtgatacctgtaaagtatcacatcatcctactaagtatcatctgtgaaacccatagggattatgttagaaaacatgatacctaagtgggatcatgtgtgatacctcacatgtatcacacatgatacctaagtaggatcatgttagaagacatgatatctaagtaggatcatgtgtgatacctcacatgtattacacttaatgatactttttttattaggatcatatgtgatacctgtaaagtatcacaccattaagtagcattcgtgaaactcatagggatcatgttagaagacatgatacctaagtaggatcatgttagaagacatgatccctaagtaggatacatgatacccaagtaggattatgttagaagacaagatccctaagtaggatcatgtgtgatacctcacatgtatcacacttaatgatactttttgagtaggatcatgtgtgatacctgtaaagtatcacaccattaagtaccatctgtgaaacccatagggatcatgttagaagacatgatacctaagtaggatcatatgtgatacctcacatgtatcacttaatgatacttttttgaggagaaccatgtgatgctacaaagatatcacatgatcctacaagagtaccatgtgatcctcaagagtatcatgtgatcctactagcgtatcacatgatcctaacagagtatcatctgtgaaaaccacatgaatcatgtgctacttgtgtgaaaatttttagcaatcacataacaaattgtgtgtgaaaaactacctccaccaacagccaggacactcagtgtacatcttttgatcatttttctaatacaaaagttcaacgatagtatgcaaacacacaagcaatcttttgacaaatattggagattaagcagtccttttatgtacattccatcaatttttgtaccacacagggacaagtcatgcataccatctgttctatccacttccatatcatctgggtcacatctagctctttttttttcgccgggccagccaagataggccaactaaatttatacttacgattgaagaatatatacaaatatacaaagttttaacttcaactagaagccgtcaaagtaatggaagttgtcaccggagcaacctctctcctatatttctgaaaaccccagcttccttccaaatcgccacctcctctttgattgaaccaaacaggaaaccggctgagcgccgctggttctgaaacacacgcgcatttctttccttccaaaccatccaacaaataagcagcacaaggctatcaatggcatccatgtagttgttccgaaatttttgccgcatcgctaaccaccattcgcccaagtccaagcctgactcatatggcagcaggaagccaaccccaatccagcccttgatcattctccacaccctggtcgtgtaggtgcaagacacaaataggtgttcataatcttcatcaaccaccaagcaaagttggcaaacctgctggttcggccagccacgcttacttagattatccgccgtgaggcatcgccctttttcggccaaccacataaataatttcacctttgacggcgctcttgtttaccaaatcagagtaccacatcgcgccaccgtgtttgccatgaagaacatgctgtaggccgagtagggagtgtatttttcatttggtgcccacttccagattgtctcatcttcctccccatcttgaagttgcaccccctagaccacgtcccaaatctgaaagtattccccaattgcacgattggagggtgcccccttgatgtctcgtacccacctatggttcagaagccctcatgccaccgtcaagcccgagcgctcgacgtggctgaagatcaaggggaatctcaactttatgctcctcaccagcaaccagtccgccagccaaaatttggtgttcttcccatcacccaacacttgtctcgttcctgcgaggtagaggtcttgcaagtctttcgactgatctattggaactgttgttcacggtgtcgacgttttatgtcgcgattccggtatttgcatagtatgggaatcgttggtactaggatatatgcgagattgaagtaaaagagatggggacgaggatttttatataggttcaggccccttatcttacaggtaatagccctacatcccattggccgaagccggtgttgctctttattcatctggatcacacaagtacaatatttggagtagcctatctaactgttgtcgacttggcggtctgaagtgctgacttgtagtcgacaacagggtagccttcctcctcgaatccgcatccggcgagatcaaagacagcgctatatctctcctgataatatccgtagataccgtaagggactagccatgcttatctctgaattcgatatccggcgtcttgtcttgcatgttggcttttatgttgatcttgtgtcttgatctattgttccgtgtcccctctcctcctagggggccctgtatttatacccataggtgtccccttgtctaagtagaactagggaaaccaatatggatacaatccaagtagtccttgtcgtttccatgtagaactctattcatcattccttatgcggaattcctcctatatccgaaggttgttttcgtataagacatggtatgtggtgggtcctgccgagatttagtcaactactattaggtatatggtatccataaccttgacacacggcctgtcctgttgttccccctttttgccaaccacttgagacgaagtccttgccgaaataattgatgttcttgattcccagcccgccattttcatgtggcatgcagaccgctttccaggcaaccaagcagtgtccgccattcacctcttcctgcccttttcatagaaatccccggcacttcctatttatttctttgattgcccactgtgggagctcaagtacagacatgtaatgcactggcaaagcaagtaggactgtcttgatcaaggtcagccggtcaccggcggagagaaactttggcttccacccggcgaatttcttgacaaaccggtcaaggagcggttggacatcgtgcttcgtaagctttcagagggggagcgggagcccgaggtaggtgattgggaacagctcgactctgcaacacaggatcgactggactagctctgattgctcttctgaacattggatcatggtgactgcactctttaacatctagctctaacaagggcctcctttaacatctctatttcagcacttaactcatccaacactaacttatctactattgttgtcacaactgactcgctagctacagacacactagcagaaagtgcacacaaaggagattcactcgagggggcatcacttttttttattctcctgggcatcaaaagaaatcacacaaaatagcaacaaaacatcaaaacacatacattgcatgcataaaatagagataacagagaactggctttagaattcttacgcgggctgatgttgagcttgcagcgcatagctggagcagaatcggtcgaggaggtaggagcagagcaccggattgcagaggaaatcggtagacggcgtgtgcgccggcgaaatcaacaaaggaggcgcgcgattccgaggatcaatcttggggatgcggaggagctcgcgccggcgaggaatcgtgcgcggaggcgcgcgatttcgaggaggattcgtcgggttgccgaggagctcgccttgcgccggcgaggaatcgcatgccttgctgaggagctcgcgccggcgattccgaggaggattcggtgggatgtgttcaggtggcgcggcgagcactggtacgatacgattctttctgtttttgttgacgcgcgcggtgacgataccgtgttggttttagaatcatcctgtttttcaacgggataccggtatatagcagctttttttaaaaaacgtgcccgtgtaagaggaggaaagggtagattgaagccgtttgtaatccggatcggactcgtgtagtcgtattgcaagacgcaatcacgaccgttggccacagatcgggcggtcaggacaccactcgccacacgttctcctcctcacccgcagcggcccgtacccttcccaaggagaggcggcggcagcggcggcggaggtggcggcggccgtatgcgggagagagaaagagctcagctcgcatggccatcgcggtgaggtcggctgcggcggtggcgaggcactccctgcgccctccgctggccgcgcccggcagcatccgcggcgcctcgctcctgccgccgcagcgcgctcgcggcgtgggcccgtgtcgcgcccgcgctcgcgcggcgagctcctccgcgactggaggtggcgggcaccttcctccgctgttcaggtgagcggggagcggaattattccgtgttttaggcaatggagacgggcggggatggcggtgctgctcatggatagctgattgatttcgtggttttccccctcttctcctgcagcgtggcgccgatgatggactggacggacaaccactaccggacgctcgcgcggctgatctcgaagcacgcgtggctctacacggagatggtggtcgcggagaccatcgtgcatcagaaagataacttggtgagctatatgcccttccgcccttcacttcttcatgattaaaaccgggtgaaacgtagatgagagaaatgcaaatccttgctacggaggaggaaaccctgcaactgatcagcagtgaagcaacctgtggttttaccacgattctgaattactgtgcgatgtgaatctggtagtgatttgattggagtcagcagcaaactgaattcgtttacgattggcccactttcattcatgtcaataacaatgccacaggtgttccatgaaaaactttcccgtgcgcattgcataagttttccattctcttcaagctatatctggtgactctttaagtacactcatcagagtcttatagtataatgttcatcttaatagttccattagcccatggtgcgctttcatatatcacaacttggaacctaatcatacagcggcattccactgattccttttgtcagatatagttcatctcctctgctgtctcaatctaggcatatgcgaaggatatccattgttttagctaatcagctctttttttcacataaatattgcagtttaatgaaaaaaagaatcaacttactgccttatcgggataaccagcaatgtattgcccacatgttttttcttttgtatgttatcaagttgcgatgagctttcttggcggcactggcagcttaatatgggggaaccacttcaactcaacttggcaccatcagtgctggcttgttttgtatatttgtcactatgtcttcaatcattgtttcttaaattctacttttggtgcaatgaaggcaactgtgaaacgtgtctacgacatatggttcacattatgtgcacatgacactgctacacagaattgataaatcttattcttttgtcgtcacaatatgcaggatagatttttagcgtttcctgctgaacagcatcctattgtgttgcaaattggtggaagtaatctggataacttagcgaaggcaactgaactggcaaatgcttattcgtacgatgagatcaacctaaagtaaaaaagcgtcactcaatctcatctaatcatgtatgacatttcttttattacatataatttactccaaacgttttgtatcagctgtggctgccccagtggcaaagttgctggtcatggttgcttcggtgctcgcttaatgtttgatccagaggtttgctttatgaattcattgcagtaaaccatcaggtagcatcaatttgttctttctccacccttagtaaatattgattcaattatctgaagtttgtaggggatgctatgtcagctattgctgccaattgtaatgtcccagtcagcgttaagtgcagaattggtgttgatgatcgtgactcctacgaagaactttgtgagctttcttcagagacctctcatgttcctttaaatttccttaggcttcccagatatgagccatggaaatcatgtcaaataagtacactctatcagatgcacttttacaccgaaaaggatcaatcaacaatgggttgcggcatgctttaatgtctcatattatcaaaatatgttaacctataccataagctaaatataagtaaatcacttgctggtgttatctggttgttttacaagaaccaggttacctagctgtagttgttattggttactggtcagtgtatttgtactcttctggcggtggttgtgcccttaaggtcaaattgaagaaagaaaaaaacagtagtatctcttgtgcatagtgatgctggacggttaaaatcttggattagtattaactgacccctaaaatgtaccactggtgcaattactccttacatttcaagttttcaacagcatcagagcataaaaaaaatctcatatcttctcaaatcaaaagaatagttgaaagcttctaacatcagtggagagtctctagttctctgcatatatttatcatgacttattccaaattaatctactgtatgtaaatctgcttgtagatgaaatggtggcatgatgacatttactgcagtttatctttttttagggccaaaaataatcacccatggctgtttggctaaatttgaaaaattcccctttccccctgagttggctgaggattatcttcaaagcattggactcctattaaattgcaatgtttaactatggttgccagttaattggtgatgtatatatttgacatgtgatcaacctttttgtatgataacaacatccttttacatttatttagagattatcccttctgcacacatcaagctgaaataattaggtaactgaataatgggaaatcaagtctaagaataagttgctcaatttaattgttttcttcttgttatgatatatggatatggcccatttctttttaacatgtcacacgacatagttccttttgttaggaatttgtaacatatcttttttttatttatattacccagttcaaattctatgtcatgctgtaggtgcatacttttaatgattctcattcatgttactctagataaatttttcatatgatgtttaattagttcttgtattgcatggtatttaattatcataggagtattgtttgagggttaatttaacctcatgtgctgatacagtgccatattgcaacaaactacgtatctttctcactgttaggtacattgactttttttttctttcccaggtgaatttgtagataaggttgtttcaaaatcaccaactaggcatttcattattcatgcccggaaggcattgctaagtggcctcagtcctgcagaaaatcggaacgttcctcctttaaagtatgtcacgcccatgattttctttgtgtaaaatattattcaaatttgatggataagtcttcgtggtccttggtcgtgattcttctttttgcttttgggtagtttcaccttttcaggacagcatctacttctttagcgtatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatgtatccaacctccctcgggtaggtatggctttgtgttttgtgaatgaagaaaaccagaaaattgccccatctcgagtgccatcctcttctcaatgagagtaaccattgaagttctaacatctggtatcaaagccacactttcctgtaggctaaacatctcttgttccaccccttcccaagctcggttgagctctcagctagcagcagcagcagcagcaacaccggctgctcctccttcccctttcccttccccctctccacgcagcagccccccggaggtgtgccatgtccgacgttcggtctcggcgttcggtcgcctcgagcactcggcgtcagcaggacaccgagctcgccgcagcagaagagcgcaggcgagcaacggctcagaccgctgcagcagcagcgagggcggccagactggcggcagcggagttggcagcagccaggtcggaggcggaagcagaggcggcggaagatgcggcacgtgcggcggaggtagaggttgagaccttgcgcagcagcatcaacggctccatcgccggcgacatcaccgccgacagggagcttgaggagctggcaagaggaagggcacgggaacgggcagagcggcggcggcggcccaagggaccgcgcacccgccgacgggaacccagatgggcgcgggcgtgccggcggcagcccggagcccgcgcgcggccctcgcaggcagcgcggctctccctcccctgaccggtgccatggtcaccacggcgtccagacggtggtaagggactttggtctcggcggtgggtggcctaccctcaccaaaaccaactacatcgagcgggccgcggtgatgagggtgaggctccaggtgcggcacatgtgggaggcagtccggtacggcgacgttgactacgatgaggatcggcgggcactggatgccctcatcgctgcagtcccgctcgagatgcagttctcgctttcccataagtggactgccaaggaggcctgggatgccatcgctgtggcacgtatcggcagcgaccgcgcccgcaagtccacactgcaggcactccgcaaggagtgggagaacctggccttcaagccaggtgaggatgttgatgactttgccctccgtctcaacactcttttgcagaagatggtgcagtacggcgacgacacctacgacgaggagagagctgtcgagaagctctttcgttgcgtcccagagaagtacaggcagatcgctcgctcgatcgagtctctgctggacctctccacgatgtcgatcgaggaggcgttaggtcgcctcaaggtcgtggacggcgatgagccacagcctctctcggggcctatcaccattggcgggaagctccatctcactcgggagcagtgggaggccagccagggtgacgggaggaagggggagtcctctccctcgacaggcggccgcaagccgtgcaaggcgcgcggaggcgtccaactgcggtgggcgcgaagacgcgccgagggtggtgctcgcagaggcgcccagggcggcgccgccggcaaccacaagccggcacgagacgacgcttgccgcaactgtggcaagcttggccattggg

SEQ ID NO: 63944 - DNA, 4665 bp, Oryza sativa
taggctcaccgattgcaacccagctctcactccaatggaggagagactgaagctgagccgtgatagcacgacggaggaagtggatgctacacagtaccggcgtcttgtgggaagccttcgctacctcacccacacggctggacttggccttctccgtcggctacgtcagtcggttcatgcaacgaccgacaatggagcactagcaggctgtgaagaggatcatccgctacgttgcggggactctcgaccacggtctctactacccgaggtgtcctggcaaggcacacttcgtcgagtacagcaacagcaaccacgccggtgacatcgacaccagcaagagcacgagcgggattctcttcttcctcggcgagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagatactggagcggtggagctcagggtggatagcaagtccgctctggccctggcaaagaaccccgtttttcacgaatggagcaagcacatctgggtgaggtaccacttcatccgaagctacttggaggaagggagcatcaaggcgagctacatcaacaccaaggaccagcttgcggacctgctcaccaagcctcttgggaggattaagttcctcgagctctgcttcaggatcgggatggctcaacttccccacaagacgacgcacaagacttagagggagaatgatggataagtctttgtggtccttggtgatggaataagccttgtggtttttggtccttgtggtccctctcttgcttttaggttgtttttcccttttaggacagtatcctttcagttttgcttttagcatctttcggttttgcttttagcatctctaggacagcatctaggaccatcacctttctgctttattcagtttggatgctctctaggacagcatcacgttcaaattttagactagtgtgggcagcaattagcttgcagccatccagccagctatggctatatatatgtattcaacctctctcgggaaggtatggcttttgtgttttgtgaatgaagaaaccagaaaattgccccatctcgagtgccatcctcttctcaatgagagtaaccattgaaattctaacatctggtatcagagccacactttcctgtaggctaaatatctcctgctccactgcttcccaagctcggttgagctcttagccagcagcagcagcaccggctgctcctccttccccttctccttccccttctccacgcagcagcctcccggaggcgcgccatgtccgacgttcggtctcggcgttcggtcgcctcgagcactcggcgtcagcaggatgccgagcttgccgcagcagaagagcgcaggcgagcaacggctcagaccgctacagcagcagcgagggcggccagactggcggcagcggagttggcagcagtcagggcggaggtggaggcggaggcggcggaagatgcggcacgtgcggcggaggtagaggttgagaccttgcgcagcagcatcaacggctccattgccggcgacatcaccgccgacagggagcttgaggagctggcaagaggaggggcacgggagcgggcagagcggtgggcagcagcccacctccacggcggtggcggcgacccaagggaccgcgcgctcgccgacgggaacccagacgggcgcgggcgtgccggcggcagcccggagcccgcgcgcggccctcgcaggcagcgcggctctccctcccctgaccggcgtcatggtcaccatggcgtccagacggtggtcagggactttggtcccggcggtgggtggcctaccctcaccaaaaccaactacatcgagtgggccgcggtgatgagggtgaggctgcaggtgtggcacatgtgggaggcagtccggtacggcgacgtcgactacaacgaggatggcaaagaaccccgtcttccacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctccaggatcgggatgacccaactttcccacaagacgacgcacaagacttagggggagaatgatggaataagcctcgtggtctttggtccttgtggtccctctcttgcttttaggttgtttttcccttttaggacagcatcctttcagttttgcttttagcatatttcggttttgcttttagcatctctaggacagcatctaggaccatcacctttatgctttattcagtttggatgctctctaggacagcatcgcgttcaaattttagactagtgtgggcagcaattagcttgcagccatccagccagctatggctatatatatatgtatccaacctccctcgggaaggtatggcttttgtgttttgtgaatgaagaaaaccagaaaattgccccatctcgagtgccatcctcttctcaatgagagtaaccattgaaattctaacacttggtcgtgattcttctttttgcttttgggtagtttcaccttttcaggacagcatctactcctttagcatatttttcagttgctaggacagctgcggttagtaggacaacagcagttagcatctcctttatgcctcctttatgctttattcagtttggatgccctctaggacagcatcccattcaaatttcgaattttagactaggagggtgcagcaataggctagcagcgagctatggctatatatatatgtatccaacctccctcgggtaggtatggctttgtgttttgtgaatgaagaaaaccagaaaattgcctcatctcgggtgctatcctcttctcaatgagagtaaccattgaagttctaacaaaatttatggagtggcgccaaaaaaaatctctaaagaggataaccatttccataaacaagaatatgcattaagtagagtttcaactttcaattgttaactttgggtaagattccaaatgatgtagatactacgtgtagagcatgaggggcacaaacacaatcctatagtccaaattgcttcctaatctgttgaattaaatttaaggtctgcagaacagattttatttcctggttatcaccagtaactgactagttctcatctgaattttcatccccggcctcaacattttttttgcagatatgaatactactttgctttattgcgggacttcccagatgtgcagtttactctaaatggaggtataactactattgatcaagtgagtatcttactctagttatgtagttttgataatgcaattcctggaagttgctattttaatgaacaaattgcgtagcgagtccatcagttcaaattaggtcaaactgatgttaatgatacaattttccttggcaataaaaaaacaattttgtttcatgaatgcaaaaagaatatatttgttctctctgtacttagtactagacattcatgcagagaagtagctcttgttgcaatcagatataatatgcctgagtcaagtcatttttattgaacatcagttatattcatttgcaggtcactgcatccataagacaaggtgcacatcgagttatggttggccgggctgcatataataagtatggtcataattagaagcctttgtgtctctaaattctttgatgctttcaaacatgcaaactaagtaactagaatatgtttccttttgttgctgaaaacctgaaacagtatttagttgtaattttaattttggtatggaataaatgttcagtccatggaacatgctggggcatgtggacagtgaagtctatgggatgccgacaagacgctcttctcgtcgccaggtttagcatcaaaggatggttttgttttcagctatcaactatttcttttataagtattaactgaactccttgttttagatccttgagagctaccaggtttatggtgattcaataatgggccaatatggccccagcagaccaaacgtgagacaacttgtcaaggtgtgggttgcacttacatttaatgaaaacaacctattgttagctttatgatgtgatgtagcagggcatttatgtacttgtttcaccttataatgtaattatctgtgacgtatgcaccattgtgttgatcatagctttctgaattactcaagaactgttacttttgtttgcgtatagatagggattctactttatgcctaaaagcctaagatatgagttataaaagataattatagcacactaaatagaaaatagagttcattgaagaaaaggaaatgcactgatcaaacagtttcatctgtttctcctggtattctgagctgcttaattgtggtctaacagttgcgagttctgcattctgtgtattgatctggaaactagatttaatgcaattactatattgacctttatcagtccttttgtaaaatttatgagcttatgcaaatatgtgctttcagttactgagaaaatcgcttgattttgacagccattgttaaatttattccactcggaacctggcaatggcctttggaaacgcaaggctgact

SEQ ID NO: 63945 - DNA, 22753 bp, Oryza sativa
atctcttacgatccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtcctcgcctgcacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggcttgccttcgtcgccgccgactggtgtccccgcctgcacggctggcctttatgccgccgttgttgggcgtctacgtcttcaccgaccggcttgccttcgccgccgccgactggtgtttccgcttgcacgttggcctattatgccgccgttgttgggcgtctacgtcttcaccgaccggcttcccttcgtcgctaccgattggtgcttccgcctgcacggcagacttattatgctgccgttgttgggcgtctacgtcttcaccgaccggccgccgcatccgccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagttaaacctactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttattgctgctacttcatcatggtggagcgacttcatctttattatcttcggcactggcaaactctattgctgctacttcgcaagttttactacttcaccaaccacgacgtctttgtgaacctcgacatttcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctaatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggttccttcatcttcattgttagttgatctgtctgccgccgactggtttcttcgcctccatggctatgcgacttcattactttagattggtatcactatcttcactaccaccagtattgttaccacctctggtgggcaatattatctctatattggtcgtcttgtctatatgccaactgcgtcagctaccatcaatggacgattgtgactacgacagaaggacaagctatatgctcaggggctcatcaactcaagcgtgagaattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagaatcccataagggataatcattcagatcataagctattcatatgagctacacttggtctatattacccggaagatttattactcgggagcatgttacacgcgtcatcctttaaagggtgtcgaaggcatattttttggcctaggcctaatatgtctgcagcccatattttcaggtgtggcctgtcacgttcttttagggacttaggcacattttgcttaggccaaagtgcgcgtgatcaagtgcccaataccttaaaatccttttataccgcagttactcaactttttaggagttggtacgatgcatcttaaaaggtgtcaaacagtaaagctttatatagctggcccgctgacttttttatatataagtcaaggtgctgtttgggtttttaagcaattgattagatacaatatcattgcttttcgccacgtaagtgtgtatttttattgaccaatattatggcttaggctgattatatattgtggtcatttttcaggcggttggtaaatcctttatgagtttatttacttggattttataccacatatgccatatatttccgggtgtggtgaaaccatgtgtcttttagggacttaagcacatctgttaaagcggtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccatatagtcgggggctacacctattaggtgcatctagtcgatgcacctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcacagttatccgactggctataggggataacttatatctatggaatatgtaacagattatgacttgggtattacgtttccttgtatattatggaacggcctaaagtcctggtttgataagattgtaaagtagacttaggaaaccgataccgtattggttaaggtttctatcttgtaaccctgccccccaacctatataaggagggcagggagccccctctaggggcatgagacaacctgatcgtcagatctatactacacccggcggattcaaatccccaaacaggagtagggtattacctctcattgagagggcctgaacctgtctaaatcctttgtctccgcatccatccacttttaggtctcgtgcgctacccccttttattattgccgaaatcatgtttcgacaaccaagaagcccaaagagcgacaaggcccaagaaggtcgttcgccattcgtaggctagcccaagaagcccatcaagggggcccatagttagaatggacattatatgccatcactaatgtccctatcataaggatatacatgtaaattcccctgtacacattaaaccctagagggtatgagactatactaagactataaatagcccctaggggcatgtaatggggtgatccgaaaaaattccatcaattaatacattgtttaacttttcaaccattccactaagtgaaccacgtctttcgacgtgaagcagttgtctcttcaacaacagctggcgccgttcgtggggaacccaggacgaagctactgatgtcaccgaagaaaatggtgaaataaagagttgcgcctaggagaaaaggagggtcaaggcaaagcggaaatggccggcaaaggagtagagcttcatgttggcgaaggggacggagagcagcctttgggcggagcaggccaagtcgtcacgccttcggatcaagcgacggcttcgactatccaagccgcgaccaaagtatcaactttgaccatccaagctacaacccgaacgacggcttcaacgaagcacgcttcgacacaagcagcgtcgaaggcggcggagataagggggcggaggcggcgccctcctccctctttcgcatggctcgtcggcatcttgacgggtaacgggggaggcggagcttgacctcggcggcctgaactcggggatctcggggaggtcactaccgctgctctcttggtcaagttggggaagccgccgccaatgtcacccttttggggagctcaggaaggctgccaccaccactccaccgctctcctcgccgagctcaggatgggtgccggtgaactcaagtgtggaggtcgatgggaactaaggagagaggggtcagagaagaaggatcggacaagaaagagaaagaagagaggggatacgagatggaggtagaagaagagtattatgctttgacatgtggccctatatcttttgtatatttttgtttattgattggaccaccacacatcagcgccacgttggcgaaaccaaactaaaaaccactcaagggggtaaactaggtgtgtttggttcccgatcaaggttggatgagatatggcggtccatattttgctggatatggcgatccggtttttatttggtagagtgaatatgacgatccagttttttatttggttgtaaggatgaaggtggatttggtgatacattttttttgtttggttgggggagtaggatggatgagtggttgtaatcaccctttcattagaggtggtgagtatacccccttcaaattcaccaaacccaaacaaattatcaatctactacaaacaaaaaaatctaaatagaaataaaaagtcagaaagaaataaaaggggaaggagaaaaacgaaaaaaagaaaaaaagatcatcttcaccgaccgctgttgcgcctcatctcctgtccgtcagcaaccgttgcgcctcatctcccgctcgccggccgccgccccaccttctttctcgctggtcgccgccccgtctacaaatcgtcgtctcggtcgtcgtcgtcgtcctagtgtggcagtggcagacctcttcctgctgcgtcacctccgggctcgccgccgtcccctcttctcgttgccaccacctcgagcactcgagcccgccgccaccctttctttctgtcgccgcactcgtatcccgcgttggccaccgagctcgcatcccactgcccccctcgcgttgtcgtcgttgttctcgcatggtgagagggctgacgcgacccacctcatcactcgccccgctcgcccgagcactcgggcggctccatccagccaaatcggccggattcctccatcctatctggagggaatattcccctccaggccgccatatcccactctcgcccacaaaccaaacacccacaaaaaatgggccgccatgtcctatccacccaaatccctccatccaaacacaccctaaatggtattgaaaattcgggggtgttaaatacccggttttaaacttcaggtgtgtctcttatacaaaacgaatagttcgggggtgtaaaatggacttatccctaaaaaaacaatggaaagctgcactccaagtattcaattgtaatggtactagtagaaaattttgggcagtctatcgatgtgttcaattacagaataaattcttatacttatctcgggaacatatgttatgcacacatgtttcccatgcacaccaactagcaaatgtcacacaaaattttagaaaaaagttggatatatacttccaatagtattacaccttcctgtgaaatcttatcttcaaattcattatattttatccgtatctgacagattttctcccttaaaactttcacattttttgtttttttgttacagctaaaatataatgaatttgaatatgagacttttcgtatatgtgcaatactattaatagtaaatgtccaaattttatagaatttccatgaaatttgctaattgatatgcattgtacacggaaaatccgtacataaaatatgttttcacttatctctccactatccaatgtagctaggatggtggagtggcaaatagtaaaaactagttggcaccccgcgtctttgttgtgggttttatagttttatcgtcaaacaaaatcatagttttaaatggttaggtgcaactctatgtatatagaaaatatatgataaatgtgaatgtatagccttatgttattacaatataattcatgctttatttttccaagcataattgtgtattgttataatatatgaatattattttcatacgcaatatgggtatcgttatagttagacaatttgcatctctctacttcactcaagttttttctgaaaatagattcatgtaactatacctaataattatatgctatcttatcatgcataataaaacaaaacacacatattaaacaaaatcatatattaaacaataatttgagttgtattcgggaaacatggtgttatgcacaaaatatgtaacagtgctatgtgtgactgtgaagtagagcaaagggaagtgaatggataactaatacttcctccgtttcacaatataagtcattctatcattttccgcattcatattgatgttaatgaatttagacatatatatctatctagattcattaacatcaatatgaatgtggaaaatactagaatgacttacattatgaaacggaggaagtaataaatgattgaattggatgaataagtagcttcttgatccaacggttattatctttgtaataatataatctaatggcttaaaattgttaatgatatagcttcttgtatctcttgctttataagagttaatgctccttgtggttgcggattctttaagacaaaagtttaactcgcacggcagcaaccaaaaggtgtcgtggtgtagttggttatcacgtcagtctaacacactgaaggtctccggttcgaacccgggcgacgccattaacttcacaatagtgtactttttcacttcaatatatttactatagtggtttttatattttctttatccatttttttcacttcaatctatttactatattgctttttagtttctatttttcacttcaatcatttttattgactttgcagcttgaaactgcatgcagctaattacttaacaaaaccatcttttttttttacttcctttttctttcacttcaatcttttatttttcacttcaatctatttactataatgctttttatattttctttatcctttttttttcacttcaatctatttactatattgctttttatcttttccttttcacttcaatcttttttttgactttgcagcttgaaactgcatgcagttaattacttaactaaaccatctttttttacttcatttttctttcgcttcaatctttttacactggtggagaaaccatattttctcccggttcgtaaccccctttagtccggttatccaaccggaactacgaacccgggactaaagatcgttatcttagtcccgggtaaaataaccgggactaaagatcgatctttagtcccggttggtaccaccaaccgggactaaagagaggataacaggcggcagttcagatgatcccctttctttgtttttttcttttttattttctccttttattttctcccgaaccaagtggcatgcatatccccaaatcaaaccctaaatcccaaatcaatgtaacatcctaaatccacatcacaaatcttgaggttacttatatacacaaatcaaatacatcacaaatcctaaaaaaactacacacaaatcaaattacatcacaagttctacaaaattcatcgcaaattcacatcacacacaaatcaaatatatcacaggataaatcacaaattaaaaaaaatccccagaggcgccggccggcaactgccgcctcccctccgcgccggccggccaccaccgcgcggccctccacgacgctgtccgccgccgcgccgccctccgcgccgcctccgcctgccgtagcgccgtcgtgtgaccctgcgcgccgccaggcaggccaccgccgcgtggcccgccgtgccccgcgccggccaccgcccggccggcccgctctcgctctcactccgattcgatccgatctagctgctctgtgaaaaagaaagaggtaagggaaaagagatggggagttagggagttaaagatgaaaaaaagagatagagagagagtttgttgtgtggacgggagaagaggataagtaatagggattatataatacgtgttgatttttattcccggttagtaacaccaaccggaactaaatatatctttagttccggttggtgttactaaccgggactaaagatcctaggcgtctgacatagtctgacatggaaccaactgggattaaagatcatctttagttccggttgatgttaccagccgggaataaagatcctctagtcctgttgctcttataaattgggactaaaaattatttttagtcccggtttttaatgggaccgggactattatggatttaggccgaccgaccaaagatggtttctccaccagtgttatattggttttccatcttgaacctgtagataattacttaaccagagcatgggatatgtgtgttaattacttaacaaaagcttgggatatttgtagtaaagaaaaatgttaattgcatccccattacttaattaataacctaaagttggttagtagtactccctcgtcctattttaggtgcaaccataagtttccacgctcaactttgatcatccatcttatttgaaatttttttataattaatattttgattgttatgagatgataaaatatgaatagtactttactcgtgacttatgtttttaaattgttttaaaaaattttcaaataagagggatgatttgcgaaaagccatggttatacttaaaatgggatggagggactaagtactgagcaattgccgctttgcgagccattgatttatgtgacttgtcctagtagcagtgattacgtttaatcacattctggcagattagttgttgggccgcttgccctgtaaaagtaaggataatagtaaagctcactttctactattagtctatcttaaagctaacacatataatagattagctgtaaggttggttataattttcttttcctctttctatttctcacttatacatttaatatatttgtcttgtagcttgtgttaagctagctcttgtataagagctaacacctttgatttcttgttacctctctcctttaaataaacttatagctcactattatacttgcactaacttatgcaggaaggtggcggcgcactagtggtgtgcgcagcaatggcggtgacggctcggcggtggcggatgatgatggcttggtggcgcgctaggagcgacgcctcgcacaacagcagcgccaagaggagaagaaggggaggtggtgcaggtcagctggaaagatggcgtggaaacgatggctcctgacgagataagttgtggcagcagctcgatgaaggtcatgttctgcggcgatatcggcgttgcagcgacgactcttcggtgagataagctacaacggcttggcaaatgttttggtatgcaatgacgaaaacttggcagcagaggtcctccgatgagataagcttcggcggctcggcggaggtgggcgatggggcaacaaggtgtcgtttgcattgtggggtgttggttgtcgtgtgatgtggtgtcggtgtagcagcgacgacttttggtgagataagctatggcagctcgacggaggtggttctctgcagcgacgacggcatggtggcgatagagtcgttagcaccacggatgagtaggttgttcagacagcatgagacccttgcttggcaactataaggtgattggcggactagttttgttgcctttgtttgatctttggtggaatagagaagcttctgtggtggttgctgtgacagcaagggggtgtggaagggcgggctagctccgcatctacttcaagtttgaaaaagattagagctagtcttctagtttttttttcttttcggttgttcttttccatgtttctcgattatgagttttagagtgtatgcactcgtgtaaacctttggctatatatattcactttgaatatagagaccggattttatccattatcaaaaaaatgtaggagcagtagtgcagtaccggctgaaccgttcattggtcggtatggggaatatatatatatagtatatggagtagtctttttgttcatgtgcagctcacatcacatgctttggatgacaaaataatgcttgcttaggataggaagaaggaccgatcaccaacatgactccttgaaatcctttggaaactgcacaacattatacccccaccatggcgcactctcagaatccaaggcaccacaatgcatttgactagtgatgaaaacggtcgaagacaacattattgctagtacattactgctagtacattactcctttttatagaaacagtttcggtatagttaggaatttttatactatttataaatttaactatttattagcgttgacttaagcatgttactgataaaacatttttttttaaaaaaaagggacttttacgcatggttataaacagaaaagctaaaaacatatagtactacttttacagaaatggtaacatttttatctctacatcatggtttattgtctatatttaccaatttaatgatgacaatattaatgaaaatgattagaatcgggcgtccggcgtggggggagccggatcgggcgctcccccgcgcgcccctcctcctacgtgcacacctattggacccacttatttctctctcccccttttccataaaagatgtttcacctagtgtacttacaatgtttcactaataaatctaatattgcagtgaattaaaatactcttttgcaaaaaaaaaacccacatattttggaaactctctattaatggaatttggtttattttttgttccaccaaaaatatttcacctagtgtactcatgatgtttcactatgtgtagatctaatattgcagtgaacgaaacatttcattgcaaaaaaacccacatattttggaaaccccttattaagggaatttggtttattttttgttccaccgaaaaatgtttcacctagtgtattaacaatatttcactgtgtgtacagatctaatgttgcagtgaaccgaaatattattttgctatttgctgaaacattgtttttatataggtgaaacaacacctgatttaaacgagtgaaacattttcgatctgaaacaattccgatatacctggtggaacatcgtgcaatatttaaaaataattcaataataagctaaatttttttcgtcggaatatatccatgtgtgatcttattttgaagatttaattgcaacaaatttaatagtgcaatcggatcatgatttggataagtaatttaggagaaaaatcagtttaaaatagttttgcacataaatcgggcgctgatgtcatgctgacgtcagtgcctgattttgctcccagccgatcggacgcccgatgcataggtccgtcccaatattaataaggcgcggaaagaaattaggaagaaaaaaaactttactcgtttggttgtaatttttttccgcgtcttttcatctcacttacgtgtgggacccaccaccttccctaacaattatttcctccgcttcccgggagcggcagcagagtgagtccaagagctcagtagaataacctcctccttacttgtaccgcgcgagctagcgaaaatcctcctcccatggccgcggcctcctcgactacctcgtcctcctccgcctccaaaccctagatcgccccccacctacctacctacctaccgcacggagacccctcccatggcggacgcggcgcaccacctccgccgccgcagcagcgccgcgctcccccgcggctggtgctgctccttctccgccaccccgcagagccccgaccaccaccgcccgctctccgccgcgtcagcggcaggaggagagggcgtcggcggcggcggcgcgcgcggtaagctcccgcccaagtcgccctcggtctcgctgccgtccttccagagctccccgtcgtctaggctcgcgggcttcatcgacccccgccgcattctctcccccggccgcgtctcccccatagaccccgacggctcgccggcggtggcggctggggcgaattcggaggaggatgcgacgccgaggccgtcggtgccgttcgtggcggtgcgtgaagagcgggaggaggaggaggggagagggctggatctgaagctgtgcctccgtggtagggacgggaggagcgtggcgatggagctggactccgccgtgctctgcgagagcagcgccttcttcgcggccatggcgccgccgccggaggccactgtcggcggcgggagcaagaggattgaggtggatggggtggagaacgtggaggcgttcaaggagaccgtggagctcatgttcgaggccgatcccatgcggtggttcgtcagggccggcgtgtcacgagcaataggcgtgctcgaggtgacaaattgcgcatccttacctttttttttttctgttgctgtttcgttgagtttcgcatcgaggaccatacgcatgtggccatgtagttgtggaaattgcattcttcacgttcgtactgcgggttaatatggttcaatttcgatggttttgtggtagattcgtgaacgtaaacatgtactattaactgtgcagtatgtacatccatgtttttaactgaatttcttaccgatgattgcattttctgtgaaaaccagtgagttggtattaatcttctagtgcctactaaaatctcgttagggatgacaccattttgggagtgcaactcatactagctcagtagttcttttagttgatacgaagatagtggtatgaccaataggatttaatgttcattttatacaacttgtgctgtgatgacagcaattaaatgagactagctaactaattatatcaacaattaaatgaactacctaattaatatatttcatactagggcagcagttttataattattgtaccatgatcgctataaggttatgcctttttctattcaatcagcaattgttgctgtgtgcaattatagtactccacaacgggtcaatggactcataaacttctattgcatgtacacctatagtcgaagccttgaaggatatgaactgaagcacattgagtgtagtaagtacggcataaagtcatcaggaaaatagttctaataataaaaaatggaaattttaggacaattgcaatctttgtcatgcatagttaaggatacccacaacttagattattttgacaatttattttggtgtctttttttgtccttagctgctgatggctaccctgcactgcagactgttagtggtctccagttaaaggtgaggtgtctgttccagggtagctcagcaattgagcacgccattaagagggttcagatgtccatattaatacttgaacattgctatcagagcatgaatagtacatatttactcttagtaccatatttatagtttcttcttgatttaattttatattgtactagttcggctgcacttgatagctgctttgttgaagccagcggctgtacaacgcagacaaacatgcccattatcatctgattatgggtcccataatccttactacatcttgaattgcaggtatcttcctctataatgtttgacagaggaatcaaatcatgtttggagtatattgaggcagttccatggaatgagaatgaggaagagaagctgaagaacctctttgctagatgtactttcgatgaagcagtatccaaagatgtactggcaagattaaaaccacaatgccagagcatctcagacgatgttacagttcacctcatccaatctgtcacaagcagcaccaacactggtgcaagaaaagagatgcaatctttagtcaatggtcttctcagtagaagctcagtctatcaaaaagatttgtctgggctaaacaaaggtagcctttaccagatttgttgttcctgtttgaattcactagtggagcattttacggaagacctctgctcggacaaaattgttagagatagtaagcctatgatcgaaagagtcagtaagcaaaccgagaacctcaactggctctttgatattcttgtgaacaatgatatggcagaagaatttgttgagttgtgggctaagcaggaagatctcatcagcatgcatgggcaagcatcagcaatgttcaggtacgaattaagtcggatatcagcgaatgtgtttattgtcctggggaaagggaaagttcagtgccccagcgatttgaggagccaattgttctacggatggtttcggcccatgttaatggattttggttggcttcaaagatgctccaaagggttagatatgagaatgttggaggagaatctcgggcaagcgcttctcactcttccactccagcagcaacagagcctatttgaagaatggttccaatgcttcgcatccaggggcacagagtgcccgaatcttagtagagctttccaggtatggtggagaagatcatttgtcagatcatccctagagtcacgtcgttgagagttgagttcacttgtctgctgatatataatcttgtgtgtatcaatgtaaaattagagttcttgtattagcttgtagaatattcttcttaataaatctagcttagctgcttccattatatgcaacaatgtaagcataaaactggccaagaaaaaaaaactagaagatatgtagcaatttggatatcgtttgccttgaagatggcatcactgtacatgatcttattcctgggaaaaatatacaaactgcaccagggagtgtgtagcccttcccatgtttcatactacttcatacagtagattcatgctacatagtattatatctacattcatgcactccaatatccatggtttattggcttaattcagcataatcagtcagtgacatggcttcacttagcagctcttgccatagatgagctcttcaggttgggcatcttcgatgttgagccagtggcaatcctggaacgcgcacctgcctgaggcttgcagcgtctcacctacgtcccgggggtccaggaagtatggcgtccacgacggcgtgccgtcctcgaacgagttgtgcgtgagccgccggatgttggacccgtcgatgtcgacggtgtagatctcgccgtatggctggtaatggtgagggttggagaccggctcggcggagacggcggcgtagtcggaggtgaagacgaggctcttggagtctgaactgaaccatgggtggttggtcggtccggccgccgtcgccgctgtgcaccacccgccgcaacccggtgccattggggtgcaccatgatggcgaagctgccgctccccggggcatggcggtcggaggcgaaggcgatccactcgtcgtcgggggaccaattgcacatcgtgtccgaccatgggccctccgtcagccgccggatgccaccggcctcgccgtccttggcgtccatgatgtacaggttcttgtgcccccgacctccccgaccggaacaccaaccacttcccgtccggtggcggcgacgggaatgcgttgttctcgtctcccacggtgagcttcttcatcgagatggttttgtcgtcgtcgtcgccgagggagatcgccaccacgtccacctccgtgctctcgatcgcgaaatccggcccgatgcttgtgtgtatatcacgcctttcctcttccagtccaacgacgtcaggaaggcgttcccggagaagatcttgcggcgaccatcggagccatcggagttcaccacgtacatccccggcagcccgacgaacgcgatcttcttgccgtcgtgcgagaaggagggaacgacccgtcgatcctgaacaaggagaacgtgtctgccggccctgggctcttgatgttctccagcagcaacggcgagtcgccgttccctctcccccagcaccggtggtacccaacgcgtgcgccgtccagcgagatgaatgggttgaaacggtgcacgcgcggcgccacgggtctggtcacctcaaagtaggcgttcttgtcgtcactcatgtcgatcacctcgatgtggcggtagtccgagcccgcaagcctggtcgccaccgccacgagccccggcgcaccgggcgacgcggccggcgtgaaggcgtggaacccccgcggggtgattcgctcgacggacgccgcttcgactctgtcatccgtgacggaaatatgttgaattggatccaaattcatttacacacgtataaaggccaactttggacggagcgaagcggaggcctgccgtcggaggcttggatcgttatccttttagggtttcacctttatatatacttcttgtgagccgtcgttcggcattgtaacctcacccgatatagcgaagatatttgctggctagcgctcgtggttttctctctcctgctttagtagggttttccatgttaaatgtcgtgtcttttgtgattgatctatcgttatttatcgtttatttgctgatcatttcctaacaggcgcgatagacgacgtaccaaccattgctatcctggcagtggaagaagacgatggtctcgtcggcccagctcggctagctgccgtcatggacggcaagtgatcgccaggacccgtaagcggtgcagaagacgtagatgtcagtgcgaaggtcctggacctcacctgtaggtgacatgggaccggggatatcttgactagaggtttggggcagccgcggtcacccacgtggcctgaccccctcgggggggtcgggcccgagggtgaagaggccgcccctccctctatctctccgaggggtcgggccgctcccgtttcgtccccgagggctggggcgccccgaccccctgagggtttggcgccacgtgaatgggttaggtgagcacagcggcgctcacctaaccgcgtttattgcgggttggacgagcgcatcacgccgcatttaatgcagtatagcgcaggcttatccggtccgtgacaggtcgcagtgtgtgaccggtcacagaccggtcagatcgcgggttaaggggcaacaggcggcctgacacacgcctccaggcactcgtccctagtcggagccggcgtggggactcctggagttggcacatcagccccagccagatacattccaggcttcatcgcaatcattgcaaggaagccattgtatgaagaagggcagacgtgtagcatgctaaactgacacgtggtggacaagaatgaccggtctgtgactggtcatacgccggttgcgtcattggcaaacaaccgtgcttccacgttgcacctgcttcagacggagtggaggttggtatgacccatcccatcggagggtcattcaaacagcagccattgcaaatctccgcccattaatgagggaggacagggctatcccggtgtcagacaaaagtacgagccaaatcttgatcaaagtaggatgggtccccacccaaaagaagggtaggtagaaatggtatatgtggtatccccttgagatataaaaggaggaccatgcctaccaagaaaaatgggagggagaagatctgagctcgtagaagggacggaaaaaaaaagagtagggagagggtctctagagttcaaacgctctttctctccagttctttgtaactccttcatacacagatccaccagaacacaggattagggtattacgcttctcagcggcccgaacctgtctacatcgcccgcgtcttgtgaatttgctctctcgcgaaccattccacagatcaagggcttagaacctcacttagcgccccaggccgaaccggcaaaggggggcccacgcggtctcccggtgaggagccccacgctctgtcatctggcgcgccaggtaggggcgcgcctgtgtttttctaagccctcgtcctctttcgtgtgcgccaagcttctcccgctcagcccaatggccgaacgggcagtggcgcacaacctctctccgagcgctagcggtgacgacagcgagcagaacccgcgtcgtcgagctcgtactccgccgcccccctctcaccgaagtcttaggcgggaggaggcgctcgagggggtcgaaagatccgcgacttcgccgcccacgagcgatggagaaggacggcgagacggggagcgtcgtctcctcgtctacggtgatggcagcacgccccagggagcgctccaggctgcgggcgtgctcctgcgtcacccgcccgtcgtccctgatccagagactccaactcgacgttggctagatgacgtggccaacttggtcatgacggcgcaacagcgcctaggcgccggcgggcggtcctccgccaccaaggccactggcgctgctactgccggctccgtatcgtcgaggcggagggcgcggtgagcggcggccgttgcccgccgttcgtccgccattccctcgtcaatgcctccgacccaagaagatgtgcgtgaggggccggatgcccgcctcaatatcgagcgccggcgcaatgatcaccgtgctgcccacgcatcggagggcgcttcctcgtccggagcgccacttcggtcggggcacgggggccagccccccgtgtccccggttggcggtgccggctgtcaagcctttgtggcgagccttcggaacgtccgttggcacccaaggttccggcccaccatcaccgaaaaatacgacggaagcgtcaaccccgccgagtttctccagatctacacgactgggatcgaggccgccgggggtgacgacagggtcatggcgaatttcttccccatggccctgaaaggacaggcgcggggttggctaatgaacttgccacccgcgtcggtccactcttgggaggatttgtgccagcagttcaccatgaacttccagggcacatatccgcgcccaggtgaagaagcggacttgcacgcggtacaacgaggggacgatgagtctcttcgctcgtacattcagcggttttgtcaagtccgcaacaccataccatgcatccctgcacacgcggtgatctacgcgttcagggggggcgtgcggcacaaccgcatgctcgagaagatcgcctccaaggagccccagaccactgcggagctttttcaactcgcggaccgtgtggctcgcaaggaggaggcatggacctggaactccaccggttccggtgtggcagcttcggccgcccccggatccgccgctcggtcagggcggcgggacaggaggaggaagaagaggtcggcccattccgacgacgagggtcacgtccttgccgtcgagggtgcttcgcgggccacccgaaaggggaggcctacgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggacgtgggaggaggagaggaggcaggagcgccttgagggcaaggccccagcggctccctccggcaaccggcgaagtgaggccaagcagaaggcccccgccgaggacattgacgatggcgacgatgacctagggttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcgttgcccagggaggacagatcgcgatggtggtttcccccaccgtttgcaacgtgaagttggggcgtgtcctcatagatgggggtgcagccctcaacatcctttcccctgctgcctttgacgccatcaaggccccggggatggtgctccggccgtcccagccgatcatcggtgtaacgccggggcacacctggccgctaggtcatatcgacctcccggtcaccttcagtggttctgccaacttccgcacggagcgggtgaacttcgatgtggcggacctcagtttgccctacaacgcggtcctggggaggcccgcgttggtgaagttcatggtggcggtccactacacctatctccagatgaagatgccgggccccggtggccccatcaccgtccatggcgacctcaaagtcgcgcttgcttgcatagagcagcgcgcggaccacctcgccgcggcatgcaagcccgcgggtggcgacgagaggctaagcgcctccgtcccagccgccccgaggcagcggatgatcacgtgcgacgaggtcccgatcaagcaggtggccctgggcgacggcccgtccaagaccacacgaatcggtggtcttctggacgacaaataggaagacgcgctcgtctccttcctgcgggcaaacgccgacgtcttcgcctggagaccggcggacatgcccggggtccctagggaggtgattgagcaccgtctcgccgtacggccgggcgcaaggccggtccggtagaaagtgcggcggcaggccccggaacgtcaagccttcatccgcgaggaggtggcgcggcttctggaggccggattcatccgagaggtcatccatccggagtggctggcgaacccggtcgtcgttcccaaggcgaacggcaagcttcggatgtgcatcgactacaccgaccttaacaaggcatgtcctaaggacccttaccccctaccacgcatagatcagattgtcgactccaccgcggggtgcgaccttttgtgttttctagatgcatactctggatatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacacgtaaccaagagaccttactctcggatctagcggaaactttcgaaagtctccgcaccgcccgcataaagctgaaccccgacaagtgcgtgttcggcgtgcctgcgggtaagcttatcgggttcttggtctctgcccgaggcattgaggccaaccccgagaagttacgagctatagagcgaatgcgcccccccagcaagcttagggatgtgcaatgtgtcactggctgtatggccgccctaagtcggttcatatcgaggctgggagagaaggcactacccctatttaagctcctcaaacgctccgggccgtttatctggacggaggaggctgaacgggccctcactcagttgaaggcgtacctcagttctcgcccagtcctggtcgccccggagccagatgagccgttgctactttacctggcggcaaccccgcaggtagtcagcgcggcgttggtcgtggagcgcgacgaggatgaccctcgctccgcgcatccccaccctgtgtcgactcgacccgggagagagcagggaggagaggcccccgagccgaacggtggcccaaggcccccgacggccgaagctggccctccgcccgcttgtccgaaggtgccaggcgcccccgacccccaggatggccacggggccactgcgggaaggccgcgcctgtcgccttctgaccccgaggtcatcggcacagaagccgagtgcgccccgcgcggcctctcggagcgtgacgaggacgatcctcgctccgcgcgtccccaccctgtgtcgattcgacccgggagagagcagggaggagaggcccccgagccgaacggtggccaaaggcccccgacggccggagttggccctccgcccgcttgtccgacggtgccaggcgcccccgacccccaggatggccctggggccactgcgggaaggccgtgcctgtcgccctccgaccccgaggtcgtcggcacagaagccgagtgcgcctcgcgaggcctctcggacgaaaagcgccctggagatgcggcccctagtgaagaagatcggccccgccgaagggtgcagcggcccgtctacttcgttagcgaggccctccgggacgctaagacccgataccctcaggcccagaagatgctttacgctattctgatggcttcgaagaagttgcgccattattttcacgcgcctcgggtcacggtggttac

SEQ ID NO: 63946 - DNA, 2303 bp, Oryza sativa
ttgttagtttggttatttactgaagactaatatgctctttaatccataatataaccttgagttttacaaagttgaatggccttgctttgctttgaataaataaataaacaaattcatatacacatgcacattgaatcggcaacttatttgttgtggtgcttggttttctccgtgacctcattctgttgttatccttagaagagctgcatgttagttgccatcgctccttcaccatgctcaacgctagttacatgctagcttcaccactttgccctgaaccataatttggtctaaagttattttgtttattgggatacattttattatatttttgattttttttgttaagatatactccccctgttgtcttttaaccgttgttaggacaaggacattgtctccagggcattacttttcctattttatattcataaaaatattaaagatataaactgcatggaagggattcgaatgaggtcattatcagataccaaatcttaatgttgttacacatgttaatgagttaagatttcgaggttttactgcaccacgttctagggcatcatctatttgagaacacagggaggtggaagggggaggtcagagggatgaacgaaccattatcaccaacacaaatatttatagtaacataattgataataggtatacattcttgctcttcttgagtacttgttgagggtctcagtatagtttcgcctttctcctgaacatgttggtgattttacatctagggatagcatattccaaattgcttagggttacttactaatagttaaaattacatggtaatatcaattgccatgtggctatctgatcttggttgaagagagcataacacacacagatgtcagcttacattcacttagctgaagcagattattgatgcaaggacaatggtggggaaaaagagggagttgatgaggaggattaggatctagtaccatgatatgttttgccacccacaactactcttcattctgtttgcgctaatcacactcaagttaaatgggccaggtgtagacagggctatgtatatgtcaatactattaacaccgcaaacaattaatactaggctggatggagccaaatattttaataaattgttactcccaaattttgcaggctgagttttataggttaaagaaagaatacgagaaggctgagctattgtatctggaagcaattgaaatcctggaagaatcatttggatcggacgatataaggtacatttggatcttctttttctgctatcattcattatgggtagactgcaaatgttgtattatcaacttggagtattcactaatgttaccactgtaactaaactttatgccagtatagaatggtgagaaaattaggtataaccagtacagtactacccaaatcctatgcaccattaaaacaactagttgataccccgcgctttgctgcgggatatgtggatgaatgcatgttatacattctagaaatgatagatgtacatgtttaaataatgtgaaaatgataatgatttgacattggttgcatattgagttctaaaaatacaacaaaattgtaaatgatatgttatatttgcatgatatttaaaatactatagataataattgctagtgggtgatgacgtagcacacttgcatgtgatttaaaatactctagataataattgctagtgggtgatgatgtggcatacttgcatgttgatctttagaagttagtgggcatcaactttatagtaaaataggattaggtccactttaatcgaaacttttcaagttctctcactttatcattcctgttgctcctgtcaaatcgcccaactggcactaaacaccagattcttcttgatctcctccctgcctctggttggtagacaacccccagatgcacctcatgctgagttcccagccccttcctgtctagatccgtcctggagcttctctcccaactccagtaccaggcataaggggtgccgctggtggttctaattataatgaatccaaacactaattctaattaatcaatcagcgatttacaacaatctaagttcaaactaaatcaaatcaacacaacctgatcatgctgagcatgttacataaaaaaccatatcatactccagaaagaatcttcattacagctgcatgtgaacaattagattcattgtaaacatggttttaaaacgttgcctaggtgtctgggtatgctgagaggtcagggtgtcgcctctggcttcccttcttcacatggagcgtatgcttcccatgataaatcatgtgaaatcgagg

SEQ ID NO: 63947 - DNA, 14849 bp, Oryza sativa
ttgtgaagtgttgacaaagagagtttaggaggagacggtgatagtgcatggagtctgtctgacatgtgcttggacagacaaaaggggggggggggagggggagaaattagactgttagaggtgtggatggctcttggagtctcggtggaaggctgccaagcagtggcctagccttgcctggtcaatgatttgaagggagaagaaccaatgtgctggggaagtggttagtggagtatccccaatcaagagaggctatggagtgctatatgaatatatgatgagaggaggaggctagaagctgaaaccggagaggaaaatgaaattaaggcaagtgagattgaggcatctggtcaagttgttaggagagttgctggcatgtatcatgagtggtataacacaaggcttgtgaaatttaggtggcattttagttaacactaatatttattaggtggtatataagtggtaaaacaatcagttatgctacccctctcgtgtaaatgtacaagatgtaaagagcctgaccacatacttaggccccctttgattcaaaggaaagttagaggaaatttggaggattttattcctatggtatcttttcctagatgatcctttgaatcaaaggaattgataaaattgaatcctatgaaattcctatgaaatgcctcatgccatgtaagttttggaggaaatctaacatgaggtagaaccccatggaaactttcctttgggtcttaatctctcctctaattcctgcgcttttcctgtggtccaatcaaacggtcattcatgtgttttgcaatcctttgttttacacttgcattcctgtcaaaatcctacgttttctcaatcctgcaattcaaaggggcccttgctaaaaaaaacaaagcgtaattttttatttattcaaattttaagtgtctttttgcaattacttctattttaatcaaactcccattctgtatcttttacatgcttgaccacatctgggtaattatcttaattttgttttaagtgcttatttccaattattttaatttcaatcaaattcccattctatatcttttatatgctttaaaatatatggaaacacaagatgttttgtctttgttttctagttctggtaattatcttaatgttgtccatctatgaatcatactttactgtagggttggaactgctttgcatagtcttggaatatgctaccatcttcaacgcaagtttgctctagctcagacatgttatgaggtaccttttacggcctcataggtcttgtctattctgttctgttttttccttggttcttttactgtgatgggcagtctgggatgtttttgtgtagaactatcatgcaatagagtactggctattgtttatgggatcagcatataggggcagtagtattctgtgttccttagcttcaattgtagtgtttgtgctctgtcgagagtggtaaactaatggagccattttcatagcatcttttgccagattgaataatgtgtactatcttgctccaagcatgtaggttaaagaatttcctaaagcatcgtagcagcaatacaatgaccatctgagttgtggcccacctaacctgtttttactacagataaggttgtgcttgcagaatgaaaatgcacaataaaagcatcagtgaaaagaaaaaaaaacgatgctattcagttcttactataattattttgttagtttttttttgtgctcttgatgaatgtgttttgccaacataagcttgcttctaatactgtcatctgttcctgttgtttccttttgcagcgtgctttgaaggtactgtaagttaacttatttgtgactcctttctctctccaggttgaatatgtatttacctgaatttcatgtattggtcatcaatggtggtactaataagtgatatcacattaacagtacttgagtcagtgtttttgttctgcattcacatcattgtttttgatttgaatgatggcatgcaagtaggtttgactgtaatttcacagagagcaagacaacagtgtcaattgttctgcattcacatcattgtttttgattgaatgatggcatgcaagtaggtttgactgtaatttcagagagagcaagacgacaacagtgtcaaagttgcgtgtaaattatagtggtgcaaaagtagacttctttttgttgtgttaatttggtcatctatccctttttgatggtcttatatgctatatggaggttcactggcaacattttttttttttaaaaaaacttattagttgagttgttgaaagttcaagatcttatccacaatacactatggataatgggcctttgacctttgcgcaccaccacccccctgttcttcatgctagttttgttgattcaactaatagttagtacttattagtgatttctgcaatgaatatgcaataacaatgcatatcagttgacagttactgatccgactagaaaataacttgtctttgcttatatgtaaaaaaatatatttaactacagtagcaaggaaattccatttattactatataatatgtctgttttaattgcatctgtagatagaaggacgtgttatggggattggtcatccagagtatgcaagcacaatgtaccttcttggcaaggtactgttgctccttttatatttatattgctgctgtatatcgtgctctacattatagactcattaccttttgtcagtaatcttgcttgtgttaccttagtcctgttcctttcaatcagggtggtactagcagtattttgctgtttaagctattgttgtagtgtttttatattttcattattttgtgactgcaatcctgcggcatattgcctttccaaacctgcacattccagctgaggatacttctgttttgctgtttaacctatagatataactttttacttttttttttcttgtcaatgtatcagctcacattatcttcctttcttttgctacatttttctgtaagtaatcattgccttttgtcgagaaccaatcagactcctagtgaagacctgaattgtactccctccgtccaggaatatgggggattattcccaatctagcacaaattaaggaagatgaaagattgcatctaagacatccagcaatacacatcggcacattgaatgaactgcacaatgtacacctttggggattaaactattaaactttggcaggttgaatggtgtggagtagcactagtacattctctgtatttcttttattctgacgggaactggtggagtacttaatttctagtggatggcatcgattgctcctgtccttgctagcctcgggtaaacaactcttatattcctggaaataccaaggggcaaaataccctatattcctggacagagggagtagtatcatttgaacttattctgctctctaattgataccaccatcatttatgttgatttgatcataaaatttcttctactctgattttccttgtcatgtaaggttgcgagggagtagaaaaaaaagaaatatagaatagtaaaagtatatctggcctcatggtactgtttggcaaaaactacttatattagtatcctcttgtctcctagagtcatttatttgtagcgacccacctatacaaaagaactcaatcccacaattctatgctaattatgaagttggtcattatggaaagaaggaagctgtcatgaacattttcctcctgctgtcactttcttgtcagataaaataattacttcctttgttccaaaatataatcatttctaggttgtttagcaaatgctagggttaaggggaaaaattttcccttttcgtcacttcagttcaatggccaaaattttgaattatttagattccccacccaagcacctgattggctgaaaatgcatggatttctgtgtattgattcagtgtcccagaaatgcttgtattgtggtagaaattttgaatcctagaaatgcttatattttggaatggagggagtagaagatattaattagggataaggttttgtatttaaccttttcctatctccacagttgtgtttagtgactatagtcacataagcctaaatttctttgctgttattaggtgttaagtcaacaaggaaaagatgcagaagcccttattgaagagtctatcaggatattggaggtatgattaccatattagttcataagtttggatcttttgtatgtgcatgtatatgtttgatgaggattttaccatgattttaggagtctgggcttggtgagtcaccaatatgcatacaaagaatgaggtatctctccacggtaagtgcttattacaacatctcagttgtctgcaatttttagcgtttgggcactcaatatctatgcatatgttttactgtacatgtatattggtcctactaaactgtggtaagagttgtattttttatttttatgcatggcattttgccgctgaacccacatcaaaggcgttaaatacactgagtaaacggtagacaagctgaattttattttctataagtaggggataagcccaaaactgctaggtgccaggggcgttgcgggggagtgagtgcggggctgggctggggcataatgtgcaagggcatggggcgcatatgggtcacgacatgcggggttacacctgtcacagctggtgatacactacagtagatcgtgccagatatgcaacagttggtgttttgtgcgtgcgtgagttgagcctgcgagctcgtttgagttgttgagcctgtgtgcttgcgtcatgtgactagctctgtttctattacagcaaggggaaggggttatgaaaatgaatagagaaaactaaatctatctccatctctgctctgtttctcttctgttcttctctgttcttctgttcatcctttctctgctgcttctctctatctctcgatctctctgcgattccaatctattacagtggtatcagattcgggtttttgtggttgattcttttcatactctctcgatctgactggtaaaaatctctgtgctccgggttggtggctacccctgcgtgcggccgctgtaagttcggttctggttcggttggatttggagaaggcaccacggcgcccatcaaactcagtgctccattgcagcagtcgctggactcaatggagctcttggagaaactggagtccatcactcagaggatggaggctattgatgagaaagatggaaaagcacggcggctggattgatcaggtggccaccaaagtaaatctcgctttggaatctgtggggaaattgcagcaggagcatgcgcaggctgcgcgtcttcagaagcatgccttgggtgaccaagtgagtactctgggttccccgtcctctctctccatggctagtttgggtgcttcaccacctccaccgccgcctccacttcttgtatttctgaaatctgctccgcattgggatggcactgaatcgagtcgcccccttcccatgaagggggctgcgagccaagagttgtttgcgtaagatggatttgcctcgttttgatggctctgacgttcgtatttggcttgatatgtgtgaaacctattttgacatgtatcatattccatctactatgtttaaagtttctgcagcggttcttcatgtctggtattgcagcaaaagtggtatcagtcgtttaagttggttgaagaagttcgcgattggtctccatttcttcatgctgttgcgttggaatctgagcggcaccactcagcatgagaaagtgcaggttctgcaaacttggcgtcagactggctctgttgttgaatataaaaatcagtttgattctcttgtttaccaagtgcgtgtgtttgatccttcagtgggtggtatgatgttggtatctcactttattttgggactggaggatgaaattcgagctgctgtggtggttcaattaccagacactattttgggactggaggatgaaattcgagctgctgtggtggttcaattaccagacactattcaacaggctgcagctgttgctttaatgcaggaaagtgtgctgcttgagttgggaacttacaaagttaagaaactgtcatacaagccatctggtgttaaaggggaaacttctcattctagtgatgaaactctggctattaaaccagaaagggctgaattgtggaaggcaaaacaactaagagattatagatgggccagtggtctttgtttcaaatgtggtgacaaatattccccagatcatcagtgtgcagttactgggcagattaaggccatgcaaataactgaggtcatacctgatgatttgcttaatgctgtggcagctgaagagaactccgatcaggaggacacttgtcatatttctttgaatgcctagtctggtgccactcatttgaatactatttgactcatttggtgcagaataaagtgttactaatgttggttgattcagggagttcccatggttttattgatttcaattttgccaaactgctgggcctgccattgcatcccctttctccatcagtggtgaaggtggctaatggtgattctctcttgtcaatatatggttcctaatggtgattctctcttgtcaatatgtggttcctaattttacctggtggattcaagggcacacattctcttctgacatgagggtagtacacttagggggctatgatgcaattttgggtatggattggttagctctatggggggatatgtcctgtaattgggctcttaaaactttaaagtttcagtatcatcaccagtggattgtgctgcaaggggtgcctgacattcagtccccacctgaattgtgtgttgtgtctttgcctcaagtgctgaaatggcaaaaagggtgtgacatttgggcagctgctttactggaaccacatgaagtgtcttccttacctccagtgccagccattgttatctccttgttgacagaatttgatgatgtttttcaagatcctacctgtctgcctcctgataggacttatgatcatgccattgccttgcttcctgatgctgctcctgtcaatagcaagccttatagatactcccctccaaaaagatgaaagagaacaccaagtcaaggagatgattgattctggccttattaccccaagcatgagtccgtttgcatccccagttttgttggtcaaaaagaaggatggcacatggcgtttttgtgtggactataggaagctcaatttgatcactgtcaaaagtaagtttcctatgcctattgttgatgagttgttattggatgagttgctggcactcaattcttttctaagcttgacttaaaagctggctatcagcaaattagaatggtggaaggtgatgagtttaaaacaacattcaaaactcaccatgggcaatttccgtttagggtgatgcccttaccaatgctccctctactttccaatgtgtaatgaattcagtgtttggctctttgataaggaaatatgtacttgtgttcatggatgacagtttagtatacagtccagatttgtcctttcatctggctcatctgaaacaagtgtttcttctcttgagacagcatcaactctattaagtgctcctttgcctgtcctcaattagaatatttgggccatattatttcagtgcaaggagtgtgtacgatcctgctaagactgctgccatgcttgcatggccagtccctactatcactgagctcagagggtttctgggtcacaggatattataggaaatttgttaagaattatagtattcttgctagaccattgacagtgttgttacagaagaaagcatttcagtggtctgactctgctcagcaggcttttcagcaactcaaagtggctatgagttctacccctttgttgtctctaccaaatttcaatcaaccttttgtactggaaactgatgcttgtgcctatggtgtgggtgttgtgttgtgcttaatcagcaaaatcatgaccagctaatcagaaactttccatctatatgagagttcttggctattatgatggcagttgataaatggagatgctatttacaaaggtgccctttcaccatcagaattgatcacaagagttcatgccatctcaatgatcaggtgctgggaactgagttacagcagaaagctatgactaaactaatgggcttacaatacaactttcagtacaagaaaggagtggagaacattgtggctgatgctttatctcgcatgcatgttcactcatctatttctgccttgacagtggttcaaccaatttggttgcaggaagcggtgaattcctatgcagtggacagtcaggctcagcatcttttaatggaattggctattaagtctcacaatgctcaaggtttctctttaactgatggtttaattcatcacaatggtcgtgtctggattggagctaatactggtcttcagactaaattgataactgccttccattcttctcccatcaatggccattcgagctccattgctacttatcagcgtttgaagaagcttttttcttggaatgggttgaagtctgctgtgactaattttgtgaagtaatgtcaagtctgccaactggccaaacatgagcattgattgcctggtttattagtgccattgccaattccaaaggaggcatgggttgatatctcgaaggattttattgaggggttacttaagtctgatggctacactgtcattcttgtggtggttgatcgctttactaaatttgctcacttaattcccttaagacacccatttactgcttcacaagttgcatctgcagtggacaaagctgtttttaagactcatggcattcctcattccattgtctctatcatgataagatctctaccagccggttttggggtgatttgttcaaagtgtgggacactcaattgaacttgagtacggcttatcatcctcaaacagatggacaaaccgaacgtgttaatcagtgtctagagatgtatctcaggtgtatgactcaagctacacccactaaatggaatagttggttgcaccttgcagagtattggtataacacatcctttcattctaccttgggctccttgtaaagccttgtttggagtagagtctcatgtcagccaagtgccagttttgttatcttcagttcatcagtcagtggctgatttggtgtctgagcatgaccagttatctgcattctttcagcagcaactccagtgagcacagctgcgtatgaagaacaaagctgaccgaggtggttctgagcgctcctttgaggtaggcataatggttttcctgaaactccaaccatatgcagagtcctcagtgataaatcgtccatatcctaaactggcattcaatttttttggtcccttccgagttgtggagaaggttggctctacagcttatcgcttggaattgcctgaaagcagtagtgtgtgcatccggtgttccatgtttctcaactaaaagcccatgttcatgatcacactccagtgttttcatcactgccttctccagttgtgctcgatgctgcaggtgtctggtctgaggaaatcctggatcgctgcctggtaaaaaaaaagaggaaatgctgcacatgtgcaagttctgattaaatggtcttcgttgcctactgatcatgccacatggcaagattatgaagtccttaagcatcggtttccttttgcaccagcttgggggcaagctgtgtctccggagggcggtactgtcacagctggtgatacgctacagtagatagtgccagatatgcaacacttggcgttttgtgcgtgcgtgaattgagcctgcgagttcgtttgagttgttgagcctgtgtgctcgcgtcacgtgactagctattaggcctatataattgggaccacatcgaggggaagtgattatgaaaatgaatagagaaaactaaatctatctccatctctgtttctcttctgttcttctctgttcttcttttctctgctgcttctctctatcttcggatctctctgcgattccaatctattacaacacggcggcagcaggtgtgcggctagtagttctgggctggggacccatgtcacaggtgcccagggagcacagctgggcatgggtaaggtgagcctagctgcctaggcatggtgtgtactgggccaggctgatgagagaggatagatttggtctggaggaggaaggagggaaagaaacaaaaaggaaggggtttcttaacaatcagggtgacattggttaacaaggtagtttacagaaccagtagagtagcattatgaattggtgttaataaagtcaaaatgatattaagtcctgttcaggagctaaagtgagttgtttgttaggattagtcctaaaagtgcaaattttgtatcaccgttcagattagaggtcaaatccatgttactgaggaagccacacatccattatgcaaggatgctggtatttcatgaggcaaatactaagaagtatttctatcctcaacccctctagttctctcagatcaagctccacattagacttatgaattatgtatgacaaatgaagatcacagcaaaataatctcagaaaatttccaattctagtttattcgaaagtagcacattttgttgtttgatagttggtacttatttgatactttatatcaggagttgataaagtcaaatcgacttgctgaagctgaaaattggcaaaggaagatattacataatctggaactctcaaaggcatgtcgatatatcttcttgcttttgtactattgcttcattatttgttctggtgatagcactgcttatgcgaatttggtcattgtcatgatgcatgccttaaaaaacgagcttgagttaatctatgtcttcagatattaaattgatttttggttgtatttttgtttctaaatacaattgttctagtgttttttgtacttgcatcctgtctagcaaggcaagagaatgatgttctcacgatctaggttgtgctctagttcaggtgtattaatgcagatgagggcaataaagtcttgcttcagctattcatggtcaatagatagcctgaaatataggaaaatagtaatcagaactaagtagacgattgaatggccgaagtaattgcttgctggtcaaagtacatgtttagtgttttcctatatgtactcatattctactccctctgtttgaaactataaggcatccttgttttcctcaaagtcaatatttaaatttttgactaattattaaactagaagtatacgtgtttagaccactagattcgtttttgaatatattttcacatgatgttaattttatagttagtgacaatatattattatagtcaaagtgtcatgttggagaccatgtagaaacctaatatgccttatattttcaaaccaggggagtattttaaaagtgtagcttatccatctacccctctcacctatagggacacttccttgatccacttatctgataaacttttatgagcttatgtgtcaaggattagatttgttagtatctctacttccaaatattaaagacaagtttcttatggcatgtacaacggtgttcattaacgggctctttccgttgctatgcaagtaaatttggtgacgtgtaagagagagggaggaaagggaaacatcgttgctatgcataacagctcggagtcgactcttagcatttattaaaggaaaatttgctgcatgtgtttggagaaaaggaaagaagtgcaataaaaaatattttggtgtattaatggttaagaggtcttgttgtctcaactattgttggaggataatctctaagtgatatgtattaactaagagcgactctacctttgtacatacccttatgggtcaagttagcctagctatataaggatggagttgtatcttcaccctggaaagaacaaaccaagccaaccacctcagccatgttccagtaatactgtattcttagcaaccgatggaaatattgtccctatcccctctccctgtagtagtttatttttgtatgcaccatagtccacggtaaactgaaaagggaattaacacaaatattccagcaatatcaggctcggtcataatgagtctattaatggaccatgctaaccttatatgtcatattcttttaatgaacaacctcttaagtctttatcaaatcttatcatgaatcatccaatttttttacaaaacctatcaatgttcgtctttgcaattgtttgataggggtgggattcatttgacactacgaatgcagctgaactcttaacaatgactcttcaaaccatggggaagttgaaggaatctgaagaattattggaaaggtggagcgtaaaagctgtttattttggccattgattgttttttaaatttcttactaacataattttattttttgtattatatttagatgccttgaagtcagaaaaaggattttgtctgaggaacattttcaggtttgtatcatatttaatgtttcacgtgatctttagtggaaataaaacatgaaagcatcatctcaatgaaaaaactcacgagctttcttacatgatcacaattctcttgtttcttaaaattatggttgccagatcacttaccaggtatttgagtttttcaccacaagctctgctttattggcaattaacacagactgggaggtatttgtgccatgtgcccctgccacgatgcttgattgggaagcaatgtaatcactgttgctccatatgtattttactaggtcatggtggcatcgccaattcatgttgattatcaccatttccatagtttgatgattacatgattagattgcttcattagtgtttcacttccttggtgcatgctgtgtcctgagaagctgagcccaagaaatgcaaatgttttgttgaagaatgtaggactcccttgctttaggtagagtattgtccatatcaccaatggcaattgtcattgttgactgatggttgcggcagctacggcacacacaagaccatgtgacctgcatctgctatgttgagttcacggtgcacccctacatgtcaggtgatacagcaaaatgcctagtggtggggaactggggactctagtggcaaactggcaatcaaaactaatactctaatagtagcattatgatgctatgatcctcaaatatttggatcaatctaatgaaaataataattaccatatagatacccttcagtcacaaataagtgttgttttagaatccatgcgacataattattactacatccgtcccagaatataagaagttttagtgttagacacggttattaagaaagtaagtagaattaaatggagaggttgtgattggttgagaagtggaggtaggtgtagaaattgaatggtggagggttatgattggttgggaagagaatgttgatggagaagttgtaatatttttggacaaaattcttagtgctagaagttgttatattttaagacagagggattattgtttagaatatagatctgggtatatgaaaataacatggccaaattcgttatatcaaaaaagctttcataatgtcacgcttctgcaactcattttggatttatggaattgaattaagtggtcaaagttatgtcttattggcttttggctttgaaaagtcgacacttatttgtgactggagggagtacagtttagtcttccacaaatatgttattgcgagatttactgttgaaggtgcatccctggaatcatgaaaagtcaataacaccgagaattgggttttcctgccgtttcatatacaatcaatttaatactggttgtcactagcaactagctggaacctagtccacctggtgggttctaactgggtattgcgactacttaacacagtttttgaaatgattccatctccagtggacagtgattgatttcctgttgttcctaatgttacaggtagctgttactttggtacacttggcaaggctaaccatgctaaactttattagtgacaaggaggacagtgacctagcaagatccaaacttgtcagggcaaggctacttgtcaatgattcaatcaggtattccattgaggttgttggataagtctttgtggtccttggtcgtgattcttctttttgcttttgggtagtttcacctttttcaggacagcatctaccctttagcatatttttcagttgctaggacagttgcggttagtaggacagcagcagttagcatctcctttatgcctcctttatgctttattaagtttggatgccctctaggacagcatcccatttaaatttcgaattttagactaggagggtgcagcaataggctagcagccagctatggctatatatatatatgtatccaaccttcctcgggtaggtatggcttttgtgttttgtgaatgaagaaaaccagaaaattgccccatctcgagtgccattctcttctcaatgagagtaaccattgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcggcgtcagcaggacgccgagctcgccgcagcagaagagcgcaggcgagcaacggctcaaaccgctgcagcagcagcgagggcggccagactggcggcagcggagttggcagcagccagcgcggaggctgatgcggaggcggaggctgcggaagatgcggcacgtgcggcggaggtagaggttgataccttgcgcagcaccatcaacgactctatc

SEQ ID NO: 63948 - DNA, 5616 bp, Oryza sativa
tgccaggaggcctgggacgccatcgctgcggcacgcatcggcagggaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacttacgacgaggagagagctgtcgagaagctcttccgctacgtccctgagaagtacaggcagatcgctcgctcgatcgaatctctgctggacctctccacgatgtcgatcgaggaggcgttaggtcgcctcaaggtcgtcgatggtgatgagccacaacctctcttggggcccatcaccatcggcgggaagctccatctcactcgggagcagtgggaggcctctcagggtaacgggaggaagggggagtcatcttccccgacaggcggccgtaagccgcgcaaggcgcggggaggtgtccagctacggtgggcgcgaagacatgccgagggtggcgcccgcagaggcgcccagggcgttgccaccggcaaccacaagccggcacgagacgacgcctgccgcagctgtggcaagcttggccattgggccaaagactgtcgacagccacgacgcggccaggtccacgtcgcacgggtggaggaagagccggctctgctcctagctcatgcaaacattgagctacctccagcggcaccggccgcagcggctttcctccaccttgatgagccgaaggtactcgtctccctctgcaacggctccagcaacgacaaggctgatgggtggtacctcgacaccggctccacccatcacatgaccgaccgacgggagttcttcaccgagttcgactccagcgtccgaggctccgtcaagttcggggacgcctccggcgtcgagatcaagggtgttggctccgtcaccttcactgccaagtccggtgagcacaggctgctcaccggtgtctactacatccccgcgttgaggaattctatcatcagcgtggaacagctggatgagaacggctcacgcgtgttggtcgaggacggactcatgaggatttgggatcgctgtcgtcgccttcttgccaaggtaaccagaggcactaatcgactctacatcctcagcgcgcaagtcgcacaaccagtttgcctcgccgctcgtcgggacgacgaggcgtggcagtggcacgagcgcttcgggcacctccacttcgaggccctgaagcagctcagtgccaaggagatggtccgaggcatgccgtgccttgaccgcgtggagcagctctgcgacgtctgcgtggtgacgaagcagcggcggctcccctttccccagcagacgagctttcgagccaaggagcagctcgagctcgtgcacggggacttgtgtggcccagtgacaccggccacaccaggaggacgacgttacttcctgctgctcgtcgacgacctctcccgctacatgtgggtgatggtcctcggcagcaagggagaggctgcagacgccatcaggcatgcgcaggctgctgcagaggcggagtgcggccgcaagctgcgcgtgctgtgcaccgacaacggcggcgaattcacagcggctgaattcgcgtcgtactgcgctgatgagggcattcagcgccactataccacgccgtacagcccgcagcagaacggcgtcgtcgagcggcgcaaccagatggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcttaccgcatcctcgacccggagacagcgtgtgcgcactgcgcgcgacgttgtgttcgacgaagggcgagggtgggtatgggacaaggcggtggacgatggttggacttcaccgtcgagtacgtccacttcgagggagctgggggagtaggcagctcttcttcaccgagcgtgtctaccccagcccccgaatctccaccgactccgacaccaacacaccctcgggccacgacttcgactacgacgagctcttcgtcgacaccacctcagccagtgactccacatgctccagcaccaacagccactccaagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgcctgcgctcccgtggcatggatggagtccgtgcgactccttcttgcgctggttgctcatgaaggctggggcgtccatcacatggacgtcaagtcggtgtttctgaatgtcgacttgaaggaggaggtctacgtgcaccagccgccgggatttgtgattcccggcaaggagggcaaggtgctacgcttgcacaaggccctctacggcttgcggcaggcaccgagggcgtggaatgccaagttggattccacgctcaaggggatgggctacgagcaaagcctgcacgaggcggccatctaccggcggggcaatggaggaaatgccttgctggtgggtgtctacatcaacgacttggtgatcatcggcaccaaggatgcggaggttgcggcgttcaaggaggagatgaaggccaccttccaaatgagtgatctggggcctctctccttctacctggggatcgaagtgcaccaggacgactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccggcgtcttgtggggagccttcgctacctcacccacacacggccggacttggccttctccgtcggctacgtcagtcggttcatgcagtgaccgacgacggagcagcagcatgctgtgaagaggatcatccgctacgttacggggactctcgaccacggtctctactacccgaggtgtcctggcaaggcacacttcgtcgggtacagcgacatcgaccacgccggtgacatcgacaccagcaagagcacgagcgggattctcttcttcctcggcaagtgcctcgttagctggtagtcggtcaagcagcaggtggtggccctgtccagctgcgaggccgagtacatggcggcctccgccacttcgacccaggcgctctggcttgctcgactgcttagtgatctcctcggcagagacactggaacggtggagctcagggtggatagcaagtccgctctggccctggcaaagaaccccgtttttcacgaacggagcaagcacatccgggtgaggtaccacttcatccgaagctacttggaggaagggagcatcaaggcgagctacatcaacaccaaggaccagcttgcggacttgctcaccaagcctcttgggaggatcaagttcctcgagctctgctctaggatcgggatggcccaacttccccacaagacgacgcacaagacttagggggagaatgttggataagtctttgtggtccttggtcgtgattcttctttttgcttttgggtagtttcacctttttcaagacagcatctaccctttagcatatttttcagttgctaggacagctgtggttagtaggacagcagcagttagcatctcctttatgcctcctttatgctttattcagtttggatgccctctaggacagcatcccatttaaatttcgaattttagactaggagggtgcagcaataggctagcagccagctatggctatatatatgtatccaacctccctcgggtaggtatggcttttgtgttttgtgaatgaagaaaaccagaaaattgtcccatctcgagtgccatcctcttctcaatgagagtaaccattgaaattctaacagaggtctatgtcctttttaacaatccaagatcttgatctccatacttacataaattacattcgagaactggtcagtgtccacattttaatatttcattgctgttgtgtccccattgacggcactggagacaagaaaactggatagcgttacagtttgggtgaacttcatatagcccctactttacaagatatagaagtttgattatgttagttctgcatttcgagaagcctaattaagtggttaaccttgcctagtctgccttggttctgcattttgaggtaatcatatctggcctagagtgaagtctaattaagtagcaatgcttctggccagataccataaaataaagtgcaaagtaggcatatccttttagactagtttacttgctccaaatgacttaagatgttctttttggggcataatagcctagtagggctactaatggtgccaagcttagccaaagtagctaccaattctgtaagtcattttcataaaaataattcgctgtctgatttgcacctaaatgtaaagctgggcaatcattttgcctatggtaattgttcccaaccggctccaattaataccaaaattctggttaccaattatatttgagcttctttctgttagatgtatatttagattttatattcctttatttgtaaagggtttttctgtatatttgtgtattcctgtacctgtatatatttgggccttttgccctaaggtgaataaaagtgctgttcataacatggtatcagagcctaaactagggttagacttttcttcttgtcctagatgatccaaagatttttccacacacgttacctggtttttgtggtcgattttttcgcggtggtcatcgaactcgtcgtggtcgccggtgctgcttgtctctgcgccggcgaccgctcatctatgctcgccggccaccgcttgtcgtccccgtcaccagctccagttcgttctgctgcccgtcgctcaccgccggcaatcactcgtcgtcggctaccgtcgtccgctcgtctcctgccgctgcccttcgtcggttgcggcgccgctcgtctccggccgcaacccacccctcatctccagctgccacccgtcgtcggctgtggcgccgctcgtcttcagccgctgcccgtcgccgctcgtc

SEQ ID NO: 63949 - DNA, 3773 bp, Oryza sativa
acagttgagattttgagaacagtaaaaaatattgattagcaaactcacttccaatagcaatcacagcaaccataatgtactggtttcagcactaaaccccgcagacttgcagaagaaagaaactatagataacaatctatacacctctctactactgttaacaaggataaacatgccaatgctgctgtttcatggcatactatgttgatccatcaagtagatacagtcatactaacgaactcacacagatgcttcttaggctttaaccaagagtccaagactaacatgctgttcttgacaccacacttcgatagacaaaaatctactttactaacaaaagaaaaatgatctgtctaggatataaacagacacaaaaacatactcatgagcagcactgcaaaattactagacaatcgatcatgaaccactagaagtgaagctaaatcctaattatagtctccaaaaattcagttggattacaccattatgcatttgtgatttccacgcagcagttacatatatatgctaggactatacatgctctagtaagaaacacattatctgaaaaaagttaagcataaagatgagcatataatgaaattacggtcattgaacaactgcatataacaccataagctgataagcatcacacaatcaatctatatcagacaaaccacatcgtgtaacaagtaaaagatgaacacttgacgataagatcttaacaccatccatagagatatcataggtattacagtgacatcagttcaataccaaaaattgcatacttgaacaaaaaactactagggaacaaacaaaaaaagggatccatgagtattaattaatgagacgggggcaaaggagcgatctctagatctacttctcggaggagtttggcccgcgcttcttgccgaagccgacgacggcggtgacgaaacggcggttgtactgcatccgcttgtgggcgcggccccggggcttcttcttcttgtcctgcttcgccaccttcggcgtctgccccctcaccttcccggcgcgagccagcgagccgtgaaccttacctgcgatcgaggcgggcaaagcacatcaatcacccaccaaatcgcacggcctagagagctacagaagcaaggaatcacgagggaaagagaggactcggaggagatggttacccatggcggcggcggcggcggcggcgctcggacgatttgggacgacgaggcggcagcggcggctggtgtgatgagacgaagccctagatgcgtgggagaatttataggagatccgttgctgggccgggatattgttttgggcctttgggattctcggcccatttcacgtgtctcgctacaccggaggcccatgaagagcccagtagaaaggcgtagtgtagtgggaaccctcggggagtcgcggcgcgagcacaccactgacctctgcggcggcggcgaggagaggagaggggagaagccgaggaggaggcagcggggagagaggatgccgcggccggaggtgcaggcgccgccggagatattctacaacgagtcggaggcccgcaagtacaccacctcctctcgcatcatcgaaatccaggtgagcttcttgccagttcgcggtgctgggtgtggaggaattcttggtctcatgtttagttatgttgcagtcgaggattaccgagagggcgctcgagttgcttgcgctacccaacgatggcgtccccaagttgcttctcgacatcggtaatgcttttacttcttcctgctcaaacgatgtgttgatttgattaaaaaaagttgtttttggtacaattactttgcttagtttgtactatgttttgaattgcagggtgcggttctggacttagtggcgagccattgacagagcagggccatcactggattggttatgatatttcgaagtccatgcttggtgagcacctcgctttgttacttgctcttaaggaaatcttggcttattgcttgttggattttttttttggctgagtgctttaaatttcttctgtagatgttgctctggagcgtgaagcggagggtgatctccttcttgcagatatgggccaggtataatatgcatcttattaatgtatggttcaagaaatttcaatctcatatgttatgtttatgctgtggtgtatgccaatactcttaaccgtaagggaaatgcttgtcttgtttatttctagtatcacacttgctctacttaataaatcataagtggcagggacatactcccttaataacactaatatttttcattacttttgctattgaccgtgaatccatgattgttctcaaaataatttctactctgaaagtaactatgagtctaggaattcaaacctttctggagagaacaagagagaattaacccaaacagttggcttctccgatagtactatgatttctgaatggctatattttttttctctgcacatggcctggcgaataatattttctgcacaatctcaccatcctttggttaacacaaatacagcaacttcttcacagttgcttcaccacaacttgtctagctttaaggtgctgcatgtgtatttatttatattcaatcctgttccagggtttaggcttgcggcctggagttattgatggagcaatcagtatttcagcagttcaggtaatgtttgagctgttatgttactgcaacaaactgaccatgttgatctcaaatctgcacttttaatttgtcctctcaactgtgtgttttgtttgtgcagtggttatgcaatgctgacaagtcttgtcacaacccaagattgcggttaaagtgtgtatttattgtttctcttagcctcttaggttgcttgcaaccagttcataactttcatatgtgcataattttcagggctttctttggatcattatatagatgcctagcaaggggagcaagagccgttttgcaattttatgctgataatgtgaaacagagtgaaatgatcgtgactgctgccatgcgtgctggatttgcaggtggagtggttgttgactggcctcacaggttagtattttattacctcacaacaatgccatattagcgtacgaacaatgctacgaatttcgttactgatatacaattatgggcatgccttctttcttacagttcaaaagcaaagaaatcctaccttgtcctcacttgtggaccaccttctctaaattcatcgcttccgaagggtaaaggtcaagatggtgccatgtgtagtgatgatgatgagagcgatgatggaagtggtgatgaagatggagcccaaacagtaagcccatgctttacaagcttgttcatgcattgcattgtgctatgtttcatgtttcaagggaactacttactgcttcaacggatggcagtatattgcattctttgtccagagcttccccttgatattgttatattgtcgcctttacatcacataagttgtgataccgttgctttttgtgtgtgtgtgtgtgtgtgtacaaaatctttctaccaatctctgcttgcaagttgcattgttcctgtggtgttttactaacttattattcagttttaccttagatgttcagtagttatagaatgctgttgtcttggaggaggtactagctaaatggttgtgcttagtcaaggactcaaggatcatctatttcatacttggttcttactctattttataggacctaatattggggtttttttccctcccttttgatgttcgaccggcttagatgaatgcttatatttttggtatgcaggtcggcatatag

SEQ ID NO: 63950 - DNA, 607 bp, Oryza sativa
cgtgcaaaaatccattttcaacctccttgtatcagtataaatgtaaaccaaggactaaaggtaggcagcaccatgctacatgttacattcaatcgtatgaaagcacaaattacacaatcaaattgccctttttgagagaacttctacccctgcagcctcatacgcggaaattcgtgtcaaagactctcaagaacgagtatatcagatgcttgaggcggctcactggtattgttcagagcgattccgctgtgtcggaggcattgacattgcaggggttgctagctgaagcgcaacagatacttgaagaacttggacacgagagcaactagaagtatggaaaagtaattattcatgactcggaggaacacctttgttgtgtgcaaggtcttctacgttggttttgcaccaacagattttgatgccagcatggatttttattgtgctctgagctatcgaccatatgctgccctagctggtggcgactttgcaagcaacaaaagatggtgattttgttttcttctggtttacaggtttatgctgccgtggttttttgtttgacctgcggatgtcatttgcccggcaaattttacttgtatcatgactgctc

SEQ ID NO: 63951 - DNA, 637 bp, Oryza sativa
ccatgccattataattgggcaaagtttgagatataccatcggtatctcaatgacatgtagtatccacatgagtcaatgacatgtggatcaggatgtcatatcttaaattttacaaaattataatggcatagttccaattttcccaacaaagaatctatggatgctacgacactgacagttggggcccaatctctgctcacacatcgtcccctctccccatcccaaaccgcagctctgtcttccccaaacgacgcggaccgtataaaactccgccgcgacgccgagcacgcgcgccggctctagaagcttctagaaggcgcagctgcagcgctggctaatggcgttcgcgacctccacgctcccattcgcgccatccaacccctcgccgtcctcccgctccgccgcagcggctttctctccccgcggcggggtccacttcgccgccgctaggagcggcctcccgctcgcgtgcgccgcgccgaggcaccgagggaggcctcctccgaggaggcgccgcggagggtgcctggtggtgtgggcgtccgccgactactacgccacgctcggcgtgccgcgctccgcgagcaacaaggacatcaaggccgcctaccggaagcttgcgcgccaagtgctcgac

SEQ ID NO: 63952 - DNA, 21272 bp, Oryza sativa
ttcttaccggagtactcccgtcgccgtttggactcaagctccactcccgctagagcgcgccgccaccgcaggtagatgagaccgcctcccacctagagcccatcaccagttcaagtgtccatccctgtcgaaggtgcaaaggcatctatccaccagcttgcttctcgcctgatgttgccgtcgtcgctgctccatagaaccgtggccagatcaggagaaatgagtttgtgggggagacagggatgggcggcatcgctgagagagagagagagagagcggggggaggatgcggcctcgtcggtgctccagcgagtctccaccatggaggagtgaagtggagggcacatgggagaggtcgtcgccggtggggaaaagcgagcgagggccggccaccgtgagaatagtgggagaaagcgagagagggagaggggaagggcgggcaacagtggtgggctggcggctagggtttgggggaggtcgagggatgtccgtttttttaaaatgacccttcaagagcacaatcctattattcatttttttttcttcttagcataagatatgctagattctaaaggtcttctaggtaagaatacataacttagaaacctatatggttgaggactgccatcaaaatatcagtaacattaagtttttttttgcaaaacggctagagtcgacgcggaaccacgagtgctcgcgaaatccagcagcattgggcatccggggcaacgtggatagcacgggaaacggccatgccgccccgaatcgctgtggaggctccattcggggcatgttttaatttaaccgatatgcagtggtaaatggtaggatatgcacgcatgagcgttcattgggactatgtgatacctgcacataggaggctttaggccgagttttttcccaactttcccaactcacttcccccgtgttccgcacgcatgattttcaaattggtaaatgatgtgtttttttaaaaaaaaaattatatacgaaagttgctaaaaaatcatattgatttatttttcttaaaaaataggtaatacttaattaataacgcgctaatggaccgctccgttttccatacgctggaaatatgttcccaacactgtggaaacaaacacacccttaggtcctcaatggttctatagttgcatgtgttggacgcacacgcatgtgtgtgtggtgttgtatatgtggagtgaattcgtgtgcgtccttagctgtactatctctcaaaaaaaaaaggtccatgaagaaacaaattatttttccatgacacaaaatattacttttacatccaattcatattataaatcgttttgatttttttctagtcaaacttatttaaatttaactaaatttatagaactttagctatatctataacaccaaattagttttattgaatatagtattgaatataatttgataatatatttgttctgcgttcaaaatattgctatatttttctacaatacttagctaaacttaagaaaaaataactagagaaaaagtcaaagtgatttatcatataaatcggagtgagtaccatataccagtgtactcaacacagtgttcaatggaccgtatcactggctaaaagtaaaatacataaatctcaaaaaagaaaaaagaattaccatcacgccaagtgtgtttttggagcatgcatatacgagttcataccccactacacactaacacacattacactcgcacactcacaaatgtatctcctaataatgcaaatcaatagaaattgatagcaaatccctactctaactaatttttttccaggtcactaaaatttgttgaacaccaggctttgaaactttctaatctaattttcaagtttcacattctatttcggaaaccacaacgatagccgatcatattcttttgagcactaccacacaaactaaactttttccttttacagaactcttacaaacaacaatatcaaccatttaatttatcaagataaataagagcaagtttaataatatagtcaagtatcagctctgaatcacctatagtcaatttaatagctaatttatacatatttaccgataaatatatacaatacactagtaatatctgagcccacctgtcttacacacattgctcttctctttccttatttatcttatttatcttctcgatatatgtactccatctgtctcaatatattaaaacttaggaccggatgagacattttctagtactacgaatctggataggctgttagaaaatgtactatctaatcctagattttaatatattaggacggaggaggtatgtgtttacagcaagtttttagtgtgctattgtacctgctgtactaccatactcacatagtcacattacgacacgtcagaggtaagcataggcgttatttcatcggctgcttgatatgctgctgccgcctgcctgggaggcacatcgggcagtttaattaaggcaattaaggccgtgtttagattttttttttttaaaaaagatcacatcaaatgctttgacacatgtatagagtattaaatatgaaaaaaaaatcaattgcacagtttgcatgtaaattgcgagacgattttttttatctaattacaccatgatttaacaatgtgatggtacagtaaacatttactaatgatgaattaattaggcttaataaatttgggcagtatataggcgaaatctataattaatttattttgttattagtttatgtttaatactttaaatatgtgtctgtatatttaaaaattttctggccaagggacttaaacacagcctaatagttgtcctaatccatgcacgtttgcatagtacgcttccacaaggagcggaagcatcgcacggatgattgattgattaccaagatctctcccaagttgatttgattttgaccaactgctacagtatataatcacacctgatagcaccgggccaccggccaaaacacgcgtgcattttctactctttccatcggaggaacacgagacacgtacgtcctcgttctgcccagccaacctaattggaccaatccgatgactaatctaagtcattacggggatcaaggacaaaaggagaatgaaaatcgcacttcatttctatggcgctcttttgaaatcgagacaatttgcgcaaatttcacgagaattttaaactgatctcaacaaaaatccgctaaaacaacatccattgagctgtgaccgtggtggagggaggaatccgtgccacgtgacccaaaaccgaactcgaatcctttccgccaaagctgggcccacatgccagccagatgcacacaattccgatttgcttttcaaagttccaaaactataaaaacttcctcctcccttttcccatctctctcctcttcctcgcatttcccgcaccacgaaggaatcaaacggaaaaaaaaaagaaaaaaaaaactccaattagatcggcccccacgtatcgtcttcccgttccattccttctcgaagcttccatgaacgtggagcgcctcgtccccggcggcgccggcggcggcggcggccgcttccggtacgagcggatgccggctaggggcccggcggatgacggggagggggaggaggaggaggaggaggcggcggtgccggagcggcggccggaggtcctggcggcgtcggcgtcgttccgcctctcggaggcggcgcgggtgttcgaggagctccccagggcgtcgatcgtcgccgtgtcgcgccccgacgccggggacatcaccccgatgctgctgtcgtacaccatcgaggtgcactacaagcaggttcgcggatcctcccctgccttctctcctgttcggtttattcacggttctgagaaacatcatgtgaaaatttggtgtgatgagagggggtgaattagtctagaattgcgtccttttttttttggttggcaaattccacgatcatattacatacatacacgttatagttcaatttgttggtactaataactacagctcatgattttagttgctgcgcgaaatgtgccttctgattgtgagttgtgatctctacgccactacgaacttgtttgattttaatggcctgcaattccccatgtagaaagggaaagggggttaatgttccatgattgatggtaccagtcaactactagtaggatttttcacaatctcaaacgttacagcgtgtccatggcattgtgggagttgatattaatggttcagtattggataggcgtgacttttatgcatggatgttaagactacatcagatttactgctgatcagcctgtctcgagcaggtctgctcttaaattaatcatgtgcaaatacagtctatgtgaatagattaaacttgtgtgtggaattttttggtgcagtatgcgcctaatcgatcattgtttttgattggatgatgtggttacttgcactgtaaacggcctattaacctgagtataatgggatgtttgttctacctgttatgcgctcatttttatctgctcttacttggtgaggctaactgcctagagtactcacctactcagtcagatgagtactcagccatgtagacttggttttcatacactgaagtttatggtggtttctggttaagcatgttccatgaaccgatatttgctgctttgttgctagatgttcatatgaaatttgtggtgtgtaaaattgtcatccccatttagcatttgcaacaacgtgcgtcctcacgtacaacttggtagaacttctttgtccttttatatttattgtaagtacttgttttcttttgttacaagaatttataaatggaccacttttaacttttattttgtgttggatttagattttaggtcctgatgtttcctgtaattgacaggtatttttggtcctaatttctgatgatcattatgatccattggaattctaatatggttacctacatatacagaggtacttaattagacacaatcaattcaagatcaagaaattgactaacttagaggatatctcaaatatagattggagtgccatggtgattttgtttgtgccaatttgtaactgcaatagatcctaaactgaaatgatttctatcatcttgacttgtaacgttgcaaatcaactatctagtattgactactgaccaactcggccttaacaacttggtacatgcttaatttctcaaaactcgaggctgttaagaaagtccgtgttccctttcacttcacatcttattatcttaaaatgtgataaggaactttgtggaacacatgtttatgaccagtttgaaattaatggactgcatgcactacacggcacaacctgtgtgcagatgttttatacatgcacacacggacaaaggcaaacaaaaaatgttgaacttgtgaaatgcatgagttttatttcttaatacttgtcatatataatttttctacttgtggtgcatacttgctttcctgtgatggacattttcttctttacactgttctatttatttccattaaatatgaatgtttcatatgtgaactgagaaatgtttcactgcttccaccagtttaggtggcgtctatataagaaagcttcacaagttctctatctacattttgcattgaagaggcgtgaatttcttgaagaattccatgagaagcaagaacaggttggttatatgaccattatgattcatgatgcttttcagtactggatttcaacctgtaagttccttaaagcaaactcgttgagttgccgtgcagttgtgctgtttgattggagatataattaatttttttactcttaacttctgtacatctcaaaagttagttagttttaggattagaatgggccgcaactatttattttagaattatatgagccattaggtcataataaaaacaactgttaacagtatggtattagagctaggttgaatagagacatccaattcataatatggtattagagctaggttgaacttctccttgttgctagtgtggatatggcatcattgccttatcctcttcagatttaggtcgtccttgttgtcatatgagactattgacgactagaggatctcacctatttgttgcctgcgcggtggcacacctgctcctcaaaaacccctggtgacaccagcaacaccaatctattgtggttccctattgatgtatctccaagagattgttcctggcacaagtaaagatctttatgatgaggtgcagggcatgacatcttctctcccccttgcttcaagtgtatctcatattatatattctatttattgttttaaggttcttgccgatccctttttattttttttctcgaaaacgcaggatgactgcatttcatttaaggagacccctttttattttaaaatgttaccgtaacatcttgttattagaatttatcatcatttaacttttacaagtattgatgcaccctatggaaagtggaggaggcataaatatgtgtgaaaataggatggggtatagaaggaagccattgcatctggtcagatttagtttgttagataacagataataaaatagcttattatttatggctcatacttcctagtccgcttagtggatcaatatttacatattcctcatcagttcatcaggttttgcaaatttttatgttttttaatattatgtccaaacaaaaagaggcagtttccacaaatataaggggttgaagggaaagattgggaaagcagcactccaaaatcccttatatttgtggatacaggcagggagtaagtctttaagcacagatttttatgttggagcaactcacctacttcttcctcgttactttaacttaaatatgacacgttttaaccatttgatatctggagaaatgtcattaggatgggaagcagagttaagcggggagtactaagttgatttctttattttgtgattcaaggtcaaagagtggctccaaaatctgggaattggggagcacatgccagtaggacatgatgaggatgaagcagacgatgtgaatgttcctgcacaggctgaagaaaactccattagacataggtaaaaatttttatacatcaacgacgcactagtagttgatgtatagttatgctttatcatattgcaaatgttgaattagagcagttgagtctccatatgttatcccatgcatgcagtaagcaagacattgaacctgttgtggcagaaatgttccttcaagtgctgttttgcctgtcattcgaccagctctggggcgtcaacactcagtttctgatcgagcaaaagttgccatgcaagaatatctgaaccattttttggggaacttggacattgtcaactcaccggaggtactcattacccaaatctttatacatttcactctattgtttccaattagaataaatgttgaccaaaatatcctatctgcatctagattagttttatcgtcaagagtcagtactaaaatatctttcaaaatacaggtttgcaaatttttggaggtatcatgtttgtcatttttaccggaatatgggcctaagctaaaggaagattatgtatctgttggacacttgccaaaaattcagaaggaccataaagaaaactgttgttcatgtgggttgtttagctgttgcaaaagcagctggcaaaaggtattatattttttgtagttcagttttgtatttagctatcttataatcattgtatttaagatattgaattgaacaatttttcaataggtttgggttgtcctgaagccaggattcttagctttactcaaagatccttttgatccaaagcttttagatgtccttatctttgatgcactgccacatatggatataagtggagagggccaaatatctctagcaaaagagatcaaggaacgaaacccgttgcatttcggactccaggtacatattccattttatgatctcatgccaagttagcacgtttgtttgaaatgcaatacttttatttttggttgttgacgatggaaacatttttatatctattgcaagaatgttgagtttagccagattgtgattgtttagtttggccttgctgcaaagtgacagctagctagatatcagaatattacttaaaaaatcttagtgatttttttgttctgggcctaaaaaagatgcactcagttaattatttcatcttacagtaaatatataagtgcttctggaaagccaccacaatgcccaatagagccttaggagtctgcaggattatctctttctccttttgtcgtatggatatcttaatgaatacataacatccttgttatgaaaaatgctacttttacagaatatttttgtagtgaattgcatactcataaaaaaatacataaactctaaaacaagttttgaatgcggcgattcttttcttatttatgtgggaactgaattatttcttgtggaattcctgccttccaatcaattgatactatcttggtagttctgagctggtccacctgttcatactattttgatacaagcgttaaccttatatttctgtggagtctaaacatatttgtgcttttttggaggaaggtgtcttctggtggccagactttaaagttacgaacaagaagttcttctaaagtgaaagactgggttagtgcaataaatgctgctcgacaaactccagagggctggtgttaccctcatcgttttggttcatttgctccaccaaggggtctcatgccagatgggagtatggtacagtggtttatagacggagaagctgcatttcaggcaattgcttcctccattgagcaagcaaaatcagaggttaactttgtgttgcttcaatagttacatatggagaaaataactccaattgtataaatcttaagataaccgaatatttgatgcagatatttattactggctggtggctctgcccagaattgtttctccgacgccctttccaacatcatgggtcatctaggcttgatgctctactggaagctagagctaagcagggtgtacaggtatcataatggtttccttttaatcaaagttgcagacctgttatatgatgtgtgaggtgcttaagttatgtagcaatgcttgctacttcatcacgtgtcaattgcatgaattgtagatgcctgaatcatagacattttgtatcttctgaaaatggcttactttgtgaggttcaagtctgtttacctttcaagctcaaacaaaaaagaaaaaaaaaatccgtgaatcccatctgctgacaaactattcaaatagacccctgcgatcggggcttctggcccttctgcctcccacacaccgtcatcctcacttcctcttgcatacgcttacaagttatgtaattatcaattccttagagacagagatcatgcaagaagatttcacgatccataggtccctggcactaatctttctttgtgaaaatacattagaagttaatgacttcataataggtccctggcactgatcatttttttaaagaattgtcttaatgcctggttttgtcaaatttaaccaagaacaagctataggggtgtttttggattcacaccatgctttggtgcttatgagttccattgcacacttttgttgtatttattcttattcttaatttttttattgtttttggtgcaaggcaggaatgataggttcctgtcatggcctctggtcattgataaaatatgaacttatcacatgacttgaaaaagcaaaatgagtcaaaaactagatggctcataaaaaccgacagttactgactgtctactctgaattttggtaattatgcagatctacattcttttgtacaaggaagttgctcttgcattgaaaatcaacagcttgtacagtaaacaaaagctacttaacattcatgagaatgtaaaagttctgcgatatcctgatcatttctcaagcggtgtatacttatggtatgacgaatccgtttttgtctccctatgttcaatgcaaactatttaattataacaacttaactccttattttcactttaaggtcacaccatgagaaaattgtgatagtagataatcaagtatgctatcttggaggtcttgatctgtgctttggtcgctacgataattctgcgcacaaactttcagatgttcctcctgtgatatggccagggaaagactactataaccccaggtaactatggtatttcgtttatgatggtatttatgtaggattattcccaaattattcttacctgagttttcctgctgtacataagggaatctgagccaaattcctgggaggacacaatgaaagatgagctggaccgaacgaaatatcctcgcatgccttggcatgatgttcagtgtgctctctacggtccaccttgtcgggatgttgcaaggcattttgttcagcgctggaattatgcaaaggtttgtcttttccattgcatactcatcatagtcttccccttcattattgtaaataaaataccttttttttccagaggaacaaagctcccaatgagcaaggaattcccttgctgatgcctcatcaccacatggtaattccacattacaagggcataggccaagaaattaatagtgaggctgatggtaaacaaaatcatgacaaggattgtgatgttaaaaaaccagtctctgtggactcacgggagtcttgtcaggacattccattgcttttacctcaagagcttgaaccaccggcattgcccaatggagatttaagagtgaacgatttagacgccaaccactctgatcacctacacaaaacaagcttcaatcagcctttgctcaaccggaaggcaaagttggattcttcccgacaggatttgcccatgagaggtttcgtagacaatataagttcccttgagtcatcatctattaggcattttgattcttccaaagaagaaaagtatcacatggataagaactggtgggagatgcaagaaagaggagatcaagttgcttcagtacttgatatagggcaagttggtccaagggcaacttgtcattgtcaggtcagtattgaagttaattttgaattaatttgttgatgccaatgaatgagataatgagcaagagtttctcaaagttttggctattttagttatataactatgctacacaagttacgtggtttgctatctgaagattgtaattcattggaagtttggagttttaacagctgcattattggtagacagtaattcattaggaaataatatgaaatcttttgttataacagatgcaacatgaatgctataggaaaagaggcaaacatggaaaatctgaaaccagggctagtaactatgtatgacgtaacatgtgatacttatctagttcgaaactaagtcgatgatcagtatgagtctaatgactgacacaaaatgtgattcttatcagtttagctacttagcagttctgctgcttttggtgatgttgtcttttcatattctgggttcagattatgttggttatttgcatatttaattggtatcgaaacagaaaaatagctaagatcagtttgttagtctattcataatttattaattcttttgggtgtggcataatgtttttattgaagttgctaaatgtaaattctgtcttcatgatcaccatttcttcaaaagggctgacatataagatgttcctgctgtatattcagatatgcttgtatactaaattactaaactaacattagaaaccattataataattgcatcaaataattctagtaagttaatgaatttatattttggttcaggtaattagaagtgttggtcaatggtcagctggaaccactcaaatcgaaggaagcatccacaatgcctatttttctcttattgaaaaggcagaacattttgtatatatcgaggtccgcgttttgcatttattttaaacatcaaaaattcaatttctaaacaatagtagattagtaggttttactagataatgatctttaaataatgttcagtaattgtcactatcttattacacattattctgtccagtttctttggtataaaaaatcttttttttttgcacacatactccataagtatgtaattaatatccatgagactgccaaattgttaacatcctatttgcgcaccttttttgcagaatcaatttttcatatcaggcctttcaggagatgaaacgataaaaaatcgtgtattggaagcattatacaggcgcatacttcgggcagagagagaaaaaaagcgcttcaaagccatcataataatacctctgttacctggttttcaggtaattttctactgcagtgattaggaatgtttttgttcctggttactcacataatatcgtggcagggaggcattgatgatggcggagctgcatctgtgagagcaatatgcattggcaataccggactatctgtagaggccctaattctatacttcagaatctatatgatgttattggtccaaaagcacatgattatatctcattttatggtcttagagcacatggtagactatgcgaaggaggtcccttggtcactaatcaggtaaagtatgagtcttgtccatttctggagcatgttttgttttctgccagggtcctggcactttgccatttaagagttgtgattcaaagaattagcatgtaaaatatttggcattgcagatttatgtccacagtaagttgatgataattgatgaccgcatcacattgattggatcagctaacataaatgatagaagcttgcttggatcaagagattctgaggtatgcttttctcatattcctgtgtccactatattttggtacgttgcaccttaacttgtatggttatctgatgaggagtatttgcttttcaattaactctatttggtaaatggcaaatcgcttacatcaagtaatgttttaatgttggatgtcgattatctgatagtttacccttgtcaccttgtagattgccgtggtcattgaagataaagaagttgttagttccaaaatgaatggaaaaccttgggaagctgggaagttttctctaagcctacgtctctctctctgggcagagcaccttggccttcatcgaggagaggtttgggatatattgcatttatgctttgattcttccgtcggtaatcttttgttaatagacagatgttcttagtattgcagaatctccaatgtactctttaaccatttttttctaggtatgctagcgattcacataaaatatatggtatgggaaatgtatttttaattaaatatttagtaatatctttccattagatagtataaatacatttgaatctcattccaaatggtagtgaccttgtgaacatctgccccgtgacaaaattccacatacatttcacaatatatttacgtcttactgtactaatgtcttatgtaagccgctataaacttttgacatgtgataaacaatttgatattatcacgatatgcttgatgaagctttcttatattcattgcagcagatagggatatcatgtgcattattttgattgtttaaaatataaatgtgatatacaggtcagccatattatggaccctatcgatgactcaactttcaaaaatatctggatggccactgctaaggtgagagaaaacataaacgttttttcctgccatagtcaatttaaccctagccacttgtatcactcaaaactgctaatgctactcttcctagaatgtagaaatcgatttgggatgtctaacctggtacttcatataatgttaggatgttgctttcttcagttgtaaaatcctaaactgcatggtgcatattatatcaaatgctttagtcatggcaatctccactaatactcataaattagttaactgttttttttggcagacaaataccatgatttaccaagatgtcttctcatgtgtacctaatgatcttatccattcaaggtatgaattgaccattcgatttcagttgctctttttacaaattgctctagactctaaacataatgagcatgcagggcccaatttcggcagagctttgctcactgcagggataaaatcggtcacaatacaatcgatttgggggttgcccaagagaagctggaaacctaccaggacggcgatctcaagggtacggaccctatagaaagattgcagatgatcaaaggtcaccttgtttctttcccgttggatttcatgtcccaagaggacttgagaccatatttcagtgaaagtgaatattatacgtctccacaagttttccattagcttctttttcatggaaaaattactcccctactgccatagttgtacatagtgcagaggtcaacctttaggtgtttcacatattttgtcaaatagggaaaagaaagaaattatcaacccacagaccggtggaaaggttacaagtacagtttagtcaccggtacgttccttctctttttgggcaagagaacactctgctcagttcattctgttcgacacaaagaatataggagtgtagatagtttatacggcaccttttttccccttttttaggcaagaattactcctgttgagttaactctttgttgacataaagaaaagctttcccccccttccaagctgtgtctcagacttccagtacgtgcacattttagtctacaactaaacaatggcattcgatccatacattttggttgaaaccaatgacaatccatgtaatcatgtactggtatcgcctctggaaatgttcagtgttttcctgcatttgtaatgtttcacgcccttagcttctgaagagcagaggaccagggccagttaagactaatgctttcatgtcattctttttttttttgtcacaatgaaagcttacaaaatacaaaggaaacctatacgtgactattgaaattctggaatgcaaaatggtgtaactaaactaacctgtaagcaatttattagttgatctagggttgattgtagtttttccctctaatgaaggtaggattatgattactgacatgtcttttgtttccaaaaacattaattttttttcgtaactattatctggtgtgtagcttttcccctcagatttatttgtaattcttagcacatgagagcgaatatggtagtagattcttttcaccttgcttttataatatattagtcatatctaaccaattatcttaaactcaagaagaggtatgaaaacacatgacctccatatattctcaaccactacctttccatatacctttaaatatgtatccacaaaggcgaaatctcttgttgttactgctgatagtctgctaaatacatgtgaattccgtttaccactcgactttgagttacaaccattggcgcgtgattcgcccatggttttcccacagaattcccggtgctaagctagctacctcatctgtcggtgcggccacttttgcggtgattcgcttgcgttggatgaacaacagaacgaactgggctatacagcgtgcagacgcaggattgtccagcaaaaactccaatctccagaagggttctctttacacgcatgatgtttcatactgacgtagtactactactcatctcatcaaatttaaaccaccaaaaccaaaatgctgactctgatcaacctgcatcggttgatgccaaagtgctcgcttaaattaacacggggcatttgtcccattgtgtcatcagcaacatggatgcattatgcatgatgatggatatacgcagatgcaggtatagtagtatcttccaagatccgacactaaagtctgtaaagaggagtggttgcagaagctagcgccgtacgtgtcacggttgttagaggggaaaaagggacaccatatggtatcgtacgtgttcagtactgcaatgcgccggccgttctctagggtaagtggatgacacgtgaagaagacgacgactagatgcatcgtctaacgtacaaggtgtacacagccttgggtactagggtgtatattatgtgtgtcaagggttaattgctgtgcaacgtcgtaccatttgatttttagctagggaataatggcgatcattgcatcatgcacattcatccattcatgattcatcttatcttatatatttgagtgcattcagtgctgattatgtacatacgttgattctattgatcattagatcgccatttgagatgtacagaataatcaaatggactaacgaatatatgacaagatgctacgtatatatagctcgcctgatgcatcattcataggacacaccaaataattttttgtctagattcacctgtgtgattatggtgtgcacgcccctttagtttctcactatacatgtgtatacgtactcttataaaaccttaacaatatacgaggtttttattgtgcttacaacctctcacgtgggtttaaaattaaaaactgacatgtgtagcaccttataaatgttgggtttattaaacaaccaacacggataacatcaatatttttttaattaaccggcatagtactggtttttaaaaaaggcacgtacttttaacgatggcattgagccgacctccaccgagctaaccctggttttttcaaagtccaccctcagcacgccatcttgctcgctaccacacccttagtaccttccttgttggcacctcgtcctctccaccgcggccgctagcctcctcctcacccacaacgcctctttctctccgctgaactgctggtcctccttgttgcccgcaacacctcatcatctcttgactctctctccctctcctcttcttctctgtgggaggccaccacgtgagtaggagtcggtggcttgaggggtaggcggtggtggtagagtggagacagtgttgcaagggagggagcaattggtctagccaactggagctcaacaacagctcaatgagcaggcattggcgattatttggaaatcgaggactacgtacatgatctagctgccacgtgtttggggttggccagattttgccaatgcgatcagttcgatggcagcagccctcttcactagagctacggtggttccttactccttcaccatctcgttcatcgatggccgcaccgacgctctagcttcttctccctcctatgattttgtgattgttgactttgtggggattgggggaagggttggacaacatgcctgattcttataattcggctcgatgggatgttgattctataatagcaattggagattattgattctatggggatggggagggagggattggctcaattcattttttttagataatggaataaaatatcccggcctttgctcatcagagctacagccaattattacaaaagtaacacccaaacactgagtgtggttcaaatgaattaaacacacccaacaaaataaaaaatcaaactaacataaggagagcacatttattcaagtctatttgtgaatctccatccatagtttgcaaggagttgcatgaccgttgtctcaagcctacgacatgcaaccttcataagctctcgatcatcttcacatatttgcagctgtgcccaaaatcggagccaatatgttgccctggaaattacctgcatatatgagatagatggtgatttgtcaaaaaccatatcattcctagtcaaccatagagtccaacaagtatggcagaagctcgattcatataactgttttttttttgtcaccttgtcggtgatgattgtcaatccggtacttatgtgaaattttgaactagaatctattagatttcttttaccagtgctagttaggtagccaatgttctctctactgcgatactacatatatactattcttatatatatgatactgttgatatgatgtttaaccattcttattgatatttagtgtaagtatatagaatataagtaatacttaaaatatatttaatataaaaaatgttcacacttttctgtccagattcgttgtagtatgaaatgtctcatccggtactaagattgttatattataagatagagggagtatatatctcgtcgatgcacttcttattactgtgtttacataacaacaacactcatccacctaatggcctaatgccctaatctaggactcgaatcgtgcctaggccgtaccagatctgattaactagctaggagtagagccaaacaaacaaacacatcacagctgcatgggacgcgattgatgtcatatcatcactcattggcgcctagctaagctactcctaattagcgcccaggctagcttattagactagtccattaagctagcgtgccgtcacagtggcatccacgcccaccgtcgtcagctcgctcgatcgatgtggatccatgtcatccatatcttggctagcttttccttcagtcgaagaagatgcggtggtgttttttcctcattaagattacgatcttgcctcgattttcataagcaagcttttcaaactactaaacagaaaattttctatataaaagttgttttaaaatataaaatatattcatccgggaagtttgtactcccttcattctagaatatactacatccgtctcatattatttatcgctttgagttttgtttataatttttttatcatttgtcttattaaaaaatttgaaattattatttattttgtttgtgacttgctttattatcaaaaatacttgaagtatgacttctctttttttatatttgcactaatttttcaaataaaatgaatggtcaaacgttgcaaataaaataattaaaacttaatcaatcatgtacagcttttctcgtattacatgtgacatcttaattttaatcttcatcttcatatgtttcaaacgagctagtttgtcatctttcttttcaataatgaaatgttatatgtcggttcaaaataggttcagcctctaaaaacaaaagatatcggtttgacaaaccctcttcctaaggtctcctttagatcggaggattttcatgagaattttagatgattgaatttcttaagattatgtttctatatggccatttggattggaggaataggcttaggcaaaatcctatcgaatggcttcctacctggccccttcattccaaaggaaaataggaatgacgaagtaagaactcatgtttttgttttcttttcctaagtccaatgcaccctctctttctgtctctacttcctctctcattcatatgatatatttcctgtgaaccatccaaaggctttagctcaaacattcctgtgtttcaaaatcccgtagtattcaaaagaacatgacaattcatttctctgtttctctaacatggtcccatatttcaaaggtgccctaataagaacaaatcagatatatagatttctatcacagaagtctaaaggagcacacctaacatacaccgcaactgaaaattttgatttatatccgactaattataaaattatgctgtacaaattaaggctgggtttggtagagtgttttagctcagttaataccttgtttttagtgtatgcatttctcaaactgttaaatattgttttgtgaagtataatttttttaaaaaataatacaaataaaaatttgcaaatttatagtaattaataccccctctgaaaaaaaactacttatataaatggatttagacatatacatatctagattcattcttacaattacttttaactgcacgggcggtccctaaacttattcggatatgtcacaaatacatttttggttcctcaacttgtcttgggtgtcatataagtctaaaaggctccaacccgcttcgtgtgctgacgtggcatgtcatggtggcgcctacgtgtcaatagaactcatatatcagtcacatataaaaacaagtaagaacatattttttatcctctcttttttcatttattttttcaaaatgaaaaacatcattttctcctctttttcctctctttttaaattttattttttctatgtaactaacatgtggatcccactgacacataactgtcaccgtggcatgacacgtcatctcacggagcgggttggagtctgttcggacctatgtgacactcatgacatgttcgggacctacaaatacattttgaaagcttagggacctacaagacatatccgtacaggtttaagaaccgcccgtgcacttcccttactatttttttcacatagaagagtatttaattaataaatcattactaactactaatctgaaatcagcgtaaattcgactttggcttatagggacaccacacattaattaagtggtgtatattattttgattcactgtattttgttctcattagagtaattaagacaacgtacacaagacgcatatttggttgaagagtggccaacatccacggattaattataatggggaagggcgagtacattatatttttctttgtcccatacacaataaatttcgttggtactaccacagccatgtttggcccaaacgcacgtacagatgatgatagccacaaacaaaaccactcgtgaagacgattgcgtcatcttttggatctacaggttgctagaaaattaaatttatatggcgccgaaattaggtgcttaatttctttagaggaattagatgcttagttcgacgtatatatacgacgagcgaccgatgaagagtgtgaataacctgctatagcaggcaaatcggcgatcgagatcccgagatcaatgaatacgccttcccttttaaaataaattgatttctgactgtagacttatactcactccgtactacaaagactctatttttttaatttttagatacaacgttaaaatattcatcgtatttaaaaaaaattatgattactattattattattattagatgataaaacataataatattttatgtgtgactaatttttttaaataagacggtcactcaaacgttgaacatcaaaacccaaaaataaagtcgtagaggaagtattttacgatcaaatcaatcccgctagtcgtacggctcgtgcccatctatgtcatattcatcaatcagcgaacttgttctttaccatgcgggccatgtagataagagatctatctgtctccatttgtgagatttttataaaaataccatttcttaaaaaaaatataaaaaaaaatttgtgagattttcagagaaaccactctacccttcttagtcaactaaattagcgtgattacaatcctcttataataaagatctgaccgagagccaagtcatcgactcattgagcagtcttctttcctaccgtatgagcagttttattcgccaatctctgaactcgttagattttaacctcctgaaaagtctttcagcctatatatccttcggccagaagcagctccaagaggttgatcaccacgtagatcatg

SEQ ID NO: 63953 - DNA, 2082 bp, Oryza sativa
  unsure (1)..(2082): unsure at all n locations
cgagccctcattgtaaaaagcatgtttcccttcttaggcagcgagaggcccatgtggtgaccccggaccagataaaaaggaggcccaggcctaggaggaaaaaggggaggaaggggggttgggactctggggaatgggttctagagcctgaactctctctcgctctccagctctctgtattccttcacgcacagatccaccagaacacaggagtagggtgttacgcttctcagcggcccgaactgtctacgtcgcccgtgtcttgtgcatttcctctcccgctgacgttcctcagatcgagggcgaagaacctcacttagcgcccccggccgaaccggcaaaggggggcctgcgcagtctcccggtgaggagccccacgctccgtcacagcttatatgtactattacaaacagagatgatgagaaacaaagctgaactttataccttgggcatcaggacacaacaatcactgatcatgtaccgactagggacggggtttgttgcgtcaactactatgtcatatctgtgatattttagtagtgttggaaacaggaataagaacaaacaaaaggacatgattgatatttcctattgcattctaaggatactgtcgcataatatccaaagcgttgctcgcattcaaagtgatatgatactcgaacaccttgatagaggagttaattctgatttcatgagaaacatatatagaactaattgatatcactttgtaggcacacataagtgagattgcttttacaatttatatatgatagattatctgcccaaatgataacatcttacgcacggcaagaagcagcagttgatttcacctttggttgtccaacatatgcttctatgtgtattatctgtaaaaaaacattgaggaagaatttaagatatttagcctcccttagatgttttacaaattacaagtcctattgttgccaaaagcaaaccatgtaagaaaatgcaagccactagtctatgaaaattaaaaaaaaaacttaactagtcaataagttctttccaccctgcaagttaattaacctaataaagtggcagtcgatgagagtgccttcctaggaagtcataacattataaatagagctccaataccatcacatttagaagaaagtgcaagagaatatgggggacaggtaacgggtacctgacgatgcaggttgtcaagttcaactcgatcgccatcaacaatacctaagcaacctaacaaaatacaccaagtagtaaatcaagccatggacgattaatcacaaaaggtatcatcgcattcgaagcaaaaatatctgttcctcaggagaagagacattctttccgaatgaactagtacgataattgatacctgatgaacagctcttgttgtaaaggaaatcgcaataatttttccaagtcaaattactacaatgtttagggtgataaaaaaaggggaattcggttttaccgacgccacaagcagccagatacatggccacaggcgagcccaatnccacctggcaccgactcaccaggtatgggnnatgattgnnggacagcttccgttgccctgaaataacaacgagtggatgaacagtggtagtacaggctagaagccaagcaacgagcgatgatgctgaagagctaccttcgaggccgaactgagggaggaggaggtggcgtctgtagcggctgatcatgtcggcggcggcggaggaggaggaggagggcgatcccgtgggctccacttcggcggcggcggaggggggaaggggagcggcgccgaggcggagctgcgactcgagcaggcggatgcggccgtccagctcctccctctccgcgcgcagcctctcgagctcgcgcatgatcgcctccgccctgctcctcccgccgtcgtcgtcgccgccgccctccattggcgcggtgccggtggggttgggtcaccttctccacggagctaggagcctaggagtagtagtaggaatagtactccagttgcccagttgcacggttgcaagggtgcaagggctggtgaaaacggttaccagccacaggtacgttgcgccaatcggactgactggcaattgccaa

SEQ ID NO: 63954 - DNA, 6283 bp, Oryza sativa
ttatggcaactaaaaaggtagcccgcgcattcgcgcgggtttgtactatacgtaggataaatttgagaaacttataaatatgttataccagcgaaataatatctgcaacgtttcaaaattgtgtttttttcatgaattttcttcattagaattgcatgacgaatttaattgttattatttataaaattacctattggagattagggttggtaacttacggtataaaacggtacctaagacatatgactcttgaggttccatagagaaagagagaaaacttaagtaataaaagacattgcatacacaaccatatataattaatggctctactgatttatattgaaaaattgataattaatttattaaacataatatatgaccctcgattttagaccattatttctaaccattggatatgtagatgatctaacatattgtgcagtatccaactaaccaaattattcgtcttccctcaccacggacggtggacatgttaattcgtgcctccgacaacatactcgcatcatcatacttagaagaaaaaataagtgccctgcatgtatatgcataatacatgtaactatctcaagcccctcttttcatctgagaaaaatattctatacccatgcatgcacaccgggatgcaccggctagccctgcaatttgttcactccatgaacagtatgttcctttgttctagtgattagataatttaataagtacaataagtatctgaaatcaattcttattagtaaaatgtacaataaggacagctctgtagacgccatctctccttcttttcttggtgtattagttggatttgagcaacgtgatataggtattttgggctataagttaatgtccaacttccaagggattaagtttcccaaccctcaacgccgaactcagcataagatcgttcgtttatccttaaaaaagattatatcttttatcaaggcattgggattaagtaaatagcatccacataaacgttgagagatataattaagttggttatgagtcaataggtccattgatgctataattaaggttaaggttaatggtttataggttattttgattttattaaaaaaataaggtggatattttgatttttaataagaacttttagtattttttttggtatggatgtgggtccaaaatataataattttattagcaattaaatatagtcggtatagatattaaactattgatttaattaaaaaaatacaatggttcaaacagatcataaattgaatatataatttaaaatttacagctattgaagatcctcatacataccaagatcaatatgtatgaggtatattatctatatctatatgtgcaagtgcatgcagtctttgaaagtacgatgaaattaacttaattaccttagaaaaaaaaagggtggcgagcaagaaaaaaaaatcacacagactcttatcatgcgtatggatggaaacatgtacgtgcgttgggcggactcgtaccaccagattgatcttaagtttgttactaaagataaatctaatggtatatgatggtaaaaaaaaatattaggtccatgagattaaataaaaccaatggttcgatgttctcctttttccatagattttctaggaattaattagagcgtcatgtgtcaatgtgtcatctttggaccatttctaggaatctcacgtggcagtttaggagcgtttttagaatatttaatggactcgggtttgtgaaatttactccataatatatattgccatttttaatattttgtttttatttggttgtcatgcaaagaaaaatggtatatattcaaagttaggaaagtgtttttcttaaatataaatttgataggttcaccagtttaaaccatctatatacctaaatctaatggtttttattgtttgttcatatttggttttcatgcaaagcacaatagtctatggtaaaatttaaggaagtgtttcttttatatatagattaatgggttcactggtttaaataatcgttaaaataatttttttcagggacaatggttaaaataattggttaagagcgtttgttagagtggcatgtgacggcttaagagcgtttctaggatgccacgtgacaacttacgagtgtttgtagaaagtttcgtggacttttaattaatacaaatctaataatgacataaaatattgtgttcattgatcttagtggaaaccaatggttggatgtttctctaatttaagagtgccacacaatggttaaaaacattgatatgatacttaatggactttaacgcgtttgatgtctacttgtgggggtattcttttcgataaagataagttcaattttaattgtgattagaaaaaggaaagaaaggaacaaaggaaaaaaaaagagagaacagacggatggagtagtacgtgcgtactgcacggaggtggggccggtgggaggttttggttttgaagatagatctaacgatgtaaaatagtgggtccaccgatttaaatgaaaatcaatggttagatttctctattttattagagtgccacgtggcaaagagcgttttgagagagccacgtggcagcttgagagcgtttatagggagtttaattaatggacttttagaatatactccctccattccaaattgatctacatataattttttttgagcttatttctaaatgatctacatatttgtgttcattcattaggtctattcgttatttgtgtattggagtaaatgaacattgatgcatccatgcacacaagtatttataacctacatgtaatatcttgatttgctattggctaggaaataatggggatggtgcatgcatcgagtttgttgctagaataaatatagtatgagagagttattagcttttcttagttttgatgtacctataaaatatatagattaatttagaatggagggaataatagatagacagatagatagatagatagatagatagatagatagattttcaacacggagtagggcacacccaacgaaaatttcctgtcctgaagccgccattgcttgaggccttggattaattggattattgacaagttaaactcagactgagttaacatcttcaccacctccttacaattttgtctcagttatcaccctttctgcccccagttcatttgcaagctcagcagctcttttgcacgccaacacctcactaacaaggacactgattttgcactttaaacacataccttctctatcccataaaaaaccaatcctaactacgaacctgaacacatgtgtgtccaaattcattattaggattggtcttttcttttttgacgaagtagtatttatttagtttgttcagtgtattatcattcgagatccaataagcatgcactgtttcggtcatgtatttgttgcgtgatcgatcgatcgattcatgtactagatgcaggaccacatttttttggccgtaccaaatctgataaggttttgtacctttggattgggtctgctgattagttatccatctcaccatttcttcaggattcatcatcattcgttttcaattcgttggtaccaccacacaccacactgttacacacaaatcgcacgcctccccactaatccatgaccaatcatctcaacatgtactaaccatttgatcttgttggaaacacacatctcttttcataaattcggaatgctaatcatatccaacatgctaacctgcttcatgcttcaattttcacgaaattgctttcctgccaacaaatgggggtgagtgctgtttgtgtttggcaacttggatagtagtacaattatctgcagctaaagaagctagttgcaggtgttaattcactatcaaacgccatcaacttctttgcctgatactgacggggactttgcaacgtaatcagatcgaaggaaaatataaactcttgtagttatcgatggcacgagcaaaattatctaaaactatctaacacaaaaccatgtgcattctctctgctttatgtacatcaattaattagccgaatgaaagctagctagaccgaggcaccgagctagaaacaaaaaaaggtttattcggtgacaaatgcagaaggatcctagtgcatttatttttgaacaacttgctgtaattaaaggttagaatgactgcaattaattagtaaatttctatgtatgaaattcaactagtgatgcaagtggcactgaatcttgaattgcgtcaatcctttttatctgaatctatctactagccactagtgaaggttcatagtggagtccagaaatgcaaaaaatatatccttgggtgcattattatactccaccgattgcatgattttttaccagtggtgtttggtcggttacagttcacaagagtagctgagacagtcagtcagtgcgctcattggctgtcaaaaaagctctctgcatacatgtaagcttctagagtatatggcacactctaactacttgcacccaaatttgatactagacgtctgtcatcccaatatatatactaacttgttcagatacataaatatattttgagacagatgtggtactgaaaagtatggttcttaaagtgcgtggtataatgtttcacctaaatttttttcgtcgctgataatcgtttcttagtagtatactcgtgccttcatgttcttgggagatcatagaagcactattcataattaactagggaaactatcgactctttagcaaagggagagcaaacagcttttgatgtgaattcttttttcttaaaaaaacacttggtataaattcttaaagaaatactagtagaacttttaatgtgaaatcttgaaaagagaacaacttttgatgtgaacaaactgtaacatgtgcataaaagaatactaattaataaagagtagcgcaaaagaaaactaaagaaagaacactacttaaccattggatatattcagatatatatatctgatatctgaaaaagacaacaaaaggacaggaagtgcaacgtcagaaaggcaaatatattcagaatatgtataatgctggcgccgtcttcaggggagaaagaaactattctgagtgcgatcgaatatctgaaaattcttgaacacttgcacacttgcttgactgactgcctcctttaattcgatcccagctagtggacacatctgcgatttggatcattctcagacactctgagtggccggccacctgcaaattctgcaaattgcatgaaaagatatggttttcttggaattccgttttgtttggttcggtgaatttggagctctatatgtctgtgcttttggaatatagaatatggttttcggaattccgtgtgctcattcagtgaatttggattggtcctattataatcttttgacgatgcgccgcttcgacctgttgcatcagaaatcgaaacctctgactgaatttcgtacaaatctaaggcttgggtgggacatataagcatcgcaaaatgaacaggttcagaggaatgttggcccttagtcatcattccatcaacatcgtttgccaccggacaccttgatggatctctcatgacaaatcattggtaacaacttgttgattgttggtacttgtatagtcatcattgtagttcttcgatttaagcatgatctttgattttcattttggttcgtctatattgattgatttatgtctcaacttgtggtcaccatgatgcaggctagtctagtcatcctggccagcaggtgaagagttgctctgggaatggatggaccactgatcgatcgatgctgccactgtagatcgaatactgtctggatcgatcgatcgatagatgcatcgacacaacaacaacaacatcagctcatacagtcacagcacactgcagcattagctagagagaataaaacagtacatggattggaacatgtgcagacaatatgatccatgagtgtccattcgatccattgagcatttgcaggcagctggtgcttaatatatttgccttttcatcatcatcgtccgatcgatcgacgcatgactaccggtttcagaaatggtggattgatcgatcggtgatgatggttgttggagatgacggtggtgatgaactactgatgatcaacttgcattgctgccgagatggagatgtgtggacgtactatacgtgagatggatagatactggtagaaatacgagatctgcctgatatgaaaatctgaaatggcatcgcatatgcctgctgctgcttctgaatgccggctttggtggacaactttatgagtcagaccggtgtcatatgtgcac

SEQ ID NO: 63955 - DNA, 12654 bp, Oryza sativa
gatggatggatggccgggcgtggttctgtgtttttgaggcgcgggttggggatccagatcatcgttcgttcggggagcagttcacgctgcctatccttttccagcgttgggatctggtttctagccccatcttttcgcttatacacgttttgaatcgcttattagggtgtgtttagtttcagaaaaaagttgaaaacttgaagaaagttaggagtttagaaaaaaaagttagaagtttacgtgtatagggaatttttttgatgcgatatgatatgatggaaagttagaaatatgggggaaactaaatacggccttagtgactaaaaaataatttaaggatcaaacttttacatacatgtttttagtgattaaaaaaataaaacttataatgtatatattcttagcgattaaaaaacaaatactataaaacaatgatgaaaaaatcataaaatcaaaattttaaaatttgacttaagaggtacaagcatgagcggaaaaataggggttcttttggtctacgagatgtgaggagtaaagtatagacatgcatattaatggttgaatttgcatataccttaaatggtagatatgttttggagtaaattgcatgtgctggtgatcaaaactttttaagcgttcgttttgtctattatttcccccacgttcttcatcttttactgtacaattatcatgaattgttataccgttgattaaatatgtatattgcctatataattaattcattgcatatatgacatcctaataagcgtctaactctataggattaatcatagtgtatagtttttaccttgattcatacacagatattttttcaagtttatatagtaccataagtaggacagataagcattattttttcctatttataattttttttattacacgacaaacacaggcataccattacacgcagcaacagtcacaaccctgcttatcataattttagttaatattttttactcaaattttatactagtacgtatacgaaaatgaacttaatttgcatccgtagtgccaccagcgttttgcgtacggatcatgcaaatttgtggatgcgcgttttggattttttggtagtaagtgagaccgagtcgttgaggaaggggtgatgataacactatacttttaacacagtaattactagtcttctcggattcgatcgtcgacgttagcgtagtgctaaatctaatcgatccccatgttgctgtcaaacctaactttcaatgatgctacatgaatgagaatatatatatatatatatatatatatatatatatatatatatgtgtgtgtgtgtgatctagagcttaagcaatactagattacccacaaatcagtgtgataagaaagcgacacaaatgaattaaattcactgtaattaaagaaggctagctagctgttcaactctggagagtgtactgtgacatgagccgcctgtgcactgctagccacggactagatttagtggttactggacaggattaattcagtattaaactgctagtgtactttgctcattgtctgatggcccaatttttccattagtttgttcaaaatttggccacctttttcctgaaccacttcagcttttgacaaggacaaaatgtgtacacatgcatgcatatggatggatgcatgttgttttactttgccttgaccttgtgattaggtaaaccttgatgtttattaattagtctgcatgcatggtcattatcgagtgattagggtcgctgttattcaagtgttttcttaatagttgaaggaaccatgtcgatcggtcaggcatgattaaggtagcttaatttgtggacaagattgaatgggttcccccatagtttattatatctctggttacatctagagtgagtgatgtgaaagtgagctatatgtgttttgtttttgtgggatatttttggtaaatcaagatggaaacacgaagcgaccagattatattgtatttcattagcacaagaaaaaaaatctacacttcactctctctctctctctctctctctctctctctctctctctctctctctctcaaactcctctatttcttagcacacactttaccacctaattaaattactgatgaaattaattcactttattacaacattcccccttatgtttctctttatatacaagttatatttcaaggagaaattttgtgtcctattttaatcttggtatctcagttacataggttggaacttttgcgtacaacaactaacttaaatatcaaaatttataatagcatgcaatatgtcatgaaaatatttaaaattatttgtgacataagaaaattgtctaaaatcatgttcatatgcatatgttaaaaaaaaaagaagaaaacacttctagaagagagagggataggagattggcaagtggatcgatctggttagggtagtattttctttgttataggaagcttgaaagcctctcactagtcactaccaccaaaaaaaaaatcgaaactggcccatcactgccggttcttttagaagtggaaataatatttggtagcaaaatacgaaatactttttcaaacttttttggagcctacgaaatccagaaatctaggacaccactattgcctctagttaaatactccctccgtttcgaaatatttgacaccgttaactttttagcacatgtttgaccgttcgtcttattcataaaatttaagtaattattaattctttttctatcatttgattcatcgttaaatatatttttatgtaggcatataattttacatatttcgcaaaagtttttgaataagacgaatggtcaaacatatgctaaaaagtcaacggtgtcaaatatttcgaaatggagggagtatcaggtattactcgtagtttaaaaaccagcaatgatactccgcgaataccatttgtcgacagtgcgctgccagttaaaaacaaaaaacataattgatgcagtgatgaggcttgtttggttggtagtgcccgtctctctgtggcatgacaattcatttgcacgtagctctcaaaataactagaaatttaactctttcaaaggaatagttagtccacataactgcagtaccctacttaattacgttttcatatatatcatccgtttatgtaaaacgttgtaggcccactacgatattctctattgctaatagaaagcagtttgaatcgttgatcctattcgatagaagagttcagatctatttatacaattatactatcctctaattagcatagtagaaacgcggaggagcattattgtcaaaaaaaaaaaggtgtgaaggggtataatcatcatttagccatgaataaacatttttttccttttctttttagctttttcaatggaatatgagcgatgctagcgtaatggattaccacatattgatctagccaaaaaaagacaaaacgacaaagttacccctaacaatcgtattagtaaattactgatttacccttaataacaaatggttcatatcatttttactgatagtatataatactactagtagagagcaccgagtatcgctcaaagatgatatgataggaacaaatggttttatgtgctaacacgcttgcctatctaaaatgatctttatgtgtgactaatctcgctaccggtataatattgaccacaaggccagggctatgtacttattcccttcgtcccattaaataaggcacgcacgtattttataattcaaccctctaaatatttgaccaattatattttattataatcaatttttatttaataaaaataatatatttatattgatatttaaatttactttcatataattatgattatgttgctatagacatcgtaatatttaagaaattcaaagtcaaagattagttttaaagaccgtgttatatttgaccgtgccttagtcggtggaacgaaggaagtattagacatgaataataggtaaatatatatgaaaaggtgacaattttgacagaaaataagaattgttttgcataaaaataaagcatgtatggtttgactctgatatatgaacatgtccaatggtttggactattgatttcgtgatcgatgctggccctacgtagatggagaggatctgacctgaaaaaggccagtactgtgtgccactgtggcaagtgattgcatcacacgccatactttgccgacaaatagtgcatacgtgagaaatgcctgtgctctgaactatactcctatatatgtttccaaatggacgtcggtgtcgatcgattattattgtttctgttatgaccaccaaaaattttaaaatggttatatttataatgcacgaatgttgcatagcctacaattaatgtgactcggcattgatgataatgatgatgttgctcaattataaattttttatatgggattcggatggtccagtgtgaaatagtaattttttttcttcagttttttctttgaaaaattgtgactcatctggaatcaagcaccaatgccgattcatgccaaggaccgatagtaatgaatttgtattgccaaatcctatactagtagaaattaaggagtaaaatctcatctccaacaatagccataattttatagaataaaaagaggttgtcctgatttcctgagaacctcgaaaataccttctactcaatccagcaataattttcatttccaatgcctcattttttttctcgattatagatgctaataacctaacaggcaattttctgagctcattcctgttaaaagtatacccttaggcaattcccaacccaagacactagacattctttccatcaactccacatcatcaagaaattagtactagacactaatcttccaatgcaaacactactattccatatttcaatttaatgctacttatctcacatgatgtcttgaatgttgtgtagaaaccatgtctgatgcaagacatggtttccttctctttcctcatttattcacctgccacatcatttttcatcctaggtggcagcttatttaatgctatggacactatcctagtcattgggttgggaatggccttagagcacccgcaatggtaaagtaatgtgctatctataaaacatgtacatctcagcaatagactagattaatagtaaaccacttcaatggtatgtctacatgggtatctatagctctctaatccattgcctcatttttctctatagactatctccatattagtagatagttttgttctctctcttcatttaatctcttccaagtaggaaatatgctgacatggatctcttgtagaaaggctatagataaccattgtgggtgcccttatatgcgcaaattaatattcatgggaaccaaggaactttgtatggacacacgacttaactaccacacacgctttaggccctgtttgattcagcttacgattattataatctagcttattaggagtaagctcaaacaaacaagtagattattatagcagattattataatctataagccagattattataatctgataagctgctctagaggagcttttttcagattattgagtggctaaagacccactacccctacatacttgagaaaaattacccacctatgctatcaactgaacagatagctgagggcattatagactttagcctttcaaacccaataatccagacaaacaaacaactcacaacttattctatgccagcttattataatccaacttatagtaatctggcttaataatctagattataataatcataagctgaaacaaacagggccttactgtatttataggcttatagccaatttaatatactcctagatcgcatacaagtaaaaacatgataaacatatttgagcacaaactcaagatagattacatacatgcattatctctacttttagtacatgacactgtttactttttaaatatgtttaagataaatatataactattatttattttgttatgatttagtttatcactaaaggttctttaaacatcacttatacttgtttatgtttccaaaaaatgaataaggtgaatggttaaacatacgtttaaactagaaaaatatccgtgcgttgcaacgggtgaatgttattttaatcttagtattgttatacggtttagctaggataaaattcattgtgggaatttgcttggatttttttttagaaaatcatgagctgcaattaggaggcggactttcatcccaagttagcatgtgagttattttaaagaaatttcttatacggcttattttgtatttccaaaagcaaatgaacttaaattctgactcaaacacgaatttatatttccaaaagcgaacgaacttaaaaactgactcaaatacgaatgacatatcaaaataccgacaaaaacatatttaatttttataatagtagagaagtcaacagtgtcatatattaaaaaataaagagaatatcatctaaatctgatcaagtacgaatttgacgatctgatgacagattaagcatgtgtttagtttaggataagatgtaggataggttagatcaatccctattatttggataagatggtcccatttatttgtttggcatgaagtataaaatgatcccttttttcgaggaatgggagggtgtgggtcacatgtcaatgaaaaagaggaagtgggttttattggtctgttacttttttaagtatggagatgaacgagatctagatagaatattcatttttagagatcatcatatcccacatgtcttcgaaccagagattataggtttgctcttcctcaacccgtcctaaccctctatttccaaccaaacacatagggatgaggtaggatggttggactcattctatttttttaataggatgattcggtctgtccgtttgacatgagagatgggatgtgatggttcagtttttagaggatgtctcacatgtcagcgagactgaaaagtgggctggattggtccgccactttttaaggaaccagcccggatcttagggaaatatttcttttcagggatcatctcatcccacctatttttagaccaagcaccttaaaaagtgggttcgacccaacccaacctatttcatcccttaaaccaaacaaatgcacgcacatgctacagctaccatcgacgatataggcacgtttcacatggagagggctcctctaagacttgggtcgctgacatatggtcccacaagctatggggtccaaatgttagcccccaaaatcagagggcagtaagttagaggatcactttcctgtttcacacatacgtttggtacatgatcatggacaccttattaattaaatagttagcatgttcttcccgtgtattgcttgctaccatcaaaaattatgaatttaattagaaaataccatcgtatatattattgaaatgtggatgtatatgccccacatgtcattcttgtatgtcatggtattttacgtatccatatgatgttatttcttaaacttttcgatctctcataaatactcccttcatcctaaaatgtttgacgccgttgactttttttttaaatgtttgaccattcgtctaatttaaaaaatttaagtaattattaattcttttcctatcatttgatttattgttaaatatatttttatgtatatatatagtttaacacattccacaaaaatttttgaataatatgaaaggtcaaatatttaaaaaaagttaacggcgtttaaacatttagagaagagggagcatatgtcaacgtacatctcttttaagccaaaatctgcagatcatcaactggtgcgttattgctagctcatatttcgttttaaaaaaatctggatgcagatttcacgtgctcgttttagtatttcttttcaaaaataaaaatttttattaattcaaatggtttccccgtaaccattgtgattaattcgtgattagttcgccggagtactagttttgcacatgcgcattattattgttcattactaaggcccggtttagttttttttttcacatcggatatacggatacacattttaagtattaaacgtagtctaataattaaataaattacagatcgattcagccaggaaactgcgagacgaatttattaatcttaattaacccgtcattagtaaatgtttactgtagcaccacgttatcaaatcatgacataattaggcttaaaaagattcgtctcgcaatttccatcagaactgtgtaattggttttttttcgtccacatttaatactccatgcatgtgtccaaacattcgatgtgatgggtgaaaagtttttgttttgggaactaaaccaggcttatttccaccatacagtaaccgccagttaattaactaagtaatcagcagattggacgtgtatacaagttctgagatagccttcaattaatcgagatattatattcaagccgtttgatttgccatttgtgtgtataattgcgtcaacgacattagttgagtacgcccatgcctttcgccaattagtaattaaccagacgcttaaattaaataaacatgtttttttactacagctgtatgcagcgcggatcgtgcaaaaatcattaaggcatgtacaaccccacatataggggtgcgtctccaagagcctcgaagttatcatccaaacagatataaagacagctcatacaacccatagacagaggtatgtctgtaagctgtttaatgctttgcatatagttttgatcaattgcaaatacgtttgtgtataccattgtgtatatcaattgcaacctgccgtgctgtcgcctcgggacgacgagtttgtacaacgatgctgagcttgcctcttccgcctcggagcacgggtcgtcgccgtcgcctcgcgagaggacgcagctcccgtcgcttgactcaaccgggttttttttttttttttgcataaaaggcatcacagagacagggcaaaaagacccgctgtacgtgcccttagtgatttcgagttccggccgtatgtttctgatgccgaatttattttaaattcatttggctccccttctgacttttccctaatttctttatgtacagatcatcagtgcataattaatgttgttgatttgatgtgcctacaaagtactcctatatgccttaaccacacataatatatacccggggaatatttctgtttaattttctttaccaaatcaatatatatatcatacgactgttggaggattctcttctgttcatttcaggtatgaactcaactcactaataatttctgtaatgattggaacaacatgctacctaagctagctagctaggagaatacctaagggtgtgttagctactggaggttcccaaccgggaacagggtgcgcggaaaacggaacggtccattagcgcgtgattatttaagtattagctatttttttcaataatggatcaatatgattttttaagcaactttcgtatagaaactttttgcaaaaaacgcactattcagcagtttaaaaagagtgcgcgcggaaaacgaaagggggaagttgggaaccagcagtgccgaacacaccctaaatcactgctacaaaagagatttttctgtgcggcccgaaagaggttttcacatgtggtagggctagcagcacgcgctcaagggtctgcaaaaatcgatatttttgtgtgtgggtgcttatgtcatccgcacgcaaaaataaaaaaccgaaaaaatccaaaaaatagtcgccctcctcgtggtcgctgttgctgggtccggcccgctcccatctctggagccagatccaccgcccccatgcctccccactatcagattcgccgccgccgtgtgaggggagggcggtcgccgtcggatccacgtgggcgacgggtaccatgcctcaccacctttagatccaccgccgccgccatgtggggggaaggcggtcgccgttggatccacgcgggcgatggccgccatgcctcaccaccgccagatccgtcgtcgccgcgcgtggggaaggcgacgccactcccggccacctcctcttccccatcgtcgtcggcagcatcggtggcgcggatccggccatcgcgcgcacacgcggcgaacgaggtggtggatccagccgtcgtgacggtgatgggagtgatacggagccggctgtcacgcgtgctcccaagccgcccgccacccgaagtcacgttgctggagaatatatttttccatcatttttaatttagataaaactgacggggaaacatattctccagatatagccacattgcatgtggccgaagaaagtttccgttggcagccttctttacgcagctgcaagacctagcaattaccctacatggcccaccagcgaaaacatcataacgctagcagttggcggacatcgtagaaagttgtgtattttcattggcttttggtcactggtggcatcgccagctgcccattttgcagtagcgatggtttcaatgttttgttggtagatcaccggaatttttcgattgacactactagaatgtagggcaatcttaaattactattttcctccctccgattccataattcttaatgttttagacaataattaacatggtctccaaatatctttgactagattttttattataatatatacaataaatcaatatatatattttattatattactttgtaagataaatctatatatgttattatagtgccttttaaactaaataattttaaggttattgataattaaattataaaagtttaacatcaattttgtctaaaatgttaagaattatagaatcggggagtaatagatacatgtatgattcttttatgtattttaataaatacgataacataaatatcatgtgttttcttgtagccgcacacaaaaatagaaaacgagatgcatgatccagaaatgcaaaacctcacgcggagtacaatataatgtttagcttgaatcgaaagctaaccatccatttcatgtccctgacaactttcctagataagcttgcttagctctagacgaaacgaacttgaagcattaaatatacacccggatgctaattgagtcgcagtcatgcgtacggccaaacatttcaataaggaatttggagttagtatttgactgatgagaaattttttttaacctgttatgtctctatctcttggcatatcaatgagctattccatcctgtttttcctaaattttcatcgtttaattatttgaaaaggctggtgggacaaagacgaggattaattagacaaattaacatatcttctcaaagcaccattgtatatatttggaaaagctagcaattgatgcatgcatggtgacatcttctgtttcttgggttagaaacaaaaggatttcgtaagataatggagtactgagatattattgtttaggatttgagtccatatcagacgatgatatatattgtccaattttaaagggaattcgtgtaattctctttttggtgtagcttgaagaaaaaagagagtacaaattaatgctccctttcttacatacttaacatatatacatattgttctagctgtgatgtttggataaagcctaaccaatctccacatggatataatatacccttaattaggctctgtttgaaagctcattaagatattttgcttttgtgctgtacgcgaaacaagaaatattattagcttataattaattaagtattaactattacaaacttaaaatatgtttacttaattttttaaaagaaacttctatataaaaaattttttttaacaaacacactgtttaccagtttgggaaatgtgcttatagtaatatggagagagttgcaagagcgaaatgaaacaaatgaatacaccctaatactcataaaatattttatggtttgaacaagatttcgttacactttagaaacttaatttgaccatcaataccttttcaaatatttaatttaaaaaatgatgtgtatttataccttgaaaagtacatcgtagtttcataaagttattaattacttcatccatttcatattataagagtttttaggttttaaatagatacatgcatgcatccatgtatgtgcttcgtatatgtatctaaattcacataaatattactcccttcgtcccaaaatatatgtatttttagactaggacacggtctctgagatgtactttgaccaataatatatatataaataagatgttttaaatgaaaagagttatatattatgatagattatttgatgataaatctactaacatcaattttacatgattgatcttttttattttcttgttattaatagttaaagttgaaattgtttgacttttcactatgctaaacatacttatattttgggacggagggaatactaaatatggacaagaaatgaacagaccaaaacatctttacaatgttaaacagagaaagtagactttataagctttttctaacatagaattgatagttagtgttttgaaagtttgagtgaattttatcatgaacatgtttagaacatttgtgaccagaaggagtatgttgatatctctaaaaaaaaactattgaagtatcatgtacattaaactatgttttccgagctaggttctcctactacatttttttccatttcttttggaaagaatcacaatatatattgtagaagattaaaatgtggatat

SEQ ID NO: 63956 - DNA, 2751 bp, Oryza sativa
ctgcagcccttcttccctgcgcctctgtgcagcgtttgcgtttctgttttttttttcttttttgattgctgtcatgtgattgtgatcctgtgggctgctagtatgtgaaattcagagcttcaggttgccgcccactgtcagactgacagtcagaaacgttgcaccgttgggcgttgacgtgcatttggaatgaaaacggccgggaaataccattttcgtaactatatttttctccgtcatcgaaaatgtaaagctggaaacaaaaaccgtatcatataactacacgaacaaaaaaaacatgctggtatcaactgggaacaggtaattgttaatgtataacatatttaattcaatgttacactatataaattattagtacaaactatgtatatatgtctattttatgtccttaaattagatatttagttagaagttaatacatcactaaactatgagctaaatagagacatgttaaaaaattataagaatatttagaaatacggttcccactagaataccataacgataacgatcagtacaacatgaaaaccatttatttccatagtttttactatcttagttaaacttttttttaaacgaaccgtagcgagatctcatactaatcaggttgaaaatcagaaacgagggtcgaccggttcggcctgggagacgcgttggcgctaggcatgcatgagatgcggcagccaggatttgtcagccgcccagccggccggcgcgcgcgatgttgccgtcggcgcggaaggcggcgcgcggccgggcatgtggcctcgcctcgcctctcccggggaggtggttgtgcgcctgtgcgtgggccgtgggcgtggctgttctgcgcgccgtcaagcacgtggcgcgcgcgcgatccatcaacaaaccagctgcttctctgctctgcttgacagtgttcctagctgtagcgcagcctgctgtggaatcctccgttttgacccgtttcttgccttgctgatgcaggacacatgcaagccaagcgtgtacattggcatgaaaaatacagatgccccccgtttgaatctgattaaaatacaaaattatatggattttgataacacgttttccaaattaataaataattgaaattcatttatcgttttacatgatgctcgtacttaatttcaatcttcgacgggtgcaaacagggccgatatagactactcaaaacacaaaaactcatgcagacatggaaaagagctactacagctcaccgtttgctctttaacttgtatgttgttgttaaaatttgaattttaaaagttagttttatagttttattttttatgacttgctttaaatcgttaacataaaaatgttactgtaaattatttgttcataaaaatcgttacagcttatgaccagctacagaagaaacgatgagtttaactcggaaccaaagattttattttaaaaagggagaaacaccccgagccaaaatttcagagatatgccaagtgtcttcgcccattcggcggcagcccgcgttacaataatcctcgagtacacaaccattattaaaatcgagcacatgctcctagcacgagatattcgttgccatccatgacttgacataaacaactaatcaaccgcttttcatttgcacatattaatccggctttttttttctccaactagtaatcaactgcaatgtgctcctcctgctatatcttaagctgctccttaagctactcgtaagtactaagtacgaaccactaatggcttggaggagaagggagagggaagctccgtatctggcgtgtcccccgcacatggcgggtctcatggacacctttgtcccgtcccactcgccgctgtcggagttcttccactcctcgattcctcatgcgccgcaccagcttcgattcgatctcttctccctccagccacacagatattccaagctgctgctgctgctatttcgcgtttgatttgattaaacaatggcttaattgatactactattattaatcattcaccttcttgagaaaattatatgcattcattctatcagactatttatagaatcaatttataatataacactctattaatttgttgccttaacaattcacatgttggagagaatattcagagaaagtagctcgtgggaagctagtttatgcttatagctgccgttcgatctttggagcatgagaccactggttatctgaagattctgaagatacaagatatatcttctacatcctcgcgctcaccactcatcggcattgataaatacgatgatgaaaagtgattttttataggctccctgaatactttactcgagttgatattccacatttccatggatcattatatctctgcgacctgatcatgcgaatgtgtgatgatatgccagctgaaaatgtcaatggtgaacaacttaaaacacggcagaatcaaaggattcttcgggaataggttgatgcttgataacattcaaagtccaagctgaagcatgtgatatatacttgacaaagcacctgggatcctgccggcatcttgcttgctataagttcaatttttctttctctcacttgtttcctttcaaggaagcggaggagaaaggtggtactctttttagctgtgattcactacaagaaaggtgatgttgtatttacgttccaatattgacaagtgaaaagtgatgtatgatccactctattacaacgataaattaaatgctattattagggactatctactctacattcctcc

SEQ ID NO: 63957 - DNA, 3970 bp, Oryza sativa
acaccattgactttttagtacgtgtttgaccattcgtcttattcaaaaaatttaagtaattatttattattttcatatattcattgttaaatatacttttatgtacacatgtaattttatatatttcataaaatttttttaataagacgaacatgtaaacctgtgcttaaaaagtcaacgatgccaaatattctgagacggatggagtatttctctccgtctgttgtgcgccatatgtcgtggcctgagtggattggagcgatccaacgaccgtgctgcgcccggtgggccccagagtacagacggccacgtaggacaagcagcaccacatccacacgtacgggcaggggccagcgcggcggtggtggccaggtcggtcagccagctgcgtatcttgtctccacgtggtgggcggcaggcaggtgtaaaatgattatttttgctctccgatcttttgcaggcgagtaaaatgatatacacgggctataaaaatttggcacatcgtgccgtacttcggtagagcagaaagggtagaaaaaataaactcttaataagctttaaagaaagatataaattggcttagatattaatgggtagtgtgtagatacgattaagaaaatatatttgttctcgaggagtagtcctcttgtttttacctgtcgtcgaaaacatcatcaaaaaatttgagaaatttaacaagatggatctgaatcgctccaaaaacatacgaatccaaattcaccttatacaagtagaaacaaaaacgcttgactatgagtagaaagtataattcacagtcaaatatataaattgtgtttctgattgtatgtttttaattgtgtattcaaatttaaacttgtatatttctaagtgactatatcatatatcgacatatcttacttttttttgacttaccatatatcaatctatcttatcattttttatgacttctgacatgatatgtacaaaacaaggagatgtccgcttaagggataaaaatccatctccatctatagctacctattgtaccaatgaactatttaagttagttaattaaatgatatgttaatccttgtagctagcagttggctatgtatcaccaccactgaactgtagtctacttactaagtttgtaaagatttttaataactgcggtagatttttcatctggacccatgggaatgggggaaattgcaaataaaaagaaaggaaaattgtatgttctgttcaagtcacagccttcgaaggcgcagctcccatagatgataccgtgagtactaattatttctttcaccaattaatcaatattatccctttctgaaactttggaattggataaatatataaaccttatcatggatcttaaggataggttttaatagtatgcatggttgctagtgctgaccgtcctactattcttcttggagagtaatggactcatgcattgctgtatgatttgattcatcacaaaaaagaaaaagcaatgatctatctagctaattctgtccagctttttcttgcagccctcgcatgggcggtttggcagatccacaacaatgcaagacggcaattaatataaagaacaagaaatttcgtttgtaccattctgaatctctgatgcatgcatgttatgtttaaaattatttcttgcctgcagtcttggagagcctagctagcttggtcaaggagaggatgatatacatacagatgcatgcaaaatcaaattttggatgaaatgttgagtggtatgcgatgagcctttgttgcacaaacttctactagctagaaacatgtgctagcttagtgacatttattgttttttcttctttttttaaatcctcatttatccgtacatgttcaagtgcaactgctatattccctagttgtctgtcattttgtaatgaatatatatatatatatatatatatatatatatatatatatatatatatatatatatattcaacaaaaacaatgaattatacataaaaaaagtataaatatgacaaaataagggagtgtctagatttcagaagaatgaaaatacattcactttcttatcacctggatgacaatctaataggtctcatcagtctccctattacttatttaaacaaaaccctttttttgttaaaatattgaacaacaaattattctaatctaaattcataaaatttagataataaacgtgactaataaaaaattaaaaccatacacaacaagaaaattgcagcacaaatcatacttacatagcactgcaattttaggcctatttagcaataaattttaggtgattaaaaaattatatacaaattttatggcacaaaatctaccaaataccaaaaataaagttttgtatcacaaataactaaataaataaataagtatgcaacaaattcacctttaaaatatatacatcttaattcctaatccatatttttttgagggaatagattcataacgcatatatgagttccgtactacactcttaatcgataaacgatggagattctacatctcacttatttgtgtgaaaagagtggtccaaggcccggcttacccgggatcgctagcgggcacgtatatgatcgctgttgtttatgtgtttacctagactccaaagtatttacagattgaccgcaatatacaattgatctatatttattaatctagatctaattatctaaagatatatcagaatttccaattagccagtttttatcaagacccatacctaaataaatccattgcccatattagattcagagacatattacgagtgaaatgccacacctaacctgacataccccccagcacattgaagaagggcaattaatagagcatagtatattcagtactacccctccttatccagtcctccacgtcaacaaaagaaagaaaaaaaagctcccttgtggaatatccggggtccccaaggggctatccgcgaaaaaggccaagcgcaccgcgacgcacgccacggacgcggggcgaatgttgctctcagtgcaagcgacggccccccgccatggctgactcccccccacgcctcttcctcctcctcctttataagctctcgcgctcgcgctggagctttcaccacgctcgctccatcgattccttgttctagtgtttctattttttatttttggctcaagtttctagcgtttcttgatctgctgctctgcttggttgcgtttcttgatttggttgggattggttgttcttgggcttatcctgtgtagcccgtttcttggattcaaagctcagctcaggtgggaaggaagtcaaagatcccacctggtgaaaacgtacggcgcagccgcagatcgattaattttcgcggaagcgtccccggccatggttgctgccctcaggccgcaggtgctgatctcttcttcaagataggaagcgaaacagagcagagcctgctcgtggaaggagaagctgagtttggctctgcagctgagactatccatctgcgacgaggaggaagaagaaggagctagcgaggatgcggcacatctcgtcgctgctgcaggggctggcgcgctcgctgtcggtggggaaggagaggaaggcggcgacggcgacgacgggaaggcggcggcggcgacggcgacggcggtgctgaggacatcggggacgctgtggggcgagggctctgagacgttcgccgccgtctgctcccgccgcggcgagaagggcatcaaccaggactgctccatcgtctgcgaggtcagtcagattctgctctcctctgcttcttgttcttgctactttgctctctctctgatctgcttgtgaaacaatgatatgatcacaattattggtggcatattagcacgtagtaactagtaacaacaatacaaatggcacatgagagaattccaacatgttaagaaaaagaaagaaattatttctttggttcatatttacagctgatttactactagtcgtctcaaatatg

SEQ ID NO: 63958 - DNA, 739 bp, Oryza sativa
cctggtattcactcttcagaattaagtttaacaattagattgtgtaatcataattgccatgtatcaacaattcaatattagttggaagttggttttactgtgatttggaaatcccatgaattgaataggcctgaagttattggccgtgtttagtttcccccctattcctaactttccatcacatcatatctcatcaaaaacttttctacacacataaacttttaattttttttacaaactcccaactttcttcaaacttctaacttttttcaagaattaaatacacccatcataaggtaggaagcgagaacaaaataaatactgtagtaagtatacgtgttatgctcacttttgtagcagtacctttttttcccttttggcacttgaaagcaaccttttcaatactaaaaagatatgcattacaaatcttcttcgattcgaattcagtacaaattttattcaactcgaaatccagcgggagcaggagcaatgatcatccttaaagttgggagaattgccgcacaccaactgacgtgtggggcctccaaaccgcaagtacacctatgctggcaatgctgcccttgcccctctcccgccaacgaatccctccactccccaaaagcaaaaacgcgcgcgaaaaatttcaactgccgcgcttctcccaccgcatcctctctccccttgagtatttacttttcaaaatacataaagaaaggaagggaagccgagtgatcacatc

SEQ ID NO: 63959 - DNA, 5747 bp, Oryza sativa
ttctcatttctgaccacacaagaaagcaaacaaacttcctgttcttatgtactttctattgacttctctctcgattgttcacctaatcttgtgttttagttcgctttgttctcttcatgacaattaacactatttttattattagtccattaactaactagaccagtgattgattaacgacagggtcaatttcagggtcagttaatacatagtttttgaggcatgttgttttaccaagttcttggatctggtgtttgtttttggcttctaggggttttctgatctgtgccaaaagggtcactgattacgtgtcatttatttgctgaagaaacaaggtgttttgggttctttggtatatctcacctttttcagtttgttggtgtctgggattctaaagctgcttttggttagttaaactctgtggctaaggtggatgcatggaaagtagatcacatcaacacattcttgagagttcttcctagatatgatttttggatataatagtttgttatcatcataaaaaggagagagaagagagagaaggaccttcaattagaggatatgtttttcttttcttaatatttacagcagtcattatgtaatgttcacaagcctttcttttttctttataatattgtaaaccagtaagaggtatcatagaataaacagcactggacaaatttggaaggacaggctgcaattagaaaaaatgatcgctcttttctattttatttatttatttattttgcaaccaaaggagtaaggacaaccatgacctaccagctctcaaaagctggcttggttcagttggttcaccatgatgtcacaatggaatctttaattttttgcattaacatgcatgattgtaccctagaacgttaaacaaatactcagagcagaaccacacacgtaatgtcaaaacaccgcaaaacaaaaacgaaaaaaaaaatcaacaagaacaatgtacaatttgatcatattggcttcgtactattccatccatttcttattacaagacgttttattttttttcctaaagctagcaacatttataatatcaaattagtcttattataacagcatttaatatattttgataatatgctagttttgtgtcaaaaatattttttaaaaaaattgattaaatttttaaaagtttaactagaaacaaatgaaaaggacttgtactataaaatagagggagtacaaaatttgacaaaaaaaacaagtaaatattagatttttgagctgaattctgaaccaaagcaaatttgtcttgtgtgtggtcagggattcgggtgcgaggaggggagcgtgttgtgcggcatcttcgacgggcacgggcagtggggccactacgtgcgaaggcggtgagggagtcgctgccgccggcgctgctccggcggtggcgggaggccgtgacgctggcggcgctcatcgacggcggcgagaagcggctctgcgagtgccggcccgacctgtggcgccagtcctacctggccgcctgcgccgccgtcgacgccgagctccgcgccagccgccgcctcgacgccgtccacagcggctgcaccgcgctgtccctcgtcaagcacggcgacctcctcgtcgtcgccaacgtcggcgactcgcgcgccgtcctggccaccgcctcccccgacgacggtggcggcgcccgcctcgccgccgtgcagctcaccgtcgacttcaagcccaacctgccccgtaagttcgccgtcaaacactcacggagacatcttccagtcgtttacatgttataaaaaaattaaaataataaattaatatataatagattactccctgcaaaaaaaaatgtttttctacaacttgtataagttatttattttaaagacaacttgtataagttaaacttgaatggagtcatttatcacatattaagctacgttattgttttctaaaacctttttataaccatttacatgacataaccaacgagaggatgtctctctggagtttagaataatttctctgcttaatataagagtatgtcctaccgctattgctgatgtttgcattgcgtggatgcagaggagagggagaggatcatggagtgcaacgggagggtgcagtgcctcgccgacgagcccggggtgcaccgggtgtggcggccggacagggagggcccaggcctcgccatgtcgcgcgccttcggcgactactgcgtcaaggattacggcgtcatctcggcgccggaggtgacgcaccgccggatcaccgcccaggaccacttcgtcatcctcgccaccgacggggtaaacaaacaaacaaaatacatatacttatcatctctattttttttaatatatgacatccttaattcttattaaaaaaatttaagtaaatatcttgttttttttacttgatttatcgaattttaagcaatattaatatttttaagatttgcatatattcttttaaataagacgaataatcaaatgttacaaaagaaaatcatcaatgttatatattaagaaatggagagagtacaaaataaaattcattccatttttttaggacaaacatctcaacttgttcgtcttcgtctgcgcggcaggtgtgggacgtggtgtcgaacgaggaggcggtgcagatcgtggcgtcggcgccggagagggagaaggcggcgaagcggctcgtcgagttcgccgtccgggcatggaggcgcaagcgccggggcatcgccgtcgacgactgctcggcgatctgcctcttcttccactcgccgccgtcctaaacaacacacacgctgacacgcacgcagccaacaaaaaccgcacacgccgacgacaatgtcgccgtcgtcgttgagaggcgccacaaaaaggaaaaaaaaacgcagattgttacatgccagaagaacaatgcaatttgccgccatgattgggacggtgcacgattgacctgacctgccggtgatgaactctgctgctgctagtggatgaccgggaaaaatccaatcctccggctttcacaccaccgtcattgtcaaaaagttgtccgagattcaattcaacagcagccacaagaaaaaggcagggaaaaaaaagatgcattttgtcctcatttttttttttctgcatgtatcatatggctccagaatttctgtggtggtggtggtggtgacaaaatagtcactgttattgttgtggtacatcaatcattcaactctcccatgaagagggtcatgaatcacaatcttcctctgaaagtctgaacactatgtggcccgaaaaattggaattttggtagtattatgcactgaagcatcagggattatttagcagaattgtgaggaacaccaccaaccgtcagatttgagcgacagcgaagcggatggaagttcgatccatggtggctgtgggagtcgacggagtcgtcttcgtggagctagctagctcgctagctacccgccatagcggctttttagcgattctggaggctcctcttccatgatgccggctccggtagtggccaggtattcccttattgtggttgtccggtcacccagataggtgtggtctaggaagttgctgtatgctggttctccaagatttttcgcagcgaggacactgcaaattaagcaatcagtatcgtgaaaggcgactctaatagcagaatggccaagattcaacatgcctaacaaagtaatggctgataatgacatttcaatagaaaatgtgctgctaatggatagttcaaaacaatgatttccctttgcttcagaaatgcatctcactttgagatgacccaaagcaatagcattttggttagaaatgcatcttgctttgacatgccatcgatgggctgtacccactggaataaaaaaataaaatgcctaaccagtggagttaatcagttgataggtgttcagtggtttcaaatagaacaagatacattttatgatgttaatcataggccaatttaagttactaaaaaaacaactctgcagactgcacataagatgttagaacagaaagcactcaccaatgtctaagataagcacgacagggtaaaatatcgtctctccatattctatcaatgttgtatcggccatagcgctgataatatatttccttgcttcctacagaaagaatcatgtagtatggaattagacacaaaattataattctgagctgtctactgcaatccctgaaagtaaataccttacacctgcctaagaatgcattaatttgacatggacgtgtaagggaagcatccaaactaacacaataaatctaatatctgacaaaggaaatcaactaaatgtcccagtattcacagttaaaaaaaagcacacataacaacaatcttatagaatctgataggatgtcagatgaagtcaagaacagattagtctttactcaaaacacgaacaatttatatcctgtaatagacctaacactgtaaccaaattatgaaacctcatcaacatacgaaacaagagtaacactaactgtccagaattgtcataacacagatatccataccagtatagtcaatggcaagatattaaaatgaaatgtacaactgatgagaaaatctggttgtgatatagattcaacctttgcatctcacttggaaatattcttcatcgctatagcgtgcacagacaacctgaatcaaagcagaaaaaataattccattgcagggggcagcagctgaacaaaacaagacactacagctagaattgcagtaacagaatataagcccttactgctggatttgcataaggcaccccatccagtccttctggaacaacctgacagcatattagagataaagaaaaattaactgcaaataatcataaaagacagcctaaattacagaccaggacttaaaaaatctaagctccaaacagcttgaggtttccaatgaagaaactgaaaatctaactaaataggttagcatccaatgaattatttggcacctaccgcaagaaacctaaactcatgctccctctcgatgaatgctgggacctgaaaatatcacttttcaatccttcctcagcaaaaataggttcaaaaaagctccattcctttgccttaacagatgtgaagcattatcacagggtataaaccacaatacctcatcctcctttatttcaaacacagtgacaacgatcagttcaccctcacatggctccacacttaagcttgagaactcctacaagtcagtccggtgctccagtgaaaatgagagatttatcataaatccaagaagcaaatgcagattcctaacaaaagcacttactagactacacaacttcaatcaaacaaatcaatcacagaatttttttttcatagcttaaaaaagcactctgcttccattcgttcactggccataatgagcaaaagcaaacaatccccaaatgcatattgcagaaaagctcactcaagcagaaactaaattttatcatgcttgtaaaatgcaaccttatagcctaggtagtagtttcccccacttttgatgtcacgccaaactataattccattccaaattgagaaacatgtgattcgatagtttcatttcatatggtaatcaacttgtagctccatttcttttgcttctttttagcatctacagtctgcagcgcacactctaacagtagcaactgagtccctgaccttggtggcctcgatggcgatgccgcgctcgaagaagatcggggcggagtgggcgaagacgcggcggaacccgcgcagcgccgc

SEQ ID NO: 63960 - DNA, 2493 bp, Oryza sativa
taaggcgatccgggccgttggattttgatcgatcggctccgggtggcccagggcggagcgtgcaggcggattcggcgacgccaagcattattctgttttgatgactatgctgtaaatgttggatatgctcctccatataccagttcagacttcagagacgaaaattagtactctgtatatataatttgtattagttaaaaatagaatctttatcggtatttttattttttttcttcagtcactttactctattatattaaatcttgtttgtaatcgaccgacgaccatctctctatctataagtgtgcctctaatccatttattcatgtctctaatactactactcaccgttgctcactgctcctctttctctcctaccacacaaatgtggccagggacggagctagaacgaaatggagggtatcacttgcttaatttactttaactttagatcaagtttaaactgatttaggtgtctaagtttgtattgagggagtgcacacatggtaaaaataggtgagattcagctaaattttttttaccgggttcctgggcaccccctcacatactctaccttcacccctgagtatcgtgatacaactaatagccgctcgtcctcaccgataagggtggcgcaacttcaaacattagcacgtccataaagctttaaagtttagtagtttggattgttgccatgaggtatatgttgggagcagagtgaccttctatctattttatcttggtccctattcccaataacaaaaaatgcacatggagaataggggatggtggcaaggtgcatatttgaagagatcagtggatcccaggggccgctaggctaaatgttatgggcaagaaagagaaatcaagattaaagttacagatgaaatcctaataatcaagctttcaccctgaatatctgaacattttgttgcctggcattacgagaaaaatggtatctcagtgcacagtgcttataaattgacgctaacagaaatagaactaaaagagggaaattcttctagcaacactaataacgggagtagatattataggtccatgatctggatagcaaacgtgccccagaaagttagagtgttcgtttggcgcctcgcacgagaaaatctgcctactcaggctaataagtttcaacggcaattagtgacatcaaaaattgcacaatagttttcatgtagtggtgagatgcacaaaagccaaagctttgcgacatgctctgcgcaagatttggggtctcccagggggaagctcttttttaatttttctgggtcggattggctgcttatgcttctaagctccgtactagctaaatccctttagctggtttggagagcttggtatttacgtaatgatgttgtccattgcaaaggtgaggaggtgttgggtatatctgcaacatttttacaagctaccatggctcatttgtgcaagccatgggacaagaacctgatcagaaaggaaaagtagttttgagtgaagtatagattagttccctaaacctgaagataaatagaactttaggcattggttgcagttcatgggaattgccagaacttggttgggctaatattaatgttgatggtgctttttgtgcaggctcaggcaatgcgggtattggcataatcattcatatagttccggttcagtcttgttatcgtcttgaaagtacattcgccacagggcgtcggcggaagaattagaacggtttgcttgtaaggaaggtttagagctggacgtcgaatgggtgcatatacaccagtagtgctagaaacaaattgcatgtttgtagttaatgcactaaagccgcactaagagaatcaatcctaatggtgttatactatcgccgagatgcaaagtacagaggagttgctagtagaggtgaagattcgtcatgttagaaagatgttgcaataggatagctcatgagttagcacggctggctagtagaagaaaacattgtgcggcatgatgggagtatgtttccacttgcatacaaggccttattctcaaagattgtaatagccatgtttcttgtgagtaaagcacactctttctaaaaaaaatcgccactagttcataggggtgggcgtaaaattaattatggaaaaccgatctatcgacttaaccaaacagttttccgatcttgcatttttttcgtcaattttagttcaatcttgggtgttttcgcatggttctctattttgacaaacgacgaagccaaacaattgaggcccgcttaatttacattattaagtgaattattgctatagattttatgcacgaaacaaataaatcatttcaataactcggtgaataagttaaaaacaaacaggcccgaatcacatatgtgcaccaaaatgaaaaggtacactggaggtccctcatcttgtcaccttacaaaatcgtccttgaaccacaaaaccggatacaacacatccctcaacttacaaaaccagcgtaaacgagatccctcgc

SEQ ID NO: 63961 - DNA, 2654 bp, Oryza sativa
aatgacatttcaattcaaaagccctaagagtttcaatatcttacttaaactacttgagaaagaatagcaaatcatacaggcagcatttttcttggccggattggcacctgcaacataaatgctgggaaagttattggacatcaggcactaaccttgctgacagggctcccgctataagtttcataaggaccttcttttgcagcaatttcagcagaagctttcaaggcatgataataaatagtctcaaaaatatccttgttcaattgctgagcctgaaaagatcattgcatcgcatttcagcgaagtatatatagattggaataaccacatttttaggttggaaaaatttacctctgttgaatcaaatggcatgccaagtaaaatgaaggtgtctgccaagccctgaacaccgattccgattggcctgtgcctcatatttgatctctttgcagtctcaacagggtaataattagtatcaattattttattgagattccttgtgacaattgaagtaatctgcaataaccaacaaatattagtagcattcaggctagtgggaagaggcataaagtaagtaaatattaaacacaaacctcagctaatttatcaaagtcaaaatatcggtttttggatccattactaccaacaagcttagccggatgagactccataggaacaccctgaacaaatttgtgtcgtgagatacagaaatttcaacctacaacaaatcaaaaattatacagccagtactgcatagtgcataccttttcccttacaaaacgcggtaaaccaatcgatgctagattgcacacagcagtttcagtgggacttgtgaactcaataatctccgtgcacaagtttgaagacttaattgtccccaggttttgttggttactttttctattacaagaatcctgcagaccagatttcagaaataagcatatgtggcaacagaattgtaggcaaactactgttccctttatgaattgcacaccttataaagcatatatggtgttccagtttctatctgtgccttcaaaatgtcaaaccagagcgcctgtgctgaaacaactttctttgccttgccctgaaattgcatgctaggttaacaaatattctttagatattacttcaataaactgcacacccagcacacatcttacctctctttcatatttcttgtacagattctgaaactcatctccccaacagtcagccaaacctggagcttcattgggacaaaacaatgaccagttttcattattttgcaccctttccatgaacagatctggaatccagagcgcatagaaaagatctcttgcacgattctcctcctgcgaattgcacatggtgagtaaatgtgtttctgtgttatcaatttctaatgtctatcagaaaatgcatcctttcaacagcctttacctttccatggttctttcttaaatcaaggaactcaaaaatatcagcatgccaaggctccaagtatatagcaaatgcacctaaattaatgttaggaatccataagaaatcctgaacactgaacatgtaaattaggtccatgtctaactaactgatggtatttaccttttctcttgcctccgccttgatcaacataacgtgcagtatcattgaaaacacgcagcatgggaacaatcccattagatgttccatttgttcctcgaatgtaactcccagtagctctaatattgtgaattgagagaccaattccaccagcacatttgcttatggtagcacattctgagagagtatcataaattccctcaatgctatcatcgttcatgcagatgaggaagcagctacttaactgcataaaacagagaggagcataagagaccatttttaataatccaaattggacttcaatggtaggaagcatattacttgaggccttggagtgccagcattgaaaagggttggcgaagcatgagtaaaccagcgctgagacatcatgtggtacgttttgatagcagattcaatatcatccttgtgtatcccaatagaaactctcattagcatatgctgtggtctttccacaaccttcccaacaacttttaacagataagatctctcaagggtcttaaaaccaaagtagtcatagtcaaaatctctgtcataaattatctcactgtccaagcgggtggtattctgaaatggtgcatcatatagaaattatcaagtcacattggcacaatatacatataataaaaaattgaagcacctgaagaaatatatccacacaagaaattgaacaacgcaaaaaagcagcattgatataagaaaatttcaagaactccaacaaagccaataaagctaaacaaatatcagatcatcaaatatgaatttcaaaccaaatgacgggcaacataagcatcataatggatccaaaagaacagaagtaaacaaagagtcacggcaatacacgtgaataaaatgttagtaaataaatgttgaagaacaacctattggtgcgattctatagaagtgacatattgcagcaatacatgattcggaaacaatctttttgggggaataatatcataagaaaacaaataaacagttaacaatttgcgaggcggtcatcgtcacaaatgttaattgcaatcttcatgcatgccatattgcagaagcacaca

SEQ ID NO: 63962 - DNA, 5201 bp, Oryza sativa
cccgatccccccaacttccccctccccagcgccaccttcccccaccccaccccgaaacccaaccactaaccctagttgtcgtgacgcggtcggaaaacgcgcgcgacttctctccctacctggccatcgccaccccggcgcggcactgcccttctgtgtgctagtaccttgatctgattgtgtgctgaatcttctctctctctttctctctctgttcaatgctctatgctctatctttctctctttctacttctcctttttttattattttcttcgagcgaaaatatttttaagttctttgctagcagttctggtttattagatgaagcacaaaggataacgagtagctcttcagtactccagtttgttttttcaattccggtgatgcattttgtcctacgtttgcctttgaaagtgtgtaacgaatggtcatcagttgcagcctaaaatacgctgtaatttcatttcctctatgtttcacatcgacgtttttcaaaccaagcaccatctttatctcatcgtactcttttttgttttctgttttaccagtttttttttacagttcttgatctgaaacggagacaatggcgagagaggatgagaaggctgacgcaatggagattgatgggcagcatcagcaagtggccaacaccgccgtaccagatggcttcaatgctgattacctcaggatctactatggtacagtagtgcttccctttttcttctaatccgccactgaaatttaagaaactaggcaccagacagtgtgctctttttgctgattattttctctttgtcttggataatccgcagaaagctgcgatcttgaagcaaaatatttttctagaacacactggagcaaaatattttggcatatatatacactgtaatagtggttgtaggtaatctatatgctttctccatggaaaaatgtcgcaacttcttgcaactgcagtccagaataatagttattggtctgtgcagttcaaatggttttaactaaaagatgcttaatttaatatcacagttgatctgccatataatttccacttaaacaattgtgatggccaactgccagtgctaatggttttgtatgtatgctacaattgcaggaaagctcttccctcatgttgatttcttcaagtggctttcatatggaaatggtctgttgttgttggttcaggatctagttgtttactaattgtttcatctatataatacgaatttgtccttttttagacgggaaacatccaggatgtgatcagtcgtatgttggacgtcgagagttctcatttacactagagaatgacatctacgttcgtttccagtcctttgatagcgtggctgaaatggagaactctatcaaggaaaagtgccctttcaagattgatattggacctgtatatagtgtagatgtatgttgtgtaatcacttaacttggacattattttttttatgtgagtttgattttccgcattaagctctgttttttcaatatcttgatgaaaactgtttattttgtagcctgcaaagcggcatgcctatgctcaatcaggcaacaacgtctttgtgccagttgagagagaacttattttcgatatagtaagaaacctgcaaaatttctcctgtggattttatttgtatttttcatcaagcatctgttccaagctgtgaggcatttcaacatcacaggatatatcagattacgatgatgttcgctattgctgctctggagctgatgtctgcatggagtgctggcctttaatgaccattgctatcaaaatcttggatgcttcacttagaggcatgttgttttgcaatgcaattaattaaacacacatgcaaacactcgcttttatttcagtttaattgacttgaattgcagatctttagtcaactattttcttggttagtttgacttgtaacaattgaaagtatgtgtttacagatgattttggtttcaatcacatattgtgggtatatagtggtcgtcgtggtgtccattgctgggtttgtgatagtagagcaagaaagtatgcatgatgtttttccctttttcatttctccatttagtttggtgatcctaaaatgctctggtactttcctgttaggctcaacaacgaacaaagggctgcaattgctgattattttcgcgtctacaaggtggtattcctttattcatgatcctagatgtcgttttgttgctgaaatcttcctgtatggatcttttgcagggtggtgaaaatacgatgaagaaagtttcattgactggagctgttctccatcctttccttgcgtatgtctgaatgatctcagttccttgtttttcaatcataagttgaaattgtatatgttttatcagtacaaattgaaatatagccaaataggctgtaatgaaactctattttcctacagacggtcatacactgatgttctgaaaggcttctttgaagataagctactacttagccaacaactatttgcatctgaggagagatatcagaaaatacttgatcttatccctgatgaaagtaagaatgcaaaccttaactagaacaatatattttagtatcatcctgctatcaaaccatttctcatttgtcaagtcttgaatgtcttcaatcattgtaaagtgtgtgtcatttctagatgttgctagtgagctccatgataagtggcaaggaaacagacgatcttctatttcaaaggaagatgtaaatgctaccaggtgggagcaactaaagtcaaccttgcagtcaggaaaacacaaggtccatgcataatctctcgcaatcctacttaattttatttgcacatttactggtgtatcagttttaatcatatcgagtattgtattctcgaggtttcatcacaatgttacatgtgggattggttgctaattttcattctattttgttgaatgcacaatgatgttttttttttcatgtttcttccacaggggcttcgaagatgtatagaagagattgtcttctcatacacatatcctagacttgatatggaggtaaaagcaaaacgatcaacagcacatgtttgcagcaagtcataaattcattttctgattcctattcgacattctggtgcatatcaggtttctaagcacatgaatcatttgctgaaagcacccttttgcatacacccgaagacaggttagacccaagtatatttcctattttttcatctaatgaatgaagatacttgtttgcactagaaactgtttttgttggctgtccgtgtgtatacacttcgtgtatccgttggaaatctctaatgcaaatgttccttgagtgacacatttttcacatttatatgcattcatttcatgcttacacttatacgtaaaatatgttctgcctaatgagttctaagttctaacaattgttttgaaatctttccctaggccgtgtttgtgttccaatcgatccaaataactgtgatgattttgatcctacgacagttccaactctgtcacaggtgtgtccttagagccaagcattaaaaaaaacaatattctgagatctaatttacctttggaagcatcattatgctaaactgacttgttgaaactgttgaacttaaccagcttttgggtgagctcaatgcagctggtcttcgtactgattctgaaaacggcaagtgataaattcttcacttttaggaatcctgtgtttaactatttcatcctaaaactttcagtgatcttttgataatcctttaatggactacagattgggaaagaacatctcttgaaaaatctatcaggtttttcagggcatcgtttctgcaaccattgctgaaagcctgcaaggtatgcagtatttccttctacatttctatggcaggaaactggatatgcttgtttagttcccagtcaatctcttccatatcttaaactgaatggatcgggccctatactcgtatctactctcgctacagcgctttgcttgcaagaaatcgtctgtgttcttctggttccatagttttccagggtcaagtctcagtttctgccttgtaatgttgcaggaggaattagaaagctcatacaatgccaagctccagcagtccaagaataccttgacttggtaaaattcactcaacttccagctgatcttaccaacctagtgccccatgaaaagcttcttctccatgagacgaaccactgaacccggcattggctgtgttaactggttaaccacaacgctctatgaatgaggagcaaaatactctccgatgctgctgtcatgttagctttgctccaaggaagttgcaattgtagaatatccagtgaccgtcttagaggcagcttggtgctggcttgaaccttttgatctttcatgttgctgacttgatgttattaggataaattcctttaattgttgtgaaatgaattttataggattcctataagtcgctgaaaagaatgattgttaaatgcttcataccaagctagtagccgctataagatctagactagaattagtaaaattaaccatcaagattgcttagagcaatgctcggtttgtggttgatgactgttgagaatttctgtaagatgctgtaaaaataaaagtttcatcgtagtttattttacatatagaatttaatatggcaatatggcattcaattaccatattctccgctaataatatgttgctatgtttttgtcaaactgaaataagttctaaccttaaaaaaacaaagttaaaacatctcatggcctgtttggcggcttgtcaaagcgccgcctagcagccggacgctagttctgtggacacatttgttaagaaagtaggtataattaaatgatgaaaatgtgtgattggttgaaaattggaggtaggtggggaaattgaattgtggaggtttgtgattggttgaaaatgaaatgttggtagagaagttatattttaggataaattctaaaggctaaatgttatatttttgggacggatggagtaaacaactgttggctgtcaataagcgctgaatgttgcagccaaacagacccttataatataaaacggaaggattatttacaagagtggttgggtgtgttactgtccaaactaatttttttcatgtgatgctaatttatacaattatactacactgttaaacagaccccgtctctgtctgatccattccgtcatggatggaatcatgtgaccaggatagtgatgtac

SEQ ID NO: 63963 - DNA, 1118 bp, Oryza sativa
ctgtcggtaacatgggccgggggtatcgggaatacaggcttgggtagccgcggtcacccacgtggcctgaccccctcgggggggggggggggtcgggcccgagggtgacgtggccacccctccctctgtctccccgaggggtcgggccgctcctgtttcggccccgagggctggggcgcccccgtttcggccccgagggctggggcgccccgaccccctgtggttttggcgccacgtgtgtgggttaggtgagcacagcggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgatgagagtttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaagcgggcgagcggggcaggaggcgtgtgctctgcttgtcagaggtcacttccggctgtagacgagccctcattgtaaaaagcatgtttcccttcttaggcagcgagaggcccatgtggtgaccccggaccagataaaaaggaggcccaggcctaggaggaaaaaggggaggaaggggggttgggactctggggaaagggttctagagcctgaactctctctcgctctccggctctctgtattccttcacgcacagatccaccagaacacaggagtagggtgttacgcttctcagcggcccgaacctgtctacgtcgctcgtgtcttgtgcattcctctcccgctgacgttcctcagatcgagggcgaagaacctcacttagcgccccccgccgaaccagcaaaggggggcctgcgcggtctcctggtgaggagccccacgctccgtcatctggggcgccaggtagggggcgcgcgtgtctttctaagccctcgtcctctttcgtgtgcgccaagct

SEQ ID NO: 63964 - DNA, 9741 bp, Oryza sativa
tgtacagatcccatgtgaaaaaaaatcagggcgatgatcccctgatcccatctggacgtacacgcacgaacgtcggcatgcacccggttggttggtagctcctcggcgaaatcatcaaacgaatgaatgcgcgcttgagtcagtgcgcatatgcactggagttgggacacgtggccggggcctgcaggctcgtctcgtcacagcaaatgctgctagctatactccctgcatcccagaaggtagcatgggtctaatcctatcaagatagaggtagtagtgatactctttatgctaaaataataaatataaaatagattatgatatatgctcagattaattatacagtgcaagacgatgtatgtttatattgtaaaacagaggaagtagtagtatttaatttaaagttgatttattttgaaacaaatacgtactacgtggtgacgaccggttggaccgggaccggattcactgcgatgcagccaaagcagtagttccatgattttgctctccgttattgcttgcagagtggagcagcgaaccagtggggtttggtatggtttccagtggttgcttccgctacctctttgcacctactttcgggcgcattgaacaactgccatgtcttcgagcaggtaaaaaggctataagccggctataaacatattttaaagaaataaagctaggaagagagaaaaaacagcaggctacagatctgtagctagctatagcacggactccaagatgtaatgtgtgtatgataggtgggaccatgtattaatagtatagtaagcaactattatatgaattgactattatattggctatagatgatttgaagctactactagtaggctacactattaaacttgctcttctcaagctacttcaagctttttatttctggtgagtggtgaccattcctagtttcctacccctcatgtttttctttctttatttttacagcggttaaaaatcatcagtgcgagcgacatggaatggaggtaaaatgttgtgacaatttgttagggaaaaacataaaatgtaactttgttcaggtgattggtaatccgtaaaaaaatataaacgaagcaactaaaattaatttacgaatgaacctccatagctgtattcccatctatttagaaggcaatgatatataaaatataaattactcctttccaatcctaagttaaatattttaatttttaactatccatttttataaactcatatagtttaatgtcataagataacttaggataaacgtggaacaaaagttacacttttcaatctgttaaacaatatgtttttttaaaagttttctttacgaaagttgttttaaaaaaaatcttattaatctatttttgaaaaaaataactaatacttaattaatcatacattgttactctgttttacatgccagagggatgagttctcaattcaaccgaacgaacacaaccgtaatatgattaaaaaaaaccccttaaatcaactctagaattaaaattaagttttaaaatttaaattttggttgggttggctggtaaaccacaaacaaacgttggagctgaccttgaagccttctagaagacaaagggaatcagagctaaacataaccaaagggatcactagcttctcttcctctctctctctttgtttttaagatagatcatgcgtttgactctagtacaagtgtagtgccgctaccgaattctcgctgtcctcctcgcagccatttttatacgccaacctcctcttctcttctcttctccaagaaaccacagccaggctagcttagcgcgcgccatggccggaggagacggcgccacctacaagggcggcatcaaggcctactggaagcgccggggctacggccggctcgatcccgcctcctccgcgcaccgccgcccgcgcctccccaccgcggagctcggcgacggccgcggcgcggcaggaggagcggggcggtggcggcgagggtggcgagtacgccgccgcgggctcgggcggcggatcctgcgggcgctctcgccgcggcggctgctggcgcgcctccgcgacgcgtacgtgcggggcatgctccgcctcgcgtcctccgccgccgtcgccggcggcggctccgctctgtacggcggccccgccggcggcgccgaccccttcgggcggccgcggccgctcagggagtacgacgagaaggcgctggtggagatctaccggtccatcctcgcgcgcggtggcggcggcggcggcggggtcgtccccgtcgccggcgacgccgccgcggtggtcgccgtggcgcggctgcccacggtggcgggagcgtgaccgccgccggatttggcgcgaatccgaagctttgtcacgctcttttttttttctttttcttccctttttcccctcttaatttctctcatgcaagacttgtgatccagaattttcgtactgctgtcctaatcgtgtctgttaattaatcttctttaaatctgggggctgcaattttgcagtgtattattcgcacgtctaattatgcgatactgggttaaattaatcttcttaacggacagcgattaattgagttcaagaacgagtaaaagtgtaaatttacttgtatgttttactcatcgatacaaagacttcgaagaaatcattttaattatacttgcggtagaacatcctagtatagatatccgcgatgtccatagcacacgcactacggcactacaatcctaatagtgtaatccattttttagaaaattgaggtgctagcggccgcatccgttaatcatttcgactaaattatgtgcatgacattgttttttttttggggtgtgaacatgatcttaaaatacaattagaggcttataggaatctagagatattgatggttgtgacaaattttatttatttgaatagaaccccttctccctctcacaagtcacacctccacctccattatgaacactagaggactattagaggtagaggagcacatcacaataatagcaaaagatggagttgcaaactggaagatgataatgctagtgaaacaaactactcaggtactcgcagctattacaatttagaaaaaaaggttcatcgcttatcctctctaatgatgctttgtaattacaggtcaactcaacgtttctacactctacactgtaggggtacgtaaggcctgacgatgacttctcaggtttattttacggattaagtataatattccccctgtcccataatataagggattttgaagggatacgacacttcctagactatgaatctaaataggctctctgaccagattcatagttctagaaagtgtcacatcctctaaaatctcttatattataggacagaggcaatatttgttcatgatatttgtggcacccggttacacttactgtactgctcttaaataatcgtcatgacattctcacttctctctctggaacgatgtgtacatatgctaaaacaagtggaaaattgcttgtgtcacaaagtctattagccattggttgctaatgtctattagctcatttaaattagaaaaaatatagacgactgttgataaatgatctacttgtgtatagaaataaatcaaatattatatatattacaaacctaataaagctaatcaagaaatgttgctatagaaaggtttggagcaatacttttgaaagtgttcaagaaatgttatcctcacgtcgcattattttatcatttccggtggaaactgagagagaaacattggttaaagacaagtttgctcatgaacccacttgtcaatatcacatatcctctctttctctcttcctcttcttcctcatgttgttgccttctctctcttatctctctcttcctcttcctcttccccttcagtcaggagcgaggcatcgccgatgagcagcgatgggggcagaggggattgcggcaatgagcgacgatggttaagggagcgaagggagccgacaaccccgtcctcacctcctccatcgccacgccctccactcatcttcttccgcgtcactggatcacgcacccgcttgctggcttcgtcgccaagaactgcaagcgcatgggggaaggtgtgtcccagctgtcttcgtgctcctcttccacgaacgcctgcagccgccggaggaagggagtgaatgggacttcttcctttgtccgttggcctcaccacgtctcccaccagctcatcggcctctccgccattagcatcctctcccgcgcccactgtctcctctgttgccaccgccgttgtcgccgtttggctaaaaagctggcccccaaacccatcctttgctgctcagtattgtgctggagcaggaagaagacacagtcaccaggggcacattcgtacttttcacagtttctctcttcatttgcaccaaatataataaaataataggtccgatgtccaatagctaattaccaagttttatctatgtccatgagaatgtacacgttctttgggtggccgtgtctcgtagcaaaggccacattagaatgtactatagcaaattttgccttattgttcctatgcatgggaaaaatctatgggtgttcgttaaaaaaaaaagggaaatcaccgtgtagcccaatctggcccataagcttttacaaggcggaataagtctatattgcctccctcaactcttgccttgaatcgtccccctcaaccgcaatacctggtataacgcctcctctatgtttgaaaaccagagcaaattagcacccttggctgtttagatagcgatttcatcatacatgacacttataggacccacatgtcagtcagaaaaaataaaaaaaaaataataatcctacatgtcagccattctaatcttaattatttttcttttccctcgtctctctccgacgaggcgacgacgacccgtctgcccgtccgtccgctccttcctcggctggagccagcagttcagttgttcggctgccgccacccctgttgccaggctccctacgaaggccacgagcctgttggaacaaatcatgacttgcatatgtctttggtttttgcattagttgcatgtagagaggaacgtgatatgttcatgtatcttgtaagtgatgtgtatgtgtgcatcacgtaggttccatgtttgcatgtagaatcagtcagtgctagtgaatggcagctgcgtgtgttgcagcacaactagcaactaaacaggttaggtgaataacaagattagcggcaagttagttaggagcatgcaggattagtggagcacgttgtggcgtggctcgcggtcagcccggaggagcgaatcttggcgtaagatgcgcagatcgttgtatgagtgagtggctcgtagtcgtgcgtgcgacccggccgggctgttagctatgtgcatgtacgggaggctatataagccgtgtaatcatcagttagttttagcagatcagcaatatcagagaagccagcaaagacgtgcgtcgccgacggaatctgttgtgtgtgtgtccacccaatttgctgctcgtgtgtgttctcccgtgagtttgttgcttacgtgagtttgtgattttcttgggccaaagctaacagagcccacgacagcgcctggggcgagggacgacagcacgcggaaggcctcctgtagcccgttgacctcgcgcctcctggtcatcgacgccgcccaaggcaccatgcccactggatttgtgcgtgacgaggccaagggaggcaaatctggtggcgtcgcgcccctccgccgcccggcggcacatgtcccgtgctccttcaccgctaggagtgcttcgagcaagaataggggtggaggagtgctcgcgacaagaagtctacgaaaaggcaccgacaccggcgagaggtggcaagaagtgctgtaacgcatgtctttcaggctctcatcactcacctctcgtctcgctagcaatgtcacaccaaatcctcaacacctcagcacacattcaccaccgcgccctgcatcggcgacttgccagtcacggccaagccttccaggatgttagcagggaaaatcaccattggcctcttcggcgacgaggtccccgccggtgcgtcccggctcctgtcgcttggtgtcggctagttaagatagtgtggggctacatgcaagcaggacggtgtggtgtcacacccggccatcccggcgctgaccgaccggctagcggcgaagatggacgccgcacgcgcgcgcaatgcgatggggacaggagtggcgtccacccaactcccacggcatatggtgacggccggcgaggcagcggcggctgaacaactgagcttctagcttccgtcgaggaagaagcgaccgaacgggagagggagagagagaggaggaagagagaagcgaggaaaaagaaaaaaaaacaaataagtgccacgtaggacatgtggggttattgttttttcttttcactgacatgcgggtcccctaagtgccacataggatgaaaccgctatcaaacagccgagggactcaatctgctctggttttcaaagatggaggagacgttatacccggtattgcgattgagggaggttatttaatcaggggcaagagttgagggaggcaatttatacttattccttacaaggcagggtccgacatttccagcccaaaagaatcggacccatttattcggcccaatctggcccatgctcggggcctagtttttccaggtaaagttgaccaaaagtcttcacctagtcgtcgtcttccctcggccggcctgaccatgaaaataaacgctacccaacgactccgcagtcacctcaccacacgtcgatggacacggcgcaccagtgaaccccctcggccccaccaaccaccaccaccatcaacatcctaccttacctctctctggcaaccgggtcccacctaaggtccacgctacacccggtccaccaacacccgtgggccccaccgctctctcgtcgtcgcaccgaccccaaccgaagcggtaacaaagccaacgtcccaccaccaccacacgcgcgcgctcgcacagacacacacacagcacagcggagaaagagagagagagagagagaaaggaaaaatcggcaccaccgcgaaagggggaaaaggggggaaggaagcgaggcgaggctagggtttcgattcgatcccgccgctgccatggacgccggtgatgcgtggggccgctcctcctcctcatcctcctccgccgccgccgccgccaggcgcctgcaggcgcgctacggtaagctcacacgacgacgggtcggctttctctcgatccatcggtcgatctccccagctgttggattgccatgggctgcgatttgatgcgtgggtggtggtggtggatgtgtgtgggtgttggctcagatctgtacatggggttcgacgacgcggacgcggcgggcgtggaggaggtggaggcgcgcggcggcggggaggcgtacaactgccccttctgcggcgaggacttcgacttcgtcgccttctgctgccacgtcgacgacgagcacgccgtcgaggccaagagcggggtatatgccacatcctcccatctgacaccgattgtaaccgtcagtatcagattgttgtgtttgtgattggttggatacttggaccgggccttggtttcggaaatgtgcaattcgtaggcacgcgtgcaaattttttttttagaacaggatgcctccgcaggtatcaacagatttcaactgtgacgaaccaagaccagcgaaagcttgcaggttttaggagttggaattttggactttttggttggagttataagattggttgttttggggtttgggtaggtgtcttcgtttgcttgattggagaaaaataattcgtagtggctatccatgtcggggagaatgattgattttaattttggggggtttagttggggacttgagttttttctgtctttggggggagtttgggactggcggaaaacatttcttgtgttgttcatgctagtcattagcctattacactctactgtagtttttatttattttctttcttgttcttagtatctgatgaaatatgttctctcagctttctttattttttgtaaatctgtggtcattttgcagctattaagatcccagctctattctctccagattataaagcacatcagcacttgtttctcttgaaagtgaaacatccataccaaactgacaatattacatattttcatttcaatctaacaatattacatattttcattcaatctaacaatatgatgattgttcttggcttggtggttaggattattatttgtctatggaagaaaagagtggtactaactagtgatcactttatgttttgtgattgggacttgttcatgattaatagtgggattcagtacaacttattacaatatcctttatgaactagttcaccagttcccttgcttcgatcacaaaaatgggcataacttttctttgttttgtcttaggtggtgaagctcattgaaattgcaggaattttcatgttttattgctttcgtaggatcgtttacattatatttggatttgtgagatacaccctttgattaatatttgaaattatgatggtgcttggatacgagggaaggaagtttagatggttactggtattgttttatctggtgctggtttaggaaattctcttttatctatttctattttctaagatgtttttctcagatattggttgttagttctgaccatcttttgtaaataaaaataacagcttttgtctgttgtatcagaatacctgtataattagtgttgatattggcatctttgtggtactatgtaaatattgggtagctgccaagctggatagtttctgggtatgtattagtaacgttggatttgtgacattttatttggtggtgatgtactttggtctatctttttgtgatgctattatttgtgcctcatctatataaccatgcccgagagctttcttgatatattcaagtcagtttatgaattgaaattttcaatgttagccttttcatgaaagatgtgacatgggtgtgattcataactgtttaatgtgtatattttagttgtcttgaattgaattgaatttcgattcttccatctttgtttaggtatattgttagactctttgaaacataataaaactaaattattcactgtgtgcttctgaatgattaaactttttgtataatcatatgcaattgcccttgaataggcattatttgtctttatgttagatccaatcagggatcgctatatgttactaatagaaattatttatctcaatattaggaggcaactaacaaatcattttcaaattcaaagcagaaatgccttcaattgagttggcggttctagccacaatgggcaaacatgagacatcttacaacatattgcacgtgaataatagtgaataggatcatgcggtactgtagcttcatacttcaacataaattggtttattatatagagagagtgttatgttgatcttattgttaaccttgagattaaattgttagattctacataaggaaaggcagcatgtaatttggatcaacttagaatgtaatgtctttctctcctaatgttttctattatcccagtctacagtatcctctctatctgaaaataccccccttcagccatattgtcctggccctcttatgtgcattgttaagcccttctatttataagaaagtgtttgatttcatatctttttctttatttagttggcatagcttaag

SEQ ID NO: 63965 - DNA, 2008 bp, Oryza sativa
ctcacggtgccccagataagttcactgggggcagaatagaccattcctcatggacaacatctggaacaaaaattcagcaatcaaacagaaattagctgcagtaacgtggaatacatacattttgtttttcttacaaatgccgtgcaaacaacaatgtggcatgctgtgattagatcaatgttcttttctgacgtcctaaccgactaaatcttgcttagacagtaagccatcagaaaatggtgattaggatagctaatgtacactttttgatgctagaacttcaagcttgtcctaactcatatatgctagtaccatttcacttcagcacacagctgctcaatattcaaaacgcttgacatatccattgtcgatacctggagcattaagtctgtggatttgcgaaaataatcctcaagcaattcagtaacaatgcaacattcattacacttacctggacctggagctgaagctgcttcaggtactcgatggcatcgtcaagcatggaggctttgtccgtctgcatcggtgaatgaaaccatcagcacaagataaacgccaaattaactcgagagattagcttccagcaacacaagtaatagtgtgtataaatcgttgaacaaaaaatcgagtaagaaacaagagagacaattttttttactaccttgctggagttgggaatgaggctctgcagggccttcatcttctcattgattctgctcctcctcctctgcaccaaattaccgtggtcaaaatcaatcccacaaaatcagctgataccaagaggaacacgagaggtagcagtcgccgtcgccgggctaaccttctcggagaggttgtgcacctcggcggcgcggctcctcttgccgcgcggccgcgccggcctggtgggctgctccgactccgacgaccccagcgcctcctaaaaagaaccaaacaccaaatcaaaccgccaaatcaccaccagcatccgatcgaatcaaacgcggacaccgcacgccaacctcgctctcgcagcgatccagccccatgctggcgtggtgtcgcatgatcaaatccaggtgctcctcctcctggcttcctcgcccatccatcatcgcctcgccacagcaccagcaaaccacaaacactagcgctaccggacgaacgaacaaaaccaagaactccttaagtactccagaaatggcgagcgagcgccacgagaaattggacgctgctgctgctgttgctggtcatgagctgcccataccttgctgctgcagctgctgcaggagttgccacctttcttcagtttctctctctctctctctgtgtctctggttttgtgatggcttttccttgagcccgagaaagctgcaagcgcggcagagcttttgacgacgtcttttgagttttgccgctgcggctgcctctgcttcggcttcagcttctctctccggctccggcagcagcggcgcggggcggtcggtgtacggctcgtcgcgtcgcgtcgcggggtggggtggagaggttcattgatggaggagggagggaggggtggttctggttcgcgcggttttcatttatgagcgggggggtgtggtgttaatggcgtggcgtgttgagctcggctttcagagctcaacagtgccagtttccgtgggaagacatggacatggatatatgctgtgtcgtgtactcgtttactccctccgtctcgtcttattaaatttttttatgtaaatataaaaaacgaaaagttgtactttaattactttagataataaagtaagtcaaaaaaaattaataataattttaacttttttttaagaataatacgagtgatcaaacagtgcaagtaaaaactcaaaaggaagtagttgtgtgtaggcttggtacttgtgtggactctattttctccatcttaatataatataacttacacattttaatattataaatttagatagaatctctatttagatttataatagtgagagtattagattcttatattttatagtgaaagaag

SEQ ID NO: 63966 - DNA, 2889 bp, Oryza sativa
gaaaattgtcagaaactaatgaatataaagctaactaggcgctttaagatatttaatataacatcctgcacaatctgcacggctgagtgagttcccattgtgtccatgctttttattgagatctctgaaccatcaaaagaacaaattccattgctgacaattggttgattgcattgtcacttagcacctcacatggtttaaggagaatgcaaattcttagatgtgccatgagaattttagttgaaccttcagaaatgatttttttttgctgcagcttaatgtcctattagatagccatagatgattattcactgtcaaatgttgattaaatatctgtgataatttttcagagctgaaccatctctgtcggagaaggatcagaaggagagggctcaaaggagtaaatttgtccgtgggcttgtgctctcgacgatatttgaggatgataacttgtaagggaggttatcaaccttaatatagcgacggcatggcatggtcaaggaacagaaaatacaggagaacaatctatgcaatgcagcaaccttgttcatgccgtcgctaatgctgcttccagccttcaaggccaactgggggccacccatcatgtttatgtatgcacgtacgtataatgtatgtctgccttcctgcatttgccgagagggcaacaggaaccagctgagtagaggagaaaggtgtttgtgtcccaaccttccacgtcgaataaatgaggacattgtgttccttgagtggctttgtgcatatatgaagagaggagagctactcgcaatgtattaggttctctctattttatttgatcaatgtaatgtaataataggaagtgttgtacaactgtattgtaatcccaatggtatgtgatactgctttgttttgtatttattgaatagccagtgtggccaattgatctagtactacatgccaagagagctagagaaaaaaaaagctagcgaatgcacacaactgttacggctggaaggctagacgagttctttgcctccagcttcactgctacctctcctgaagcgtgcacatgccatctcttcctcaatcccctctggtatgaattggttaggactagtaagtaatgggttcatatcctcttccataatgtcactaccgttatcaagatggaccataatggcactaccattaccatggtggaaataaggtatgtctccataccctatgtccacaatgttcaaggcaagaaaggcaagaatatatgttaagtgggtcccacatttatgtaaacaaattctacttcaaggtaggtcccaccataccataatctattctcatcctctttaatgtgtatctgtgttttatctcattattttatttcttaaggttgagccataagcttatggttatttttagcatttatgtcttatgactaaagcacataatgtatatgactagtcataaggtcttatggttcattcttatggcacattgtggatgcccttatgtgtggggtaatagaagggtgagacccatatactagtaaccgtaatggtagttgatattatggtagaggatacgcactcataaacaacagctcaattgtcactatcctacttcttttacgattaaagtagagggtttgtcgtttgggttaacatgattgaagttagtgtttctcatatttaacagtaaattctatagaaattatttgctaagtcggatgaagctcacatcaaaatctacggctcagcaataaacctctcaactttgtgttttcattgtggcagttgaagaggataaccggtctatcaagcggtatgcacgtcaatagaggccctagaatataatcgtcatggtaatgcctcagtttcatatcaatcacatcttttgttgttgtatggtttcactaggagtttatttcctttgttagaaatgaatagtgagggtttgtttagttcgtaaaaagaaaatttttgggtgtcacatcggatgtttgaccggatgtcggaagggcttttcgaacacgaatgaaaaaactaatttcataactcgcctggaaaccgcgagacgaatcttttgagcctaattaatccgtcattagcacatgtgggttactgtagcacttatagctaatcatggtctaattagactcaaaagattcgtctcgcgatttcctccctaactatgcaattagttttttttatttatatttaatgcttcatgcatttgtccaaagattcgatgtgatgtttttgagaaaatattttagggactaaacggggcttgattgtattttaagaatatatcataaatagataaactaacttatttgattctatatctttataagctaatggttatccacttaactaatatcacaaatattagtttacttaaacaccgtgggattgctggagaggtagggtgccacgtcagatgtcgcttttgcaaaaaagcccccgcatattggtttacttagacaccgtgggattgctggagaggtaggggtgccacgtcagatgtctcttttgcaaaaaagcccccacagttttgttaattacgcattggttcccgctgctatccaccgtcatcgtccgttggatctcgcctaacatcgatctgaccgtccacgcgtccaattgtgcccacccttcctcagccgtgcgatcgtcggttcgggaatgaacggcgcagatgtcgccacgccgcaccaaaaccctagccgccctcctcctcctcttctcacctgcgtagcgccgccaccccgcctcacgcatggacgcaccgcctccgcctcgacctcctcctcccctatgcgcgccgtcgccatggccgccgccgctgccaccgctgcaacgacgacgaagacgacctatacgacgacggcgaggacatgcgatgggagtc

SEQ ID NO: 63967 - DNA, 1799 bp, Oryza sativa
tcgcggatttctttgcgcgcagcgctaacctcagaataaaattacagctttggtttccttctgatctggatgttgacaacattaacaaggttagatgaaagtacataccaaattgttcaaagctctggctcaggtggtgtttggatccaaggacttaactttagtctctttatttatacactaatttagggtattaattatatactacttacaaaactaattatatactacttacaaaactaattacataaatgaaagctaatttgcgaggcaaattttttaaacctaattaatccataattagagaatgtttactgtagcatcacataggctaatcatggattaattaggctcaatagattcgtctcgcgaattagtccaagattatggattggttttattaatagtctacgtttaatatttataattagtgtccaaacatccgatgtgatagcgacttaaaagttttagtcccatctaaacagggtctcactgtggctgtaaacttatcagatcctaagtttcccatttgtctgtgctgtgcatgacagtcttgaaccaactctgagaacctcatggaggtgaactagaccctccttgttctgtactgacattagctaatgcctaatgcagaagatgtgctaagaaatcattgataaattcagaaagttgacatgcttttctgaacagctttgcacaggatgatttgcgtgtattgtcaagacatcgacagatatacaatattacttgaagtaattgacctgctgtacatacagaggaagtattgtggtatgcagataagcctgataaacatttcgggtatgcgatcttcagcgcttcttgggtatccaaaagcaactgaattgatttgaaaaggcaaatgtaaatcgatctggccatgaaacttgcgcaaaaaaagtttgatacaatttgaattctagtttggcatgtacctgatccaacgcaatgtatgaccttcggcatagcagatctagagcatctatcagatggaggatcttgttaatgatgcttgctgacaacagggactggtttggtaatggatcactagcaggattgcagtttccaccaccctcaacaatagttgtcagtaatgccaggccttcatgtctgttgaaaacgcctgaagcctcctgcaaattctggttatgaggtgcaaattgtcatgctttaggccgattttgttggtgtggccgaattttgtgtgtgataagcaagggggccgccaagaggattcagcaatgcttctcctcaaggcatgatgatcctcagagaaagaggatggccccatcggtacaaggacaatctacaatgatatatgcagagaaagggagaagggatcaaagcatctgatggaaaatggctaagatttaatgaatcagaaacagaaagatggaaatggaagaggtttataattagcatagtagtttcttgaggcagccagtgttggctaaaattaagtatccaagctaaaaagcagctaatccatgaggacatgtggttatatgtttgtgtggagggtaacccacggtaaataccaatgctttttcccaagaagtggatatggtcacacagacacatttttgtcttaagttgttcataccatgggttctgaaatctgaataatgaacagcaattccatcaagaactgacaaaaactggttatcaaaggatcttctcttatgcagcactgaatctaagaacaatcttgacctagcctggcttgggtgagtacaaaaacagagatggagcaccagttcctggttcattcgagaagaaga

SEQ ID NO: 63968 - DNA, 1185 bp, Oryza sativa
aaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaactttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctattcgaacagtttgttaacctctgcagagggggtacactttacccacatgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaaatgcaagagcaggaaaccgtacacccggtacgttccccgatccgcggttttggaaaattcatttagttcgcaagcaccgacccaggtgtcgggttttccaagtcttttgtaaaactccagttttacccaagttgttaaacagattttaagtttgaaggcgtccgtcgatactcgcacagggtgcacgaatatcgagacgcaactagatggttacaaggggacaagatatagcaattaacaaaggaaggatcaaatgcgacaaattaggtaggtccgccaatctgccttgcagacgggacaaacagattaagtgcgatcctatcaatgcataatattttgcaagggatataattaaatttcaaatataggctcaagatattcaaaggtggcttgccttgctcgagatctggagcttgatcctcaaaatcctcgcactgcgggtcttcgggctccgaaactacacgcaaaacgggacaactcaacaaa

SEQ ID NO: 63969 - DNA, 10174 bp, Oryza sativa
tgtaactgtacatgtgtagagatcgagacaagaagatgaagcttactgtttgtatgctcgctgctactactatattttgtaactgtatatgtgtagagatcgagacaagaagatgaagcttgtgtgtgttttgtaactgtttttaccatgttctttctttgagctggaaattataattgattctggtaacattttgtccttctgtttttaccatgttctttcattgttgctcgctatttttgtacacaggatgataatacatatgcatccatggtattctttgcggatgatcttacgatggcaatggttctcacgaaagattaaacctgacaatcttggcatactatcacatcgaacctttcaatttggccactctggaggtaccattcttttattctccattttttggcttaatttcttgatatgtatgtaatagcaagtatttaccctttttattgacttaatttcttagtctctatgtggtagcaagcctattccaggtctatggattatacattaacagttcttcctagcttcggcttatatcgatttatttttcagcatgtactggcttcaatgcctaaatatatagggatctttggagttgtggatgcgcttttgttgttttctaccagctgatgtactgtgtggttgtgtgattgctcatcaagattatttaagttcagttccatgctagcatctgttgttcatcatattagttagcttttgtttagtgttcgatctattgaatgacctctgttgccttccattttcttaatcccttgccactattgtcgttggcagaatgacagagcatttgcatcgatgatgttcgttatggacaatcttacattggtgatgttgatacatatggcatagaagactctgaaaacttggcaatctcaatatattataacatcatacctttgaatctggccatcctataggagtataggtactgttagtttctatctcctttttgtttcacttaaattcttgatttctatacgcattcggagatagcaaccttagttattctaggttcatagaagaaggaattcgctctagcctttacttaagattggtttttgaagatattaacctgatatgctcggctatttctttatgacaaaggctacaatattaatgtgatctcccttaccatatagtcatatgcttttatatgactcaagcattttcgatgatgctgactgtaatagtacagatactgatattagaattttctccaatgtttcatttttctaattctttatctcatcgaatgattactttatgcattgctaatagttgacatgtacagctcagtgcaatgcaagaaaacaaaagcagtacttgctgctcttctcatgcaaatatggtgtaatagcttcctacataaggtaatggtctgaatcccaatgtggagaaatacaactttttcttcattttttgtttgcatagatcaatttgaacttatttccataagtgagacagttacttatattccatgcaagctaggtgatctacaatggggagttttcttctttgagtaaggagagtctctgtaccttttttctcccaagttttctttaaaagttttttttttaaaaaaaactctaaaatggctgtatgttctgaaaaaaatcagactaaatcattagctcaaaataatccacatgctctgtattatggctaatatctttgtcagatcaaacctatagattttacaattcaccttatagtcagggaatgcaaatgaacaaccaaattaaatatttctcttggcaaattttccatctatggttgtttggatcgatcaaagatttcgaaactggtcagaaatttaataggtcaacatagctacattgtttaatgtcttatttcgctaaatcagttcaagatatatgcaacaatataacattttctgatgtactatcaatatattctatatatgctcgtataatagtgtgattgactctgtaggtgtttcacatccagctaaccacaaaggatcaatgcataggttaacccacaattattgcagccctagaaagtattgctgaactttgcatcatggaaagagtatatgtaccacacaaaatatcaatgcctttattatatgttggcatttgattcagtataattaatgtgattctacttgagtattactttcgaacgtggtgggcaactttctaaaatatctacctcatttcaattgagtttcgatatggcattttattgtatattccaatatggtgcacatggcatttttttcttacaggcaacattgcttatgtgatttttctgctctaatgatttcctgcttttggaatttactactgatctatccttttgaattgagattttgctttcatggacatgtttataaagtgatgattatatttattcattataggatcacttgccagtataatttcattaagataccatcttttgaccatgcaatgttttgtgcaaccctttttggaagaggaggatatatatgccatgtagaacttacatattattttttgcaaagcaattgctatgttaaaagattgcaacaattgatgaagagaagtatgcgatgatgttgcaaataaagaaccacctttttatgattgtggttatagcaccgtttcagttctctgatccactccattgtatgtttacagtattttgttcattgtatggttgctaattttgccgaaatgcacatgattgtacaaatagttcatagacagatcaatcggagcaattcatatttgaatctttatggaaatcctgatgtatgtgccagtttgttttcactgaatgttgacaactatgtatatatcgagcatgcagtgtagcgcgtgatgattgctagtacttatcatataccaagtgtaatcctatcttaccataaagttgatgtccactaactcataaatcttaacatgcaaccataccacatcgtcatccacttgcaataattatatatttaaccttatgcaagcatacaacatcatctataatttatttatttaattctacaaatcaacatgcaagttatagatggccataaggcccgcccggcacggcccgacccaagcacggctaggcacgacccaccagccatcgggccagcacgacccggtagtcacttcatgccgggccatgctagcccatgggctgcacctccggcccaggcacaacccaccaacagtcgggccatgccgtgccggcccaaaggcacgggtggcccattgtgcctttttttcaataagtctattttccctccctcctctttgggctgtgatatactacctccgtcccaaaatagttgcaattctatattgtttagcatatattaaggtttcagaagaaagactatggtgccccttattaaatggtgtttatgtgagagtgggaagatggttgagggtaaaatagggagaaatttgaatgagatatgattgattgggcaattagtactctagaattacaattatgtatgtatatatatatatatatatatatatatatatatatatatatatatatatatatatccctattctttagaaagtggcatatatatgtctatttttactaccttttctctgtgtgtcgggcctagctgccggcccatcgtgccgggccgacccaacatgccggtggggggggggggggggcaggcatggcccggcggtcaggccgggtcgtgcttgggccaggccaaaatgccgtgccatgggccgggccatcgggcctcgggccttttggccatctgtaatgtatatctaatcatcagccctcacatcattttcacaatattttaacaaatatgtctatcatttgtttgttttatgataagtattgataaaccctcatgtttcattattttcttttccttttactcctagctcgatcatcgaaaaaaatatattaaaaattgcttagtagttgccgtagcaaagcgcgtgaaatcacctagttagataaaatgttaagacaacttaaaagcaccattaaacttgagtcgtgttgtttcaacaaatttaattatatagagtagaacatcctattatcgatgggttgtaccataatggtatttgtatagtatgcgagacattgataccaagttatacgtagtcgtaaaaagatgggagttgtggatttttatactggttcaggctctaagatgggtaatagtcctaatccagtttgataccagcgatcaaccgaaaccaatgaaagagaaaactgtaaatttaccactgatttgaatcgttattttaagactgtcgctagtaaaagattaaaaaataacactagaagtctagaaccatcgttcaagtgatatcatcgcaaatttgagaaaactagcggtaaaattacaaatgcccaatggaagacaatggaatagatcaccgccccgcttgattcacccgtccgatccaaatccaacggtcatccttccatctcccccatccccacgcctcctctccttccacgagtcgccgacgaggcgaccacgccatctccatctcctccacgtctcgtcgccatctcctcatgcctacccactgctagggtttgcccctaagccccccaccctctccgccatggctctccctctccacgacgccaccacctccccctccgaccccgacgacctcggcggcggcggcgaggaggaggaggagaggctcgcctcgaagccgctgctctcgtccccgtccacctatccttccgcggggacggaggagggcgtcgaggagctggagctcgaccggaggtacgcgccgtacgcgaggcgggacgcgtacggggcgatgggccggggccccctgggcgcggcgggggcggggcggctggcggtgggcgccgccgtgctcttcccgctccggctcgccgcgggcgtgctcgtgctcgtcgctactacctcgtgtgccgcgtgtgcacgctgcgtgtggaggaggaggagcgcgagggtggcggtggcggcgcggctggagaagtggagggggacgggtacgcgcggctcgaggggtggaggcgtgagggcgtcgtgcggtgcggccgcgcgctcgcgcgcgccatgctgttcgtcttcggcttctactggatccgcgagtacgactgccgcttccctgatgctgaggtatgtagtccttgatgattctacttctccacgggacgcctcctccgagttttgtgtttaccgttgcttgcttcatatctcagtagattgatattgtgaccaattttgtttacaaaaaatgataatatgtcacttcttaggtagcagcgcctaatggctggttggattatgaatgtcgattttgtactctggctgttgaaattggaaatacatattagagccgttctgcaatttactttatatctactgggtgagggttgggtaatgcttgtttgtgctggcataggtgttttttggactggttcacaagtggttctggtatatgttctgatagctgatgctagaaattagcatgcaaatgcacatcctgtcagtttggcatgtctttatcagtggacttctaacttctgtgaaggcttgcttatttgctgttgtctctcacgacatgatgcatgccttgtgttcatttttggtggaaatgtgctaatattatacagctcttggtgatccttcgaataaactggcacctttaaatagtataatagtgtaatgtgatgataattggttatcgtggtaattttatttcattgcttagttcaatattatgatgataatatgctggatcaggtggtggttttatgcccttggttagcctccagtaggtgagaataagataacgattgagttctagtgaccggaatgatgttcagaacttgttctgaattataaatatgactctgacagatttattttgtttcttatccaagatggatatagattttttggtgatatggtgttgttctaagatggttaaatgttttaaaggattttgcccatattttgggacaagtagtagggaacattattaaggaataatagtctccaagcagctcaattttctttttcttgaagtatgaagttttaatcagtgcctcttgtatctattttatatatccaactgggtactctgttttcttcaggatgagcatcaggaacagtccaaagaattgggaagaccaggggcagtagtatctaatcatgtatcttatgtggatattctttaccacatgtcatcttccttcccaagctttgttgccaaggtactgcaaatatgttgtaactttgtttttgtacttgtaattttgaaaaactgtcattacaatgtactcattttgacttgtctcttttacacatcatttttgaagagatcagtggccagattgcccatggttggtctcataaggtacttgcattcttgtttggatttgcctcagttgtgtctgtacttttggtaaaaaaggaaaaaaaatcttacaattttgtcctgtgtgtctatctctagatacaagtcactattcaatgttttgaccattaacaatattctgtatcgattaaccatgtgaaattaacttcacttgaactttttgcaaaatgacttcatgatgtatatttttatttttattcccttttctactatagtatgaatgtataacaacatagtacagccattttttttaagagcatatatctgttgatagagggagtacagagagtagaaaaatagttgggtttattcagatgccgcatacagccgtacatttacaaaatgacttctgttttcatgcagcaaatgtcttggatgcatttttgttcagcgggaatctaaaacctcagatttcaaaggcgtttcaggtacttgctgaatgctgatgtccatagccttgagtcaatcatttacttgtattgccttaacttcaggtcagaacagcatattttccctttcattaagagttcacatctgagatgtgacttgcacatgagcgtggccacttaatttggccaaattgacaacatagcatatatgcgcatcagagtggtgaaacatgtaaaacataaaggggccttgatcaaaaagtacattttcttcttcataatgaccaaaagttcacaggattgaagttcaaaatagtgtgatgagatatttacaccacagtaactgaactagattacagcactcggtgcacttctactttctaaaatatttctgtgacggggcagctatgtcctttctgttgtatatatggcttcattttctgttgtcatgaatattgttaataccacttagctaaagtattcagtttgttgttgcttttgctaatccattcaatgcacaggtgctgtgactgagagaatccaacgggctcatcaacagaagaattctccaatgatgctacttttccctggttggttcctgattattgttttggaccctttcagttttgttactaacttagattaaggataatatcaatccatccaacactaaatgtataactttagttgcagcgatttctctctctctctttttttttaatttttaatgcaaggaatacattgagattgtttactgaattcccttttgaaaatggaaaataatgaacatatccaacacaatttaacatttttactgaaaggcaaacaagaatgtagaactatggtatatgatctgaaagtatatttaatacatcactctctaaattgcttcactttttatgtaattattttcttatgtatcatatgtaaatactgggctgttgcattcttctattacagaaggcacaactacaaatggtgattatctcctccctttcaagacaggagcatttcttgcaaaagcaccagtgaagccagtcattttaagatatccttacaagagatttagtccagcatgggattcgatgtctggggtgagtatcaatgacttttatatctttttattcatatacccttaaagctggcaagtgtttggcttgaaggccatgcaaggcagtgtctgccttgccaaattttacttctttggcttgtatttggccccacttggtttatcgtcaaattcttctaaggtttcttactttctttagcattggctctacttcattctcttttaaatacttggtaatgattatccagtgctatgcgccaagccatctatgtgctttttagaactttgtgagtttgatgtcatttttactaatcatatgctgaacaatttcaacttgtcgctccttcatctgtttaacgtatctatatctcatgggaaacttgtatctgttcaaccttactgaatctcatgaaaaattttcaggctcggcatgtatttctgctcctttgtcaatttgtaaataaccttgaggtgatccatttgcctgtgtattacccatctgagcaagagaaggaagatcctaagctgtacgcaaataatgtacggaaattgatggcagtggaggtatatacatttatctttcaaaatcttaaaaatggttttcaccatccacattttctttataatccatttgtatcacctgaaatcttattccattctaactaatattacatttttatttttgttctcaggggaacttgattctttctgatcttgggctagcagagaagcgtgtgtaccatgcggcattgaatggtaataatagtctacctcgtgctttacatcagaaagatgattgaaatgccttgccatcgcgcttctgtatactgatgctgagtgacttgcttgtaatatagtacaagttcctggtgttgcatgattcctcatgttgagaggagctatgttaatatcctcccagtaaactgtaaaattatttgtccatagtgtggttcagtaatcatgtcagttatacatgattacattcacatgtctgggacacacttcacatgcaatccatcgatgtgagctttataactgctactttgttacagaaactgaatcatctatttggtcttccctgcaggattattatgtcaaagctaatttggatatgcgtgccgttaattttcctatttgtccctgaaatgttatcgtacatgaaccgaagtcaaagtttgccattagtttttctcaccaaagggatcctttgtagatgaccacagaattttgcagcaagaatcagctaggcattaaaccacaggaattaatacatagggggatgaagggggtaaccatagaaatttccattttcttcagctcaggatcatgtttagtagtgttgatgtgtcatcactaacaatgttgtatctggtgtaccttccaactagcgaattaccaatcaaatgtaatagtttttatggttacctatgtgatccatttcccttttttagcttacaccatcttagtttaatatgttgattggttcttcattaaccttactctttacaatagcagaagttggggtgatgcctacattcaagacacaccctcccactctgtattcaatacatctgttgtttgccacattttcccttgcacgtatgcatttattggttgctaattgatctcatgcgttcattatataatctttaggtctgagattaattatttgttgccttcccgtgcacgtatgcatttattggttgctaattgatctcatccgttcattatataatctttaggtctgagattaattatttgttgccttctctaatttttgatcttatactgtatttatctgccatatgccatctaccataatgaatggggactatactggtcagggtagaaatatattggacctggctattcaagcttcccgttggcagaacgttactgaccagtatagctatcagcggtttacggtgatgtttctttctttgcccagcactattaatgaatgtatattggcttctttaacaatgttgctcctgtaattattattattttgtctttttggtttgaaaatgttctagtgccaggtatgcctgtcaattttagactcatttgaaacgcatgaatttcttagaaatgcagtcggaccgtgggtgattatatggaagtacgacaaaatttctaagaaattcatacgtttttgtcggactttcatgcaatccccctgtagtcagactgcgttccaaataggaccaacctagtagtaccggatttgagatcgctttggggaaaacaaaacaatgtactaaattgctgatgacgtttcatgctccaaaaaatggataaaa

SEQ ID NO: 63970 - DNA, 12639 bp, Oryza sativa
tagtttatcaaaaatttaaaattcagtttgatattttttttaaaaaaatgatggtttaccgagcgacttttatcttgagcaaaaaaacctttcagtattcgtgaaaactgagcggtttctatcgcctcttccagcaaggccatgcaagctaggtggcctgtgtccagctccaatggtacattagtacttatcaataactttaaaaaaatttagtttaaagacactagaataacttatatagatatgtcttacaaagtaaaaacatttctttattgtatataatagaaaaacataatcaacaatatattttggagatcgtgtcattatcaatagcgatcggagggaataaattttcagtgctcctatacgactagatgatggatatgggttaggattggatatccaatggctcaaaatccagctgaatactttggaacttgggaatgcacaaacagttaactgacatggacaaaccaaagaactcgaaacctaatttgctctactcgtgtaacttcgatgtaaatcgacagaatttacaacatagccaacattggcagccgacaatataggaactaatccgacaatatagccaaacaagtctgacagctttctaatctgcttgttacatgtgaagaaatgtaagttttgcaagcaccccatgagaagggcaaagtatcttacatcaaaattttacacactgtaaatttcaaatggccaatagcaggatcaactaaaaacctgaaaaacaaaaaactgagggaaggctccactaccatcaattagggtttgccttgctagttacttcatgtcagcaccaggaggcctgtcaggcctccaatatagaattgtattagctccatctgcaatatccatgccaacaactgcactgatctatcctagaattatatagttttgggctcgtcgcagggaaaaggagccaaaagaaggacaatgaaccagccagaaatgctactgatgccactcctggaacacaaagcaccaggtaaaccaatgtaagaagtagcatatttaagactcaaccatgcttttgatttctcgaaataaatcaaggtacacacctcttttttgtggtgatgagaaaactggcaaacccattatgttacaaaatatgtgggcaacaataggagagacgatattccctgcagtattttttgaacgaagtgattgaacaaccatgttgtcagaacaatataaagcttcaatcaaacaattgaattaggtaagtgcagtggaaggatgaagaaaaggagactggtgtattcaggaccttgctttaaagttcagctcttctagaaacaggttacatacttcataatcagtggtaacaattgaacttactatgcaaatcctagaatcattcacaaaaagatgtcttctcaaatatagctacctaaactaatttgaataattggagaagtaattcccgcaacaagaatatgcatagctggaaacaacaaatgcacaatgtacacatgcaacacacaaaagaaagagtaaaacctgttcgggtgaacaaaaatactgcataccacccaaaaattacagtgtagcctaactggacacctgtgaatgaaaggcaaaaagttaaggcaagcccagcaaaatgaagcaaaagtgatatactttgagaaaaataatgtacaaaatatgacgaatatattgaaagatcaaacatttgtttatagtttaagaacgaatacaaaggaaccactaacaaatattgacacctgtagttgatgttgtacgaagtcaatactttattttaaaaagttaacagtgcaatataatgatgatgataaactaatatgctaaataccaatgactgtgattagatatgaaggtgttgctacatcactataggttgcaaatcaacacggtgttgaaataacttcataaacaaagatacaaaaaaaatcgctttaatttcacatattagaaataaagtaagttaaatatagatcaaacaactttactctaaaaatcattaaaaggaaggcgttacagtaaagaatagaactaaaaaaataagaaagaaaataccaacgatcaggagtgatctcgtaaaattgcgtccctgttgatgtagttcgaataaatggttcaagtgtgctgttgatagaaaggctcagttacaaattaacagaagaaaacatcaacacataggtaaatcttaagggttgtattacgcagcagttcttaattcctatagaaacaactagataaggacagacaacatgggtataaacaagttaatagtaccagatcagacccttagaaatgaaattttggtacaatataaaagctatttacctaggctgaagaagactggactcagaaatataatgttatatattttgaatcctccacatagaagaagaggtaccatgcacgcccggaaaaccaattcctctgtaattggtgcctgaacaaacaagcatactcaaataaaaatcactagtagaatatataaaggaaaccatcgtttcagtagtaacatttgcgccatagaaagctaaaagttttgcataagtggtaatttttcatgaactgttagatggtaacatcctacagatcaatcgtactatatcaattaattgaaaaattccttgatcatcgccacaccacataacattccatcgccggtttacaagacaaagcaaatgcatcaaagcgaaggagagaacaaaccactacgcagttgcgccaaaccatcacatctcctacggaggcacggatccggtgagcaagcctctgtgcccagcctatctccggctcttcatagcctccgccgcacgaattcgccagcagccagagcctcgcgacgaacgagccagcgtacactagcgatgtaaggaggaggggaatcgccaccgcttgaagctgcagccaagcaccaacaatttcagaattgaagcatcaccaagctcaaacctgttagtattactgacatgttcagaaaggaaaaaaaaaaaacaagaacagtaagtgaggtcgcttaggctcaccaggtgatctctccgaatgccaaacacggcgagcacgacggacgaatctccgatgctccacacctaggaaggatggggaggagaagacgctagggacatgagattccgtttagggtttagggttcggaggggacaaggtggggggcacttacgcggaggagggaggcggtggcgaggagggaggccgaggaggagaaggcggcgcagaggaagcggcggtggaggaagacgtggagggaggtcgggggcgggaggcggaggagggccgtgggggcgtagagcaccgcgacgtaggagacggccatggcggcgcacgcggccaccgccgccgccgccgcgccgggtatcgccggctgcggggaggcggggtggtggaagctcgccggcgtcgccattagctccggcgagcggagggagtagagtagtgtccgtcagtcactcaagagactgaagacgggggacaccttctcccttctcgtgtctatacttctcaacataaaacaatgtaaaaactgcttttataatttggagtataatataaacatttttacattgtttactatatagcaaatgataaggcttagagaattttttttattaaattttaaagtgcttaaactcccctcttatacaattactttataatataagtagacaattgggaagattagctaccctatgatcagatggctaagtggtgcgattgcgtacacagtttattatgatccgatatgcttcctccgttctactgtgcaagattttctagcattacacaaatttataaatatgttaatgaatataaacacatataggaaacgtatacattgatcaatggatgaaccgtcaaaaagtttacgatatgaaatgaagggagtattactcgctacattttggcatatcactttctacggtgttcttttttttttcttttctcctgaagatgaatattaagtttttttacgtaaaacgatgtggtattaacatttgattgattgagttttaattattacatacttaaaaaataaattaatatgatattttagagcaactttcatatagaattttttcgcacgaaacacaccgtttagtagtttgaaaagcgtgccaaaaaatcttaatcttcatccaactcttgttggagaaaagaacgggccgtaacattttataatccaattactatctgtctttggccatatcactgtttttcagtgaataatgttgcagcttgcaaagtagcttcatttccggtcgtttcaattcaacatattgccaccaatcggagccgaccaaaggacggtggcaataccatctaaatttgaactgtttttctatctttcatgttcagtacaagccttatactcactttataagacgcatcatccgttttgaattaacggtccagatttgagcttgtgccatgctcctcatatatgcatttattagttcatggttgcactgcagtgagcatcttcgtccacattggatattggacattatcaccacattctaacacaagcgcagcacatccatttgccgcccgtatttgcaatggtgcacagatacacaatgatgttcatagttgcactgcaaaggtgtgttctgcagagagatacaggaggaacggaaccaggcgagtactcaagtatggcccttctgaaggcacaaaacagggctccacattgaaaaaagtagcgcacagctcaaccagctccaggcaaaaaagtagctctattttgatgttggcacagccgacaaaactgcggtttcatgtccacattcaggtcttcagaggagctttcttctccctgtcggatatgcgagcgggcgcgtttgtgtgcgacttgaagcggcctcgaccgccgtcctccttctcctggaagtttttaggtcatagatttagcaccatttcaattattgatagaaacaccaccttaagagttaattttgatgtttttaagtgtgatgaaagtaaaccttcttctttactatctggacgacatcctcgtcttgaagaacatggccaagcccacaatgttgcgggtaatgcctcgcacttgttccccatacaagtacatacttcacatccttgaccaaactcctatggatatggttgcagaagtcttcaactgtgcagccacctctatcctgttgacacaaaacccaagtcatcaaacatattgcagtcctttagaacaagtagtgcaaggcatgacaacaaataaagcttacagtagaaagaacaactggatctgtgaaatcaggttgctgtccttgtggctttgtatacactctcactagccccatttcctcccacattcttgctagtagcctgtccaagtttagctgcaaagaaatagtttatgttaaattcaagataaagaaccacaaaatggaaaagagaaccaattggggacagaaaactcaatacttctgcgtgcactgcggttttcaagatgctcacatcacacaaggcccaagggaagtaccagaaataacttgagaaggatataaaggtccccatcgtttggcatatgcttatgcttatcagccaaaatttgaattttcaatgttaaatttggagctgattttggggttttttcatcgaagtttatttttcagcctttgcttttggatcgataagaacacatatataaaagttttattcacaaactgctactcgtttgcaaatatgccatttggcatattctgaaaatatgccaaacgatggcagccaaaatttaactgagagagtaaacagaagatatataacatgcctgcaaattgcagctgatcacaagcgaatttggttgccgagcaagcttatccacatcatcaataccaacaacatcaatcttgttatatacataaacacattttatgtacttccgatttccttcaataacatcgatgaagtcatccacggtagcatcctcgcggaataacacctaaagaaaaccaaataactgtgttaatcatgcgtgcacaaacacacacatacacaatcataagagtgcgtgtgtgacctctgcgttgtgaattttgtactcatgcagtatctgatagcagagcttctcatcaacatgggtcaagggaatcatgctgttgaaagaaattccaccagtcttcttctttttgaaatatatctgttcatacaagcagaagtgattaataatagaccagggaaaataaacagtacagatacacatacgaaatgattcattagcaacaaagaatatgatttagaaagagcaacaccaactgtataaacatgactcaggtacaccatatgtaagacttgattcaaggaactagtcagcagagttacatggttcaaatagtccacagaagcttgctgaagagtgatttatgatatacttgcagatctatgtgcagaatgacttagcactgttatatttactatcagtagtttgacaaattatctgacatggcaaggggaatctgcagtcaaccctggcttgccactccacggttcacgtactgttttcttatgtaggcaaatgtatattttaccaagatgataatgatacacctggaattaatcctaatcaagcacatgatgctcaagatgtcatgcaaattggttcatttgttggaaatggaatcagatgaaacgaatgttgtttgagccccaaattgtccatcttgcgttttcaatgttgaattctaatttcgccctaagcactacctgaggaggccttttgttcagacgaagtccaacagcttccagttctctagttaatatttggcggtgtccttcactctgaaatgaaattcagaacaagaatccaataagcaaacagagctcaggtaaagcttggatcatgttcaatcacatatagaaggggaaagattggatgtaattgtaacatttttttcattaagaaaagaaaaggaactccatcaaaccccgcctcttgatttgcatcaatctaaccttaacaaactctccactaaaatcttctaagaactttcaagcaactataaaattgatagattcatttaaagacagtgtataaaatttcctgtctttataggacatatttacaaaatagcaaacatgagcactcaactgaacttgaagttcacctattttactagtaatattacaggagtttttattaagaaaagagaaaaaaaacatctagtgaaggagatatgcaatgttaaaaaagaaaaatggccttggtgaataagtagccaagtgttgagcttatcacatgattgtttgccctatattgtcaactttaaattcataatttcccctatttatctattgtttacaggtcacaaccccttgtttcttgtctcctaacttttaggttttcaaacttttagtttcctaaagctcaaagttacctcaagtaagataattttatcattataaaatatatgcaggtgcttgcagagtaagacagttgagcattctaacaacagaaggcttaattgaaaatgtggatactttaaaatattctgctagtaaaaggtgttgtttagctagtcctgagttcagaattatatcaaaactacgatgactgagactgattttctagtctatcatgatggatggacaatcacactacaaaagagaaaaaagtacatcggaccctttccaatctttaagaacattagctcttcaacaaagtaaaggactagaaaagcaatgaagcaaagccgatacagctacactacttacttttgaggcatccagaaccatgagcacaagatctgatgactttgcgacagcaatgacctaaaatgattaaaataaaaattaaatacaagttatttttgggtaaaaagacacagatgcaccgtacacattgtgataataaaaacattcacaaaatttacctgtctaccacgccccttgccttctgatgcaccttcaatgataccaggaagatcaagaagttggattttggtatcattgtactggataataccaggaatgcaagtgagggttgtgaactcatatgatgcagcttcagaatgggtcccagtcaacatagtcaaaagagttgactttccaacactgcaacataaatttcaacacggaaatcacagtgatttaataaacctgagaaaagaaaaagattgggactcaacagtttttagtagagagttgggacatagatgttttcatcttaaattgaacttaacaaacaacgtgctcacatgcatgctagaaagtatatggaatacaacatggaataccaatttatcatgggtaatccatcgttctaccaattaagatatttagatatcaaattcccatcgttctttttcaagtcattagatggaagagttagaagacaggcatgcacaagaatacaaggcagccaatagttcgtaagagctggaatggcatgcacaagaatacaagggaggaaacaatatatcgagaagattatattacaccaggttcttatacagttatactgatcataacagactccatgaattctaaatctatcgctacaaactgaaaggcttgaaacacaggattttagggtactcaatttatagggatgtaggcggaggagagacctgggaaatccaataagtgcaacacgaccatgcccaaactttgtgacttcaaaaccatctcctccaccagtggaaccctatgtgaccaaaatgatgcagatgtgacaacagaaatccatggaattcccatgactatgtcaactttttatattaccaaaagaacttgtaaggatatgatcaagatgaaaaataataacaaaaggaaatatcaacatgatatttcaaatatttcaaataacaaaagaacttgtaattccataccctacttgcaacaaaatatttcaaataaatgctcaaacgtcataaataccttagggggctctaataattgtgtcctcaactttgctatttttgctttcagttgtccaagatggtattctgtatgacaaccagaaataaaaattattcccagataacaatatgcaagacatttctcacacagtattgagtatgggtgggaatgtaagagatcagagataatcgttcattagctaaatacaacattgttaatagcaagttcacgttcagatacataaattgcatatatgcaaacagagatactcaattactcagttatgcctgttcttctagcaacaaatttggcatctgactgttgatactggacgagtatagtgtgtgtcaatcagaaaatggataaagcagggtatgcagtaaacataaatcaggcaataaaagacgaattccctgagtccactcgtcataacatggatgaatttgtgccaagcaaagaacatgtggcaacaaatcaacaatttcggatctgaacattgactagtggatgcacaaataaatggcccactggccatcattgatccaaatgtccataacactgaataccaacatgaagagaaattttagcaacaaaataaactggaaggttgagaatcgtcagtggccagtataactaattaagcagcaaataatgaagtaaaaaatcctgaaaataaacatatacttgcgatgctcatttgacatccatccaatccaccaagttaatttttatatcaatcactgacccagtgaaacatgctagtatagtttcatgatgaaagaaacgaaaaaaaaataatatgaaggaatgaagatgaattacagggttgtattaaaataaaaaacaacctgttgctttatttttctgtgtccgagccatctcggcttcaatctccttgatcctctcaaggatacccatcttttaacttgtgacgtatgcgaattactccaaggtaggtgaatatacgacctgtcgcagaataaaagaaacaaaagaattacaatgcagtgatttgtgcaagcatctgaggctgcccgacagctccatccctagacccccagtattgaaggctagactttggcaagggcaagacggaaaaccccttaacactaacaggggcggatccccaaactttttgggtgaacaaacaaactgttactagttgtattaagaatagaggtttaaggctctcagattaaagaggaagaagagctttcttccagatctacaagagaagctagggtttacgaacgcacgcgcgcaagcaaattccagacaaaagtagtcccggtgaggtgggagagagatgaatcagaaagagaaagaggatgtggatgctcaccaggatcccctcccctgccctgctctgctcgctcgccagatggagatcgccgcccctcccctgttctgttcagccgcgactcgtcttggcggcggcgcaaggagcggaggagacgaagtgacgggagatttctctttcttttacgcgatactcgactactccaactttatctcagtatttttattactttaaaactgactacttagagattactccatccgtcccataatataaaagattttaagtttttcttgtaacgtttgatcactcgtcttattcaaaattttttaaaattattaattattttatttgtgacttactttattatctactgtattttaagcacaacttttcattttttatatttgcaaaaaaattttgaataagacgagtggtcaaacgttgcaagcaaaaactgaaaatcccttatattgtgagacggagggtgtcgagggagaaccctcaataacagagagtcgtgagaccccctttcgtgagttcggccgggggcggaggcccgtctctcggaattcgtttgctcgtccctaagactatcaatgagctagtacacaaacggattatacaggttcgggccgcaatagagcgtaacaccttactcttgtgtttgggattatcgatgaagttacaagggttcctttactccggagagcactcttgcctcctctcttccgaagtttgggttttctcgggttcccttccttgcactgtgggcagggtcctccttttatagttctaaggggataccacacgcgccgattctacctactctccaccggggaaaggggggaaaagaccccacttcacctttttggccttcaagacgtgccttctctcggaagctaagccataaccgatccttgagcggaacccagcgccgtcccccgcctgacacggtggtcagcccggtcattccctcataaatgatcgaagacatgcaacagcccttcctcgagcagcactcggatgtgacgggtcacacctacccccattccgccggggtcaagggtgacgtgatgatatgattaccctatccatcggatgtgacggaaacgggccggtcacagaccggtcacatccgactggcaggggttagccagacgcaccacacgtctgccgcgagggacagttggggtgctgtgcatttacggctgttcagcctgtgctcccctctgccgcgtggcggccaggcgagggcctcggggcgaaggtgcgatagggcttgagggggcgatgtcataccccgagggggcgacgtcgtaccccgagggggcgacgtcgtaccccgaggccccccccgctgcttctatgatacgcgtggcgtgtgagtggggccatccggccaagccacgtggccagaggaagagtaattctcctctacctcacatacccccgggcccatatctccgatagagggagtatttctttttatgacggatggtggcctacgtaacatcaatactttaaagaaaaaatattaacaaactcggttttagagattgtgtcgacaacaatctccccagaccgcccgcaaccactaattgccacactatgcaccgccatcaccgttctttcttcatgagccaccattgttcctaggggtgggtaaaaaaaagactgaaccgaaaagatcgagactgagaccgaattttgtttggtcaattcggttagtctcctcagttaaccgaatagaccgaattaacaagaaatgtctaaatgcaacctacaatccactaaattcaataggattaaactctaattttcacatccctacttcttcaaggcatgcaacctaataagagtttttattcatacgtgtacaacatgatatgtaagtaggatatgtcacatcatgtactagattaacttattcttatcggaggtagtaataagagtaaattccctgtgtaccctgaaaactcactcaatccatttcatacccctaaaatttataagatcccttctatacccttcaaatttcaatttgatcccttccatgcccctaccattacattttccttcatttcattattatgtttggttgcaaatgtcttttttgcccttgatgctttaagtttgaatataaacttgaaaaacgattgaaaattttgtttgagtgcacaatatgtgcattttatgaaactaatgtgactaaatgattactgcagaaaattttgacataagtttaaaaataaaaaaaatgtaataaattaaaatatttatttgaaattttaatatgacaatggaattttttgatcgggaacattcataagaaaaatattgtgagcgttggtagtcctatttttgtataaatgctcctcaatttttatgactttttttaaaaaaataaatatattttttatttcattatctaaaagtaaaatttgtgataa

SEQ ID NO: 63971 - DNA, 867 bp, Oryza sativa
tcagcgatcaaaccaacggcggaagcgccaccgatgaatccaaggtggagttcggccggagcttactgagcgtagtgaagtccttgaaggagagcgacttgagggaggggttgtgctcgacggagttggcctcgtagaaccagtgcgcctgctccagcaagaacaggatccgctcgaacgactccaaatcctctttgggcacgttgagcacgaagcggctgttatttttccgtttccaccggcgattcgattcagtttttttccggggggtttgatctgagcaaaagccgagaagactctcgcgagatggatgggatcgagggtttgggatgggggctacctgcagagatcgtcgagaagctcctgcggcggcagctgccccctcgacgacgaccggtagagccccccggcgcgcgctatcgatatccaccgccgccggggcggcgcccggtctcccaccccttctttcccttttttggttgccctcgggaatccattgcttgttaggttgcggcccagttcacaaggcgcactttaatttaacgtaaactcttttcgaagacggaaaggtgggccgtgggctacaccctaataaggcgtaattttattttacgtaaacgagtttggaaggcggaaagtgtgggggcaaacagtagtagattaaaaatcggaggagagagacagcgaaggagcggaggagccgaggcggggggagggaggccatgatgccgccggcgataagcttggctcgctctcagacgtagtccgcctccgctttcctctctaccccgtccgccgatccgccgcagtcgccgtccggcaccaccgctgcccgtccttcgccaccaaacccgctgcaggtcttat

SEQ ID NO: 63972 - DNA, 1276 bp, Oryza sativa
acgatactattgtgtgctgatgtgagtcaagttggtgcaaacttatactagaatatggagtttctttgttgctcatgggcaggtgttgcttgaggctatgggaatatagctggtgatggatcaggactaggcttaggagaagttaaggttcagacggtcaaggatatcatgtgggatgctcaggctagagaacaatgcacgtggaggtgaaggttggagtctaagtttggaaagattggcaatgtggagttgtacggggatgttgtttcccaagtcttataggttcctacgtgattagagtcctagttttcgttggattcgtggctaggggaaaccacgtttgtgggtgtaaatatatgatggattaaagctagaagatatcgactttttggaagagaaaaattaagattttctttgaggtttcaatcatagttcatgagttgagagaggagtgctttagatgcactttgtaaacacatatcgatgcaataaagttgatctactttcaagagtttcatcgatacatgtttttctagatcagacggtttgaccggagttcataggacggtctaaccggaggcatggcgatggtctaaccggtggcgaggaaccggtcagaccggtggcgaggaaccggtcagaccggtggcggcgagaaggtagcagagggaggctgcggtccgattggccggataacatcggtcagactgacggcttaggggaggtcagacctgtgtgcacatggaggtcagatcgcctacgcctacgacttcgtcaagtttgaaggtaacttttatttccatagaaagtttttggtattcctaccattcaccctcttatggtaggtttgttcggtcttgttcgatctttgaagtacatgatacaatatgatatgtaagttgatatgcatgcatgatatctaactttgtcaaatttttcaatcaatcttctatatataagaaacaagggcacattacaaaatgaaaaacaatgtgtcaaatatcactgttggagaaagggtttttaacccggtttgtaaccccctttagtcccgattatacaaccgggactacgaatccaggactaaagatagctatctttaatcccgggtgaaataaccgggactaaagatccatatttagtccctgttggtgttactaggactgaagatggaagaggccaggtcccgattggcagttttttcattgtttttaactccttgcatattgatttcactccattcccaaaacatccccaaattgtgaaacccccaaat

SEQ ID NO: 63973 - DNA, 9562 bp, Oryza sativa
acagtcaaatacataacaaattctcaacaaaagtttcatcacaaatcctaaaatccccagcccggctgccgccgaccccgcctcctcctcgtgcacccggccaccgcctggccctccgcggcgcccctccttgtgcgcccggcggccgcccggccctccgcggcgcccctccttgtgcacccggcctcctcctcgcgcgcccggccgccacccggccggccggccctccgccgccggttgcccgacgtcctcatcgtgtgctcgctcccagccactgctacgctgagaaacatataggggaaagagataaggagttagagtaaggaaagcgataaggatagttagaggaaaaagagatagaggagagaggagtttgcgaggacgatagaagaggataagtattagggattatatagagcgttttgatttttattcccggttagtaataccaattgggactaaagttaggggaataaaaatctcgggcgccctgacacggcttgacatggaatcaaccgggactaaaaatcacatagtcccattatgcttttaaaccgggactaaaaatgctttctagtcccagatttttaagtaaccgggattgttgtggtttttgggcaaccgaccaaagatggtttctccagtagtgtatgaaacataaattggttaagagtagtgcataaaaaagtgaaggcgcaaagatcacatgatgaatggatgcaagctattccaagatagcagcgcttaaagcaatggctggtatgcaaattaatcaatttacacccatctaattcacactaacatgagcgtgcatgtaatgatcgaagaaactgatcaaattatagtatgttgggaatgataatttgaatattcgactgatggatcaatgtatgatatacactaagtaatgcatccgcacttcatcgtcatcaaatgataaatacaacagagcaaaaatgacccattttagttttgttctgtcccgggccaccaaaacctcaggacggccctatgcatatagatgcacgaatgcgagtgagttcttattccttcagtaacctaagctagctactagttcacttgatgatattgaaatcatggtacctagctagtaactcgttattactagctcctataataatgtataagtatgtatattaattatttctctatgccatttcattaattaattttgttgtccgtctatatctccggatcatcgtcgccggcggccttgtgcctctcctgcttcactcctgccgccttcagctgcagctcctgtccttttccccacaggaacgcgtagagccccacaatgatcagcagtgccccgatcacgctacacaaaaatagttaagaaaaaaaaagtctcagattaaacacgggtattcatatattttccgtatttcctaccctacacttagtaacaagtaatatacatgacatatatatagctagcagcgagagtaatatatatgctacgtagtatagggaatcgaggtacactcagtgtttaggtgttacttttgtaataattggctgtaactccgatgagcaaaggccgggatgttttattccattatctaaaaaaatagggaattgagctatatatatatatatatatatatatatatatatatatatatatatatatatataaaattgcccaaactcacttttgaggggaaaacactccataaacatgataatttggcagtagacaccgcgccgattaaaataataattttcgattaaagaggagggagaaatcgcgtgaaatttctaaaatacccttgggcccacaagccatatcttccatctctcttctctctatccctatccgacacggctgaggggatgatggtggccggccgacgactcctcttcacgtgtgcggctagccgggaactcctctccctgcgtggcgctagccggcgaggtccttcccccgcgtgtggccagccgacgactcctctccccgggcgcgaccggctatcgaacaactatccccccccccggcgcacggctggccagcgagctcctctcccgcgcgcaccgaccagaacgaggaccaggatctccccgcgcacacggccggtcgacgagctcccccccacctcgccgaaacccacaggacgccccaccgctccgcgccaccagatcggcaagcgtgacggctcgtcgtcttcttccctccattaaatcggcagatcaactcatcgtctgcatttctcagttctccaaccaatttcccgattcatcgatctcatcgttcgttcgctctagctatcgagagtgatggtgtggtctgttcccgatgatggtgctgctgccgaccatgctgctgctgcggctgaggctcccgggcgacggatcgtggtggccgtggacgagagcgaggagagcacgcacgcgctcacctggtgcctcgccaaacgtcgtctcctcctccagcggtgacacgctcgtgctgctccacgctcgccgcccccgccccgtctacgccaccatggacagctcaggtacctcaatcgaaatcactggacacgcttttgtggtctctgctcctaattcatcaagccaacacctgggttgttgttgcagggtacatgatgacctcggacgtgatggcgagcatggacaagtacgccgccgtctccttccaggtgcgacagacatggggcggcgccggcgattgcaacggcatcggccatggaagtgtgggaggaggggatagggagatggaagatatgacatgtgggcccaaggacattttagaactttcacgcgctttctctctcctctttagccagaaattattattttaattatcgcggtgtccaccagcaaattaccacgtttatgaagtgttttcctccaaaagtgagtttgggtagtgtcctagggctaaaaccacatataaacagtgtcctgtagcaaaatttgccacatatatatgaccatcaagataatgagtaatattggcggctttgctttagtcgccaagaaaattaactggctgccaaaaaaattatgttttcttgtagttatatactcccttcgtctctaaatatttgacatcgttgattttttagcatatgtttgaccgttcgtcttattcaattttttttgaaataggtaaaactatatgtatatataaaagtatatttaacaatgaatcaaatgatagggaaaatattaataattacttaaattgttttgaataagatgaacggtcaaacacgtttaaaaaagtcaacggcgttaaatatttagggacggagggagtactagcttatgatagttataccttcctagatagatgtttgcgccgagcaacagtgagtccatgacggtggtgatgatgagcgagagcgagttgaacatggaagggtagatcggcccgcgacgcgtgattgcccacgagatgagcacgaaggtgataccggtgttgaacaccccctgccacaccacgaattacatgatacatcgataaatttctttagataacggaaaattcattccgacctttactttaagaaagctatgaccaattattattatgattcattatctaaaaattattattattacgatttaagtcaacaaaatgactatgaattatcgatataatgcaactaaggcatatactccctccgaaaaaaaaaatctaattgtaggatgaatatggacacatatatatcctataattagatttttatttttttggagtgagggagcatatacataccgagtaggcgacggcgagaaggcgcaggtcccagctgagcttccactccgaccagtcgccggtggtcaagacgccggcgacgagtgcctgcaggctccctgacaggcatgtcagcaccgtcgcccagtacttggacgggaacaccttggctagcttcgcctgaattcatcagtgtttttgcaaattagtttttgcaaaattaatttgcagtatagctagtgaacattacttggatatagatatttttgcaaaacatttttttgtgtgtgccaaactatcatatatatatatatatatataggaagaaattagatcctatatacagctatgatcaaacatgcatttccatatgccaaaagactcaaatcgattaattaataatgctaattaacctgcacgatgaaccacaaggcgtagctcaggcagctgccgcacagtagcagtgtgccggagatcgtcgtgccggcggggctcgacgacgatgacgacggcggcgccaccgcggcggcatgggaggcgcagcaggtgggtgggccagaggtgcagcagctgacctctgaagaggctgacgaccatcgtgccgctcacggacaggaccgtgcccaggaccttcatcttgccggcgcagcttgctatcgccagcttctcagcacttgatgaaaaagaaaaaaaaaggatgaaaaattgcaaatatatgttgaatgtcaccatatattgacatgacaactgttgattaattattttgtctattagtaccttgtatatggtgagtattaattgtatattttagtattaatatatatcacgaggtaaatttaaaaagtatatatgatgtcatacttctatatatagtttatatatgtgtgttgttaagttttttttaaaaaaattatatattgtgcatagttaaaagaaatgtaccggaaaataacggcgataatgaaagtgacgatagggatgagattcagaaagttggcggaataggcggcgttcgtgtcacgcagaccgtagtagtacatccctgttgccagtagaactctacaaattgtcaaaaggttgttagtttcaaaatgttagtttcaaaacatagaggaaattatattgtgaggtttggttttttaatttcttaaataaaagggcaattcacttttggtttttgctacaaaaggagtcgctaagggaacagacaaggtggcggcatatagcattcggagacgatggtgatggaaggatatttcaagcatgcatggatgcaattaatagcttttgtgctttagatggttttcattcaagcttggagtagcattggtatcattcaagcttggagtagcattggtatagcatatggctaaaacagtaaaacttttcctcccaataaaaaagaggtaaaactgtgtgatattagtagtggacggttgaatgtaggccttattatgcagaggctagaataaaaaaaaaatctctgtctgaaaaagttataatttaatgcaaattttgcgatcatatataagagaataatgttgagcatgacaagtaaaaacttagccttgtcgttgagtataacagtgctaacccgaacgttgcgttgatcgaaatccagccacacactacggcgttcatctttttcatcattcctctgaaacatacagaagaaggaagcacaggtagaaaaccagaaatacaagcacataaatctataaacgagtagcatacatttttccacacaccaatgcattgtacatcgctacatatatatttgtccaatactcaccccagaaataaacaagtgtggtcatttttaagtattgcttccatacatcgtcaaaactaataaatttctattgcatcatggtatatctttagaagccataaagttcatctaaatttgaggcatgtcatctttagatgatataaatatatataatgtgcctggtttatagttagttctagactccattatcaaaagttctacaagatgagtatacgttaattacatttagaataactttagatgcatatgtcctctatatctatatatacttcccctttaatttctccatatttatttatctatcaccatttggctagatgtagaaatcaaacggcctgatgcgtcacgagcttttgcgtgtttacatattattgatgcaattaagagcaaaagaggtgatcatcaagaggacggcccatggtttcactccacctacatatgcggcgaccatacaatgcagggctgaattcaagtcattttttgtctctttctaacttagtgtttctgttgagtgtttgacacatgcagtgagatgatatttgtccgtatccagccaagtcaattggctcttttcttttcttgcaatttttctttctttaggctgtttttgacacacgaaacgataggatgtattagcacataattaattatgtattagtaaaaaacttaaaaattacattaatatatttttaaagcaatttttctataaaaaatacaatgtttaaccgtttgggaagtgtgcatacaaaaagaagaaagtgtgagttggcaatatagacataagaatacaaccttaaaatcgtcaactagttgggtgggcggctaaaaaggtagcctccagctacgaatgctctcgaactttcctcgactggtagtatacgtacaaagaaacatatatagacaaagataatagcgtaagccatgtatagtattactctagtagtgcaattaaatatatttattatttctttttggaatgaatcaattaattagaaggcatgaatgctatactatgtctttgctcacggctggcactgagatttcgcacgtttcccacgagtttccaaagcacctctctctttaattctcaatttctcatatagtaaatgaattggatcaggcaaataaaatcgtcgttcgatccaagcgtggattagatttttttttaaaaaaatggtttgatttcttttcatcgtttctaccgatcgatgtgctgtacgttctcccattggtaaagcgaacgacgaagatgatgaagaaaacagaagcaagatatatactgtatatagatgcatgcatgagacaaaataatttattaattaaagtgataatatttcagcaatgtgtactaatttatatgtacacgtatgatactggattattggtggtaattaacaaagaagaaagagagagagagagagagagagagagagagagagagagagagagagataatgtggcatttactggacctttcgaagaggacggcgagcggcgcgacggcggcagcgccgacgaggttgcggtagacgaggaggacgagcggccgcgcggcgccggcgccgagcgcgagctccgacaggagcagcgtcaccgcggtgaacacctgcaccatcaccatccccaccggcagcagcaccgccgccgcgcccaccgccgccgcctgctcctcctcctcccgctgctgctctactaccgccgcctcctgctcggccacgccgaccaccacgacggcggcctctcccgtcctcgccggcgacgccatgtatattttgctttgctagctatagctagagctaggggcacgatcgatcgatcgatcgacgcgatacgaaatggaaattaagaagaaaagtgagacgcgacgagtcgatcgaggatgggagtgtgcgagaggcgagcgattgattgagcttgcggtggtataaatagcggggggagagatcgagagagagagagatgatatatggggcgcagaaacggacgaaggtagggatagatgggttggtggctggaattgacgtggcggtatatcagtatcagtgtgtgcatgcggcatgcattctcccatcgtccggtcaacttcaactccacctgtccatcagtggaactggaagtgcgtgtggaatgcaaccggctaccacttcactccatctcagcttgttaccatgttcagtgtgtaactaaacttaattcccaattagagtttaaacttttgtcccaaaacaaccttcaggcccttgttcggttacacagggattcattccgggccggttatgataaatataacaagaaatttataatagatacaacaagagaccaggaatatttattccgggtcaggaactaatttacttatattaggtataacaaaacatccggattagttccacacctcttgactagtggattgattccggtctattattgtccctatcatgagtaaattggttcccggcccggaataaatctcggtaaatcgttgtatatatcctaaatttcttactatacttgtcattctcggcccggattgaatccttgtgtaaccgaacaaggcctaagagtaaattttatagaatccaaactattatatggtccaagtttcttaaagccgtataaactttggccgatgacacataacctcaagtattatggttataacgttttacaaaaccacattactaataattttgagtttggtataccatgtacacttttcagttctacaatcacatctcaaatttatgagcattttattcattatataaatgttacattcatttttttatttcaatacaatagtatgtcaaaatagttaacggtgtggtttgtgaaactttaggagtatataatacctatagtttgtgccacatgtcaagatacctgtggttttgtgcaacttggactataataggtgtgtttaatgaaatttattgtatctttaatttatacatagtattcttctaccatgcttggtccataaatcaagaagtttaattttatccttcaatactttacctacttaaccaccaatactatatattttcctattaataagagactctttggttattttccttcctcgccgaagttctcttaggattctaatattcaacttacttacttcattcaaaacataagcactttgaggttttgcgcatggattatgaaagtaggaagatttgaatgaggaatagtatgattggttggtatgaaaaaatagacaaataaattaaatagatgatggttgtgattggtttccagttaaaaattcgcattgacaaatatttgattatacagtagccaaattgatacgaaattaaaataagagtataatgcattggcagcccttaattaaacttatcacgtcatgttatctaggttcttaaactttgaaaatgcacatctaaatcccaagactatatcatataggttcaaaactatcacatacccccttcgagtgctcgtgtggctaacacttcactcatttaatgacactcaatatgtgaacgtcgacgtcatgcggatactcaaaggggcatatcccagccactaatactggagaggactatggatcggacgtccaatgttttgcataacgtcggacagtgttgcatgacatttgtttcaaagtgtttcacatgtttcatcttttgatgggaaaatatttcaacacaatatggagaaaaaatgattcatcatatgaaaaaaatgtttcaactgttgaaaaaacatgtttcaacataaaaaaagatatatgtttcaacaattttaaattatgatacacaatccaatcaatactgaaacattttcttacaacaaatgaaacaccaattttgacctactgaaacatgcagatgattaaaaaaacaaccactgcaacattttagtctaaactaatgaaacatccaatatgttaagctgaaacatataaaaagaaaaaagcagcctagatatatttattcttcttctccagtggtaggtaggccccatgttgatgccggatcgatgccccccccctttgctaacctatactccat

SEQ ID NO: 63974 - DNA, 1127 bp, Oryza sativa
tgcgttgacatcaagtggtgcagtaatatattcaaatgtctgaagtaacattatgaaaacatcatgcatcatcatttgatgctaatcatgtttcttaaacatctactagctgcaccatcatgacatcaagttgtgcatacatatattcaaatttctgaagtagcaatatagatccatccaaaaaaaaagtacttgcattatataaacatcatgcatcatcatttggtgctaatcatgccttttaaaaatctactctagtgtcatcatcatgaataacaccaatgccagggactccaaaccaagcaatcgcatttatatccaaatgatccgttggttgagagagcatgagtacataactttcttcatgtattgtgacacataattttctgacatagtacgtccactcttgtcaacatgcaagatcaaaggacaaaccaaatatacagtgtttaaagtggctccgatagtgagagcacaaacaagataccaatacattcatggaatcaatagtatcttgccaatgtgggaactttcttccatcaacttgtgagcttcagcagcttctgacagaggaaacgtcttgtatattactggtttcaccttgccttgcacaacggcaggccatacatttttctccacctcactgacaatcagagctttattatcaaggcttctgttgcgtagtccagcagctgcacagaatcataccatttccacacatgctaaaatcagcgatatcgtttaggtatcatccaatcacataattgtgattctcagtaaggcaacaaccagcagtggtataagatcgtaaataacaaaactagaaacacaaaaatctagtatgagggacattgttgcctatagatcaacgttaccttgtatggtcaatcgtcgagcaagcatgggttgcaggttcacttcagttacagcgcctccttggaaaccaatgatgaaaagtctaccatcaacagctaagctgttcaggttacgctgaagatacaatccaccgatgttgtccagaatgacatcgacacctggtaaatatacttccatgtcaagagtcactaaagcatatgcaaacttggcaggtatcaaacattatagacagttccatggagaaatgccgt

SEQ ID NO: 63975 - DNA, 45881 bp, Oryza sativa
accggtgtgacacaactgaataagttagaagacttaaacgagtgatctgcaagtttagggaccgggatgacacggttgaacaagtttgaggactaaacggtcgatttgcgagtttatggaccgggatgacacagtggtacaagtttagggaccagtgatagactttattcttttattttttttttgataaactggcagacgcatcatattttgcttggacttccgacttcttacatggacggatgcatatgcagagtacttctccggcaggctaaaaattgtcgctcgatctatgtacgcaaagcacgacgatgaagtagtcgctactggcatcgctgtctcgtggaaaatgtcagttgttttgtctacagatcgttacgcattaactcatggccactagcagtcaaacgaccctctcaaaaatgggctgacagaggcaaggggaccccctgggttaactttgtcacgttgcttctgcaacagtagtccacggtaccaccaccaccaccacgccaaaatttcttcgcattggaagcagaaatatcttcgctttccaggcttagctacgttttttcgtcgatcccctttgaaaaaccgatccgaacgtgtctgtctagtgtataccctcgagaccttgagtttcccgtttttacggagcacggtacagtggcgaggactacgaccgtgcaccagaaggaaaaagaaaaaggaaaaaaaaaactccgtccgtatcgtgtcatcagatgtgctgtcagcttcgtgcgcccttgacccatctgtagttaagcgtgtgccgcagctttcatgctttcattcaagcagcatgaatgaatgcactgcatgcagcaggcagcaacaacatcaaagaaaaagaccgcgcgcgatgacgtcgaaacgcacaggagatgcatgtgttgatgattggtactggagacggctgaactcttctcgtctggccaccggccgcggcccggcccgcgacacatgcatgcagtcagccacggtcacacacacacctgatcgacctgccgcctgccgtctgcccgtctgccgcgcgctgcttctctctccgtccgatggcgcgtgcagtgcgtcccattgccccctcgttaattttttttttcccgctcgtctcgcgcgcgctacaaacgcgaacggtcccacggcggcgcgcgtacaggcgtggttaattcgcgcatgcatgatttgtaccacagtttgacggttagcctttgcccatactcgctctatcccaaaacggcacaacctaatttaatcttaagacaattattttattcggattaggtgtactagaatagatcacatcttattttagattaggtaattttttttaagacgaagcgagtataattttctctcagatcgaggatcgagctgctccttttgctgctatgttagtactttgggttagagactactccctccgtcccagaaaataaacatttttagagttggacacaattattaagaaagtatgtagaagtgaatggtggagggttgtgattggttaaatagtggtggtaggtgggaaaagtgaatggtgaagatttgtgattggttgggaagagaatgttggtggagaagttgttatattttgggataaatcttgagggctaaaagttattatattttgggacagatagagtagctagagggttcacggtcgatctgattgtctccctccgtcccataaaaaaccaatctagtactggatgtgacatatcctaatactataaatctggacatacctctgtctagatttgttgtactataatgtgtcacatctagtcctagattcgttttttcggaacggagagagtacgtagttaaagggggaagaaaggcgttaggctgatatgtatatatgtatatgtatgccatgctctaagaagacgcatgggtaggtgtgcttttgtttcagaagtactccctccgtctaaagaaaccaacctcgtactacgacgtgattaggatgcgtcacattctaatactaaggttgtatttttttttttgcggaggaagtatatggttcgactaatttctgtgataaggtagatttatgagtgcgatctgatcaggcgcaatggtgcacacacagttgttgcatacacatatatgtgtacgatggatatgccatgtggtgctgatggcgattcgtgtctcgatcgatctgtgccagggcctgcattgtgccggccggccggctgcagcgacgaccatgcgatgcagggcagaataagcgcctttggagcatgcaacctaactccagcttgcaaaaagggcgtggcgacaaaccgctagcggagatcgaacatgcaacatgaatgatcatgcgcgggggccatttcattgtttgatcgtgcgtgcatgcgcgcggttgcgcttggaccggccggccgagcgcctcctccacccatcgatcgctttctctgcagattggaagcagactttatattaatttgtccctccagggacatcacatcgttttatatatggcgttcaaaaataataataaaaataaaatatttatcaagatatatcaatatatgatatatcttttcgcaaacatacgagttaaattttgacttatacaattcaaaacaaaaataatatgaccgtgaattacacgttctattcgtagtcaaatttattatttttatttctacttatataagttgaatttgaattttttatatttatgaagtgacatataacatattaatttatcctactatatttttttcaattttttttataacctaaaaatggcccaaccatcatcacgctcatcagctcatgcattgtcgctcgataggtgcagttgggagacagtagtagagattcaggggaattgaaacaacatttacaaacaaattaagtgcaaactctaaataatgagatctgctttaattaacgaactactccagtatttaaccgtatgacgtcatacagtcgactgtgctagcgatattttgctagcggtgcttccatatttagccatatgactttgtgcatagttagggcaacgctctaaacagttaatggaggtatgtattattcatgccacgttttcaaaattgcgctttttgggtcaaacaaaattcctacatccacatttgttatatttataatatttaggacctgttttagatccctggcaagttttatcaccatgtcacatcgaatatttaaacacatgcttgaagtattaaatatagacaaaaaaaactagttacacagattgcgtgtaaattacgagacgaatcttttaagcataattgcttcataatttgacaatatggtgctacagtaaatatttgctaatgagggattaattaggcttaataaattcgtctcgcagtttacatgcggattctgtaatttgttttgttattaggctacgtttaatactacaaatgtatgtccgtatatccgatatgacacggcaaaaattttcacccctggatccaaacacagccttaatctaatttacccgtatatgagtaactttcatccagtcataattaataaatcaattcccagttagaagaagttggtagaatagtcgatcttagggtaaatttaagataagctgaatctatcgtcatttctttactcatttggcattctaagattataacttaacaaacaactgtttgagataacctagctaattacttcctccgttttataatgtaagtctttctaacattgtttacattcaatatatatgtgtgtctaaattcattaacatccatatgaatgtggacaatgttagaaagtcttacattatgaaacagagggagtatatgatttcaaacggtaatgctacataacgttatctcattccaaggcatggaatgagatgctcttatgctctttcctccgcaaatgcgagggaggggcacgccttgccgctgcatggttcaaccagcgaaaccgcctaccgccaacactattgcctcttgctcctcttcctcctccgcagatcctcgccaccgtccccatctccgcatgcgcagtcgcctccctatgtccgcctagcaccgccaaacaacgagtaatacacaatgtgacgatgagcctgagcggcatcctctagagtctagacattacggagcaggacaccaaaatgccttgctacagttagagagcttaatttgccaatgacttgatgtcctcctcctcttccacttgaaagaagtttgcgatggacatggtagccatgagcctcctggattgattttgatttgagtcgatgtatttgctacatcctcttgcttctagaatcaatatacttttcctagattccgagacaactgtatgggtacgtacttgtcattgttgcaaaactgggctaagtatgcaaggtggctatatcttgattcatcatggggtagtgctctcttgagaatttacacctgattccgagtttccgacatgtattaggcttgatacacctaggtatcgatcggcctgttaccggatgatatcatttttgtactgatgggtatcacttggtacaaagagggggtatcagatcgatctggtaccggattggcgagtagtactattcaagatgctctagcagtcccctgattcaattatgcagttagcttgtggaaacactaccaaactctcctcttttaaacatgatcgatgaagattcacacgcattattatttttgaacagtattagagcatctgaagctctgaacatgtatggttcatcttcatccgtagcaaatgcatgcacaggagttcagctacttccttatttacaccgttcctagctgtttgaagctgcaaatccggggctggcctgtatagtactacacatatacaccacttggtgtccattaatgtcgaagcatgcgtggcccatttgtctccgaccatgcatgcatgggtactaaccgtgctagcagaggtagattaatggaaaggccagtatatatagcagagtgtgcgtacacatgatcagacagaatgaatgcgtggtcggtctcgacgctgcgtgtagttcctttcaaagttaaaaatttaggttgaaattggtatgatgtactgagactgaaaagttgtgtataacatgttgatgtgatggaaaaagttggaagttttgatctaaagacagccggagcttaatttgcatgctcttcgctgtcacactactacacgtacgacctcgctgaacaaccttagaactgcatgtgatgaatatctagcgagccatcatgccagtactgtgtaccgtagcctgaatatatgcatgcatgcatgcctgacgagctgagtgatcgatcgatggcagcacgttgctgacagcaagcatgcatagacgagatgcatgcatgtgtgatcgatcgaggcgctagctgccgcggtgatagcgtgcatacatgcatgcagtagtgcagagtgcatgatcgaggtactcactccgtttcaaaggccaatatgaacattttcaggatttaaactttattaccacataatagcattttctaacacctaagacattaattccaatatacaaggtgatataatcgagggaaaccaagcaaatcaaaatttaaaatttaaccattaagatgactaatatagtacattttaagctttacctacgctaaacaatatagaggtgtttatatttagaaacggagggagtataagcatttataggatatatataaattttgtaaatactattaagtatttttgaaacattaatttcaatgcacgggattctaagcattttttaactaacaaaatacaagtgttcttaggggtgtttatgagggaacttaggcaattcaattttctttaacgaatcagcacagaccgtgccaatttcattaaatatagagggagtaaaaatttatgtacacgaagtgaaaaaaatatgagttgtacaaagatatgctagggcatcatcaatgattaaggtcgctaaaggaataaggtgggaaccaatagtcttttcttgatcttgagctaggacccactgataaaaaaaactctattcagtagaaataaaagagcatcatacatgttgcaaaggcgtgaactatttttttttattttttatgatctaaccttaagcttaagattgcccatagcaatattccttgctttgctactctcctaataatgcataaaggtagaacaaaaatactactttattccttaaggttactttgcatccagtattagcctgcaacattatagatgccctatgactcttgctttatggtattagctgcgctagccgatctttacaccaacgagcacccaagttttcccttcttccttgattttggctagaagcgatagcataaacaacctcttttgctaaaaaaattctcttgtttcactctttccagatttttagcaaccttatcatgtttgtctttaaatttgttcaacgcggtgactgaatattttcctttatccttaatttttggcaacctaatgatgctttatgttttgaaacgttgggagtagtagctactccctctgatcccataaaaaaccaaactaatatcggatgtgacacattctaatactacgaacttaaatatacatatgttcagatttatcgtactataatatgtcacatccgattctagattcgttttttataggacagatggagtacgtagcatgcaggatgcagccaagagaacccatccgtggccatcgctagatctatccattaatccatgcatggatcgatcgatcgatgtgcagaggctgcagacatgcgtacgatggcagaaggacacccaaattaattaagctcgcgcgcgcgatcgatcgacgatcgatcgctatagctactagctatgtggatgagagcagaaatcgataattaattatgacaattactactgggccggcgacgaacagacacagagaaccacgcatatctgcagctcgatcgatcacactgatctgcatctgcatcgatcgcgatcaatcgatcgatcggcggacggcgtactgccacctgctgctgatcgaactgctgatatatgcgaggccattgcgcctacgtacgcgacggcatctcatgcgtcgtcttggctggcctcagctcaaatggggcgggagctactgtcttggcctcaggccctcagctgaaatggggcgggagctactgctagctgtgagggtagtagcttgattgctgctacggatagttcagatgatattgagactggcagccatgcatgctgctgctctgctccctgcatgcatgcccaagggctgcatacccctgcatgcctggccggcctgtatacatcgatctatccatatactacatgcatttccatttcagcttggtttccaggggcagcaggcaggagagggaggctgctggctgctgctgcagctagcgccactgcactgcacacacaaacttaaaggtggcctttcattcattgcccctcgctagtggccgctgtccccaacactgctcctctgcctgcctccatcctccccccccccccccaccacacacacccaaccacaggaccacctcttcgatctctctccctcctttttcagctgcaccagctgcaactctctcctctctctctctctcaccgagctgcattgccgcagtggtcactgctcagatcagagcggtgaagcatgcaattactggctgactagctagctgctgaaacgagctcaaaaggaaagagctgagctgagccgggcgcgcgggcgaggcagcatatgcatgcatgttttgtatgatgggcaatgaaacactgcaggggcaggcactagctacttgcttgactgtgcctgctcacaggcagctagctgtgcgagcctgcatgtcttctagtgtgcctcagcgaggaacagagatatggatattactcgtaaagagattggtcctagaaacagatcgatctgcatgcatgcctttcaaaccccaaaacaattgtttgcttgggttgcaaccatatggtggaaagctgtcatatatgctagtattgctcatgtatgtttttctcacatttgcagcaggatatcgcaggtgtttccatggccaatttctgtgtgtttcctacagcaattatggacttacagcaggtgtacatgtgcgtgacccagttcttttttaattccatcaccaccgccctcttcttatattcattcatccattaattcctgtgcttgctatccattggggaccttcagttagtttgggccctctgaatgagttgtcccaaggaacaatctataatgatgttctgatgactgccactgcatgttgtggtgtgtgtttgtcgccttgatgtgtctgtgcatgctagtagtagtagtatattgcaataaaccttttgcacacaagaaaggggagaatgctctgaggcgagacatggatgatactcctaccgaggaggatcatattcataggttttgtgcggtgcagtgcgtgctagcgcctgctgcaagcaggcatgtatcaagattcaagatatggcatgcaagatgctttgcacttttttactgtatctgggatgatactatatactcgtactatgcatgatcgattctcgcatcgcatgcatgcatgagcatgactttgccaatgggatgtcagtgatatatgcatggctagctcatcgcttctgggtattatgttgcagtgatgcagccttgcttgcacggcccaatgcaacggaaagatcagaatatactctctccatcctaaaagaatttctatcctggctatgaatctgaacacacaatatgtctaggtttctaagttaagattgattttttattggatatatcattgatctcctttcacatactcctacctactcctgaacaggcacaattaaaaatggtgagaaagaaagggcaagatcgcaagaggaaatgtcaattaactaaataaataaatatataatcatcagtgtcatattgtgtgtgtatgtgtgtaagaggaagataagggggagccgtggaggcacaggtgagaactgagaactatgctcgatctttgagaacgtgagaaacattgcaaatgatacactgctgattctgatgggtatcatcgtcactgggtggtagctactattcatatggccaccgtataaagcagctagctagggaacattgttctgatttatgacatgcaccagctagctagctagactgatatttactccatccatatatgttttcttcatccatcctaagatataaagctgctccctctatccgtgaatataagagattatactttttttttaagaattaaggaagtaagaaaatgacatgtgatgagataaaatgtgatgtgtgaaagaataaagtagtactctctccgtcctttaatataaaatcccttatattatgggacggagggagtataaaaattagtaggtgggagaataaattagtataaaagtagatggtagatgaataaattagtacaaaagttggagaacatgatgctgtcttggaattctaaaaccccttatattttggaacaaatttgataaaaaaatctcttatattcatgtatggagggagtatacctctgcagctcaatatacatatatatttcgtaagtacatataacatctctctaaaagtgttatatataaaagtttgatttattttaaataaagcaataataatattgtacgcttattgaggatacattcaaaattcatccttttgtgtcgaaatgacttcaattatatttactcctccgcttcatattatttattgttttagctttgtcctaagtcaaatattcctaagtactttagctatatattaattttagatattcatatagtttataatatatgaattatttatgtaatgaaagtatttatcatggtgaacctaaaacaatactaaattttataaatgttaaagtatataattttctaaaaaaaggtcaaagttagtaatatttggcatatataacaaagctaaaaacaacaaataatttgaaacggatggcataaagtattttaaaggcaaattattgggtaattaaaaatagtttgacttaacataacgggagagatattaattagtaattaggatagcttgagccagcattatgtatttgatactgctaattagctagagcaatgaacaatcaaaatcaaacaactgaactgacctattgctgacagttttctgtgagcatgagaagatgatactaatcccaaatccttttccttttcatagaaatgatcttatctgattatttctcccttttttgggtccaaatttatgtctttactgaggataaaagtaggtgtggtcctgctagctactagttgatgctcaaaagatggatggtccctagactaaactagcctcctagatttcgatgttgaaagatttgtaaaggtactgtattttagtgggaagaagaatattattcaacaatctaacaaaattcaaaatcaagtatacatactacctgccactaaatgttgatttttttagagaagggtatttatacccagcctctaaatccaaccggatatatgcagcctttttaatttagaaacttagccctcaaataatccaatctaaaatttgcttctacgaaaatttgaactcagcatcttgaagtgctacttagttcactgcaaccactagattacgtgccctttcacaccaaatgttttgatatataacatctaaggatcttcctttttgcaaacaactctcatcagctttcaagaccatactaattcaaagaaaaacaattaaaattccagctgatatagctatactcatggaacactaaaaactctttaattagttcaacctaattaattcaccagacgaagttagtgtaatccgaggaatagaaggtgttctatgaaattaagaagcatatctaggcattggcatccttgtatcttgctaatctaaccccatgttaatgctagtagcactttgatttgttgtccactgcacacagggggtgctagttgattaattaggtcaagcgtagtttatttcatcgtttgtttgatggcttatatatcaaccgcaacaaaatttaaattttaaaaattatttttaagttgatttaagttttttttactatagtttattttccagcgttgtctttaaattgttaattaggaaagttataaagagttttccctcaaaataatagttataaagagttttctcttaaaaaatagttataaatagttttatctataaactattttttattgcctagtcatagatcgagcaaacgatgcatgagaggtttagccaggtcaagtgtacatatgtaaatttaggaaagcatgtatatgcccgtatatacactccgctaacatatggcattgagcttaatgagcttatcagctcgccaggtcagctccgatcctctgctggccaaattgccaatatacgatctatacgatcgatcgatcagggagagtgaagtgagccgggggagcaacaagggagagagcatatggtggtaaaaggacagtgacgcgacagcgacgacgctgatcatttattcctcagtgtaaatacccaccacaaagcttcacaggtcgtcttccacatccttctctccgacgacgctacctagctaagctgctgctctgtagctggcaggctagggtttacgctagctgatcggagctaccaccaacgccggtggttggtagctcggcggcggcgggatcttcttcttgctcgggttaattggcgagctatatatatatctagctcatcggcgggaaggggaaatctcggctgacttgaagggatcggaggaggccatatatatgcatggctgagttcttgtaagtgtttctctctctgaatacatctggagccggtttgggtgtttgatttgttaattcttggcgattattctatggatttggggatcacaaaattatgtgtgtgtgtgccttttgagagtttttaatctccccagctttccgtggtccttgattaggattttatgctgtggatctgagcccagatttgttaattcttcttcaattattttctgtgagactgtacaattccctcttggatttctttcgtacctgagttccatttctttttccatggaaggtttcttctctgaacctgcagtactgggtcgccaaccaaataatctttgtttcaattgcaccggatcgcctctctctgatccttttgcttccggaacgacctggttgatcgatctgtcaatttaattatccattttgcccactgctcttcatttttttcctttttttttcctgaatatagtgttcagttctaggaatccccaactgagtaaattaatcctctgtcaagcctccaaaaaatttcacctttttcgctcgccacacaaatttcctccctcgatcgattggtttcaaagagcacaatttaaaagctaatgactgctacagttaaagactgggtgcatgctgcaggccctgcaggattagctagctagcaaaagctattcgtctcggcataaaggctagcactcaatacaaaccccccgacccagccttctcctgttcctcattcccatgggcaaatagtgatcctttgtacgatccaattcatagctcttcttcccaccggcgagacgaatcatgcatggctgctcgattcaatcatggaatcatatcattcccacacatagtgccactgctgatggctcgcatgcagctcacccagctagagctgcaagcgcagcagggaagagccggtctttcgatctcgatctcgctactagctactacctaggtagatcgattgataggagtagagatatagctagctgttgctcgcaaatacgcagcgaataaagctggctcgctttccccattccccaatggaacagtgacacaagcagagagagagagagagagagagagagagataatccgtcgagatcgggtggtagacccttccgtgcacaggagagatttatttaccccgggttaattactagtagtgctggttgattatggcgcgaaatttatgctaatcagtctgcatgcgatgttactcctaattaattaggtgttgttgtgtgtgtaatgattgggtagctagctagctaggtggatcgaggactgacgatgggaggatgagctcgaggaggcgttgataaggatgatactaggaagcaaccaagcggccgccgccgcggctgcggcagctgcggcggaggaggaggcggcggagctagcgaggaagcacacggcggcggtggcgacgtcgcggcaatggtcggcgcagacggagtcgcggatcgtgcgcgtgtcgcgggtgttcggcggcaaggaccggcacagcaaggtgaagacggtgaaggggctgcgcgaccggcgggtgcggctgtcggtgccgacggcgatccagctgtacgacctgcaggaccggctggggctcaaccagcccagcaaggtggtggactggctgctcaacgcggcgcgccacgagatcgacaagctgccgccgctgcagttcccgccgcaggaccacctctgcatgggacaccaccaccacctgccgtcggccatgccgctgatgcaccaccacggccaccaccaccacgccgacgacgataagtaccacgtcgcggcggcggcggccgcgctggccgcggagaaggaggcggcggcggccggcggcggaggaggaggagggggagacgacgtcgacggcgggggcggcggcggagcggcgcacatagtggggaggttccccgccggtggctaccaccggttcatggggctgaacaacccgctggggatggtcaacagcgccgccggcgccgccatgccgttccactacgccggtgagtcatggaataatggcagcgtgcaagacagcggcgccggctcgccgcaggtggccgccgccgcggctcaccacacctcgccgttcccttcactgctttccttggctccagggccgcatcatcagctggtgttctactcctccgaggccgagcagttcacagtagacaaccttggctcgcagggcttgtccctgagctcggcgagagctttccatgatcagacaggaagctaagcaagctcgatctacacagtacacacactggaacaacactcttcgatcgtcgacaaggtaaggatcgatgagctctaccaaaagaacaaatctaagctagctagtgcaagtgtgtgcattgctttgatctatgtattaatttctttcaagggaacaattaagcttgtgggttaagatttaagaaggaagatactgccagctagctggctgctaatttcttttgctctgaaactagggcaagaaatatgcagggctttgctgcatatgcctgtgtgcaatacggatttgttacttctttttatatgcaaagaagtaattgatgtattggcttgtgtaataattaataagttctgaattttgaacctttcagttctgcctagccttaattttctttattttttcaaaagggaaacttctttgtgtgtgtattcagttttctgacgccgttgctgcatcccaagcttcctggctgtacacaaaacattgggcaatgaatatctggttgacacactgcatactgaggaagtatgtccctttttccagttcattctgcgaaatataaatacactccctgcaaaatactaatttccttccaggtatatgtagactgaaccctgaagtatacattatttatattctaaatgtgaaacaaagaaacttacagtggatatttcttaatgttggaaaaaaaatgctggtttcttatgtgaaggaagcatatatatacacatgattatttttcttaactgtcccaataaattaaaatggtatttttaaattatttcagaaacatggaaatagtatagtgtgctttgatgtttaaccctatgcttgaatgtttttcgaggaattaaaacttataaagggctacaactcacacaaagtaaacaatttttcacctcatgcatatatgagcttgggtaatagtcaatccatgtgattccacaaggctattaattgcagtcataatatacataatgcaatgaaatatctatatatgggttaatggatatgtatgaataatacatacatgcgtcgtcattgtattaatttgagatctctaccagtacaattaatcttacgtgtacacatcttgttattttgaacgacacatgaggtcacatatatatagctagatatataccgtgccaaagtaacaagataaggttctatctgcaggttaatgtttattaacacccaaacatctttacaactcctacctagctaagtttaactagagaaggaacctctttacaactcttaccctagctagttcagtttagagtttaggccgcttagggacatggtccacatgaatatatagagttatgtaaaatagtaggcattcttccatgaaacacattgatagtacatgcctacaattatgaaaacggcaagcagctcactgaagcatgataggaagataaacataatctagctaagcatcatcttattgttgtacgtacgtgcaagtgtagcattatattgcctagtcacaaataaattaagaacttaatttagaagctagtagcaaagtaaattcgaagaggatgctgaagtacccaggaaaaagtatattgaggctaggaaaggatcagcacaacgttgcaattaattgtgaaattgtaaaaatgcagcaaaatgattttcgatccatttattaattaggtcaaagatacgtataaccgtaccaactgatcaaattgatgatcagattgacatgtgaaaaaggaggatcaataaattatactcctagtatatgtattggggcatatatgttttcacttgattgataagccggctaatcctatatagcttaagaaatcatcaattactatgttttctcatacgtattattgtcaaattaatatatatgtcaattaagttcccaaattaactttctcagtcaaattgatctgctcctcactaattaatttgccaatttgttatgaaaaaaatgcatatgctttacacttttcatttagtatataacatgattaaaggcagattttaccgaaataataaattaaactaggtacaggaaatcatatgactgacttgagttgatataaattcaaataaggaaatattggtcatgtttatttcttaaaatacggacatgtttaagcaaagattgtgcttatcacatggaagatggaacttccttcaagaaaaaaataattaaacttaattaatggtagagctgaaaatgcttttgaagttttatgcggcttgatcgatcccatagaaaaaaaagaaaacaatatgattgtatatatatatataccattctttcattactctatatactatatctggtttcaaataattgtcactttgagtcttcgatcatcaataaatttaatttaatagttagattatgatgtacaaaagtttcatgaatatatttaggatgcaacacactttgttcatatggaatacttctaagcatttaaaaattttcttaacaaaagatgaatggtcaaagtttgaaaatgaatacaatgacaagtatttgaatactcatgaagtatatactccctccgtctcaaaataagcgcaaccataaattttcgcgtacaattttgatcgtccgtcttatttgaaatttacgattagtatttttattgatattatattataaaacatgaacaatactttatacgtgacttatgtttttagtttttttttcaaaaaaattttaaataagacggacgattaaagttgggcacggaaactcatgattgcgcttattttgggacggaaggagtatatgggaaatatatacattcttcatttcatatgaatagatatgtgcacttctggaaagtcaaaatgacctcagatccacaccagttctacaaatataaatatttatatatagtagaaaagatgcccgtgcgttgcaacaggggaaggttttttcatcttattattgttatacagtttagttaaggtaaaattactgtgcggattcgcttggatatatatattttttagaaaatcatgagctacagttaggatcgtctcaagttagcatgtgagtttttttaatgagatttcttatacgacgaattctgtatttccaaaagcgaacgaatttaaaaactgactcaaatacggatatgtatttttaaaaggaaacttaaaaaccaactcatacacagatgacgtaccaaaatactggtaaaaacattttaaatttttataatagtagagaagagttatacgtacttgtttttcggacaatccggttttcagagccagctagtacaaagtatttcagaagtcaagacctgtcctcagatgactacactcattatatattttgttcgtgcatgcagaatgcatttaattctagacgattgttggcgaaagaaagacaaactgagcagctcaaacactgttcacaccatacactcctacctgttgggactagctagctagttagatggtcacagctcacaaaacataatggtaaagtagcgatgtaaagagagcagtattaccgaccagctcgctagcacattcaactcgaccctgtactgatctgtcctctatctctctctctctggtagatctctgacccgtaaacatcatcctgcgtcacccccaccagcaacgggatgcccaaagaaaacaacaaaataagacacggtggacacactttgttggcgcagacccaccaactaacgcacagccagctagctgctagcttagcacaaacctaattaagctagaggctagtatagacaacatgcatgcatcaacataatatgcatatcacttttgtaaatggtaacatgcctagatagctagcttacctagctagctaaaagtaccaatcgtgtaaaaggaagatcatcagcagaaaggcatgcacagttacacgcaagaaattatctgttaatctaatcacgggtactgtatatgcatgacaattactacacaaccacctaacattcttaactaagaattatccgcagcagcagaagcagtggtaatatcctactccctccgtgtttaccattcgtcttattcaaaaaatttaagtaattattttttttttcatatcatttgatttattgttaaatatactttcatgtttacatatagttttgcatatttcacaattttttttgataagacgaacagtcaaacatgtgctaaaaagttaacggtgtcaaacattttgaaacggagggagtaattaactagtactatggatattccacaacgatctggagtagttgttttagacatatataggctgctccagtctatatagggcccatttggaatgtaatgtattatatatacaagaatttggatgcatgtcatgcatggctagtttaatcatacaagaattaaacatgaagaatcgtttaggcactgaaatttgcagaaattcttaaagaaaaagtctgcacaatttatcttagacacacacacacacacacagagatcagaaagatcagaatgctctgaaacatctcaaaggaaatgaaaatatgaggtctcagcatatgtttgaagtcatccaaaatatggaggaaggaaagggattccatggtaattttcaatctaaaaaaatccgataattcaaaaaggttctacaggaaatattctatatagtttaagcctatgaaaaaaactacacatgcatctcttaacaagtcctaagttttagaaatataatgttcctcattgttggattactactgtgtaataatgtaaagttttctaagaaaagcttctacacaccattcattaaattgagtgggtaatacacaaagacctagctaaccacaaaatttaacagtatggtgtacgttaagaagcaatggcaaccaacagaccacaaataaattaaaggagaagagaacaaaccgaacaagtgaacaacagctataagatctcgaggcacacatcaaagatctccatactgaccatatatatgtagccaaaaatggaggcaatgaacaactcccactgtactccaaattaacaccggagcagatcaacattctcgacaactttggaggattgattggtacgaccagtaaattatggtgaagacaccctctcatgctttaagataatcggtcccatatttgccaagcaaccttggtgaaaatcataattaagacgtactatcaactcgcactgaagttcttctttgaaaattctgtcttacatgttgagccaccaatatccatgaatggagaatcaccgtgcggcataagaaaatcattcctgagacaagaaagctagccactgagatactagaatacattgacaatgtgtatgtattagattaatattattcaagcaaacttaattaacccaacatgacagttattcttcttgttgtcagtcaccaccaatatttgaccgatcactaattggtaattaagtgagattattaattagcagaccaaacagcagctaagacctgcgtatcagcggttcattctgcgtgccatcatcctacccatttgaccaagaggaaagcgagcactgcgtacgtgggggtcactatctcatcttgcgtgccggatcgatcgattgagagcaatatatcagggctaggtagatctttttccctccacgtacgcacctttgccaaagctgaacccaaatcccaaagcgacctttcttttgtgcactgatctaacaagctatagctactcgatcatctgcacgtatatgtgcttctctgcttatttggggaaaaaagacgctgttcccctgccttagcagcggctactactagctagtagagccgaaaacatttcctgacaaaaacccttccaaacaactcctgctgtctaccgtggacaagaccctgcagggtcaaagacaagctaagagtaattaggactttgtttcaaaaagaaagccagggttttgaagatactacttcgtaattactaggacttgagccttaggagttaggctttagctccataatcctatttacatgctataaaaaatactatacaataattcaaaacataaattaagaagtagctaccaagggcacattagctctgctctaggttcagctctacacccctgaataaaacatgaatatctgcaaagacattgcccagctgagaaaagacagccttttggttgatttgtatatgtacacatgtatatacagaggcatatatacacacacacacaaccatgtcttatctttgaatggcatacctaaaacaaaaggacaagcatcttaagtttgcaaaaattttgtctccgtgaccaccaatcatctagcctagcagttccccaagaaaaaaagaaaaatcaagctgctatagctagcaagcagcaagcgaagggaagtgaccagtgagtggggttgatgagtagtaaaagaccagcagtggggctggctctgtggctggcctggcctggccggggggctggtctttggaggcgagctgagctaggccccctacggttaaagcgctctctctctctctctctctctctctctctctctctctctctctctctctctctctctctctctctctctctgcgtgcactgtgtctgcatagccctgtagctagggtttgcatgcatgcagcaagcagttagctaagcagatgtacccttcgtatcttttgccacggagagacatggaccaatatataccctttcacatgaatggtcccctgaggctaccacgattcctccccacatttttcctatcaaactcatcttcctttcatctttagtttcatccgtttgttaactttgagtatagctaactagcttagcaacaaaccggtaattagctagactagctgttctcatgctggaaaagtaacctagcctacgcatctagtaattatgtaattatatgcatgcacacacatgaaccgattttgatcaacaatgtagccaactagctagagcaatagattgcacgctggctatccttaggtgtgaatatatggtgtatggcagttaaggttgattattattaagggagatgatgatgaactgtgtagtgtgggctgtggcaaatggatgtgtcttgcatggtacgtgacagacgagcaaattggacacacgagcaatgatactctcgtaagattatgctttggagagcagtataggggagtggcctaccaaatgcatagcctgtaccatgcattatcctcatttcgttgatcactctttcgtttatctcttctgtagcatgactaattctatagtaggtacgtgcgctagccgctaggtacagatcgaaccgtgagtttcttaactagaaatggggagaaaagaaaatcagctaccttaactagctgctaccaacctaaattctgtaagcagatgcatgcatttcattaattaacagaatgcgatcgatgcatgcaaagggcggttgctcctcgcggtattttagtcgtcaaactgattctccccatgatctattgcatattttgagctatttttcaaaaaaaaaatcacaaaagcttaattaagtggaacacaaaaggcgaacatattgcaactgcgttaattcgttttttattaagaaggaaaaatcacttgaatgtcttctgaaggccgtcgtacgtccatatcgcgaaaaatcagtgtgttaaccgacggtcctgacgaattctacctgtgaaggaaaaaaaacggttccaatataatgtagtgattgcacgtgtacgtataactactgcagcatacagcagacccattgcatatgtacaattaacctggcgctacagtatgcacgggtattacttcctccatcccacaatataaacatttttagagttaaacatggttattaagaaaagtaggtacaattgaatagaggagagttgtaattcgataagtggaggtatgtggaaaatttgaatggtggagggttgtgattggttgagaagacaatgttagtgtaaaaattgttatatgttgggacaaattttagaggctataagttattatattttgggacggagggagtacctgacggaggattaattggaccttgttcctttgcagctgacgcatgtgtgtacaatcaacctgtcgccggcccttaagaggctggtacatctgtgtttgcagtggacttcgagctgggcctgcagcctgatgggccgacttataggctcatcaagagaacatgcatcgatggttccatccatgccaggcgaggcgactggcaaatggtaatactgatgcgtgacacagccggccgcacagcacaggtgtaccgcgtgtagcatcgcattatcattgcaggatagagcagtagtggcgagctaaaccctctccaacgcagtcggaccataataaaccaactgtgccatctgcttggagccttcgatcccgacctcccgttccctggcaacttctgagcttaattactacagtaccatctgtccagctaattatagcacccgcttgcacgcgagcagagacatttctgcatcacacatgttagtatgctattgacaaattgtgatgaccagccatgaaaatgcccttgcaatccaccacagggataaatgttattatgttaaggatggtttcctgccaatcagtcaacaatatctagtacgatgctaccgagatattctccaggaagtttttaagcattcctacatcagagacttggacgagtcgcatggtccatgagtaactcgtcaaatgacatgttgcaactatcagcccaccagatggagtacatgatcagatccaacccttcctgattcgagcccatgcaagagcagctattagggcaccacctaaatgagaagtacctgatacctgaccttgcctctaaaaaataaacagatatcagcctctgtacaactttttttggggaaaaggaagtatatatataaaaagcataaattagataaatgtaatcatcaagaagaaagatataaaacatagaatttcaactagccaggaaaggctagtacattctagaaacagaaacatcacatggaaaaatcagtaaaatattcctagccaccctaaatgtgaatatcaactttttaaaaaatatcaggttaatttaagaccagagctactgcaggcaggaacttcacagagtaagcgattcacaaaaatcccaaaattgaaataaaaatgaaagtagcagtgtccaacagctatactgtaatgcatctgctgaaccagcacactaccacagtcaaaactcatggaaaagcaacagggtagcaccaaaaaaccaaaaggagcacttattacattagcaaatccacatgaaaagaagtcacattttaagttactgcataccttcaccctcagcaaatcagcaccgatcaaaatagccccctgaaaagtcaaagagtttttgttttacatcatagcaaccatgcttaacagaaagttttgaagaaaaaaagcttctcaccataattgcagctggaataggaatgaagaagtaaagatagactagtttctttggatacaaaaagatgtcaagaaggataattgcattagcagcagcacttgcaccctgattcacatgaatataataggttatgttttgggtgtaacaagtaataacttagtactagtacaggtagagatggcaacgggtaatccccgctggggaatacaacccatccctatccctgcgggccacaaatttccccaccctcgtaaactgcaatcaggaacaattttcccatcccaccccacgcggggaattaatcctcatggagggcccgtttaaaacaacatatacatctcaaatcgaaatgtaattaacaaataatatccacactttatataaatatactagcatatatccactaatccacgtgacaacaacacaagatcttcatccactaattatggctcgattggacctttaggcctacataatttgcaatggacttggatccctatcccgatttttaatcgggtatcctcacgaaggacagggatgggcaacagaagatcatccccgcccatgctagacccaagggggcataagtttttccacatttaatttcccgtggagaatcagttgcaaccatccccgtcccctgtggaagaattccctgtgggggaacagggaacgaggctccactgacatctctgagtacagtagcaaataggatatccctttgttggctatatatacattaaattaaactatcatagcgattcaaatttgcagtactgctttttaattaattatttgggtgtataagatgaacacataataggtaggtgggaaaaaatcgctgccatcagactactgatgtgattatgtcataataatgcttgttttctgaataccagcgcgaaataaagtgaactgcaagaacaagaaatcaataaatcacatacaagcgcaggagttcttgaattgtcccatccgccataaaactgcaaaataaatattacatattagattagggagattattgcaaaatcataaatattgaacccttttcatgcaggatatgtcccacacgagtgccaataccaagaggctggttggcatctagtagctagcagcgaactaccaggtactagcattttcacaggttagcttttcttaactagaaatcacgttgacataggattttgtttcagaattggatgacataggacatcctggtccaggattagaaatcctggttccctgatgcataagaattcacatcatatccaggcttacctgtcttcgtggagctaggaaggctttctctagcaagaagaatgcagatccagcaagtgctcctgctacgtacaacttcagtagaaaagcaggaccaaacatgttggaaatctgattcacaaaggaaaaaaaaagcaattcagcacatgcaatataagtaataaatggccaatagaaaatcagagtacaatatatatactagtcccttcatttggagaacgaatcttaactacactaaacatgataaatagaaatactaaaattagaagggaatagttatatgctattgattttgtttttataaaatggataaaccgtatctagtacattcaaaccatggtagacattgaattcccatggcaaatcattgcaggatctctctacctagctggctatttcatcagacctgaaaaacagcctcacatcttctcctgcatggtgccttcatcagtcatcaatacgtacaactctgattggctcggttgaataactagcacaggaaatgtcaataacctctctgtgtgtctctggactgatggaggggggcttggcaatgaagtattataactcttcattacatgtgacctttgcaagaaactaatgaaacaaagaattgttttacaaacatcaagccaattttaattttttttactagagaaaaaatataatcaaaatttgattggtcaaattcaataatgtcaaaataaagaaaaattgctagatcaaattcaatactccactaccaaatatattactctttcttaattttacacggtcaagttcacccagcatgaatcatgccaacaagttgatggtaattcagacttgcttgaaatattcaacaaaagatgctggaattcagatgagcatatattatagcaacaagatcatgtcttggatcaagtgttagataatgtttttagtctacactcaacttatgattctttgactgatttgataattcaaaacagctataattcaggtgtttcagaaagcaaactagtaatagtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccatagggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcgatgtcgaagcggcagggtcccccgaagcatcagaaccgctacgcgtggaagcccaacctcgggcagaagatcaacgagaccgtgagtcctcgagccgcctccctctccttctttatcctctttttttcaaggcctgagtctcacggctggaatcctcgccgctgcaggagcccggcggcaggttccgtcctttgtcggagatcaccggcgtctgccagcgctgcaaggaccaaatcgactggaagagaaggtcgggagtccccttctgtagtcgtcgttaatcttagctcgtaattttagcttcttggcctctcggtccgatctgtttgtctcttcttggcagatacgggaagtacaagcctatcgttgagccggcaaaatggtaccttctcttgccctttttcgtaattatcgcactcactcgattgatggaactatggaggagtgggcagtgatggatgctgatagttctcgtttggtttttgcagtcagaagtgtgggaaacggaacgtccgacaggcgtatcacaacgtctgcacgggtgaatttcggctactccaccatgtcgtcttttgctatgatggtgttgatgttgttactgatttctctgttgcatatgctcaatgcagcttgctccaaggaccttgggatttgcgcgaagtgctgcacttgtgttaaagcgcttgtcggaaggtgatccctgcttgtttactatgttgtggtactagtattagcataaccaaatgatatcctaactttgaaacttaggtggctaacaattttctaccattttctagggatcttagtgaacaggagagtgagcgcaaggaactagaggaggtttggttgtgctatatttgaatggagattgttgtgaacgttttcttttgtgctgactattaaattattttgtaggccataagaggtgctagggagagggagaggcgcacacttcttcgccttgtgagtacttactatggcatgtttttaatgatatatctttatctgattaggtatagcgaatgtttgtcttcaagggatgcctaatcacaatatatgtttcccatgatatctgaaggcagcactgcaagaaattagaacaaagattttgtcataattgtattgtttgatttatcatttgaaaataatccccagttcaccacagtatttcgcatatacccttgaatttttcccttttatgtgtttctttggatgcatcgttattttggacaacttaaattatggagatctctaaattatgtgtattctagtattaaggtgccactgcctttgtttcgatgtccaagttgaatgaattaatattatgcaccttctcttcttgtgctattcatggtttttgttgttccaatatgtagcattaaatgtgaatagaactttgattgttttaaattcttgtacacaattgtttgctctggcatcagtggttcgtttaactgtaaggattctttacaggtctttatctggagttctattatattgctatacattaaatctgagcatgtgaatataaatggctggtccatgttctaaagtttcacctgtcttgaaacattttgacctgtaattactaattagtagtatcagttaagattgttttataccccgctccctgtagaatgtaaatatgatctgttaatttagcttttcaggtatggaaaaagaaaaacatagcatgcttgcttagaatggttgcaatatcaagatccatagtacatgagatgtactattattattattcagctttggaacatcaattcttaaacaaactggttgccaaacttttgacttgaaattgtcgagatgaaagtgcattaagattccaaattatcatggtaccttattggaactgaagccttagcttattattctaattttcattttggtaaccaaatggaaatcatttttttagaattgctggtccatttagttattcacgtgaactagtaattccatgcatatttattaacatcaacattttgttgcagatgaacaaaggtggcggggagagcggaccgtcggttccaaagattgctgacagaagtcgtgaaggggacattttccctgctgcatcccttgacgaatatgctgaacaagctagacagcaagatgattcagatgaagaagaggccagggattttgtagaagattaattttagaactcagaaaccttttcttttgcaaaaggatttatatagccttatgtggtgatttacattacatggtgggtaatcccacccactgcggaaaacaagtgtattagttttggcagatatatttccgtctatcagatgtttatcagtgtgtgctcccattccgtctgtgcttgttcaaactgaagaattggaaagtagcatatattgcggtttttccggtttacatgtcttttccccataatgcagcttatcggtgtgtccggaactccggatcagcttttttttattattattccgaggaaaagctcttctattattctcttttttaccaacttattgcgtgcatgatgcccttgaagatgttctctgttctgttcttccctccatgtcaagcgaggttgttttcttcatgtttacggttttatttagcgggctgccaaatttttcgtatacattgaaacgttaaaaagtatactattgttactaaggctgtgtttagttcacgctgaagtttggaagtttggttgaaattggtacaatgtgatagaaaagttgtgtgtgtatgaaaggttgatgtgatggaaggttgaaagtttggaaaaaaaaactttggaactaaacagggcctaagagcacccgctatggtaaagtagggtgctctctataaaacatgtacatctcagcaatagactagattaatagtaaatcacctcaatagtatgtctacataggtatctatagctctctcatgcattgcctcgtttttctctatagactatctctaatctagtagatagctttgctctctctcttcatttaatatcttccaagtaggaaaatatgctgacattgatctcttatagatagcttatagataaccattgtgggtgccctaagagcatgtccaatagcaggctataagccagctgcaaacatattttaaggagataaataaagagaaagaagagcagcaagctacagatttgtattttaaggagataaataaggagagagaagagcagcgagctacagatttgtagctagctgtagcacggactctaagacgcaatgtgtgtttgacaggtgggaccaggtattaatagtgtagtatgtaactattgtatggatgagctattagattggttatagatgaattgtagctactacttagctatactattaagcttgctctaacaggggcttccttcttgtagctcgggttcattaacccaaaaatcttgcccacgtttgctactgtcatgtcagagcatggccaggacatcaaaaccttccataacaaaacacgcaaaaacagtaaacaagtgtctcggcaattcggcatcgtccgccgcccggtgccgttgtgtgcattcgtctcccatgatcccatatcccgtcggcgtcgagacatggaccagactccctccgccagtgccgcacctgttcctcctccccctctttcaaacaaaagaaaacaaacgagatctcatccgaacagtagaacccaccacgtaacgttactctcatctcgtgccaaatcaaagcaaggcaggcaagcaagaggccgttcgagctgcggggacgatatgcaacggccggcccagtcgagatcgggagggccggagggggagtggtgcggccggcgggtgccctgcacgtgagcgacgcagccgcctgcgcccgtcacgcgcgctcccgcacgttcccgacgttgtgccctctgcctgcggccgcgtgtctcgccaaatgggccccgacaaatccaagccgctgatacacaccaatcgctttccccgaaatgccctccccaaagttggaaccctttttggttgccggcacactgcccgcaccaccggtggttggcacgggttggatatggaccagctgtgactattccggcgatcgagtggtgttcttgattataaaccctttgtgtttcaagaaccttttctttttagtttataaacccttagtacatgactgaagttttatgatgctaagcgatatttgttaaaaataaatgatgctaagcgatatgactccactagtatacgagtgttgatttaatgttaaatattatagttaacacttaagatcttaacaagaaagaaagggattgtttagtaggcggacaacggcggctatggctatgccgtcgttgtgtgcgtgcatggcactgttgatgtcgagtatagtgcagtcacaaatctagcagccgaacaaacaaaaatgataaatatgcatccgtgcattatgacagaatattttaaaaaattataacacatctaaaaacctaaaactatttaattaccaaactattcacgtgatgagatgaaaagtgctgagcagtcaactatatcgataatagactataagttttgcatggattattgccccataagcagcgatggcccatcaccgtccaaaaagaagtttttaaagtagtgatataggtttctagttagagaaaacaacaaaggtaatggtcacatcgttaaagatttcataacgatatctttattttttcggcaatagatataacggttacaaagtcatttaataaacattttagcggtaacatggttcacgtcatcttattttgcacttcaatttagcgcacaaataatacacgtggatcaaattacttggcaaccaggggcagcataaacaaagctgactccagagtgagggcattttggtaaactccggacagaaaggcaggcggagtcatccacagtccgcaccattcccccggcgctgcaagcaaaaacatgcccaaaagagcacacaaccttggctggaggcggcggcaggccgaatctccttatcagtccgggataaccccaagctctctctccccctccatccctttccccactcaccagtagccaccaccacatctcgcaaggccaaaagccctagccaccgtagtagtagctagtagctatagcaaggtagagagagcgctctagatctctctctcgcggggcgctgggcagatcgacctggcgatggcgaccaaggggaataagctcggggaggtaatgtgggagcaccggctgcaggcggcggccgtggtggcgctggtggcggccacggtggtgtcgatctccgccatcgggcccaggctcggcgccgtggtctccttcttctggccgctgctcgtctccacggggttcttcctcgtggccgtggccgtcctgctccggatctcgccgcccccctccagcaccatcgacgagtccggcaaggagctcatcgacttcgtcgccgggtgccgcccggagcaccaccccccggaggcggcggaggccgccgtggacgtgcctccggagccggagatctagaaaatcgagggtggcgggcgtggcgcgggcggccggcggaatcagcggcgcctcgtcgccgggcggcggtggggttgtgtggggtaatcgccagcatgggcccacctggaagtgcgtgccacccccggtgtacggtgcggccgtgggctctgtgttagcgtaggattccgcctccgttgtggtccggggtgtacaataccattctcaataaaaacatggcataaattcgtcctagtactactcggtatcgacttccattatgatcgcgtcttgctttgagttgatgcaacgcaggttcgctgtaacgccatgaagatgaaggcgagagtcttaagcagttaagctatacttacgctcgaagaatatgcgagtctgccaatcctcctcgagcctcaaaattctcctcttcatcccgctttagaaagctagattcactcatcgagagctgaaagcaaaagaaatggtgcaattgtaaatctcatttcgcatcattgatgttccgtgagaaaagctataaagacggaaaagagaaatggattgatagtagcgtggtagcaggatgccctttcggcgtaatcggagaccgacactctttcggtgttaaggagttgctaaaccggtcactcagccgtccagttttgctcgtacgcgacgccggttcggacggtcacggacgcgcgtttctcccatcgttgtcgccgtagtaggaccccgtcttactaattctcatctgttatcgagcggacgcaggcctgatggtcactgtcacgaggctgaacttgatacggtttttataaaggaagacgaggccgtcatgctatattctctggtgcataggtcaatgcgtctgacgtggccaccgcgtggtctggtcgggtgcttccatggtgctgacgtaatggtctctttgagctttggattccatggtgacatttcttggcacaaatgaatttagttggggcatttcttttcttgaatatgtttttttttcttgaacaggttgaagcaggttttactagctacgtagttatatgctaatgagccaattctattgattaactgacatcgagaggacgataggagaagaaggtgaccggacaccgaaaaatgcacaaacatttttgtctcgaatggatttgaatatggtcatgatggatgtgaagttctgtagttagtaaatactccatctgttctaaaaaaatgaatctagaactgtccagattcatcatatcctagtacgatatttgatttttcttttggaacagaagaagtatgtattttccaataacttgaaagacacacatgcacacacgtcatcacgcacgcacatcacagtcacacatcctcgcaaacacgctaacacacgctcaaacagaagaggctaacggcgtaactgcgacatcaataataaattctaattgataaagctacaacttgtgcacaatatctatggacgttaggatttaaaaccttagcagacaagattatgcacctatgacatcactaacacatcatcgatggttcctagttagaaaactatcaataacatagcaaacatatttttgacaatgttatcctactaaattttggtgttacttatggtgcttcacagctagccaaatgctacctaaatttccaagaccaccaaatgtattttacacagtgatatcttacaaaaaatgataattttgaaaatgtccaccactaaatatagtactgcaattattaaatgttctgaaccagatttaccgaaacacgtactacttgttgtagcagtgaggactaggtgtcatacctcctattcgaccaagacacgacttcaggccttgatgggcatattcctgagtttcaaagcaggtgacaaaaaaagagttcaagttgctatggacggaaacatgttaattgggcaaatagtattcaagcttgttatagaaaggcaagcggtgcgtggaggatggagaagaagcttggcggctacgttacccagcaagaatattctcttacaagttccctagggtttctagtcctttggattatccatgtaacttcgcatgtaactaccatggctatataagccgatctaattatatagcaacacgatttatactttactgaaatagcgatcatgagtgtcatttgactcatatcaagctcatctcgttacaaggataggcgagggaaacacttcctcatctatccccattatgttcatgacgttgggtcacaacttagggaagactacgcgtcggatgtatggagaattaaaaaaaatcggacataccccagtacctaccattgttgcatgcaccgaacgaatctgccctatcgatttcatcggtgcttattcctacatgattactctcttcaccactctctctcctctatgaccactttatcaacaacctataaacaatttttcctcttaaattctttatctgatctaccatctgattacgtcgttatacttatagcaattaaatctttacaataagatgtcacatgaatatattttgattatatatatatatatatatatatatatatatatgttccaactagtgaaatttgatgtttcatgcgagggaagcaaatgtttcacatgaaattcgagtttgttgcagattttaagttttctttgttgcgatatttatttaattttaatgttgcacatggtgttgtttggatggtttaataactattttcttatgtttcacttattcatttgaaatgttgcacatggtattcttgggatatttcaacaaatgttttgtaatgtttcaacaattataagtcgatgtcatgtataatgtaaaaatattttagttaggatttaacaatattattttccttatttatttgttcttctacatgtgtaggaacatgtatacgtaaatatctagatcgttcaattctctcggccaaatagtgtcgatacgtgcaacacagtaaaatgcttgttgaaacattttgctcatatgcatgaaacatcaaatataaacaattgaaacatatacatactttttattagaatatagtcaaacgagatgtcattgtaaagatttaatcataagaaacataattgtataataaaattatagattagataaattgtttagaagaaaaatcattttaaacaaggaggtgggagagataaaaagctaatagttggttacatcatatccattgcatgctgcagctcatcacatcacatccttccatgctttgttgcatgctgccattatctccaccataaataatccattttcgtgctacgttttgcttgctccgacggaatgttcgattttttgtcgggcgtcggatgtctgataagaagcattttcgtcacaactcacaacacaacctaaaaaaaatagcagtccaaaagtgtaccataatttagaaaggaataagtccattttgcctccctcatctcttgcgcttgcgtgaataacatccctcaaccggaaaaccgggtataatgcctccttcttctctgaaaaccagagcaaatcacctccctcggcggtttcggaggtggttttgtcctacgtggcgggttgacttccatatggcatcgacgtggcgcttacgtggcactaaaataaaaacaaatgtaaataggacccacatgttagtgagtaaaacaataaaaataaaatattgggcccacatgtcagttacctttccccttcctctttatcctcacggcaagcgagatggagagagctagctcggcggcagcaggacggcgggtgctcggtggagcggcggggcggcgggagcttggcggagcagcggggcggtgggagctcggtggagcagcgggagagtcggggcggcgggaggtcggtaggagctcggtggagcggcgggagaggcggggcggcgggagctcggcggagtggcggaatggcggggcggcgggaacgacagggcggcggaagctcggcggaatggcggggcgacgagagcggcaggagtgacggggcggcgggagctcgctgcctcccctcccacgcccctcctccgccacctcatccctatcctcgcctcttcggcctcgccgccgcctcttcttctccttccccggcatcctggcgaagatggacgccgacggatacgcaaagttggcatggtaggatgcagcacaggggtcgtcgaccacgcgtcgctagtccgacgtggacggagccagaacgccgccaccatgaccttcccgcgcttcggcgtcctccatccaacattcggcactcttctcgctgcgccggcagcgactggtagtgtcgccatccaatcttgcgttggggcagcaggcaacaattggccgatgacgtgtgatcatcgtaggcgcgtcctcttcgtgtcacggcgatcctcgtcgccgtagtagccgtaagcagcaccacaacagccgtaaggcacgccgtagtacatgtaaggatcagctccgaatggcacgccgacgccgaagaaggggtcgacgtagcctggcgccgggccgaacgggaagccatagctgccgtggtgatcgccgtcgacggcgagggctccatattctgtggagtggtcacccgccaccgtctcccacgcctttcttggtccgaggacacctgatgagatcgtggcgcttttcttggaagacacgttactgcggctcacctgcgaagcggccaggctctgcggcgccgcctctgtcgcgttgctgctggcggagctccttggcttctcggttccacttgaaacgctcgctgtgccgctggtggtggcgagaacgttggcgatggtggtgcggagcgttgggttggggatcaggtcgtcgacgcacgcctgcgccccgcacgcgcacttggacttggcggcgatgtggtcccggatgcaccagtcgcagaagctgtcgaagcagcacttgctcgccagcaccgcgtcggccatcacgtttcggcaaatcttgcagtagagttccgatgagatgacgccgctagatcccccggacggcgtcctccattcggcactcatctcgcagctgccacgggggatggaaaagataatagaggaagaggagataagttgctgacaagtgggacccacaagttgactcagctgccatgtaggacaaaaccgtctccgaaaccgccgagggaggtgatttgctctggttttcagagaagaaggaggcgttatacccagttttccggttgagggatgttattcacacaagcgcaagacatgagagaggcaaaatggacttattccatttagaaatacaaaatttggtagggttggcttaggcaaccaaccaacccaagccaaccaaagaagccctcaaatctttgtctcggcccataatggccagcgtttatggctcacttctaatgggctgtggcccacctgaaacagaagagtatcgtgtaggcgtatatgcccactcgttaaaaagtggccactctctgacaagtgggccacatcggaacactcttgactcccctccaggcctccacggctccacctccttccgctttcgcctatccgccgtctcccccctcccccttcctcggctcctcgccatctcgcgctcggccgcctctctccctgcttaaaccctctattcgtcttctccaagcaaaaccaaaacccgagcccacccaccgaggtcctctccccctcctctcgctgggccaccacgccatggacggcgtcgcgaggtcgcgcctcctcgtcccgctcctccccaggatctccgcccgctccttctccgccgcctcccccgcgtcagagccagcggcggctgcggcggccgtcgccgcctccgacgcggccgccgccacggactactcgtcctccgcgggcgatccctcgtccgcgccgcccccgccggcccgcaagccgctgggcctgctcaagggcggcgtcctcgcggttgtcgccgccgcgttcggcgccacaggctacgtcagctatggtgcgatctctgatccctaaaactcctagatgcctctcggccctgctacttcgcattgcagtgtttctactaccattctcaattttaaagtgggaggggttcggtttggtgctgtgcgtatgattcgtgctcgtgtttttgtcttgtgtagcttattctctggatgaaattgatcagaggacgcgggagttccggaagaactcgaagcagcccatccgtgatgacctgtccggtttcgaggtaatatggtagcatgtcaatatgtcatgtttgggtgtgtgataacttgtcgctagctggttagtagcgtgactgcataagtaagcagtgatgcccttggaaatatgaccgcataattctgatttcctgtgtaaaaaaacttggtttcatggggtgaatatttgtacacagctatagggtagttgagatttgggcatctgaaactaaaagttattctagtacgacacaatatgttctattgtagacctgcattctgagagtatggataaaagctaaatttctgaattgggttaaagaatttggatttcagccatgtctaatagacgatttgcttcctctctgcagaagtttcaggctatggcttattcagcagctatgaaaggttctgaccacatgactccttcattatcttaccatattacctcgggattatagagtttcaacatgtcatgcatacctttcttcatccacatcaggagcaatttaccattacatgttattttttctttgtaaaatacttgtttgcagccaaccttagggaaatttaccctgcttcacagtgaataactaagccttgtcactctctgaaatataattttgtatgcactaaagtaatggtagtcagaaagatctactttactgtatgcatggtgctgttgttaagctgacaataaattccaaatatgtaacccaaacttcacaactggaaaaaaaaactaggggtactataatctcgtgtaaaatagctagggaatacccactttgtgtaacaatcagttagctagagcaactgtgatctaaccattatactatttacatgcgctgcacctagttgctacggagggcatgtgtctttggtacaaagctgtttgttaaatatctagtaaattgatgcattgtctagagcgctctatggctctagacaaacatacaccacagggaagaagcatggtatgagtgccctagatagcaggggttcgtcatttaaccctttcatgtactataaattgttatcctcctgtttgcatggcataattattgttgttccttttctttgcgtctcaattcttaaacacatatgttttgttttgcagttcctgttgctgctattgagttctatttggataccaggagccaaatagaagatcaaattcgggtcagtaaaaaatattaaatcttttgttctccattatccatgttggctattgtgaacagacgtgcagatcatgctaatactcatttttattaaagggctttagtgaaccatcatcagataaacttcttccggatctacttcctcaagagcagcatgtcttcaccctagttctggatctgaatgagactcttgtatactcagattggaaggtgaacatttatgttttctacgaagttacttatcttggtatttgatatgtagtccttatgtagtatacaatatgacccaatcctaacagttacgcaaactcttaacgctctggcttccccgtctctccacaaatttgcacttgaactttaccatctgtgctgtatggcataactcgaaagtgctcatgctgattttgttttggatctctgattctctggttttaccagaactgttttgttacacggatttgagaacctaatgccttattaaatttcgtttgggacacataataaatatgttatgtgatccaaacaaagttttaggttgttagcctctaaaatcttttttttacaagatctagtcttggactcttggtacaaccagagatccaaacaggccctaagtatcgtaatccccattcagattgatctaaaaagggatggttatttaaaatggttttacttatttgcttgttcgattggaagcttgtgatcatttttcttcagttcactcatctatcaattgtatctctgttctcctatatcaactttgatctaaatttaaacttcctaagaaacaatatataccgtctttttgtgctctctctctagagaagggtaatcactttctgtatgtctactgcaaaattgccaaactattgtggaagtccttatgttttctagttaagttttcaagcatgcatatcatatagtataaaatgtttatgacccttgggaggctgcttgacccataatttcttttatgtatgtatagcgtgagcgaggatggagaacttttaagaggccaggagtggatgcctttttggaacatcttggaaaattctatgaaattgttgtgtactctgatcagctgagtatggtaggtttaccagaatttcctcaacaatttggttgtttctgaaaaatatataaacccagatgaactttttttacatggacagtatgttgatcctgttattgaaagactggatccaaagggctgtgttcagcacaggttatcaagagttgcaactaaatatgaaaatggaaaacactatcgggtatggtagtcttatgctcttatcatctgttctcttagttgtattatacactggttgaaacagtttcatatatttatcctttaagcacccttttggtaagctaagttgcacactagcttgttctatgtttttttggatagtattgtgattattgagtaactaactgtatgctacgcatatgtatgcatgagatggattagaatgtgttttatgttcttcaaataactggcaggagtgaaaattgatgttatgacaaagttgtttctgtccatgcattaagcatataccactttgtccactttgctctctgggatctggctttcatgaccgagagaacacatcatgttttatcttgtatagtttcctcttatacagtaaaaatgtctacaaatcatatcaatccaacatgatgggtttatattgtattgtaaataattctggttttttttcgtactcctattaaaattttccttccaatgttcattgaatgtaataaaatctttgaattggagtagtcatttcttatctgcatcttggccaaggcctttgcccttctcctgtgaagtaagaagaccagtgcggtgagcttccctaaatgcttcggtgcagtggaaccttgatagccgtggcatgcgtattaattttatggtgggtcattcaaataactacttaaaggggtgttatatttttatggattacagaacaaaacaattgcttattttcgaacattactgtagaagtaaagaacaaacataaggataaagagaggctttatcatcattagtcgaaagactggacagtacatagcagcaaaacaattgcttgcaatttatttatttagttattctttatccgcaagccgacctaagaggattctgccgcattataaacgtcttggtagctcttgtattggattggagtgaatgcaccgaactcatctcctctattatgcttgagcctctgagcctcttctcttgagatgcgatatgcatttgctagaacatcatttgggagagcacggaagatggaactctttcctgcaatgtggcttaccatagagttaggattggtcttgaatgcaatgtaagcacatccttctctttgtgccttctttacaactgcatagtgttgtggtataataagcagctgtccgcggcgaagctcgccgttgaacactgtctttccattgttgttgacaacttgaacccgggcacggccttgagtaatatacacgacgctgtgagcgttgatgttccaaaatggtgaaaggagtgcattctgcaatagaaaaggtgcacatcattagcatattgtgtgcattaaagcttttaccaagaaaaaaatgtgctgttcattttacctggtatagatttactttgactgcactcatctgtacaagactaagaatggggaaattctgggtgttgagatttgtaacccttccagctcttggattgtatgtatcagcacggttaggattatcgatgttttgccttaccctcagggtgcaaaaggtctcatccaaaccgttagagcagccacttccatattgactttgctgatattgtccttcttgataacgctctcttgattgcacttgtccttgttcctgctcctgcaatgatgcatatggctgcagcaaactgagcccgtgttcgacacggacaatttctcctctttggtcattttgacattggagctgccttgccacttggctgcttacgccaagagcctcgctaagtagttcagtgctaaagccactaaatatgttctgtgaccgctcctcaacctcacgcctgtatgcttgagggtttctcttatttccagctaacaagaaatcctaacagttgattaaaaggctaaatcatcatctaagataagtggaataaaaatatcaaaatagtagtaaaaatgtttagctttggaaaagttctgcttaattaccctttgcctagggtcaagttgattagcaccgttgttgagatcagtgacatatatggcaacaactggcacttcaccatcattgtagcaccaatgagctacaccagcaggcaatgcaattacatctccttgtctgaaacggtggatcttttgatgttcatccttgaacttttgactttggctttgactttcggtcaattgggcttggcctgattgttggaactgttgttggtaggactcaggacagcctgggaaagttggccctgttatacctctccctgaaagtatggcatgcatgttaattacaagcaatataaacatggaagctgatcattaattcattatgcacttaaattgttgcacgaaccttggatgatatatactagagatgcaccattagtgtaatggggtagtagaaggcctctaggttcaataactcgacggacaacagatactccggtacattgaaattgctcattagagacatcgaagaactcagttgtgccagcttgagacctcacactccgaattggctcaaatgcttgcaacctatcgaacctgcattctcttggacttccacgacgagaactctgccattgactagtgctctggcctaatagctgctgggctagagagccattgcacaagaggaacaagcaaactgtgaagaaaactatggggcgatttatggatgccatgttgttgtagtactaatgaacttgaatggttttgtgagaaacaatgctaaatcattgtgcatttatagtgagataaagtctcatgcatttgaatgttaagatagagtttgttaatgtccagacatgaagtgactcatgatatatgaagtgtggtacacggaaggtggatggataatgatggatgtgtaattgacacatcatttgtattgttctctctttctttcttttgcaatatgacatggatgatgttaaagattatatccatgcatgcttttgctttttgttgctgtgccatagctttctatttctttttgaacatggttgttggtgatcatgacttatatcttgaagctctgttctagcaatactttaatatttagtgaagagtttttagggtggtcacatgttgacacgatcaacaccgagacctgtgagtttttggattgttgcatgatatatgggccacagtaggcatgtgaattttttttgagtcatggcttgtcttataagctctcctcttttcgcaacatgacatatagctctgtagttttatgtacacatccttttgctttatcttgcttgactctctggtttgtcatgtgttacacccaattgtcatcagttatgacttatgtatgggaagttctaacactttagcttaagatacttacctagatgactagaaatgaataggttgacagaggcatgaaatgatgcatgacttgctatgtcatagattatatcttcttttgcattatgtcgtggagaatgccaactttgcacattaaacgcttgcatgtttcattgcttaagggtttcttatcctgggtgataacattcaaggctcattgagaacacactgctcataaaaatgttctttttttatttcgtggtcccataatgctcacacattactcataatattgtttcattttctaacaccatcttctttcattactttagtttattctgtactacagaatacaacaaactgtcttgtgcatattttggtgtttcatttgggttgcctacaccataattaacttctcattgccatgtgcaaaaatcttcatcctactgctaactaactctttgaactgcacggcacctatcgaaaagctccctctccttatgacatcgtcagttgttcttctcagcaggttgctgtcatcttagacttttcttgcaacaaatactttacataaggtgtgaactagtagctggtagcattatttggctggggtaaatatcattgcatgttctattgctcatgactgttacttaaagttaacagtgtaagtccaaagtctggatcaccctgtatctacaatttcttcaatggcctttaatgcttttaaacttttggaaatttgcagtataaggtttccttccttgagcttgacatgtattggtcattgttagctattacacaggcatttattttctaagctgtttaactatttccatttatgatgggcacggtgaataggatcagcttgcagcctactcttgattatggtgcttttgttttgcgcttatttccaccatagaaatcaaccatggaccatgttgtttatctaagtgctgataagctgctcaccgaacagtttgctgacagttaggtgttcttttttccttgacaaatcctactttgaatttgaacttggatttgttttcttaaaactaaagtatcataaccaagaagactatcttttagggatgtaggtagtataatctacttcctccgtttcacaatgtaag

SEQ ID NO: 63976 - DNA, 2482 bp, Oryza sativa
gtgcctaaacacctcatgtgacaccctatataatatccgatgtaacacgctaaaactttaaaccctagatctaaacaccccctaacctaacgtcctaatccaaacggcagcggcggcggcggcaatcaccgattcacctggtcaccgacggcccagcgggaggggacgttagggccgagggcgaggatggtgccggagcactcgaggcccgggtaaggggacgcgccgggcggcgcggggtaccggccctggcgctggacggtgtcggcgcggttgacgccggcggcggacaccccgacgagcacctcgccttcccccggcggcgggaggccctccccgacgtcccgctcctccagcacctccggcccgacggcgcgcgcgatcaccaccgccctcatctctccccctacctcgtcggggctcagctgctcgccttgctttgctcctctcgatgagtccacgcacgcgctgacactctgcgtctctgctgtgactcgtcgactggatattgagatgggccttgggcctggttgagtaaaattggcccagatagctgaaatctggtccagccttctaaaaaaagataagtacttcctaagtgctagtccttccgtttcatattttaagccgtttaactttttttcattcaaactttgttttgattgatcaagtttatagaaaaatatctactaacatagttaaaataagttttattgaatctaacattgaatatattttgatatttgtttgttttgtgttgaaaatactactatatttttatataaatttaattatactttaaaaggtttaactatgaaaaaaagtcaaacaactaaataataaataatatgaatgaaaagaagggagtaatacggtataaacgttgtttgctacattgtctatatattttgaaaatgaatcgattcggggcgagttggtattgactggagaatagaaagtctatatatctgtgtaattgaacatttggagaatactctcacattaattaaaaagatataatcattaatttggtggatcatacttgtactaaaacggataccttctgaggtatggcctgatatagacttccattaaaatgctattctcttacaacatttgagaggacaaatgactatactaattaatgcacaattttttttctaccacatgtctttctttttttttctctatccatatatactaaagttttcctctataaacgcctagagtcgacgaccattgtcacatttaacaagtatatttctctctttttttttcatttctcttatatgtcagcaacttaaaagtctgtttattaattgtctttgtatctgccctaattaactcttacattcaccagaaaaatgttcatacatcaggttgatatgacctaccgtaaatagtagtttaaagtttgtgtgtcaataataatgcaatttataaaaactatggacttattaattgtattttattattttaataattttaatgttagaattatgaatacgaagtctatacatcctatgctctcaatttagttttaactttttattttaatttcaaattaaagacttgcatgatgtaaccaatatgtacaacaactaacatattcagtcatcgtctcgagtggcaacgaatagagtgttaaatcatcaaattttgcttgtactccgtgcaaacatcccaaaaaaagaaaaaaaaagactggataattctctagtgatgatataaagttacaaactcgtgcaacacatggattgatggctacttaatgatattccatgcatatttatgaggttgtcaattttaattgtattttagtgtaacgaactactatacctaatcttgttttgcttttagtatgactagttactatacctcatcttgttttgtttggtattgcagaagaattgtttttatcttctttgttaagctacgcgttatttaaggcatcagaagtactatacagttggaagagaatcaaccagtaaccatgacaaaaatatcagttgagtggcggcaaatcatgtcatgctcgtgtgggacatagtactagtactactaatgggcgatagcaactcagcaaggcgaaagaaaagaaaagaaatgaaagtgaaaaagactgtgttctttatagatgagacggatattttgtacgtaaaacgaaatgatcactaatccataattaattaaatattagtaaaagatatatttaaggtaaatttaatatatctttttaagaaatattttttaaaaaaaatatattatttcaaaatttaaaaaacatgtgcacggaaaaataaggaataacgtgcgcactagaaatgagaagtgttgcaaagaaagctttccagattgagatggattcccacggtgcgggggcttcacccgcacgcgcgctctccttcgccaccgttgccggctaaccaaaaaagtggaacacgaagaagaagcagcagaagaggaggagcatctcgcaacc

SEQ ID NO: 63977 - DNA, 7026 bp, Oryza sativa
gggcggccacatcatttttgggcccgacccccccccagggggtcaggccacatgggtgattgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcggcagaaacccagcggtcgcaaatcgcgcacatcggcaaggaaaaaccgaccgacaataatgagcggctttcttcaagaccgctacattacttaagtagcgcgcgaaccgggacgagccggttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgagagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcccctctgaaccgctacgacgccgttcttgaccgcctggcgggtctgcgatcccaggggctcacgggggccatggtgttcggcgactaccttcgtcgccggatcgcgccactccagcggcgcgcccggggcgcctgggagtacaccaggtccgaggactacatgaggacccaccaggggggcagatgggactgggcccctgaggacttcaagatggtggtccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccaaaccatgccggggaaacctcatctcccccccaaggtggtcgtttagccgacctcctcgcaggttcgtccccgcgcccactgtggccgtattcattctcccaaggcgagttttcacttacccgtttctttttgtcttctggtttttcttccgctttcagcgagattccgtcgcgcctccctcaccattccaagtccggccggtctgaggccgaggagacagcaaccgtggaggcccggaggcgggaagctgtccggcgagaagccgcggaccgcctccgggaagctgaggaggctgcccaggaagccgtccgggttcccaggctgaggaggccgctcgggaggaggccagactccgccgggccgggaagtcagcccgggaggcagagcgacccgcgcacgccaggcggcctgccaagccctcgacccgactccgcccgaggcgacgacgacttccgaggccacccacgatgaggccgcgggcgcgccgctcggacccgacccttcgggcgacgttcgggacgagccagcctcgggggacgcccctgagtccggcacgtcgattggcgggccgagccgcacagcgcccacaccgaggcggctctctcctctgccttccgccgccccactgaacacagagcccctcctgcaggccctggccgccgcgaacacgacggtgctgggacgggttagggcccagatggaggtttccttgcaagcagagcgggcggagctcgacgcggcgtggcgtgcgtcgatgaggggcggcgctcggtggaggccatggtggaggcgggccgcaaggcataccaccggcacgcctcagagctcgaggtccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacaccgcccggggagtccttgacgccgccactgcacgggaacggcgggcgacggagaacgaggcggcgtcccggcggcgcgaagtggcccttaaggctcgcgccacggcgctggaagagcgcgcccgcgcgagggagagggacctggcggaccgcgagaccgccgtcactatccgggaggcaacggtggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccgcgaggcagcacgggaggagcaggcgcgccgtaatctggaaggcgccagcgccgagagggccgcactggatcagcgggccgctgagctcgaggcgcgggcgaaggagctggacgggagggcgcgcagcggcggggcggccgcgggcgacggcgatctagccgcccgcctcgcagctgccgaacacaccatcgccgatctgcagggcgcgctggactcgtccgccggggaggtcgaggccctccgcttggcgggcgaggtagggcccggcatgcttcgggacgccgtctcccatctagaccgcgccgggcggcaagcggccctctggggcgagcggaccgcgaagtacgccgccaaccaggggggcctcgcccagcgcctctcagagatggccgggactctccagcgcctccccgaggagctcgaggagacctcgcccggggggcagtggagcttgtactggcaagctaccaggccagggacccggacttctccccgtgggcagcgctggacgagttccctcccggaaccgaggacgatgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactagccaggccgggagcgcggtgaccgagggttatggggacccgattgtgggcctttgccgattcccccccggagttcaccacgtcccggggcacggctcggttctgggccccgtttggcgatttccgccggctcgggccaccgagggcagggtcgagcacgagcgtgctaattcaagccaagactcttcaaaaggaaacaatggcacagacacagtccttaggaaatcaaaaaagcttttattgaaatacggaagagaaaaaagataagtatatgcatatgtggtagcccccggccaaccctgcacgcccgaggggggtgcgaggttggccagagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtgacgctgatggtagcgccgcaggctctgctggtagcgcgcggctcgaatggccgcgcgccgccttcgttcttccaagtagtcgaggtcatctctgcgaagctgatcttgatcagcctcgcagtacatagtggcccgaggggacctcagggtgacctcggatgggagaactgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgttccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgatttaagtgcggagtgcttatcgatcttgatgaccggataagcctcgggccacttagtgaacttgtcgatagcgacatacagatactcgaacccgcccggggcccgtataaacggacgcaggatatcgagcccccagtcagcaaacggccatgacagaggtatggtctgcagggcctgggccggctgatgggtttgcttggcgtggaactggcacgccctgcactgccggaccaggtcgaccgcatcgttgagagccgtcggccaatagaaaccctggcgaaaggccttgccaaccaaggtgcgtgaggcagagtgggctccgcactcgccttcatggatagcggcaagaagctcgacgccttgttcccgaggaatgcactccaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgctcccctagggtcccgaggcctggactccgacgggcctcaggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgaccaactgagagtcgcctaacaccaggaggcggcggatccccagtccagccgccactctgagtcccgcaaggagtccctcgtactctgccatattgtggttgcccgaaagtcgaggcggaccaggtatttgaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgggtttcaaagtgcaaatcgaactcagagagttcgattgcccatttcaccacccgtccagtaccctctcggttatgcaagatttggccgagggggtaggacgtaaccaccgtgacccgatgcgtctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgccaggggccgcatctccagggcgcttttcgtccgagaggccgcgcggggcgcactcggcttctgtgtcgacgacctcggggtcggaaggcgacaggcgtggccttcccgcagtggccccggggccatcctgggggtcgggggctcctggcaccgtcggacaagcaggcagagggccagctccggtcgtcgggggcctcgggcagccgttcggctcgggggcctctcctccctgctctctcccgggtcgagtcgatacagggtgctcttcgtccgagaggccgcgcggggcgcactcggcttctgtgccgacgacctcggggtcagagggcgacaggcgcggccttcccgcagtggccccgaggccatcctgggggtcgggggcgcctggcaccgtcggacaagcgggcagagggcc

SEQ ID NO: 63978 - DNA, 679 bp, Oryza sativa
ttctagtttcaaatgattcttggaatgcctgtgcaccattttgccgtttgtcatactagtagctcattattagtagtacgagaaaggttcagttgaagagttgggtgaatgcgctctctctctctacaccatagagccgttcatgttctgtaacctctagcaattctgagttttgacaaatgctgtgcaaatctatgtcctacttttgaaggatccagtattgtatgtttgttgcttaaaattttacatgggttttggcaaaaaaaaaatgcacggtttgatttgacgaaatggtgtacaaattccagcacatctcgttggtagtggtaaggactagagacgcatatgcgttcgctcggttctggataacgtgcacagaacgcgagctctcggtggttggttgagctgcgcgggagagcggcggtcgatggcgattgcctgcgcgctctcggtggccgccccgtccctaaccggcaagaccaactcaaacccgccgccacgccgcagcttccagcagcagtggcgcgagcgccgccgccgtggcgtggccgctcgcttctccggtaaatccgccgacgtcgacgcggaggcggactcggggcgaatcgaggtcagcgatactgatacatagatagactgctcgcacacgctctccaccattcctcaccttttctcagtt

SEQ ID NO: 63979 - DNA, 2700 bp, Oryza sativa
tctacatttaacagtactctttatatcaactactccctccgtcccataaaagacaaacctagtacggaatgcgacacatcctagtactatgaatttggacatgtctcctaggatgtgtcacatctcgtacaaggtttgccttttatgggacggagggagtactccagaacataaaaacagaaaacatgagtttttgatggaattacctcttttctctataaaagattcaaatcctttattgagattttcaccaacatagtcgcaaatgttacgtttgaagagcctctaaaataacagtatgtttagtacagcagcaaatttataacaatacttttctgtaatactacatagacagactttaaggaaatggcgaactaaagggaaagtgaaattgatcgtgagcaattctgtgatcttaccaagctgcggtcatcaaaatatacatccccaccctcaatacggctgtagcatgcaatctcagaaggctgcatgaataggaaaggatttggatacatagataccagagataatatataaaaatcaaaagaatatggtatcattactcacctcctgaaaagcaacaaacttcctagataaagtttcttcactcttattaagcttcatttctgaaacaaaaccttcaacattacgcccatttccatgcgaaaacctcccaccatatccaaagttatgccgtcctggatggcctcctgcccttggaagaagaggtggacctctgccattccgccccccatatcctccccgagaatgattgttggtgttccgtattgagggtagcactataagggaaggcatggaatgaaatatagtgttgaagctcaaccttccctcctagataattcaaacattttaaagtgctagctgccccaagccccgcaccaacatatcaagcgatagccagtaaaataacccagttacaatctttaccacaagcatgggcattaccaatcactaatggacctagtagattgataaaatgtatgccaacaatagatatcaagttgttacacataaagcattagcatgatctccattccttccagcactaaatcatcacaaatagcgtattgattttagggagcttcctatcacaaatatgattagcatatattgaaggttttcaataaattatgcatgttttattatcaactttgatctttcaaagttcaaacttctatgtttctagttagatggcagattgagaagaatgtgaaaaaaattgttctacagaggaaatcagatcagatgcagtattcttcataactgtaatctactgcagagttcacttcaattatacttcaaattcgtttgcagatagatgttattcaactgtagtctacctataatcaaaacgggagattaacatactagcatagtgcaatgtaactatcagctaatccaatagcccctaacacttatcgttaggcagtgttcaatggctactctccaacaattatgcttgatggtgttgtaaaacatctcttgcgatttaaaagtgagttgcaagcagaagacagtagccatgatgtactgttactttataagacacattgtgcgtatcatatgcctatcgaaagtggaaggaagaattaaaaagtccagaacaagaataattcatcatacatacatgtgaaacccgcaattttctacatgctcactgaatcccctaaaccctacgatcagcttacccgcaaccaaaagaactgggttggattttgtaaaaatgccctaattaattctactgattagacatgcttagagactgatcattgtcacccaaaatgtgcacgataatttagcaaatattagaggcggacctgggactaggtagttgctacgcgcgggggtcttgacgtaatcctcgttgtcagagccgaacaaatccctctcctcctcctcctcctcctcctccgcatcaccctcgcccctctcctcgtcaccgtacccaccggcggccctcgcgggcgcgccgtcgaacgggtcgtcgtcgtaccccctggcgtccccctggtcgaccccgtcctggtcctcgcccccacccccgcccccgccgctgctgctggaggcgccgctggaggaggaggaggacccggcggcggacgacgaggaggatgaggacggggaggaggagccggacgaggcaccgccgccgccgccgccgtcggcctcggcgtcgtcgtagtcctcgccgaagatttcgacgtcctgctccgagaagtccatgggcagagagagagagagaccgacgaagaaaggtttctttcttggctttctggtcgggggggagggtttgtggtgcgatgcgatgcgattcgagtgttcggcacggcgaagaagaggagcttctggaagtattagggctcgctcaccggatcaacgggagcgagctgggctcactaggcttttggcttggttttgatccgggctttagattagatccaaggtaggcacgacacgagggtatcgtgtggattttgcgtgtattgttctgttgatgatacttatatcttgtaatcagccagctaaaacaactaaaacagtaataatctcataaagtagaaactaacaagtcttataaagtataactaacaaaggcaaataattgatattcagcatcatactgcatatgtattgctccctccatttcacaatgtaagtcattctatcatttcccacatt

SEQ ID NO: 63980 - DNA, 2372 bp, Oryza sativa
ccattcaccaaacattgataggtgggcccctatgaccaacaatgtgtgaagaacctattccttgcatgcttgcatggattgagtaggggtgcatggcaagccaccgccacacgctacttgtatcgagccctactcgggctacccgaggccacgatggattgagctaggtatcgtggtgagttctcaccatatcccgttcatggtggaccccgccaaggcatacccaagggcagcggggtgggcaatgagaggagatcctggcaagacttaccatatttgatcccgatacgaacaatatatttcctttagtaaagaaaaacaatatctttcctcgagctttgatcatcaggtgttccctggtgaagatatatggggagaaccaggacaagcgaggagggttggaagtgagagaaaagagactttatcatattttgtgtggttcttaggaaatccagaagagaggaagcataactattttgagtaatcaatagacttgtaagatcctcataacagataggggtaatcctacaaataataagaatagggtattgtacctccgagcttgtatacatcctaatgaactcatcggttctttcgtttctatattgtttacacgtgactagcctccccagccaaattcacataagggggttttgtcggatttttgctatctaatcatcaatatagttgagtactctctagaaacaataagtatgactgaagtggaatggaattattaattctaaaggtgaaatggaaaattttgctttgggatccgtgtagtgacaagtatttgcaaataacttttgtggtaagcaattataagtaaatgagaacagaagtagtataaacctaaataagcagtagacaatttaaatttcagaacttaattttatagccggtttatagtattttgttgtttttgctgttcaaccttatttgtagatcgctacagtaaacctagtataaaacttcattgttacagttacatgttttcgtctcatatggtgtattttggcatgctttcttatcgaacatgcatgtgcatggactagttttaaaatgacctagtagcccaagctagattatgggctctaatatgcatataaaagtttaaggatagtcggtatagtttactcatccgaatataagatacggtaaagctaagccacaaacaagatatttttatttttattgtactagaaaaatatctgtgcgttacaataggtggagacaattttcacgattgatggtagcgcccacacacttaggctgtgttcggcaccggatgttcccaactcctcttcctcgtgttccgtgcgcacgctttttaaactgctaaatgatgcattttttttgcaaaaagtttatatacagaagttgcttaaaaaatcatattgatccatttttgaaaaaaggctactaatacttaattaatcacgcgctaatagaccgctccgttttacgtgcgtgcgagatgggttcccaacccatagaaccgaacacaaccttagtagtacgttttttttacattttttttctcaagtttgaaaatactatacctggctttactcctatacttacaataactacggtccccatcggttggtctagtcttattataagccataacggcttattagagcaggtacaatagcagactataagctagctataaacatattttaaaaatataaaagaagagagataagggaagcgggctacagatctgtagccagctgcaacacggactccaagacgtaatatgtgtatgacaggtgggactaagtattaatagtgtagtaagcagctattgtatgaattgtctattacattggctatagaagatttggagctagtagttagctatactattaagcttgctcttaacgattaagaaataatatgcgagtaaaagttttatatattgttcttaccgattgaaaagccaaagttgaaaaaaactatgttaaaatagaatcaaaatcaaattcaaaatcaagttttaaaatttaaattttggctttagcttataagccgtagggcaaaggatgaggccatacattggaaaaaataattatcaaaacaacatcttgcctatttgaccattatacctatctaaccaacaaagagaatcatatcactccgtggaccaaacgatcggtaaaaaaaaaagttagcatatcactgaaactacatatagcgtgtacgggcacgttgcggggaagcacatctaggacaagcaagctccaaaccggtctatccgtcagctcagccctttcttgatcggtgtggcaagttagctcgccaaaaaaaagaaaataaaaagagaacataacaaagttgcttttaggtattcattcacactaacc

SEQ ID NO: 63981 - DNA, 4954 bp, Oryza sativa
cgtggtcaccagccaaggccgtggggcccacgagtcattgacacgtagtcctcgtttacgtgtacgtgtagaactttaccagcttattagttaggccacatgtttttgactcaacgaaccccgtcacccgaccacgtcactgtcaggtgggaccaccgcgcggtgggtccccggtgtcatcgatggcgggacgtgggggcccacggcggtgtctggtcgccgcttaccacccggggggtgacgtggtggaacggcagccgtgcatcggggacgaggcggaatcgaccggacggcccagatgggctcgcggggaccattttttatttttcttttcctcgtttcgttttctttcgctatccacagcgagcgagagaggaaaagataagcacgaagaattatgttgctttgtttcgccatggtgcggcttgtactgatctctcccccttctctcgatttgtggggacagattggaaaatcggacataatatataggtagattgtccaagtacttgaaaatagctcaaaattttgtcttgtttgtactacccaagtgcctaagtagttggtacacgtacgtgactcttatcaatgactttggttcgtaaacataggtatttggcaaaatttggtacatgagtacatgacatcatgacttcgatatcttcaccgtacgacattacacaagtgactttagaaaaaaacactataaaggtgatttatgattaaataggggagaggaacaatgtgaaagttgtgaactattgtttctctcccatcaaattagaaatcaatattttaataggtacggcatccatgagttaatttttacgtttgtagagtattttcttccaaaagctacttttgtacgatgttctacagctaaaaccgctaagtcacaacattctttattaaatttttccttattatttttatcattgctctgtgtttttatcctgaatgtttcttgccattttttttctttttgttgttatatggcataagtactcccttcggtcaactttattttattttatgtatcatttgttaaatatagataaaatggaagtcgatccaagtggatttattggaccgtagtaagccaaaaattgaatttacaacttaattttcaagttaattttttatattatagtttattttatagtatttgcttttgtatcgctaatgagtaaggacacttatataaatattttacccatatttttttctaatcctttataacccactaactcctaaagcttaacatgcaaaggtgccacatcatcatccactaacaattaatacatttaatatcatgtaaacatactatattatctaatttaaaatttattacattttagagcttttaaaatgaaagcatgttaaatcatcatcccacataattcacataatatttcaatatatattttcattattttttataatatcttatatacctatacaagttcatcctcacttggttaatattatttctctcttctctaaataagccatatcacataaattgattttagtgcttatgtaagtttatattgtttagctatattacatattatttttacttattattatcatattgaagtcccgcagtaacgcgcggggtttcacctagtaaacatactaattagtataaataaaagcgaaaagatgagattgtaagaagttgataagttattagcttgtatttgtattcgtaaattagagtggatctaatttatggttttgacgttacgttttaacaacttatacgttattaaaataaaatgaaaattacttaaaaaatcaaatgcggtactacatctaaccggcacgaaataagtgaacccaacatgaacacgtaccctaaacctcaaataacaggccaagaaacaaggtaaaccatcattagctacatttaagataacccctctaattacaagttattaccatccacacgaaaccgtatgaaatacatagaaataactatttggataaaccgtaggaaaaacacataaactggaaattcctacaatgttaaaactcttgataatttttctccaaaatctacattgagcaaatttataaggaattctatagaatttgggaagatccatttctttatttcaaatggtcaaataggaaatattcttacagaattagaaccctaaaaaaaattctgcacaaatccttttgttgacaccttcgaaacagacacgcaatagcctcttatctgtaaagaaagagttgactgtccagattagaattggctgtccaattcgatcccccaacaaacagaaaccaccctatccatccagccagagggaagatctggtcggccaagaaccgaatccagtgctatcaagtatcaacacaagattgctacagccaaccacgaattgattcccgaatgcaaagtaattatcaggaaagagtgacagcaacccaggagatcgaaagggagaatgatcgcctttaattcctaataattcttcagtttttctgtctcgccttttttagatctctgttgatggtgctggtaatgccacgtacgagcaaaagatgaaagcatagttaggaagtaataattctgtataattatatgtacctatcacgaataatgagagaacttgcccttttaaagcttagatcacttgaaaaaaagtaatgttgagaactctggattactttgtgccttactggacttgctggacttgtgggaatctactgtactgccacaactatatggaatacgagaaattttttttaaaaaaaaagttcctacattcccgtaaatgaaggaaatgaattcccttgagcaaaggtaggattcacgttcatctaaatacaaacattctagtgttagttcatgaaatttcaatcgtctccaactggcacattggcacatttctatcatgcttcctgataataaagtccattgccaccaaaaagatgcatgcctgaactgtcataggctcatagctcctaattagcgataacacaacatggaagaaatctgagcatataatatttacagatggcagcaacagctgctgagatcatgtaagatgtgagaaagatatgaacagattgattcttaacttcttcctggctaacactttagcaagatactacgtccacagtcaactttgatcagcccttaattttagaagcgtaatgtactccgtgaattcttcacccgagaaacctgcaacgatggttaaaatgtcacatgatgttcaggattagcatataaacatggcagtttgatactttgatgtttttagattgcacttacaatatgggacttccattccactttgcatccctcggtgacaccaaactgaggctgtcccttgacgtgatggaatatatgaacaaggaccacagcatcaagggcagcatactctttctgcaaaaggaggaagaatctctctgttttagggatggcgctttttgtcctcgatgaacagtaggctatcaaactaactcgtggctttagattgcaagatgaagcatgtttgacttagttttaactaatggtgtttaccaagataagcttagcacaagatctgatagaaaatttgcttgtacatgagaataaggagaggcatcttaaggtgatgttaaaaatgtggtaatcgacaggctcatttctaaagtaaatttctttttctacttttttcatacaaacacctgtcatggttagaaaagtattgtgaaaataaattcagaatgagactgaaaaaaaaaactcacaatacaaaattatgagaaattaattaatcactcataccaacaaatagggcctttcaaggaataaggactcgtgaggacagcttttaaggaatatgaaagatgacagacctgattctgggtgagagggcgctgttcccagttgctattccgtcgcgtcttgttcaaaccagctcctaatattttctgatacattccgtgataaataaagatggaggaccagatgattcacactaaactataagcttaaaaaaaatcaaaactggttcaacgtccagttaagtggagcctataccgctatagcaattaccttggacagcccagatagaccaccagtagtccctttgaagagcttctggatatcaagcagcatttcataggactggaaacatttcaattctccatatgattgtgatagttgatgcagatcacattgcagattatatcctttggtttacaatggggcaaaaataagtacttgtttaacaggatgcataagaaagaaatgttgttttcaggaaaacaagagtgtatgggaagatatgggttttttaatcaaaatagtacgctacctagctttagtatgtttgaagaacacataattcgcctgaagcagctatccaacacttttgggtcatcttcatacagcttgatcagatcaaaaataaaagctttcttatctgacgcaatttggataatagagacctaaccatagagcaaaattcaattaatgcaagaactgacatagatagataaaatgcagaatttctgaaagaggaacaagtaaaaaatatcatgggaacttaaggataagatagtcgttccaaaacaataaacactgtaaagaaaatatcactgagatgatcacaaggccatagcttactacacagggagtgatatggataactgaatactagaactactaaattgcttaaatgatacctaatacaatttatttatcctattttatccagtgatgccttttgaggaagaacagggggagattttcattcagcctgctgtatcgccacaataatgcaacatatgattaccatacattaggaaaaatgattataattgtaccagaaaactaagttaaacatggaaactgacagaaatttaaattaagacatcgcttaccttattaggtttgctacctttctcaaaattaggcttccattcacaatccacaccaataatttta

SEQ ID NO: 63982 - DNA, 985 bp, Oryza sativa
cagaaatgcggcagaatggcggtcgcctaacgttggagcagatcctcaggtgtggcattgcatctaaacatggatactaagttttatttgcgtggttatatttgctgcagtcatgtatggttatagttgctgctatcaaactatcgatcgccgaaaatgataaccctaaaaatacagttgagctggggcgctatacgacagtttgtccgctaactgtatgtgttcaaatgcatggggtttcaatggtggttcgctaagctgcatgtctagctagaaggatcataaaaggtggaaaatgttgtagtttgagtactgacgtggaaagcggtttttgcgattagtagtgccaaatttgatctcaatgagtttgtagtatttgtacgtgttcggcaatgtttgggtgattgtcggcagctttgttattccatctgtcctgcatcttttgttgtgttgtgacatagtgcttaggtctattattaacaattatcacacttagtgcttggaggaatgaaagatcactctttgtactacgattaaaattcaagccaggctgctcaggaagtcagtgtccagtgaataacatagttttgttttgcaattggtttgttgatttaacacacatcaatcattctacatgtggagcttgagttctctttaatttgtgaacaaaatgatcacttgtatgtgctatgaatttgtactatacaatgtgcaatcgtttattcccaaaattataattcctagaatattgtgaggttcgtgacggcgacgaatgaaatgccaacactttctggttcatatctgtaatatttggcaccctggacatttctccataaaagatataactcatatggctgttagaatggagggattggagcaaagatggttgttcactgctgcattaattctgttcctctcaactcaaactttagtttccaaagatctgttgaatacttctgtgcagtggaatagtgtgggccactca

SEQ ID NO: 63983 - DNA, 589 bp, Oryza sativa
cgaggatgcatagttatttttcatattttgtactacatccgcccaaaatataatttttttaagtatgaatttaaacgaacagttatctaaatttataattagaaatacttatattatattatattttaggatattggaatattctgaatactataataagacaagcgtcactcaacaccaaatatacaatgtgaaaggcagtggtaattaagtggagtcggcactcaacaacagtacgcatgtcaatgttcaacttcggcataggtacacgtcatctcgccgacagatcatcatcagaattcagatagatccgaatcatacccagctggtgcaagaacgcatcacaacgggcccctgaaccctaacgcgtatatggtccatgatggattgatggatatgcatggctctcgatatctctccaaaaacgtgtgattttcactgatgaaaaaacgtgtgatttatgctatcctaatgccagcatttcccacgtgcacgattggaaacattcctggatattgcagagatcatatgtatccatttcttgcttaggataatttgttttgtcagattattttcttaaaggaaaatt

SEQ ID NO: 63984 - DNA, 1313 bp, Oryza sativa
tgaccgtctggatcgcttcccaccttgaatcattccctttgtgcggcttcgtggtggcgctgctcatgctgctgcgtgagctctcatcacttatgtcgctgctcgtgctcgcgcgacacatgctgctcttcccactctcagtgaaattagccctgtcacttgtcttagcactaccactggtcttcctcaaactattcgtcccatcactcactttagcagaagcaaaactatcgctcgtactactcttctgtgacgtcttcttctcctgattcccattacaatccaagttttggatctccttcagttcgccggaatcttcctcctccgcgactaacgaatcatccaggatcccagactccgaagagaggcctgaaagctccttgtccagcgtagatgccggagaaccttgatgctggtcagatggtgttcgctcctcggaaaccacctcagcatcacctccctgttccccagtgcccttcggctttgccgcttgaccaggcatgctttgcagcggtgatttggacgacatgaactaagcagtttatcagaaacaatcaagcgcggaatcggacagcaaggtgaacaaaatccctccacccccaaattcagtacttcagcagggcggtcaataattcctcatctgaaaaaaaaggagagaaaaatttccccattagcattaccatgttaccaacataacaactagggtttgttccacagtcactccgatttcattcacacaaacaaacaactcgaggggatcaagaatccaaccaaaaaaaaagaagagataaaaacaaagcggcaccgatgaaccagccggtcaaatcgagcagaaacccacctgaacctttcgaacaaagagagaacccaaaaaaaaacagaaagggaaaaaaaaaactttccgcgattcaggatcaaagaaacacctacggattcgacagatccagccccgccacatcgccactctccaaaaaggggaagaagaacaagaacaagagagtgcttgctaggaggaagaaaaagatgaaatcacgaggcccccggcatttcccacagaaatagggggtggtggggaagggaaggggggaacaatgggccagaaaagaggagattaataacaaaagctggaatctttaagataatcccctctcctcggctaaaggaggaggcagccacagcacagcacagcacagcacacacactgctgctcctcctcctactcctactatacattgcagcatgcaacctggaacagcacagcacaactgcaagctcacaagaagcagcacaccatgacacccctcctcccccac

SEQ ID NO: 63985 - DNA, 1200 bp, Oryza sativa
ctagtccaactgataggtcagagcaagatgctgcacttgatatgctatgggctgatttagacttcactttagagtcagagaacattgggacttattatgatgatgaggtacttttgctgcatgaatttatctgacattgctgacgtcctattattttccttaatggggttgatttgattatggaacatggcaaccctatctatattacatgattgttgcacttatctttgcagagaaaataagctgggtatagacataggttcttgttaatcattcatcaccattgctgcccaatttgttacattctattttaccactatttgtggtaccaatatttgggaacagcagtcttaacttggcgcagccaattctaagtagtgtatgtatgcgtattttgtgccactaccatattgcactctttaacaatgaacatatatttatttgtttggagaataaatattcctttatgttatctctgtataacagcagaacaccttttgatggttgacaacaggagattctggtcaattttaactatattatattatgtaattctccaaaattttccagtgtgacaaatttgatgctttcatttttttggtgtcatctagtcaaggctaccatgttgaaatgattagcttctgttgttttgtagggccaagaggacagtctgctagatcatgcacttgctcctattacaccttgttctagagggaagcatgaatttattattgatgagcaaataggaatcagatgcaaatactgctccttggtaaatctggaaatcagatttattttaccattgctggtgagtttagtatctctcaaaacttctggcttgcttcccacaacataagttgatcaattccattatttatcttgttcttccattccaggcctccaattttgcagagaaacctgcatggcgaaacagctcttgtttgaagactgcgttgatgtgtcctgatctttatgaacaaacagggactggtgatggacaatctcaagatttccatataaatggaactgtgtgggatctcattcctggcgtcattactgatatgtatcagcatcaacgtgaggcatttgagtttatgtggacaaatctagtgggtgatattaggcttaatgaaataaagcatggggctaagcctgatgttgttggaggatgtgtgatctgtcatgccccagggacaggaa

SEQ ID NO: 63986 - DNA, 9309 bp, Oryza sativa
taaaattgattaattatttgctcccaacttcacaaaacatgattcttataccgtattactaaggctgtttttttaaggagtttaaaattatgagagcttctgaaatttttctatttttctgaattctatagattgttaaaatccaaagatggtaatttcgatcgtttaggggagttggagattctagataaaccaaaaagaagcttcccaaacatagtctaagtttaagctatttatcagtataattttaccattcttaaggaactactaagagatatcataatttttaatgtaaaatttggtactcacatataattaaatatctcgaggtattttctcagggattgcttattctcatataagtaatcggtgattattattcgcttaaaatttaaatcaactgggccctaacctctctttttttttttcttacagtaggattttaagacggctcattaatctatcttgcttgtgcttttaggactttgggggtgagtgagtgagtggtgactcactaatcttttgctggttaatgcttaagactaccaactaatataatctcggtgttgcttcggcatttggggtgagtggtagctgctggtacagcgtgcattggcgacgttctctcgtggcccggacccaaaaatattatccacagggctagcttggaaaaaatctgaatgggaaaaattaatcctgataattcactttactgatttctaaagaagtatctggaaattcgtagggagaaggattttactggattttttttgtcagataagtgcagttactcaacaaaggctacccaagcaaactcatatgcttgtactatacgatacatccatttaaaacatgattttttttgggatctttatgtgttaaaatcacatgttctatgatgtatgcgtaaaaatttcttcttcttctttttttcatgtccaaattgtcaacctcttatgtaaggcttctaaattattctggttttctttccttcgggaaaaaataaactattctggtatgtccaaattgtccttttatgtagagtggtttccttttcttcaatttccttttttctggtgatagccaaactttagatttcaccagccactgttatttagctgcactgcaaacgattgtgttcactaaccggtgccgagtagcaataaccatgcaatcaccactgatcaatcaaatggtttccagtctacagccggcagtttcggtaatggggataaactatgttgctactatcagcattatctaatctgtaatgtccaaagcttaccttgaactaatacatcttaaaatctctattagagtggggctaaccaattaagcttactttgatgggctggttaatctcactgtggggttcaccaatcttgagagctagcaataaagctagagccaagaaattgtaatcatagctgctacaatcgagggctttgtgcttaggtcacatgtatcattaacaagggcatgagaaataaactataaagaacagttccatgagcaaactcaaggtacacatggaaaattactgtgtgattactgaaaagagttgtaaaactcatgctttagggttcatctttttttgcaagattgaaacagtgatattttttcttgaaactgttggtgtttcttggccaactggtgccggttgcaaccatcatctgaccaaaattttcatatctagctaagcagtcagtgagcaaggcaggcagacttagctatcaaccaggaatttggtgaatcaaatcagaaaaccacatcaaaactggcacgtagatttcgacaattccatcagaatccattgtctgtaaagactgtaatctgaatctccaccattcgcctcctgaaatctgaacattgcaactgaccaaaacagtttggcacctccaagcagacagcaacctgaaaacagcctatcgacaagcaattcggcgacgctcttaaacatatgcatctatatctccctatcactgtacatacactcatatagataccacgtggtccatggatctacagatacataattcagaaaaaattttggaatctttgaagtgttaggcgttaggtatgcagaactctgaacacttgaccgttctctcgctcttaattttaattaaactagctgggtggcccgcacaattgcgcggctagcacccaaacaaaatcatatatttttttaagtatgattttacttaaaatttattaaatagctatctcattgtcttaagactttgaaagaccaaaccttatcatcatcgagtttctaattatatagtttttaaaagtcacaccagttgctaccccttatgtctcatctccttctttatttgcttgctagatctaccactatttctattcattcttattagaacctttaaaaattagattttatagtttttagagtttattgtcacgttgggtttcatttttataatttctagatgtctcgtcaaacattgctattatactcctctatgacacgtccactgtcttatctctttattgtcattgagaatttaaaaatcgaacataattatcgtttaacttcatttttactttttagaagtcccgccaaaccgttagcggctttgccattgtaatcctctacggctcgcccgctgcctcccttctttatttcattttgattttaaaatcgaatatgattatcattggtttttttacttttcagaagttccgaacctttaaaaattggacttgtagttttatttttaataatttttagaagtgccatcaaacgatgtcactatgtccccgatctacagccggtccgccacctactctttattgtcattgtgattctaaaatttttttttttactttctacaagtcccggcaaccgccttacttgtttgcttcacggttttagatgttacttaatatatctcgtcatgtgttttagatggttttttattttaataatctttatttttatcaaaaattttagttatttataaattgtattcctaattgaaatcttatttttcttgttctaattttagaattttttttaaaaaattatttaataccgtattgtgttattttaatgtttttattttttattttcaatttcagttgtttcaaaattgtattcctacttgaactctcttttattgttttctaactttggatattaatttattttttattctaaattttattgcttcacagcctccctgacgtctctccttttaatcgtcattatgattctatttggtgttttattaacaatttttatatgtcatatcaaccgtcaccactctactcctttataggcatgttacttaatatatctcgtcatgtgttttagatggttttttattttaataatatttatttttatcaaaaaatttagttatttataaattgtattactaatttaaatcttatttttatttttctaatttttagaatttttttaaaaaattatttaataccgtattgtgttattttaatgtttttattttttattttcaatttcagttgtttcaaaattgtattcctacttgaactctcttttattgttttctaactttggatattattttattttttattctaaattttaattaatctcgtattgggttcttatatggattcttttttcagtatgcttatttttaattccgaatttcagctaattttaaattgtattcctacttgaactcttcttttattttctttttctaattttagatttatttatttttattccgaattttacttaatctcgtattgggttcttatatggactcttcttttaatattccttatttttaattccgaatttcagctatttttaaatcgtattcctagttggactcttatttccttttctaattttggatcttattttatttttattttgaattttgattaatctcgtattgggttcttatatggaaacttctttcaatattgcttatttttaattccgaatttcagctatttttaaattgtatttctatttggactctcctttccttttctaattttggattttattttatttttatttcgaattttgattaatcacgtattgggttcctatatggactcctctttccatattgcatattttaaattccgaatttcagctatttttaattgtatttctactttgactctttttttctttttctccgattaatgtgggaatttctagccccacggcgaacgtggtgccttcgtttcgagctgtcttaataatataatagattctacagacaatggaacagtatattagtgacctgtgagatgagatggatagctaggcagggattattaattaacaaatggtgatgattagtttaatctctacacaacaaaggctaggtttggagccatgagcactggcacatggagcccctcatggccaaaaaagctagcttcagtaaacaactcaactaagatggcctcaccttcaaaagaaaagaaaacgaagaaaaaaaaagatggcttcagagactagtactactgtttgaaattcagaggctgcatgtgcagatgtacaagctggatgaatgacttggaactttgatgacgacagagacagatcagaccaggtaactagtacgagttaagtggagattacaactactaacagtctatcagaagtgatgactggtaagtttagtatgcacgcatatgcttgtcatttgtcaagatgatgcaaagtcacagattgatgttgaagtgttgaacggtgcaacgaagagatgaacaatctggtcgtcgggttaatctgtcccaagataaactagtaaagatgatggtgatgggaaattcagagtagaaaattttgcagttgttgcagaagatgcccaacgacaaagctcacaaaagagacggactttaccggtcacctacatacaactacaagtctaaagataagcagtcgaattaggataagccagggaagaaaaagcacaagacctgcaaagcatgacacgcaccagcaacttaactgatgtgcagagaaactaacaccatggaggcagacagaatgaaagaaagagattgttcagatgaatccaagaaggcaggagagatgttggcatgcagttgcaagatgatcaaaagcaatgatcaaaagcaatctggtaggttttggcaggcaagagagcttcagttcagctgatcaggagatgcagcagcatcagcaaattcagtaatgcatccaagcatggatgaagcgagagcacgacgcaatggacagcgacatggcgtgtgatgtgatgtgatcctggtgtgctgatacgcagcacatgccggcgccaaagttgcaggcttcttgcagccgcatgcaggttgtttaattttcttcccccccttgcttttctgaaagaagaagaagaaaagttcagacataaatctccatttgttggttacagatttgatgccgagaaaaaaggttgcaggtgtgaaaggaaatcccacttacaaaaagaaatttcatgcgggggaaaaaaaaggcaagaagtaatcaatggaggctgtacaggagaaggccaaattggcatttgtttttagttccaacacacaagactgaaaccagaaattgtgaagaattttggctgacaattggttggttttgctttggataaaaatgaaaaggaggatacaatccaactccaatactccatcgaatgaattttacctaaattccagtgtatatgcattgaatgattccaaatcaaagaagataaaaggttcagaaataatatacaggctctaaagagaacaaaagaaacaagaaatagagatcgtataactgggcctgaatcaaattgccaaaatgaacctagatcaaattaacaagacgggcccaaatgggcctacacgaatttatcaaaatgggcctaaactaatttatcaaaataagtctaagggtacgtttaagagatgaagattgaagaaaattgacaatatacacaaaactaggtaagtattagtacatgattaactgagtattaattattttaaacttaaaaataaattagtatgtttttaaagtaattttacttcattttttttaaaagaaaatacattaataattattttaaacataaaaatggattaaaatattttttaaagtaactttactattttttaaaagaaaatatatcgttcagctattcagaaagcgtgtgcgtggaaaacgtagaattttctcacactatcttcctctctctcaaacactgctctaaaccaattttactaaatgggcctaaccaaactgcctgtatgggcctaggagtacatgggcctaaatccataggctcccgtctaaccagtgggctaacccacttcccattctcgagggctcgtgtcttgtccgagtcgccggcggcggcggcggcggcggcgatgttgcggtcggcgctgcgccggggaggggcggccgtgaggcacgccgcgtcgtcgtcgtcggcggcggaggcggcagcggacggatctccgggtgcccttctccggcggaaagtggcggagcgggagcgcgcgcggaggcggccacgggacccgtcccgcgacgagttcttcgtggcgacgccggagtcgctcgcgtggctcgactcggcctccctccccatggtgctcacggcggccgccatcgcgctcttcaccaagctgctcatgatggtatcccttctcccgccgcgctgattagccttgtcactggggcgatgtgcgtcccccacccctagggtttacttgctgatgatgctatcttgctagcgccgtgtgtttgcttgaaatccgagtgagccacatgatgaatgcgcctgtgtatgaccacattatacactggattaaattcccatgctgcttttgcgaattgcgacggagccattttgctctattatgagcgtgtgcagctgttaacctttaggaacaagtagaaatgtctttcggaaatgattttgtaaagtaattgaagattgtttggatatggaaaatagatagatatagaaatgccaagattttctttagttgtttgatgtctgtctgaatgtatagtttacagaaaaatgtttcctatgggatagggcttgttgaaatctgcaattcaatcatggcctttggatatgcatttttgtttgatattacacttcaatccatatttgtctcactccaatttcacttcattacccatgagctaataactgccttaagttttgatggtaagatttgggaattcttcttgactcttgtgaactaaatcaaattagttgttaccaactgcatgatgtgcccttccatgggaaatgacaactgtgctgaattttagttgtatgttgtgggaaggaacatgatgcagcagatcaagaaagaggagacgcaagataaagaatagccaccctgatcaaggaaaagtaaggatgcttacgcgtgaagaatgggatgagatccaagaagtcaggccaaggaccccttttgaatcgaagttagctcgtccgcatgcccgtataagaactggggaaccagtacggctggttagtagctgacataacttctacatcgatgcatttccccaatattaattttgatattcagaattaattgaagttggcattctgatattcagaattgcttcatctacactgtcgcttccatgctgaaaaaaataagtgttgatgatatatgctagatagtgatatcgttacatgtttaaacaaccgagagctgcaagacttccttgcagcttggtttgactggcatcctaagctaattaagttacttcttacctgtatacagtttacagttttatgcttttaaccacctttctttacatagcttatgttaatgcttctctttataacccttctttgtaggaggatgtcaaggattgggctaccgatatgatcatggatgcttttactagagcagaagaaagtgctaagaaaaaatgattcagaagaaatggacaacactaaatacgtatgctttgaggttcacctgaatgcatagttagttaacttttcttttaatttcggttcctgtaaatggccacttttgtgagtcatgatatccgtgtagaataatatttatgtacttcctccttttcatattataagactttctagcattgtccatatattcatgtctagattcattaacgtatatatgaatgtgggcaatgctagaaagtcttataatatgaaacggagggagtagtaccaatatatgcttttggaactgcacaaagctgcccccaagcagcccatgtctgtcttggcctgagcaccagagattgaagttaattgtaccattttcattttcatagataaatggctgatggtccagcccaaacccaataaattgtgagttcgagtggctcaatggcccaaactgtcaccggttgagcaaaagtggtgaagttttcaaaggtttcttctgaggtggtgtttggatcacagggactaattttagtccctgtcacattggatgttgggatactgattagaattattaaacgtagactattgacagaacctatttcataaccctggactaattcgcgagatgaattaattgagcctaattaatccatgattagcatatgtgatgctacagtaaacatgtgctaattatggattaattaggttttaaaaaaatttcacgcgaattagctctcatttatgtaattaattttgtaagtggtctatgtttaatactctaaattagtatccaaacatctaatgtgacaggaacaaagtccctggtccaaacaccccgtctgttacaatactggcaagtggtgaaccacaccaaggatccgtgaatcttcatcgtcagtctggccaggttcatctggaaaggtaataatgtacttactgtataatctctttaaccagagtttcggcactcctcgctctcgtgattgggcgacaatcgcgtgagtcatctgagtttggatagagaggccaataattcccatctgagtttgtgacttggtcctgattgctcagatgtgcttggttttctcacttcgccatcttttactccttggccgatactgccacatttactgtgattccctcgatgcacgcgagtgcacgtcgttgacgcagacgccagacatggaccgatagaacagggacagtttttggaatctgattcgctgagtgaagagtgaagtggcataatagatttgtttgtcatttgtgaatattttcggatgaagactgatggatgatagatttgtttgtaaatgtggctgttaccagttattccctccttccttttatatactatctccgtccttaaatacgaagg

SEQ ID NO: 63987 - DNA, 24027 bp, Oryza sativa
gctgttcgcgtcgttcgttctcatgtcggttgggtcgggtggcatccgcccgtgcgcgctggcgttcggggcggaccagctggaccggcgcgacaacagcgcccggaacgtgcgtacgctgcagaccttcttcaactggtactacaccgtgctgggcctctccatcgtgctcgcctccaccgtcatcgtgtacatccagcaggccaaggggtgggtcatcggcttcgccgtgcccgtcgtgctcatgctcaccgcgctcacgctgctcctcctcggctcgcccttctacctcaaggcggaggccgacaggagcgtgctcgtcggcctcgtgcaggtgctcgtcgccagctacaggaagaggaggggtcccttgccgccggagacggccgacgcgtcgcgcttccacaaccgggccgggtacaagccgaggactccgtcgaacaggttgaggtggttgaaccgtgcgtgcgcgctgggggacaacccggacaaggaggtgaaccccgacgacggctcggcgcgcgacccgtggacgctgtgcacggtgcagcaggtggaggacgtcaaggccgccgtccgcgtgctgccgatatggtcgacggggttcatgcccggcgtgatcatcggccagcagatgttccccgtgctgcaggcgaagacgatggagcggcgggtgggcgggctggagatccccgcggcgtcgttcggcgtcttcagcatcctcacgctcaccgtctgggtggccgtctacgaccgcgcgctcgtccgcccgctgtcgcggctcaccggccacgcgcgcggcgtcaccctgcggcagcggatgggcatcggcctggcgctcttcgccgtggccatggccgtggccgcgcgcaccgaggccgcccgccgcgccgaggcgctggccgagggtctccgcgactacggcccgcagtcgggccgcgccgtgcgcatgtccgccatgcggctggtgccgcagcactgcatcacgggactcgccgaggcgctgaacctgatcgggcagatcgagttctactactccgagttccccaagaccatgtccagcatcggcgtctcgctgctggcgctcggcatggggttcggcagcgtggccgggagcgccatcgtcggggccatcaacgccggcaccaggagcggcggcggccgcgacagctggctctccagcaacctcaacagggggcactacgactactactacctcgtcctcgccgcgctgtgcgttgccaacctcgcctacttcgtgtggtgcggatgggcgtacggcgaggagggccagaaccgggtgaccgcggaggaggaagcggtggaagacaccaagaccaaggaagaacagcagcagaaactgtaaaacctttttagtgaggcaggctgctgctgtgttctgcttcagctttctacttctctagttctctcttgtgaaaattgtagtaatatttacatgtatatgttggtgcaaaaatggatggttcgacctcgaatcctatcagccctccggatccaaagatcctacagggcacaggctgctacctgcaacgttaaaatgctagtagtagcagcagtttttttttttctgttacttggatgggttgcatataagtagtgataaaaacggtgacagaaattttctaccgaccgaacatcgttttggtaaaagtagtatggttcgattctactgtagtaaatataaaatttgacttttctaatttcttttaacccttgttcggttaatcctcatgagggaggcaatggagggtatttattccacacctatttgtggtgtggaattattcccccttaatcccctccaaaccgaacaagaccttaatgtgatattacaatggtggcaagtatagctaatgtttttcacttgtaaagtttactcctcctctattcaatgaaattggcagcttgccgattcgttcaaaaaaaaaagtatagctaattctcgactgaccgataatcgtttacatagagatacttccattttcgatcctccgtagagacctactcgtcagcagtcgtcagcattcgccagcatcaaacggacatgataagatgatcaccgcttctcttgcagccttcagcattaatgctgcttgagtgcttgttgctggcgccaaaatgctgatgaaccaacagacaagatagctcccgctaaaaccagttacgcactgcaatcaatatgcagttttgctcgacgtagcgcatggatcattcagtggttgaatacgatgtagacaaaattcaacgaggcctccttgtttcccaattctcatcatggtcttcatcagtccaactgttgctgaccatcataggcattaaacacttaaatgctggcgttacattttgtttgcttgccactatttctgccgatttcccgataagaaagccataaccttggagacttcggatataaatctcttctccctcaggtgctatagcaaattgttgcttctctgtgtgctccgggtaaactaaggtaactgctcgattccctatccttttccttagcttatcttctcttctcttcctcttagcgctatcttgtgtcacgccaactgcaatagtagtatagtactccaccatttgcatcggtagatgattttatagcttgttcttaatttcaagaatacgttttccttgatctctatgggaaaaccatgtgttgagctcggtggttggggtcacgagtttgatcactatctcctaccttggatcaaagaggtgcagtggtttctctgttgcaagatcctttatgcaattttcctggaaaaaaacaggtcccagaaagagtgccctttttctttgctgttcctcaaagttacattttcctgctaggcaacagacataacttgtacattatagcctctaaggtaaacattaacggaaacaaacacataagaaatactgttcactgatagatgcatctgtataaagcgttgcccatggttaatcacctccacccacttaccagctactgcccttttagctttgcagaagatggaagctcaagaaggtgatgtgaaaagctgtgaggcctccaaagtgaaatggaaaggtggatttgtagccctaccgttcatcataggtatgttaccattttttttcgtcttttatgttttacttcaagggtatcgttggatggcagaattttcaaaggaattttggaggattctgatactaagatttttttttcctgcaatagttgtttggaacatacaaacgaagcaattatattctgatgaattggtttcatatgccctaaatttaaaagcaaatattgtacagttttcccccttctacaatacaaatacaccccgtggggtttcaaaaaaaataaatttaaaagcaaataaatatgagctcaaacacccatgtttttactttctaaagttcagtgcattctatcttcctctcttttgactctctattgaaaaaacaaatatactttcttatggattcattatcatttgcttgttggcttatctagtgtagccaaaatttgaattttcaaacttaagttcaaaattgatttgggggctttttcgtcatagactattttctagccaaggcttttagactgctaataatagagatataaaagttttaattataaattattttttgtttttgtttatttttctataacatatcaatcgtagctcaaccgatcagggccagccaaatgactcccatattcatgtgtcctgaaatcttgtgggataaggtagcatgtccaaaattattcatgggttttcccttttcttgcggttttagaaccgtgcattccagtgaggcccttatctttcttgttatagttagatcacctcaaattgcacgcttgaagctgttagatttagtaccttcattttatacattcgttaatttactagtgacttcaaatggtttacgcaattacgcgctttattttccagtaattaatgtactcgattatgtatttcctatctttgaatgtattgagcactgcatagcttgccatgtcctcctacaaggaacaaaactgaaccaagcgccttggacacaccgagcatttccaaatggaccacaggtagaactgtcttgattatcggtgtggcagtggcagttcagtggcactgcggtagaatgacaaacctagaacgatcgctggcgataaagctgtcactttgagggcaaatcaagggaaaatggtaatgttcagttgggaattctagaaagcaaagccaccgatggagtactagagagattttttggactggcagggaaaaaacggccatcttaaattgtgcgctgccgaagattgcaggagagatacatatgtgaactcatctgcatttcagaaatagctaaagcatatcatcttagttattttcagcataagtgctccaacttagtcaagtaacaggtaaactgaagattacagtgacgcatattcacatgctgtgttccggaagaggcgtttccctccctactaggattcctacttgctactgctttgcctagattaagagctagtagtagttgtccaccttatgacctaactaccgtctaccggttgatataatttaacgaggttatgcgccgtggtacaagatcctgccactctttgctaaatcctgtaggcgtagcaattagcatttcatttctactgcgccatggagcactctcttgttgctgaggctgaagcacaagtgttcttcaaggccaaggccaagggtggtttcagagccctcccttttatcatctgtaagttcgaactgaaattcatacaaatggatttcagaaaccactgatcagagtatttatgcaaatggatttatgaaatccttcgtttctttcttgttttctttgagatgacatgagtcaagttctagaatctagatgcatatgattggcctatgatattcatatgtgaactttttcaggatagtgatgtccatcaatggtgactgtgcccttcaattgagtaaattcaatctgacggagtttcttgtttcctttgcatctccttagcaaacgagatactggagaaggttgctggattcgggctcaacatcaacttcatcacgtacctcaacatgcagtaccacctgagccatgccaacgccggaagcctcctcttcgtgtggggcgcagtatcaaacttcgcgcccatccccggcgccgtcattgccgacatgtacctcggccgcttcatcgtcgtcgcgatcggctccatcgcctgcttcgttgtgagtgcaaaaagaagatgagatttccattgacaccggaggagatcgaacaccgagctgatgtgctttgctttgcttgtttcaggggatggttttcctgtggctgagcgccatgatacccggagcgaggccgccaccgtgcgacatgagtgcctcgccggagctgtgcgcgccgccggaggcgaggcacatggcctggctgctggccggcttcgtgttcctgtccgtcggcgccggcggcgtccggccgtgctcgatggcgttcggggccgaccagttctccaggcaccccaaggagaggaggtccaggatcctgcaggtgtacttcaacgcctactacggctccatcggcgtggcgttcatggtcgccgtcacggtggtcgtgtacgtgcaggacaacctcgggtggaaggtggggctcgccgtgccgacgtgcctcatgctgctctccgctgcgagcttcctcctcggctccggcctatacatcaaggacaggggctccaagcggatgttcgccgggataggcgccgccgtcgccgcggcggtcaggaaccgtagggcgtggctgccggcgaagaccgaggacggcgtgtaccatcacctcaaggactgcaagctcaccgttccgacggacaggctgaggtaagcgacgatcgatcagcaatgcagcttgacaatggtgcgaattgctgttcaaagatgcatgattcgaagttcatgtggtgtgatcgatctgttcaggttcttgaacaaggcgtgcatgatcagcaacacgaaggaggacaagtctggtagtggcggcgcggacggcatcagcgacagagggcggctgtgcacggtggaccaggtggagcagctcaagtcggcgatccgcgtgatgccgatctggtcgtccaccatcttcctcgcgcaggccatgaaccagtacttcgcggtgccgcaggccgacgcgatggaccggcgcgtcggcgccggcgggttccgcgtgcccagtggcacgttcgccgtgttcaacatgctcaccatgtcgctctggtcgggctgctacgaccggtggaccgcgccggcgctgcggcggctgacgggcaacccgcgggggctgaccatgaagcagcggatcggcgggggcctggtgttcggcaccgcggcgatggccgcggccgccgtggtggaggccgcgcggcgcaggcaggcgctgggcggcggcggcatgtcggcgttctggctcgtgccgcagtacgcgctggcggggctcgccgaggcgttcggcgtgatcggggtgatcgagttcttctacaccgagctgcccaagagcatggccagcttcagcatggctctgctctacatggccctgggggcggggagcctggtggggagcttgatcatcaagttggtccacgaggtgagcgggcggagagggaggacgagctggctggcggaggacttgaacgccggccgctacgactactactactggcttctcgccggccttggcgccgtcaacttcgtctacttcctctggtgcggctgggcgtacggcgaggaggggcagaacgtggagtgggaagacgaaggtgagggagagacgactatagcttagtagttttgtgctgaagcatgcatgtggattgctgggaacttgtgacaatgtggaacctttcctatggttatgctaatatgaagcctatggtttggttgccccatgaaaatagcagtttgcagggttgattctctggaccatacgcaatatcgtcacgttgatcatctttgtccattgcagtggcattggccaaggaaaaatatcggcaactcagttggccatttattagaaaacactatatctatgaatctcttatttggaaaataaaaaaccaaatctatgaatatatctctagtgttttgctagaagtgacttccttttggttttggttattcagcaaaattatcaatgcgaaaaatatttattagctaaccattacaatgtctgccttcctggaaccacagctaagctcctaataatttcttcagctccttcttgttgacctgataaaagcaataggtaagtaacaaactcaacacaactgcaaagaagaaaaaattttcagcccgcacctttcccatggcattccgaggaagcgaatcccataagtacaacctcgtaggaatctatcatgcatagaaaaagaattaactccagcggggaaaaagatttcagttcgggatcagataaaagctaagctgtacgtgttaatataagcaaaggatatgtaaacttaaccagaagtggttgagaaaaacatgagtcaggaaccatcccttgcgcacgcaaaatatgaattgagaacttcatagtacttccaaggtaatatgtgtaacttttgtggatggagggagtatcacgcaacagtcaaaagagaacactaaaaaaggcaacctcacaaataaggccatactgtaaagttgctagggaaagggggaaaacatgtagaaaatcaaaccttgtatggagcaagcttatcttttgaccaacttgtcagtgcttccaaggtcagtgctggtttcgagtccagttcagctcttttctttgagtcctccttaggcacaattattgcacagataatctctccataagcttcgtcaggtaagccgagaacagcacattccaggacaatttcatgctaaacaagaaatcaaaccagagtaaacaagatgagtaaccttcaactaaaccattgggctgtcttcaattagataggtttacaaagtgactattggaaactattcaagtaaaatggagattttaagtttttacctttattattgtctacctttattcttaccacaaggaaagtactacgtatcagcaagttctttcaaggcagtacgtttgctaataatgtctagtgtggggatatttacctgtaacagcactgactcaatttctaatgcagacagcttataaccaccaactttcatgatgtcagcatttgtgcctacacaggataatacaaatgagacagataacccaaaacgattacaaatagacagtagcaccacaacttaaacaaaaaaacacaactagtggaaaacgatgaagtggtccttacgccctaaaattatgaaatatccttcatcgtctacagttactgtatcaccagtcttgaagaacccaccatcaataaatgattctgcagtaacctgcaatacaaattaactgtgctgaacaacgaaacaaagacatttgattctcaacatgcacccttcatttggttccttagtggttagcaaattctgctaagtttgtatggtgcagcttagaagtcatgtcaatcacaacacccacaaaaggaatgcaccacactggtttcttattaagacacaaataacaggcaagagcataccaacaagtatagtccatattaacaaagaacaggctacagagttgggtgaaaaaaatatgaagcaacactaccctttaattagcaatctacaacgaatgggttttagtaaaataaggatgcaactcatggagattatttacaaataaataatgtacgcaatcaaaatgaaatgtataagtttatttcttgtgcatcattcacaatagataaaggttgactgttgggagaattagcaaatgattgttttaattgacgaggaaaatactttatcaatcatagacttcatatttttgtttatgaaaacacaaccatacctctggttttctccaatattccttaaaaagggatggacttctaatacaaagctcgccaacttcagatgtagtttcagccccatcctccataataatcttggcctgggaaagaatggttctgtaagtgccatgaggcaatacagaataaattagtttgatgttatcctaacttccatggatcgtttagcatacctcaacacacggaagcggtttgccaactgtaccttctttacgtgcaccatgcaatgggttagacagtgccatgacaaactacaaccaataagactgtcaaaacatgaaaaaatgatatcatatttatgaaatgtaagtccatagaaaaggaagagttcgtgtttttaacctcagtcatgccgtatcgttccaaaagacggtgacctgtcacttcctcccaccgtttcataagtggggaaggaagggccgatgatccacacatctgcaccagttcatataatgttaataacaaaaatttagataataattacatcagtccacattatgatagtgcttaataaagcctacaagccaaagaatactatacatcattacctagagctcgaaaagttgaatacaaacaaagtcatttggcttcagtgcccagcagaatcaaataaaacacctaaaataaatatagatgcatattgcaagctcacaaaggcatcatgcaagaaacttcatctgcttttcaagttatcgtggtgttagaaacctaaagtcagtgagaccacagttatcggatatattgagtcctgaggtgcttaattaagtactttagtgcttgatcgagcaagcatggccaatgaaccagttggactttgcaagttgaatagcaggattgaagggttcatgacccttgatctatctatcgtactaccatataacatacatatatttgcacattttcaacagatagtaatcagattttgtccatagtaactatctactagtcttttcaggaacatagtacggactgaaacacatgagttgtaattttgcctgacgcgtgaagtttagtctaaccaaggtccaagaatcaatacaattacttgcaagatatatatacaactgaccattagcctcaattgctttgcagcaaaggaagatgcagactgttgttcaggatccataccatcatacccttgcaatagccgtgtgtacattgttggaacctggtagtccaaaagtatcgaataaccataatgcctcgagcaatttaaggacaggtaatagtttagcataaatctaaaaaaccaaaaatatatggcatagaaccgtactccagtaaatactgtaattgcttcatcatttttactgccattgttgggatatgactcacgccacctctgccatattcccctcacactaaatttcggcatgaactcaacctgcaacctcagagaatatatattagcatggaagaaattttgacacaagatgcattgtatgtgactcctaaaacaaaattaaaggcttaaagtaacacatcatacgaccagaaaggaaacccaagtgctacaaaagactggttcatttaaacaaaatcacaacatcaatcgatcaagtgaagcactatgcacatgctgaataaagcatttgagatattagtaaaagtaaggtcaattaccactgatccagaatagaggggtgcaaatagagcattgaacaggccatgaacatgtaaatttgaagttaaggaccttaataaatctcgcaaaagaaggcatggttcctccaaaaacaattatagggaaatctaatgcaatccattactataaaacattgtgctaagtacttaaaatagcatttagcattagctttttgtggatatggtgcagtgggagacagtgcagaaattgatcttcacttcgatatccccatgcctctgacagaatttgaacctgccaaaccacatgaaccacaaatacctttagatcagtcaaaagtagataagcagtatcgtgaaaggtggtaaaatatagaaataacatcagtaaagtgaaaattgctaacttcattcagactgtcccaagaggcataatctattaaaagttagaaaaaaatgcacctgagagactatccccttatgagtgtggaccactccttttggtttaccagttgtcccacttgtgtaaaggatgagagcaggatcatctcctgtagtatcaaaccccagcatggttaggcagctttggaattaatattgattattgagaaaatcaatgattgaaaatgacacaaaatacagtatagaaaagtagcagcagaaatcaataggtatgactgccacgaaaaacagaatcactcacctctgatttcctttgaactgtcaatctcagctattaagctagaaatagacgaagtcacttcagtacttgatggttcttggcaatctatatttactggtatacttgtcacagatggaagaagagaacagtgagcagaacatttggtagagatattctccatgatgtcttgatgctccttggtgcttaaaatcagcgaaatgtcctataggtttcagcagttagaataaaagggacatatttcaaaatttatagtaaattgcaaatgtatgcccttgtacaaaaaaatgttgactttgtatttgtgtaagaaggtgtctagactgtcccccagtggcccattgaagaaatgctgcttgctgcgtggccctttttaaacatctatttctaattttggctcagtttacaatattaagatgaaaagaagtgcatagcaagagaagtaaactcgtgatgtgttttcctggtgttgcccctcctctttttttcttaccttgctgctttctcattgaaactggcgttttttttgggagagagagagagagagagagagagagagagagagaggtgtgtagtatgatagtagaatggcatctttcttgtgtaagtacatctattgcaaaaataaatcactgcaacaagttttagaacaaaccgagtcattcatgacatgaaggagttcagcttcaggatagctaagtgctagaggcactgcaactccaccagaaagccaggttccaaatatcccggcaacaaattcaggagaaggtttagccactatgccaatacgagctccaccaaggaatccagttccatttattcctttgacagatgaacctgtacttccattctgtgtcatctacaagaaaaacagcagaagaggtgatcaggcatcatcaacagccattgatcaggttaagataagatcgtgataaacatattataatcacataacaggaaatctcaagtgaacgaagataaaacaacatacagagaaggagagcggtggtacatttttattgcgcagaatattgtagacatccagtgcagatgcaatgagctggacaaggttataactcttttggtcagatctgatggctgcatggacaccttgtgtcgaaccatgcttaaggacttcctgaacaacctccatgaacgtactagtagtattttgtgtggtgttgtaagctagtaaaacacaagatgaaagtttcaatatcagaaaatataaatgcactagaatttacagtaaaatagtaattgctaattaattcatatggttcaccgttctggccttgcatacccaatcggcagtagctcctcgcggaacagaccgaatcaatatagaccactaggtaatccataacacctctatgaggcacaaccttaccggtgaactcaattaagcacaaaccaggaaggagtggttatgaatcgtgacgtatcaatgtcgatgtgattatcaatgactagttggaagtggctcggctgttcaacaataacaattcactaatcagtaaccaccgaccaacccatgcgtgctgtacctactaggaatattggatatagagctaactgcattctgcgtacgtagcatcgtaggacccaacagacaggtttagaagcaaattcggaccactcctccatgataacgcagattgtaccactgatcatcatcgcagcagactcatcaggtagccctttagaaacccactaggaccactcttccatctccatgaggagaggacgcaacttattcactgatcaactcgagctcgaccacttgcacaccgaatccctcatcaaaacaacgaaaacgaagcatgacggggcacaccccgagagaacccgcggctggatactgctactaggcgagacaccccgccactgaagcaaaacagcgaacacctcccgatcgtgaacccagagcacggaggagaaacagagtcccccctgaacgaaaacaaaacgcgggtgcggcaaaacgacgaacacctggcgcggcagaaaaaagaggagaggaaacggggagactgacctggcgaggaggagcgggaggaggaggaggaggaggaggaggcgaagtggcgtcggaggcgagagaggagggaataagaggagcaggggaggaggagcaggtggtagggggaggaggaggcgtgggccgcggggcaattgaatggcgtcatcaagcgcgccaccgccccgcgcacccacgcctgtgcgcgcatttacgggcaggctgtgccgggtaggtgaactcccctggccgcggcactgttccgtgctcgtactcgtaccacagcagcggactggcggtaggttgctcgctcgctggtggccgcgggccggtggcgccccgcgtgttcgcgcgaagggggaaagaggaagagccggacggacgggggcacggggccgtcagtttgctcggttttttcggtttttcctttcctttcttttattttttccttctccggctgtactggtttggtcgtcgacggcgtacgttggtacggcttgtcaatcgactgctatcggcgccacagcgtcgtggttgttgtctgacattgcaacaactcaatttgctataggtgtggcatggtaaataaaggggttgtttggttcttaactaacattgtcacaatgttagacaagtgtggcttgccacactttttgtgtcctataaattgtaagccacacttgtgacaaagttaggcaaaaaaaattaagtctatgacatgcgtagtaagatgataagaaagtgtggcttgccataactatggcaatgaaccaaacacaagactaaagatgtgtggcagcctaaagtgtggtgtggcaagttgaagtattgaaccaaacagccctaaagtgtggccaacaatttgttagccacaagtgtggcaatgtttggctagaaattgagtatatgacatgtaggcccatggaacaagaaagttgtggcttgccacaactgaaacaagcaaccaaacgttaagctaacaatctgtggcatgtctaacatgtggtgtagtaatatgtggcaactaaccaaacagccctaaatgtctgctgaagattatcaatgtgagacatacatctgttcagatttattatactaaaatatatcacagctagtcctagatttttttttcaggatggagggagtatgttctttccttgtttatccatatctctaataaagcgttccattttttttataagtttattagtttaaatttttaagctattttttaatgattttatactttaattcaaatgtatagttctactctaattcacataagaaaaaaaccatttaaacatgcatatcatcatcattagtaagatgttttttaaaatcctcaccgctatgctgggaggcatgacgttggcccattcctctcgcccaataggatacgtgtagccaagacctatatagaaagctagtgaagattggtgatggcctgtactatctaaaactacatacgtggttgtacccctcactcgaggttgtctaggacctacacatagtcgggtactcgggtggaaccatttgcacgaagacattctgcaaggtgacacagtgtgcttagggaagtccaaaagtacctgcgagaagactatttgagagatgacatgtggcagtgattgagatagcccaaaggcgcccacgaggaaattgtcctagggacaacacgtggcgaatgctcagggcaactcgggagcactcgtaaagagattatcccaagaagcgacgcatggtgatgcccgagccagcaggtacgttgtgtcggtattcttgacactcacacatggtgtgcccttgcactagggcgtaggctcatgcacgagaaccccaataggggaaccacacatacctatatcctgacaccaaggctcgcatgtcccatcattccatattaataagtgcactcaaagtcggttgaggacattaaatatgggtgattcagtgaatcgcacctccccaaaccatcttttctttgaccgatccattatgttaagagagaggcacggtcaatagcatgtttgaggcggggctgcgtagcatgacatggaagaatgaacaagggatagacggtatgacagcaggtacagtgtagatcatgatgtatatctacagtaccttagcaacgcacccccccttcccccgagttaggtagaccttgaaaggtgtataaattgacaagggattgccaagaagaaggttgaacacagttagatacacgataatacacaaaagctctaggtgccccagatttagccgaacttccacatattaatcaagagaacgggactacgggagtagatttattgttctccggaggcccaaacctgtataattcgttcgtgtttgtcaaatcttgttctatctgctattacacgttgacaatagcttttgacttaatagtacaagggtgacatatactttttaaaaaattgttgggtctctaacatagaactaagggcatgtttggtagagctccaactcctaaatttagctccaggagttaagtctagagtggggttgtggagctgcgtaaacctagctcacctatctagtttattttgtgatagagcttcacccaaacctgctcccaatttaggtggagctgaaactatttggctgggctccagtttcaagagaggtggagctgaagctagagccgtgccaaacaagccctaagaccattagggttgtttggcagtgctatttgtagccgtcctgcaacaactaaccaactgaatgcattgaagataaccatgctacacggctataatgcggcgtggcctgttgcagccagtgttctcgaatagccccattgtaaatgaatggataagcttaaaaaaactcgtgccttagaaatacacgagtcaacgcccttggccgtcaactcaaaaccttggttgaattatgcctcttcttagttgccactttaccaatcacctcacttgtttgttggattatcaaacgtaaacggaattttaaattctaaaacttaattttaagtatactggggattttgtttattgcagtctactttcaatcttagtgtttaaactgctaataaaagtttcacttataaactattttggttgttttgttattttttaagctcatcaactgtaggtgtctttactgtgaaactttatgtgttccgtatcatacatctattccaaaatacctttttcatatgcgatatctgaatatacatcacatagtgctatcctagaaactaccagtagcattttttgaaaagcaaaatatgtgtcccatggctcaaaatatgcaagccttagcccatccaaagaaaagcctgcgaacctaatacggcgttaacctcgacggaatcaacaagtgggcctcaaatgggccttactgaaactgacagaactgcaagtcacatctttcaaacccgccacaagagattcagcataacgcacggtgtacatccctttcatctatttacaccaatgacaggtgggtacatcacccgcgcctggtcccacccgtcatggagaataacaaacccaccagcactttccagagaaacaaactccacgtgtgacaggacggatcacatcaacgacgccgacgccgcaagaaggcccgatctccggcccacccacgtcaccccacccactggctgcgcggccccaccgaaagctccagcgcccgtgaccccacgcgtcagccgcggtggactcggcgagcgacgcgtaacgcgcccacctcatcgcgaagggcggaagcattcagccacccccccaccccgtcgaatcgaacggcgagcggcccaacaacctaacgtctatgaattcgagccgcaggatgtggcccggccgcgctccgccgtccgatccccgcacgcccccaggatccggccgtagaatatgaatttgatttcgaaagcgaagagtgggaggagaaagaaagggggtggagaaagaaagagagagaagagggggaggaggagagaagctgcagcaagagggaaaatccactaatccccaactcggagactcctcctctctgaaatccgccattccctacccctccgccgcaaacacgcgcgcgtggggagctcgcggcgaatccagcctcgccagccccggccgcgcggggacgccttgcccccgatctggcgacggcggccgcgatctcgccgcgcgcctcggcggctgcggcgaattgggggtgggggtggggtggagtggagtttcgataggtgtggcggggagggagggagggagaaggggcggcgtgttgatctggtagcttcgtgggggttgggtggattagatagatggcggggaaggagcaacaggggggaggagggccgccgccgccgccgcgggcgccggtgcccgcggcgtcgtcgcagccgccgattaagaagctggtgaggcagctcgacttcacctcggcggcgttggcgggtaaccccgcgatggcggcggccgcggccgccgtgtccagggcgctgcagccgagggcggtcccggtggggttcccgcagccgcagcaacttagggcgcacctgccggtgggggtgccgcagcagctgcatccccggggcctgccggtgatgcggtcgcaccacgtggtgcatgtgccgctgccgcggccggcggtggccgtggcggtgcccgtgccacaggttcggccggcgcagccgcagccagtgccgcggccaccggtcgccgttccattgtgagtgtgccagtacctagatttatgtttagcatcaagctttacatttttacttctcaattgggtaatttctctcttctaactcctttttggtgattcatttcatcggaggaagactgtttttctttttctttttgtttgtaagccaaagtttcaaacttggtttcgattttactttgcccttatctttccttggaaatggaaggatggaccctttgtttttttttttcacttgcatctatatttgatattaccctcgttcttattacgatcttagttgatgcaaattccctatttctattttttctcttgttattttgcgtcatgttccaagatgttcttattgtgctttgaatctgtattgtaggaaaccagagtcaccaaagccaccacgggcacggctttatgaagggaaagatggcaccccgacaaagaagaagtgctgcaactgcaagcactccaaatgtttgaagttgtaagtcagattacatgccttagcttgaaaacggtgcaatgttgcaactggagtacccttctgagtaactctagtctggataacgttggatccaaaagagtttattttatttgctacagatgctaggacatatgtaaacttgtaaagtgaaattgtcttgagtttcttttaatccaaaagcttatatagatggatgctcaatccttttttttaataaaaagctggatgataatagcatggtcccaaacttgaccaatagcattcacagtgtgaccaaatacttgatcttatggtattgtaagatttctctagtatatacttgtcgcaagttagctggtctggataattataaaatgttatattatatatgtatccggaaaaacttatgggttagctctgggctctggcttttaccatctaagttccaatatgcatccaaaacgatgtatactagaaatgtggttcatctgattcacggtacatgaacatgatttggttctgcagtttaatgcgtttctgttcgatttccactgtagactcaaaacgcatacctctgttgtctctggtacctctttcactatgcttgtaaggttttgtgtactgatagttgatattatcaatctggatctcatggttttctatgtttaggtattgtgaatgctttgcatcgggtgtttactgtgatggatgcaactgttccaactgttttaataatgttaagaacgagactgctaggcgtgaagctattgatgctacattggagcgcaaccctgatgcattcaggcctaagattgggagtagcccgcatgctaaccggaataatatggtatgttttgagttccatgtcttaaatgagtagttagatatacatgctaagggtgttcaataattgatgcccgttacttctggagtattaatgattcatacaaggaatgtccgtgcatatggtgcaatcacatgtaattctcatttgaaaatcgaaatgaagctataaactaattgaatgcaaatgtagaacaggggaaggcttgggaaattacacaagttcaatgaggaactaaattgctactctctacaactaagaaatttacagtttggatgccatatttcagtaaaagggcatgcaacctagtagttacagtgctcaagtagcacctctaggtcctggattcgactccccatgggagcgaatttcaagcttagttagaaaaggtcactcattggcccctcataaaaacgtgttaagaattgacctatggaggacgagcatgggttaaggaccaatccatagggagcgagtccacgtgtggggggctgggtttagtggcctttctcggtcggattggttgaagcttcttcttaatgaaaagctgtgaacatggtctttccccaactggtcgagtattttttggatgccatgtttcatttttgtacatctcattatctgatttgccctgctatgatgcgtgtacttaatgttagtccctgaaattgccaggaggcggctggtgatcttccattagttgggaagcataataaagggtgccactgcaagaagtcaggttgtctcaagaagtactgtgagtgcttccaagctaacatactttgctctgaaaattgcaagtgtatggattgcaagaatttcgaagggagtgaagaaagaaaagctcttttccaaggggatcataaaaattccattcacatgcagcaagcagcaaatgcagcagtaaatggtgctattggagcagcagccttttcttctccttccgcatccaggaagagaaagcacatagatccttcccttgaccactcggccaaggaaaatggagctcacaggactaatcatgtacctcaggtaatgacaatttctagatttcagcaggcagttcagtttttccctaatacctccgtctgtgcatactgcatagctttgtgtttttgaggtattgacttcagtgatgggtggaagtggtctgctccatcaaaaaaaaattatttataccatgcatacaagtcatctgatgaacggtgtttcagatgtgtggttctgagggataggatagttattgactagcgctattgcttttttgatcagaaaggaaaaggactttccgtttgtatcagtgccgcacgtttacaacgacccactgttacattacatacccttctaattgacatccccatcagtttagcacaactaacacaatatctacctcactcttgggtttgtaccagcaatttatgcactggactgctcttttgaaggggccaacaactgtactatagataaattttgagttattagttctccgtgatacagaagtggtaactcctcatatactgctacttataaatgagtatgcaaatattttcttgagggatacaaattcctctacaacagattcaccaaaaaattggactaacccagataatcataagctgctaatagcaagagttatttcagggttctggtagggttttttgtatactctttgtgatttaattaggttttttatcagaagaatggaatgccatccgatggcccgcttccaataaaccagcctgtgcatcctccaacattggggccctttaaggtcacctacaggtaactgtcaacttctatcacttttccttgagaagatcaatcatacctgtttttgttgatggctttgtacccttccattataggcctcttttagcggatattgtccaaccaggagacgtaaaggaactttgcaagcttttggtggttgtatctggaaatgctgcaaaggcatacgctggtattgctggtcttacattttgggattttattaatttgcttgagaaagtattcatgggcatcctgtgctgcacataacttaatctttgttagaggcttagagccattcaaacaacttgcattaatctgcacatccttgtttcattttaccattccagattcaaactatgttttacttttcttgaaaactaagttgcactagcacataagcttttagttcaactctcatcttttcttgggcttggattttggatacctacgcagtgaagatatttaactatttgccactcttagatgcagcatttaacaatttgccacatgggcccacatatcttagacaaatgagggcccacatatcatagacacatgagtggcaaattgttaaacggcaaatctaaaagtggcaaatagttaaatgccccatctgttggtcactttgaagagagaaaaaacccaacactatagggttccatgtgctgcttcctctccattttttgtatttcaaataaatggttttataagatttcttttggaaccctaaatgaatatgaagctattccaggcttgatttggtgcatgatgcatcccattaacaccattctgtaacttccaatgttatcagggttaatgtcttttccctgttgaaaccatgctgtaataggcgtgatggttttatcatagttatgcttgatgtttttaaatgataaccaagtctttattagcatgttttatgtttgttaatataaggcatgaccacattcatacattgggaactgtctcattgggaaacaggtaagaaatcccaggataaggtggtagagaaggaagatgagatgggagggaagagggaaggtgagattggaggttccctagcatcgacaaaccatgacagagaagaaaacaataatgatccaaataatcaaaaggcatcagctgatgacccatcaactggaggaactcgtgcaggcaaagcttctctagaagagtctaaacatgattgcaatgatgatcagaaatccaataggccaatgtctccaggaacactagcattgatgtgtgatgaacaagacacgatgtttatgacttcccaaaatgtagttccgcagcagccagcacctgtcaaccagaaccagtctgaattgtatgcagaacaagaaaggtgtgtgcttacagaattccgtgattgtctccataagcttgtgacattcggaagaatgaaaggtacatcgaaatttcccatgtgtcatgctaatacagaattattgaacttctccattttttgctttgtaaaacgtgtacagtttgatcctgatggttcttccttgcagaggagaagttttccatggcaatcaaatctgaagtgcctgcccatcccatgcaggcgaatggtgtttcacgaataccttattcaaaagaagtagatgtacctgttgtaaaaacatttctacagagttccagtagacatcctgctgctggaaactccgcaactgggcatttggacaaaaaacccaagcatgaaaatacataggtgtccggggtttgtattttgggtagcatggtcaagagaatcatgttttctccctctaacatgttgatcagaagcttgtatcagtcttcattcttgtcttaggttcaagaaagctccaatttgttctcattggtaaaaataagtgtaatgttggatagttagcttagtcataaatatgcatttagcctttatcttagtgtctacattgtttgttcctttacctttaccatttccctcgtgaaattttgccaatcaccatgctagtattttagatgagattattccactttacgcgattaattcatattggttgtggctggttgtaaatggtaatagttccagactggttcacctacgcttcaaactttttgtgaaagtgtgaagccatacttcatcctattggcaactaccagaattgcagaattgcagaaccatcttatctccaaatttgccttcagttcatactgtaacactcttttccgatgaagttattccgctgcaatgtgccgcaaaacatggatgcatatgagtactggaaagtggagacgtctatttcatggatttatccttcaatatcatatcgatcagccgcaattttctgttgaaaataatgcagggagcagggatcaagaaagactttttttttctattaatagaacacttgatatcactctatcctgtacatgaaatggacattgcttcttgagtggacaatggcgaaaacaagcttctcacattttgcacatacagttaaatattcattggtttctccaggcctgaagaaagcgaatcacgacggcaagagttaaggctgcttgtgctccattttcgcctcaaattactgccccaagacgcgagatacggaactcttgatgttgttcagaaacttttccctgcagaaaaacaactgggctagtaaagaaagtgcaacaaaagaaactcttcaactatggtgctcagaacgataatacagatgtcccgagctgcattataaagtgtcagtacggtgccagttcaatatatatccagtattctcaatgatgcaggtatgcaggcatagtgcagcaaaccaaaaagaaattgacgttatgttgtgtgtaaatgtgaaagttccataaaacttcatcgtaaagtatatcaaactatcagtatcttctcatcaatgattcaaaaaaagtaagatctctaagggcttgttaatgatacaaagcaagttagatcttt

SEQ ID NO: 63988 - DNA, 14582 bp, Oryza sativa
taatatatcttgtgattttacctggtacaaatttactttcacggcactcatttgtagaagattaagaattggaaacttctgcacatttagatatgtgatccttcctgctctagtgttgtatgtatcagtgaggttcgggttgtcaatattctatcttaccctcatggtacaaaaggtctcatccaaaccattagagtgaccaccttgaaattgtttttgttgatattgtgtttgtctatactcacttggttgcacctgttcttgttgttgctcttgcactgatgcatatggttttagaaatgcaagcccatgctcgacaagaacaatttctccgcgttggtcattttgacattggagttgccttgctactccactgctaatgccaagagcctcactaagcagttcaacactaaatccatcaaagatgttcttcgaactctcccttgccttggatctatacaattattgaccaatcttattgttgccagctaaaaagaaatcctatcaatccataaacaaaataaatcagcatgtcaaagagagaactgcaataaatcaaacgaattcaaagaatgcttgggttgttggcaataaataagctatgattaattaccttttttctaggatcaagctggttagcactgttatatatatatcagtgacgtatatggcaacaattggtacatcaccatcattgtagcaccaatgagctacaccagcaggcaatgcaacaacatctccctatctgaaacgatggatctgttgatgttcatctatgaatttataattttggctttgtcccttgaatgattggttttgcccggattgttgaaactattgttggtaagcctgaggacatcctgggaaagttggtcctgttacacctctacctacaaatccaggattccacattaataaaaggatataaaagcaacaattatccaatatatacttaaatagatgcacgaaccttggatgatatacactagagttactccattggagtaatgaggtagtagaagacctctaggttcaataactcgacggacaacaaatactccggtacactgaaataacttattagagatatcgtaaacctcggttgtatcagcttgggaccttacggtgcgaatcggcttgaatgcctgcaaatgatcaaatctgcactctcttggatttccacggtgagaactctgccattgactagtactttgacttagaaattgggctaatgagccatgacacaagaggaacaagcaaatggcagagaaaactactgggaatttgatggttgctatttttcttgtggactaaactcaatgctttgtgtgaaacggtaatatattttggtctttttatactgatgtgaagtatcttcgttcaaaagttaagataaagtttgttaatgtccagatgtggaatgactcattagatagtaaggtacacggaaggtggatagatgagtgtggactcacaaacatgcatgagcggcacattgttattttcaattttcttttcttttccttttattttatagggatccttcttgtcatgttctacaattaaaagattgtttttaatctggaccgcatgttgtgtattgctttaattttgtgatgaaatgttttggttgagcatatgatttaaaataatcggttggatttattagtatgttttggagttacgaaagataaataagtcgtaatctcattatgtgatgtaaaacaatcagttgtgcctgctatgtggtcacggaaggtggataaatcatagccacgtcatattacctcttgtattgctacatgacaaacacattgttgtttgtttatgaaaatatatactccctccttctataaatgtttgacaccgttgacttttttaaacatgtttaaccgttcgtcttattcaaaaaacttttatgaaatgtgtaaaactatatgtatacatgaaagtatatttaacaataaatcaaatgatatgaaaagaattaataattacttaaattttttgaataagacgaacggtcaaacatttttaaaaaagtcaacggcgtcaaacattttgggatggagggagtatatgcttttggttttggtttcttctaacctaatatattatttctatgcatggttgttgacttgtcacaaatttatctcataataaatatattttacatgtacggcacctatcgactgtgacatggtagtcacatttttgtgagacttaactttaaactgcagcactggcgtcccattaaacttttgcaaacatgtatgatactgtagctgacaaaaccatcggtaaaaatgctagacgtgggcccgtccatgtctacttaaaaaccatccatgtctacttaaaaaccattggcccctgctatctgtagcctgtaggagtcgtcctgatcagaataaaaaaagaataagtccactttgactctcttaaaaataactcgaatctaatccgtgatcctcaactgtaaaaccggataggatgactccccgaactattcaaactagtgcaatttgactccctcagtggttctggatggcggttttgctgacgtggcgttgacgtggcgatgttgacctgatctgtgttgttgatgtggcacttatatggcactaaaataaaaaattatatgggctccattcgtcattcacatgaaaaaaaatgcgaggcccacatgtcatcctctatctatcctccttccccccctctctctctctcccttctctgtatatttctcttcctccagattcagtgcggaatctggagcggcggcggcggcagggtgagggccggcacgaaggaaggaacttgagcgggtcgagcggcggcttcggcggcgacggccttagctcgccggagaaggcgggggcgtccggccagtggcctcccccacgatggtgccgcgctaggctggggcgaacgagagggctaatgcagaaggcaaagcctgagacgccgctggccccagccgtgcctcccgctctgcgccggcagggggtgcgcctctgtttctttctacccggagaacatgcatgtgcacagcgttgcctagcagatgcaagtgcagtgccggtgtggggtagcaaggcgcagccgccatggaatccagtcgaattttggcaggaccagcagctgcaggacgaatccgtcctaccagcgtggtctacccgagtcctacagatcttgaggtcgtggactggtctgattttattctttgtggtcactgtttgcaaggtcttgaggtcgtagacaatagctacttcatcaccaaggacaacgtcggcatgctgaagctcgccaaggaggctaacagcatcttggttcgtcgatcagcgcattgactcatgttaccaattcgcctatgaaaattgttaacatctaaccgtgacatcctgtgattaattggtacaagtagtttgactgtcgtatcccgcgccggagacggtgggttgcgcagtggcgcactcaaacggccacaccacggcggccatgtccatgggcgggctgataaacaagatgaccgggcgcatcggcgactcgccgttgatcgggtcgggggaaggcaaggccatcatacgctccacgctggcgcgtgacatcgccgccgtgatggagtacaggggcgccgggctgcaggaggccatcgactactgcgtcaaggaacggctggacgaagggttcatcgggctcatcgcggtgtccggcaccggcgaggtggcgcacgggttcaactgcaccggcatgttcagcgggtgcggctgcaggagaaaagagagagaagggagagaggggggaggaagaagggttggagagagaaaggatgacatgtgggtcacacaatatattttgtgtgtaaatgacagacaggtcccacagaatatttttaattgtaatgccacataagcgccacgtgggatgaagaccaggtcaacaccgccatgtcagtgccacgtcagcaaaaccgccatccaaaaccgttgagggagtcaaattgcactagtttgaatagtttggggagtcatcatatccagttttacggttgagggtcacggattagattcgggtaacttttaagggagtcaaagtggactttttccaataaaaaacaaagggagccttgtgcagtttggaccgatataaagcaaaatcattatggaaaaagtacaaattagccccttgaactatcgcagtcgaccgaattaaccctctaaacccaaaaatcagacatcactcatcctaaacttttaataccggacaaattatccccttgacccaattcaggacggttttgtcctacgtggtgtaagcgtggcactccagtcatcatttttttttaatggtggggcctacctgtcatatatactctctcccctcctctttctcgctgaggaggcgagaacgcccgagagaggggggaagaggagaaagaggaggtgagagattatatatgataagtaggcccactattgaaaaaagaaaatgctgactggagtgctgtgcatacgccacgtaggacaaaatcgtcctggatgtcgagggcgataatttgtccagtattaaaagtttaggatgagcgattctgattttcgggtttaggggtaattcggtctgggtaattagtacttttccaatcatttatgatccgtctaaacctgagcacgaaaccgtgcctgattccgtggttgcatgatggaaacgtgtaacaccaaaggtagtaatctcagtgccgattgcgacccaaaacgcccggcgcgtcgacggccggaccgcgtcgatcgatgacggttactgcacacgcacgcacgcaagcatgcccgatccctggaacccaaccgcgcgcacgcgccgtgttccgccggcacggcgacacgtaccacggctggccgttcccctgtctgtcaaccaccaccagccgatggaggcgacggcgtacgtcacgcgccgcggaagacggacacgcggttgcgctcgcgtagtcacgccttccgcgcgcgcgcgccgcgcagcccggccgcctcctccacccacgcaagcaaaagtactaattacggccacggcctccctgcagcgagggtggtttatacgcgatgcgacgtatcgctgcccagacggcagctgtgataggcgtccccgttgggccggcatgggcaagctgatcggtggtgagggcgtgaggccgtggcctctcgcacgacgacggggcacgtacgcgcgcaggtactagtcaacgggaccgatctggtaacaagccggccaccgatcggggctcggttgttgctcacctttccgcgctacgggaaatgctcatagctagaaagagttatagaccagccaaatttgattctgcgtatttccatttgaacggtctttttactccaacaggtcatttatattacatctttcatattatatatacatcgttcaatatctatttagtattataagttattttgatttttccctaattattttttagcgagtttataaacaaattagtaacatatataataccaaattagtttcattaatctaacattaaatatatattttaataaatatatatattaatagtatatttgttttgtgttgaaaaaaaatgtcactatattataaacttagtaaaactttaaaaaaaacttgaaaaaaatcaaagcaacttataatatgaaataggggaagtattttctaactttcataatgcctatattttgaatgactaaattaagaatagatttttttaaaacaactatatttgtacggatatatattttaaggatggataagtttttttatgactcttaattatgtatgcaaattaagcaatctaaattatgtctgcaattgaggtcaccgtagccagcttgaatcaaggatcgaggagggcggggcagcaaggacgcagttgtattcgtcagtgctgtacttgaagcaaggagcgcgggacagaaccatagttggctactgatatatgggtcctgtatttttttttttttcactgaccgaactactacctccgtcccaaaataactgcagccgtggaaatacgtgtccaacgtttacccgtccgtcttatttgaaaaatttataattttttttaaaaaaattagccacacataaagtactattcatattttatcatctaataataataaaaataataattataaaaaaatttcaaataagacgaacggtcaaacgttggagatgaatagtgcaaaactgcacttattttgggacggagggagtaccacagtagatgccatagaggaaaaaatagtgggttttgtaatgagggggtaagttgaacgattttgatggttgaggggtgttcgattgttggttttgaagttaaatggtgtatttttgacacgtaatagctgagaggtgtaaaatagacttatctttttttcgtaatcgctacattttgaaagactaaattttaacaactatgttggtaatggatagatttttttaaacaactatatttgaacggatatattttagaatggatattattttagtggttctcaattatgtatgcaatctcaattatgtatccagtctcaatatgtatgtaaatctcaattaagtaagcaatctaaatgaggtatgcaatcgaggtcactgtgggcacttcaaatcaaggagtgcgaggcagcaaggacatggtggtattcatcggtgccatactcgaagcagagaggcgcatgtcagaaccgtagtggaatccagcctctctcctctggccgttgttgctggtcgaacttgagtggtttacctcgaatggtagtgtagctctggaggactcggtggcagcggtcctcggggaggatctcggcaacaacactccacatggaggactccgatggtggcggtgatcctgtttcgctatgcatcgcagctcgcgtgaaaggggagagatgagatcgagagagaagagagaaagaggatggattaaagagatattgttagcaacttacagatggcccctgtagtttctttacacttttttcgcctaccgaattgccatattggaagcaacatagatgaaaaccacgagggggtaagctgaacggttctgatacttaagagctatggacactcggttttgaagttggagggtgtattatagataaacataatagttgaggggtgtaaaataaatttattcttttttatatcaaaatgactatatgttgatagaaaacacgaggcctgggagatctgcttaactccagtgcaggtccaaagctcgccttcgaatgtatgagcgtgccagttgatttgatcctgtaatcaacaagaaatagagacaaagaattcgtggttaaatctataaatgatagccgatcggctaggtgccgatgacatatcatttatctttgagccgatgtcatatatgaatcgatcgacggttataaataaatagtaaggaactaaatctattcgatcggcagtagatattaacgatatatagttcttatattaatatatacttaaatcaaatgattgggatagatcggtcaccatgccgagacagtataaatcacttagattgaaatatatattaataacaggattatatatgtttatagcatagccgatcagatagatctagcatgtatcggctaatactccgatactactttatataaagatatcaaaacaaatataatataccaaacaaaagcttaatatacttaaatgcaataagatcttgacataaagggcggatttaacatgtcattgaaacacatagaccggatatggttaaatcagataaggtcggctgaaactccgatactaccctaatcggcaaccagagaacaggctacagattgatattctaagcacgacttaatagatcaaactcaaatgatgcagcattaagtatgaaaagaagaacaatatctagacaatcaagccgatgggtgtttcataaagtggtagatatcttatataatctaagacaacgtcgctatttaacctaatcggctgtcttctatcaacatatgttagccgattgtaggttagatgacgatgttgccaaagattatgtaagatatatgataacttgatgaattatatagacaagattagagtgtcataaagatggaagcactaatcccgagaacacaagccgtcataacaagttttacctcttgttgaagatcgaaaccgatgcagctcaacccgaaagcaagaactcgtcgaaataaaactaaagcaaaaaggtgacgatgcgccgagattgtattgaacatgtgtgttaaaaattacatagggctcggggtctatttatacccgagaattacaagatatgtccataccggacacgaccactatctctaacaaactctaagataccataagtctttgcggcagacttttgcccaaacatatctctaagaaagttacataaaacatcctaattaatagatacaattgccttctcaggactctatccatgtgcggtaatcatcttgaagcacctcaattcaacccaatgtcatacaccaaattatactgtcagaatcggctgcatcggctcacctagtccgactctgacccagccgatcctaattatagccgatctggacttcagccgattcttgctctgttctcggatcaatctccgccttcgactccaccttaatctaatctccttttctgatgctgatattaccaaatttggtcgttaacactataattcaacgactaaattttaacggctatacttgtaacacacctatatttgaacggaatattttggaatggatatttttttaatggctctcaattatgtatgcagtctcaattatatatgcaatcttaattatgtatctaatctcaattatatatgcaatcttaattatgtaaggaatctaaattatgtatacaatttacaaacacaagtaatccagccccacctcagccacagccacctaggcatctccacctcaaccgcagacacctagggcaaggatggcgcaactggggtccgtgtgggcggtgcatggccggaggtgctgcaggcagagtgggtatgccgccgccgaccacatccaccaccctacaatccatccctacctacagatttagtatgctccttcctctccaccttcactcctctgtggttccactcgccggtgccccattgttgccattgccgccaaaaaaaagtagaggggggggaggggggctcagctgcaccgagtagtgatgacaacaacaatagacaaggcgtcgtttggtcaatccggatatgggcatgagctcggtgcagaaaaaaagggttgcaatatggcgtgaggagagaattagaaatgctaaatttgtcgcttctttctccaggatatagcagacgcactaatttggaggaccggatggtatatgtgctcgagccggttttttctctccccccctacccccctacactattttgttgatagaggacgtgatagatgagctgctgctgggaatgctctaaagacacacgatagcatcgatctcagttgatctgatagcacagaaacgacaacatatgttacagtactactggattatttttaggcagatgtctattttatcccaactgctccagtgcgcggtgcgccgtctaagtaaaattagacatcattccaaatgtctcaacgattgtgaatgcctcaaatcagctatttaagcagtgttttgctccaacgaacgctatcgacgacaaatcacgcagcaaaaacgtacgacgtgtaagtggatcgatcgaacgtctggtcgatcgttaaagtgggccggatcttttcttctccgatcgatctcatgatcttccctttagtagcgcatgtacctattctcggctttatctttacgtgcctatcgctcaatgcggttcaggaggggacaacaacgtatcgtcctggctcctgtgcacatcttttttctcctgttgatacagctttaatcaattttggtgtaaactggtaccccttggtggaatccacggcatgacgggtcgatgcttctgcagttctctgtgctgtgcgtttcacattatatggtaatacgtccaacggagagagacatggaattctgcgttattttagggtgtgcttggttggagggatatccctggatgggagatggcgatttagtttttgagtgtgtttggttggtgggtgagggtggatagggcggcccgaagaggaaatattccactaagatgctggatgagtgtatccggctaaattggccggatgaggatatccacctttgctaatcttgaccattagttcttgattagcaataattaaagtatatttttgttaattagtaattaacttgtcaaaattagtgttgattagatataattactctattttattgttaattagtacaaattatagctatattaatgataattaacatattttattattaattaatatgttattgttttaattcaatccattctcatccacccaaccaaacaagaaactgaatggtcatattcacttaaccaaactaaaaaattggaccaccatatccctcaaaatatagatggccatatcctatccagccttgaccacgaaccaaacacacccttaagatggttgggaactccttctccttgcacggaaaacggagcggtctattagcgcatgattaattaattattagcttttttttttgaaaaatgaatcaatatgatttttttaaacaacttttgtatagaattttttttaaaaaaaagtaccgtttagcagtttgaaaaatgtgcaatgtgcatgtagaatacgagtacgagggagatgggttgggaacattgagaaaaaaacacagccttgcctgcaggcttcaggttgggcgttccttatttcagtgaggaacaactctcatgaggtgatgtatccaatgtttgtcatgtgcagtgcgtggtatatactagcatgatgaatcgcccattgacctggtcttggcacgacaagccgatgctgcgacgaaagtggaaagaatcatacatgtacaaacaggacaatcacatgcatgtaaaaaagagaacaattatacttccatccatcgagctggctctggctaaagctatagttagctcgccagtttcggcagtgcgggtaagtgttttcattgcttaaagggtattttctaatttcttgtgtaccatttaaacagtaaaataaattttaaaaaaataacaagatacttcctctataaaaaaaaaacttaacctaggacccctcctagtacaatgaatttgaactatatttgagatttttgggacggagggagtacattaatatgagatatatcaatccataaacatgcaagttcaaattctagatagattttttttatttgtataaatcaaatttgacattgcatgtttgagagatatatttatattatatatcgttaatttttttttaatttttttataactacttagatgatataaaaaaagagataaaaatccatctcctaatatgttctcttgatgttgatgcactgctaaaaaagacatgtacagatcggtactataggtgtcggaacaggtaaaaccggcacctatagtgttttcccacctacaaagggtaaaaatataaaaagcgacacctttaagcgattataggtgttggttctatagaaaaacgacaccaatattataattgtcgttttttttaaatccgacacctataatttatcataggtgccggttaattaaaaaccgacatataatatatgatagtgcccctaaaaaccaagccgaaccgaccgctcgttcttatcctcccgagcgcccgagtggatcaggagaggaggaccgcgtctctctctctctctctctcctcgcgcatgcctctctctctcgcggcgccctcccctccaccagatctggcgggaggagaggcagccgtagcggcgtgtgacagctgtggcaagtggtggcggaaggggaggtggcagcaagggcgacaccctcccctccgccagatccggcgggaagggaggtggcggcgccctccccaacatcagctcaatattggtgtttttagtgttcttagtgttcttggatgttcttaattagtcgggggtgaaggggagcttatcgatggatcgggtcgaggttttgttttattcatggaaccttaaaggtgccagtttcactagaaccgacacatatttcccctccacatcagtgtcgtcttttaggtgtcgattggaaaatccgatatctttgtagggttctcaaccggtatcaattaaggttttcgtggttgtgatgctttgtagctaccaaagttatgcttttggcgagtctattgagctatgatataatataccaatggcgtacgatcaaatcatgttatcattaagctaggttcttaattacttaaggtctggcttatacggctgcttcgtatgtagattccaaatggagacagggctttcatgctgaattaagaaaggtttcttaagactaactatagattctgttgatttaattaatcttgtctatatatgcagaagatcttttcttagaacttccccataaagccatgacctgttcatacttcatacacatcaacgcgcgcactgtaccacacacgtgcccacaacacaagtgttcccactaccactaacatacactccacccatcccagctaaagccttaaaagcttcatcgtcatcacattcgtcccagtctcgaaaagacgcctccggccgagcccagactccgccggagacggggagccggtgcacctaacaaaagatcgatcggcgcgcgatacccctcctgctacactgtgctacttcgtacgttcgcgcagtaactggtccatgtcgatatcccctgtacgtgctgttaacgttgatcgtttgccgcgaacaccctgccagaatttaggatcttgtcaagctccgatcgagcggccaccgtcgcgtctttgtttgcttttagctacgtctttgtttgtttctagctacggagagtctcggaaaagtgtcttgaagaagatattctcttgtttcttaccatgtctaaaatatttatattttttataaaaataataattaacaatatagattattttaaaaatatcacttcacaaatatgcaaattcaaatttaatttctacgagttatattaaaataaaaaatttaaatttaaatatgcgttaactatttttttaatgagttccttttgttaccatttgtacagtttgaccactcatgtttgtaaagtgttatatatcatattaattaatcttatcaatttttttaaaaaatactaattatttagatggtccaagagaaacgagatgtgtcacatctcttaggatgaaaatccttctccaaatgtatctgagagtttcagtagcctcgccgatcgacttgccacaccgccgtactacatgctttgtcgtctgttcgtggcagtatatatattatccccttgctgtgtccgtcgacataagtggagtgtactaggtagacacactagctagctagagtgatccagctagcatggaggcctcagccatggaggaggccctctcgaagaagacgacgagcaagggaggcctcaggaccataccattcatcatctgtaagcgaagcgagcctgcctgcctgcatgcattccatccatctttcaccctgattttgccggcatcatctgcacgccggctttgcacgagacatatgtacgaggctggctggcctggatcgagatgcaagtttggtttactttgtgttgttggtgtcagcgaacgaggtgttcgagaaggtggccacgttcgggctgcacgccaacatgatcctctacctcaccgagaggtaccacatgacggcggccaccggcaccgtcgtgctctacttctggaacgcgctctccaacttcctccccatcttcggcgccgtcctctccgactcctgcctcggccgcttccgcgtcatcgccctcggctccgtcgtcagcctcgccgtaagcacaaacaccaaccaaaccatccatccatccatcggagtttcttgcgcgatgacacgttagacgtgcgtgcgtgcaggggatgtgcctgctgtggctgacggcgatactgccggcggacaggaggacgccggagtgcgaggcgaggcgggatgactgtcagctggtgccgtggcagctgccgctgctgttcgcgtcgttcgttctcatgtcggttgggtcgggtggcatccggccgtgcgcgctggcgttcggggcggaccagctggaccggcgcgacaacagcgcccggaacgtgcgtacgctgcagaccttcttcaactggtactacaccgtgctgggcctctccatcgtgctcgcctccaccgtcatcgtgtacatccagcaggccaaggggtgggtcatcggcttcgccgtgcccgtcgtgctcatgctcaccgcgctcacgctgctcctcctcggctcgcccttctacctcaaggcggaggccgacaggagcgtgctcgtcggcctcgtgcaggtgctcgtcgccagctacaggaagaggaggggtcccttgccgccggag

SEQ ID NO: 63989 - DNA, 653 bp, Oryza sativa
ctgtagatcatacacagcgtatcggttacacgggtcaacaaatatagggccgaggtgacatacaggcttacatcatggcctgcgccgatccatatgacccatagatgagtattgtgcttcttaccacaagctcagttatacactgccgtttaattgatgagcgaatgatacgacacatgtgactgaagagtatgtccctacgcatcataagatagatatgattctcgagctataagcattagtatcgtctctcactgacccatttataaattgtcagtatgactgcaccataatgtaactctacatttcatacatgtggctcatatagtaagactctgaactagtatttgttaccacaagacgtatctattgctggatagggtcatagccaaatttaatatcgtcgttgctgaatgacgcacattactgtatactgtaaaccatagggtgaattatattctggatctggacagatactatcgactgtattaggctcggggcttcaatgaggtgtggactgtttgcatctccgaatatctagctgttggtgtgactttaacccgcctgtaaattttggatcgacatttgtactaggttatatgcttttataatgccagctaatacattttaggtaccgatcatcgtatgctacc

SEQ ID NO: 63990 - DNA, 684 bp, Oryza sativa
aattcggactccaaaccagaaggaaaaaagacatggttgatgatccatcattctcctataacctttccaagccaagcaagcataccaccctagcatcctgtacacatctaaaattcaacgtcaccttagcagttaccaacaatccaaaccctctgtccccaccccctggatggctggatcctcctctcagttgatgttagttataccaactaaccatccgtcactcgcaaaccacatttgtattcacattaccaaaccaaagccatcaaccgttatttacagatgatcatctctacccctccttacacagctactccattctccaagaacagagcacacgaggttaaataagagcgaagcatactgcgaccacatgattacagcattacctggccaagctcgaagctgccacgggttcaaccctgcagccaccacctccttgccgttgctcgcggagatacccaagcaaagtttcagcctgcaaatcacacagctaaacataagtgtctccaaaatttggaagcagatttcagattcagtaaatctagatagctaactagtgaagcacacattcgggggtgctctttccaatccgactgtacaactaggcagataaagcacgacaggctagactatggtggcaaaatgataattgtcatataaataattaatatacttattgtt

SEQ ID NO: 63991 - DNA, 4883 bp, Oryza sativa
  unsure (1)..(4883): unsure at all n locations
gtatgtgactactaaaaggttaactccaggctcacacattaaagttctgttaacataatagctgaaagagttttttattaggtagggtcatcagagttgagttttcctataaacagcagttttttttttttattaagccacttatgaaatatttcatttcttaatacattgctgctctactttcataagcaggaaattgagaaggctgctgaaagaggagagcttactgaacttgttcttatggtcatatggaatcgacttgatgttgctcgccgcgatgtatgctaattttctctttgaattatctgatgacttatgtattgtttatttttttatttatttcaagcccttgcagttttcatcttgttttacggtggtactagtcagtattcacccttttgttatcaaaagtgtggttgctttttttttttttcattttgggcgtaagataatcatagttgaatgtgcagaaaatgctttcgagaaacatgtaagtacgactcatggtaaagaaactcattaagtacgaatgttaagtattgatggaacaacaattgaattttggattccctgcccccaaaaaaggaggaaataatttaggctgtataacactacaacataccatttactcaccttgcagatttggacaactaaaacaccttgtgagttgtaagaactcctagatcccatgcatttatttttcttattccacactgccactcaatattacaacctgtaaacattgattgatatttaaacttttatcacttctgttgctcaattgttgatatctagtctttccataaattttcagcatagcaaaagtatatttgagaagggagaaattcctttgcctataagttctaatatctacaatcaagatatttgactagaggcagcatagcaaaagtatatttgagaagggagaagttcctttgcctataagttctaatatctacaatcaagatatttgactagagggataccatatttattttttttgaaagaatgggataccatatttattgtttagatattgacttatacacccgcaggatgagagggatgccatcagaagccttgatctcttatacagaagggtagaggtaagtcacacaggtgcaccgcacacagcctccattatcttatcattgttggaggagtccattaagctcttatatttatatcaatcctgttcatttgaccgcttcattggtctctgatgggctaatcagaaaccataacctgaatgcagacggaaattttaaggagtgaagcaactcctgctatgagattgctcatgaccttctgaatcttcatgatggatctgatgatgacaagtggttaaagaaatgtaaaaaacatatgcttgaagtttttcccagagaagacccgttcaccatgggtctttcctgctggtttcaacatggaggaagtatgttagttaatgcatgcttttcctcatgggataaattgaccatgctaaaaattagagttattcgagacttgagaatgaaaatttatgcttgagacatttacaaaattttaatttacatgacacaattccaaaacagagatgctgactttacagatttcacacaaaaatatcatcccctagttgtattcaaaattagttgtgccacttaccataagtgttaccaagtcttttattatacataacctcctaatcttagccatatacttcatagttgttaacgttgacagcaatgaaattttccttcaagcaagcatggacactgccacatccctcatagttaatttagttagtccaaagataatacgcgaatcatcgttagtcagtgtcatttagttgagattcnntggatttcgctggctccattctcttctttggttctctcatgctacaaaaaaatctgaattctttcttttgtcagcatcaaggacagatcaagctgccacctcaggatgatgatgttcttctaagagttgatttcatcagggaagttgatgagctcttgaaggaagttcaagctgcacatgaaaacaataaggtcccaactggtaatgacccggaagctgttgcgaccaagttgaagtatcaagagaagctgcggaccatacgtcaagtggaatctctcctggaactggcatcctccctgaaatggtgaggattgagtttgcagaggaccatgaaattctgcgcacataggactagaagttaccggctgagtacttgatagctgcaattagggtgcagccttttgagctgattctcaagtttctgctaattagaaactcctagcatttgaatacaaaggttagctgatatctgcttgggcgtcaatgcattttcgtagaatattttctgcacctgggtgtccaactctattagatttgtactgctctaggcattcagagttcaactgtgactcaagcagggaggctttgctctggattaatgtatcatcatgagaatggcggagggtattcacacgctcaagctctagcatgacgcagatgattttcaagccatcgagctgtgtctctagtgtgcataatccagatgcagagatggttgagtacttgagttctgaagttcccaagtcaaatactgtgtaaagattttcgtttgaaggaaaagaaaacattgaatgtaacattagtacaataacttgtaaaagtttttttttgtatggagcatgtgaaaatatctggaacaatccatggtttcaacagtagcaaaatttggtcacataccaaggcatcaaacattcgtatgttaccatctacctctgcacccgatggtgcaatgcaacgcgtgaatgttgcacgggcatagcacggttttcatttttggtcttgtaagagatggattgcaaacaatgccttttcaaaggaagtgcacctggatgctatgatcaaatatatggtgccatcggatggtcgaagcgatataaaagaaaatggactacctgagctattgttttttacccttatatatcagtcacttgatttagcgtctgatgactctatatcaattttttcttggagtgaaacaacgagcaatctaacttttaaatattgtaatagacttaccagtatgaaaaaaattgtaatcaataaccatagaaacatatatcggtcgattcaggattttttttgaacgactcgcatgagacgatgcgaagttctattgatagagcaggaaaaaattacaatattataaccctggagggtcataaccaggagaaagaaaaaaatataccaccacccacacaccggcagcgccaacacacacgaccaggagaaggttagcaccggaccagccgccgctaagcgtgaccggctgccgctagaccaacaaaggaacacagacgagatcgccctacagcaagggggggggggtgccaaaacgacgtcttcaagaagagaagcgacggaagaccgccgccgccgtccatcagggctcaaaggagccaagactgggctttcgcccggtaatcacccttaaggggtgagatagcacgacaacgccctcaggagggggaattcatcgttgtcggtccggccaaggctgggctgggttttcacccgccgctcaccacctacgaatctacggatgatgcaccgatgctccaccaccactcaaactctgccgacatgtggggccctgcacgaatgcccccgccggccaaccttcgtgcgccgaagaccgcgccacacccaccggcagctccaccacgcaccgaggtcgcctcttccaccgccggccgcgcctctcgcgccaagccggcctcgtccaccggacgcgcctctcgcgccaatccggcctccctccatcggctgcgcctctcgcgccaagccggcctccatctccgccgcccgcacctctcacgccgagccggcctctgctgccatcggctacgccactctgcgtccagccggtctctgacccctcctccaaacgatgctgcgccggccgatgcagccgtctgccacgccctcggcaagccgtacgaggccgccatgcttcctcccaccatcgtcacggtcaccacctcaccgtcgccgccgtcacctcacacccaactccttccccgcctccactgccgcatccttcgacattgccaccgtctcctcagtcacggccactgcaagtcggccgccgtcgccgatgccgctgtcaccagccaccgacgccagcagtcgtcgtcgcaaaccgccgacaccgccaacgcaaccgccccaacgccgtcgtcgagctctccgctgccgtcgtgaccgccactggggcaaaaccatctccagcgcctggatccggtcgccgatgccagcatcactgctagatccgacctccgtcgccagcctcgccgccacctccatccccgccgccatctccaactccgtcgccgacgcccccagcaagagaagcagcacaccaccagcacgcacgccatccctgtcgccgtcgccgcctcccctgccaccgttgtcgcctttcccggcgccagccgccaccaactgccgccaccacccccccaccttcaatccccgccgccaccaccaccaactgctgccgccacctcacaccgacccgctgccggcggcctgcccgccagatccggccgcggcagcccggatttgggcggtcttcgccgtcccgtgcgtggccccccaccgcgacgggagagggagacgaagacgagggtgaagccccgccgccgccgtccttgcggccgcgcggctttgccggcggccgctcgggcggcggcgagacggcggagggaggaggggggaggagcgggcgacgccggtggtttccacctcccatgtgcccgtgggggaggacaacgcgggggcgcaatacaactactccctttaactacaaaacggtcgattca

SEQ ID NO: 63992 - DNA, 2586 bp, Oryza sativa
ttaatctgcacaagatttccgagaatgcctttgatcgacggttcgacgcacaacacaaagtcagacgttcaactgatggctctagctctgcatgtgcacaagtccttttctctctcctaatatattagcgtacaatctttttgcgtgtccgagaaaaagagtcattttctctttccgcatctccttgcatgcaactagcatctattaggctccatgtagcacgaggtttttgttgtaagcgttaaatgatttttcctcgaaatttttttatctgatttgtgatccggagaagataggtgctggtgcaccgcttgtcggagagaggccaaaggagatagaagaaaaaaaaggaaaaggaaaaaaataaaactgtgtcatgtgatcgttgccacgtaagttagaccacggtcaaacaaagctttggattgggatgatgcaataaaccaagtttaggtaactcgatgcatgctttgcaagtttgtggatctaggtaaaaaaaacatgcttataagtttaagaatcgctggtgcaatttactcgtgtatttatttggtgtactgttcttctatgagcctactcaaagtaagagaactttgacttagcacaaaactaaaatagttaaataccttacattttcaagcagagggagtagattgttgtatctttttccatcgcatcttttaagaatttttccacctcccttatacaaaaatgcatatggataccctgctggctgcagcagctaatctttcaggcttacctaatgcaagataaccagtaaatggatggtttgtgtagtgaccacttcaaattcttaagcataccagcataatgcccgtgacactgcaacggatttgttttttaaaaaactatttattatatattattttaaagcctctaaaatatgttattcctattgtccaatatatcatagagcgatgagaaattccacaataagaatatttcgatatttttcttttgtctgggtcttgtttgtatggaaagtaaatctgtaaaatcttctctcacttttcgcaggtctcttttaaaatagtatagatattctgttgaattatgagatgtttttggtaaaagtatgtgccaatgcaaaaggccggtgtgtcacttgacaacagacaacactacattcattaagggcgtttacattgtgtcgaggtggcattcagcattttggcctcattgttcccccaacaaatattatgtgccacgtttgcttctggcacacatatctgaagttcgtgtatccaactttggtcacttgttcttcagtctaatcctgaatgagtgcatggggcgagagcatcgtgagcgcactctggaggtcatggcccggttcctccactgcacagcctgcacatgtgtatttttgcctttttccttgggtcacggcatggggattgggcacagtgtgaatggcttaaggccttgcacagtgcaaggacatggcgtgtggattcgtctacgtggaggaaaaagtaggtggggccatagctttggtttgttgttcgcttctcgctagagtaatgagtgctttctttgcacaagcctggtgcaaggcccacttggtgaggagcagccgaggaaagtgggagagagaatgcgaaagtagcggtggttgggttggggtggttggctcggggatgttggggtggttggctcggggatcccgtgaaagtagtttgcactgtgagagaagtggattctgtgtatttatcctacatggcatctaagataactcaaatgaggggcttgcactgctactggcatagagttcagctagcattcctttggcgaatgtaaaatggagaaattaccaggagtaactactttgcaagagctacacctttttgagcttataaaaataatttatggttgaggatagaaggttggttgaggagtataatacgcagaaatttgaactggatgtgattgatgggataaatagtacttgagagagtgacaagtattatgaaatacattttgaatggtagaaagacaactaatttaggacggagatgtattaagtaagagaaagtagtacatctttagcttcaaaagatatcctgggcacaataaacaaattagtactatatccatcccgttttaagtgtagttgtgggtttccgtatccaacaatgttgatcgtccgtcttatttaaaaatttatgaaaaaacattaaaaaattagtcacgcataaattactatttatgttttatcatctaataataataaaaatactaatcataaaaaaattttaaataagacggacgatcaaaccttgtgcataatcagttccaaattgtactagggcgttctctataatttttatcgtttctgatactgacggtgtggagtagtactggtatgttttctgtatctttttagtcatggttgtatctgttgattactactctgtcaaaaaaaaaaaaaaagataactcttagctattgaattatttttggacggaggggtacttgtttttgaatgactaacaatccttgcttgtcttgcgagaagagaaatccattatatttattctctccatccctaaatataagggattt

SEQ ID NO: 63993 - DNA, 2071 bp, Oryza sativa
aaagaaaggggattccttgcttccacagccaccaaaagtaaaaccacccggtgcatggtgttggtggccggccgcccatgccatggctccctgacctttccgcggctcaactctcccccatccatctcccacacacacatccactgacagctctgcacgagaaacgcttggccccaactgtcatcgcacgttggcgctgaactggtgcgcctaggtttggtaccaatcgggtaacccatcccagcctcctcgacacctgtatcgtcaaccccgggacgagacgcgagcgcaaaagcgactacaaagatacacaccgcaccaccaccaccacgcacgcaagcacgcctctcgtcgcgttccgtttcgttgcgacgccacgcgagccatgctgccgctgccgcgtcgtgtacgtgtgtatatacgccgcgccgggttgtagcgtagcgcagcgtgggagtactacactgcactgcatcgcgcaaccaaccaaccacccaccacaacacaaccctcctctcctcatcatcactcgctcgctcgctctcgcgctttgcggcaactggcggtgtctcctagcccttgcctgccatggtgtcgctagccggctcccagatcccgtcgccggggcagagtccgtgcgcggcggcgcggtcgcagcgccgcggcgcggggtactccatgcggaccatccggtcggcgctgctgcagccggactcctgcccgggctcgccgcatgtggcggccgcgtacgacgcggcgggggcggactcggacatggagaacttgacggactccgtgattgatttccatctcagcgagctggcggccaccgcggggcccgcgcaccccgcggcggtggccaagtcgtcgtcggccaacgcggcggccacggagatgctcgagctctcgcgggacttcagtgactactcgagcttcaactcggatatctccggcgagctcgagcggctcgcggcggcggcggcggcggtggtgacgcccagatccgacgcgccgcaggtgggcgccgtggatctgaatgagcttgagtcgatggatctgtccgtcgaggcggcgccgctggagcgcgtggagccgttcgtgctggcgtgcgtgcgggcgctggggcccgacgccgcgccagacgcgcggcgcaccgcggcggcgaggataaggctgctggcgaagcacaggtcggacatccgcgagctgatcggcgtgtccggcgccatcccggcgctggtgccgctgctgcggagcaccgacccggtggcgcaggagagcgcggtgacggcgctgctcaacctctcgctcgaggagcggaaccggtcggccatcacggcggcgggggccatcaagccgctcgtgtacgcgctgcggacgggcaccgcgtcggccaagcagaacgccgcgtgcgcgctgctcagcctctcgggcatcgaggagaaccgcgccaccatcggcgcgtgcggcgccatccctcccctcgtcgcgctgctctccgcgggctccacccgcggcaagaaggacgcgctcaccacgctctaccggctctgctcggcgcgccggaacaaggagcgcgcggtcagcgccggcgccgtcgtgccgctcatccacctcgtcggcgagcgtggcaacgggacgtctgagaaggcaatggtggtcctcgccagcctcgcgggcatcgtcgagggccgcgacgccgtggtggaggctggcgggataccggcgcttgtcgagaccatcgaggacggcccggcgagggagagggagttcgccgtggtggcgctgctgcagctctgctccgagtgcccccgcaaccgcgcgcttcttgtccgtgagggcgccatcccaccgcttgtcgcgctctcgcagtccggctctgcccgtgccaagcacaaggtaaaaccttttcaactttacattcctcttgtttgctaatgtcatatcgggattggatatttgggtatgatttgcaagatttctagtatgtcgattttcaagtgtagattttgggtttgagcttttggtgtgactgaagcttttggataattgtaccgaacagtatccaacg

SEQ ID NO: 63994 - DNA, 13652 bp, Oryza sativa
acgtgatcactgaatggcataagcttttgtctgcattacatatgaccatattatgcgtaatatctagaagtaaaattttcaaacattttctcacaccatacagttttcataaaagaatgtgatgtagcccaagtgcccaactgtctagtatcatctttaaaacagtctaatctgaaaataggttgttacgtgtacatcatcttttctaagcccattccagtttagttagtctgtccttttgtcatccatagtggattcatttgttggactgcactgaacaaatgaatttttgatatgctgatttgaggttctaactacactactgcatggcattcaatgtggatgctcctttggattcaacaaatacaggtgcaagcatggaattggtctctatttgtgtatttttacttgattagaaagatatgttcccaccactgtgtattagtgctgttcagaagattcttgtgtgtttgtccttgtctttaacttcaattggcagactataaaaaagaagaaaaaagaacattgctctttgcattttaatttatctttgttgtagtgctatatgggaatatcaagcctgattattctgaagtgcatattattcctgttcttgccgtaatataaattgctaagtatgcagtgtaacatcatgtggaaccaacattgtgtgcgtgtgttctcacttgataacattttttattataacagtgtttaacacttgctgattgaatgttgtttgctgtagattcaattggcagagaaacaagctgcactggagaagttagagtgggaggcaaaggtttcaagtacaaaagtcgaagagctccaagtagatgtggcgtctatggatgttgaaatctctgcgttaatgaagctatttagaaaaataacagaaaacgaccgagccccttactcgagggagagagccgatgattcatctttggaatgtgaaccggttcaacttgacgtaagctcattttttccttgttatagtttcctttcgctcttcaacccaaagtacgtcatgtagttttaccacctctttgatgagcgattgtttttcctcaatacaattggctaaacgtcctacttgatatgggcaggatatggttggtgacatcgacatggagaagatggagcaggaaatgtctgcatacgctacagctctcgctgccgcgaaagacaatcctactgacgagttcttgaaggcagtaacagaggcaagactaagactccaagccttcgtactctaatttggattgaagcactgacatgccctgtactacctgaaggagtagctctattttgatgggccatcatgtgttatgcgggtgtcataatgcatctaaactgacagctcttgcttcctggatctcacatttcaaaaagatccatgtttgcgttctgtcggtctgggtctgtctgatgatgccactgagcttgttattgttgtaactttgtaagctaagaaccgtatgacactatgaccgaacatctgaacatcttagtagatgtcacaccgtgtaccattttagtgaagggtgaacagaaggtgagttcagtttacctgaacgacctaaagattgacgttctctgtggtttgagctttggagccaactgaatttgatgcagcattttacccagaaaacgaagtcacgagctaacgtatgatatgtacacatttgcccaatcatgaaatgttaacgcgcacgcggatagctacagtatttcagaaccattcaaaccacaacaaatatatctatttggatctaagtatttcagaactagtcctttatcacatttaagcattgaaccttccggattccgattgaaggattttccatagggttttaaattggagtgcaggctttaaatcaaatgaacactggatttcaaggggggaaaaaatgcagtggaccgtaataagaaaactagaataaattatgaaatgagtaacgaccaacataaagagcgtatatacaggttggtgatctaagacatctaacagacctaacaagattttctgcttggttacatttctaagagttacaacatcaaaaacaacattctttcgttcagatacagaaaaggcactcatgattggcataatacaacaaaacatataaaaccaagcaaaatcagacactcccaagctaccttcagtgaaggactgagccacaggaatgttgactgtcgagtcctctgtccgccatcagcagaagggaaaagtgagtaaaagccaagtcacgagttacaacttacaactcacaacacagaccagaggatcgtcctaatacaaagtaatagtacagagttcttttatccccactagaaaagaaattaagcagaaagctacttaggggaatcacaatacatttgacagtttttctggcagtaagctacttgagcactatattatggttaatggtaggggtgggcaggcagcagctacatcttgaattagaggaaggcaggaagttgaagtcacagccgcagctacatcttgttattccaactgcttttattactgcaaacaagaaagcaaaagtcagtactcattagccgcagagaaacagaaggcaaagtaacaacaccagaaaaatagtaaatgagcgttgatagtatggaaaatctactggtatggcacaagtataacaataaggatctgggtaagcataacatacgaaacctggtgcattaaaacgaatgcaacacagtacagtatgataagcatctgaacagcatttcttttaggctgatagggaaaacttttgcaaagcgagtaccaattaaaatattaacaaaatcatgtgatacttcagcagcttggattaaatagcatacaacatatatgagatctagtccatgtgatgcaatgtacccaccacaggtttcatatttatgttatttaaccaacactaacttgtctccgataataatttcttgtgcttcatactaatttttcttaagcctttcagatatggagtttcaagtcaagttctacacacaagggattagtaccaaatagagagcatattgcaccctaaaaatgatgcattcctcgaaccagagtaaatttgtgctagctcatacatgtttgctatcaccaaataatatgaacaggaaaaaaactaaggagcattgatctctatgcaaatttgaaaattaaattttcatttgaacagtacaaaagagcgtaaatgataaaaaataaaacatgccaaccgtaacattgtacaaatctaaagtttatcccagtgcaaaatttacagctaatggagttaatcttgtttatagctaatggagtagcataaatacaaataaccaagaaagcaccaatgcactaatggagtagtagaaatacaaataaccaaaaaaagcaccaatgcacagtataattgtgcaagcattgagtagtcatatactaagaaacatatttaaatatgataactattaacatattcaaagcgcagcaatccagcttggatcagtacagctataacattgaaatttagttagtgaaattgattttggtactgatcagtgctaagtacaactgccaaaatgtagcatgctctgttaagttgaattgtggatgatttttttacatatatttgaagaaagaaacttcttttttcttataaaaagcacagttaagtccagtcatgtgtagatgaaggaactcttttatgcattcccatattatactttgcaatgatttgtctacaccttgcatactaaacttcaagcattggcattccctttcaacatacaaatgatatttgtttaggatttttaccccaagactgctgctcttttatacatgatttaatgtgctattcttttctggctttgttttcatgtgatactatctagtccatgttgtaaacttccacaggtacatgcttaatatttcattgtgcaaatactactgatagcaggggcttgtgggctaattggtatagcatcctctctataaccgaaaggatgatacaacaattccaggttccataaagatagataattttgcaaacttacattaagttcaaaggatacccgctgcaatattaatccagtttctgagaaatatagcccacttgttacaaagtcagttgcagagtagaggacaggaacctttacatttttgtttgagaatacatataatcagcaaatggattacaaaaaggtttgcttcctacagcgctatagttacatgttaagcatacaaaactaattacattctcggcttgagcaattcctttatgctacaaaagaataaatggaaaaaagaataactatacacaacaaaaactggtatacatgatgaggttacatgaatatgatgctatacactagtatccaacaagaaattatatacaggtatacaacgacaaaaaaaaagaatatttacataaaaaaggagaacagattaagaacttacatctcaattaatgctacaacagatccttggagacaagcaggtaaaatccaccgatgttataagcagtaaacagttgacagttgcaagctgattcgctaaccaaaaggcatgtgcaaaaaagatgccgccgcgaattgccgatacccctacactaaacatagcccatccagatacattactcaggcgacatccgccgccgctttgagtggtcaacctcccttgatctgctacgcctcccagatgatcttcccctatcccagtcttcattacgatccgactcacgcttcccgtgcctatgataatcgccatggcgatctctatcatcccggtaccgttccctctccctgtctcgatctctttccctttcccgttccctgtctcggtctctttccctttccctgtccctgtctctctccctctccctctcccgacctgcgtcccgttcatcacggtgcctcctctctggccagtctggtggaggaggcaaatctttctccctctcccgcctcctatcagatgcccctgaccattccctctctggtggcctcttcttaccatggctcccaccttcaccatattggtgatctgatgctgcatcgtcgccatagcttgattgctcttccccaccccaaccacccatgctcgggtctggccacatcccgaccccaccagcacccataccaccttcttttccaaagaacgctgggtttacatgaggtgcaacaacaggtgggaatggctgcattaagcctgggaatggagcagccccaggtcctccagggaagccaccaaacccaccacccatcctccccattgctgcaccatagccagttggatcaaaaccctgccctaacatgcctccaggatgaagcataggtggtggtggagctaccatccctccgttccccattaatccacgtccaccaaccggacccatccgattcctcatattcccagcttggcctctaccccccatacccccgccaccccttccccaatttccaccgccgcctccacctccgccaccacccggtccacctcctccgcctccacgaccaccaccataattcccacccacctgagctccacccggacctccagctgcaccaccacctctaccacccttctgcacacccgagttttgctgagccatcgattgttggttcttcacctgagcttcacccatgcggcgcacggtgtgaggcgaggcgaaggccacgacacaggggcgtccattgaacaagtggccgttcatgccctctttgcaagaggcagcagcgccagggtcatagaaatcaacctggcagtatcccttggacttgccgctcgccttctcgtcgaagaatctcacctccttgacctgcccgtacttgcttagctctgcctctagatcggcgtccgtggtccaccagtggagctcccctacgaagagggtcgtaccaccggggccatcaccacccccgccgttgccgaccacaatcgggcccccaccgtagtttcccccaccctggcggtggaagccgtcgcctcctcccggctggatctggttatgcggaggcggcggaggcgcggcggccaccggtggctgcggctgcggcgggaggtggaccgggttgggccggtcgggaacgggggcgggggggacagccgcgacgcccgggatgtgcaccttctccggctgccgctgcggaggcggcggcgggagcgaagggggcgcctgcagctgctgctgctgctgttgctgctgcggcggcggcggtggcgcctgcaacggaggcggctgctgcgaaatcggcggcggctgctgctgctgctgcggcgggggcgggggctggggcggcgggtgagacgactggaggaagccgtccccgacgttgacgtcgttgtagaggtcgtcgtagtcgtcgtcgtcgccatagtactggtcgacgtcctggacggcggagatggcctcgttgcggtggaacgagccgtcgccgtcgggatccatggcggcgggcggcggagccaaaccctaggaggggagggctggatctagaagagaggggagagagcgcgagggagaggaggaggtgggaaagggggcaaaacgcaaaacgagctcaactaatccggtgtgattgggttcggatttctggaggcgtctcgggttcagagctaacgagcgggtggtgcggtgcgtatgacgggtgggccccacgcgcgagatggttcgtcgtcgaggggggaaggacgtggcggggctcgagtgcacgggtgggatttgacctgacgtcatatcgtgtggatcccgttccgaccggcgcaacgccccccgcctgttgttgtagacttgtagggccttgtttggtggggcttcgattacagcccatcgaaagcccaaacagaatgtgccagaattgaggccctttgacatgtttagattgtgcccaacacagtttgactaatggtagtttagatcgaaagtccaaaaaacttttttttcgaaaatagtaaaagtacacaattggtcttaaatcatgtcacctatattagggcacccacaatgattatctataagctatctacaagagatccatgtcagcatattttcctacttggaagatattaaatgaagagagagagcaaagctatctactagattagagatagtctatagagaaaaacgaggcaatgcatgagagaactatagatacctatgtagacatactattgaggtggtttactattaatctagtctattgctgagatgtatatgttttatagagagcaccctactttaccattgcgggtgctcttagaattaaacgggccagacctaaattaatcatcttaaaatttaagagcacacattaacattagagattaatactatatgaaaaaccaacggaaaaaatttcaacttaaatatgctacaaattgaatgcaccgtttgaccggttaaactggtggatggaatgccacatgcgcatgcgccgagccgacccgggtggaggcgaggaatggcgtacgagcgagcgacggagacttctccgtcgggtgatcttcggactgttattgtttttgtagaacgaaactgacggccatgctcatatgtggtgctttagatattcctgatccttgtgatctgcccgtacggatctcctggatgagtaggcatccaaaactctatccaccttagtaactatacgggtaagcgggcgattaattttttttatagcgtgttcttcgcatgattgctctcttcttcgtcttcctgtacatcagcattgccttttttttgggtggagtttgtgatcacgtcgaccgtcaacactaggaacgtgaacattggcattgggaacggcaacatcggtatcaggaacaccaacttcgctactggatcttggagtgttctctaactatgtcttttatttcaatgttaatcatgttactgaatgattttattatctttgttagcatgttcatgtttagcactggttttgaatcactcacatttacaaatgttatgcttgttatactttttttactagattaagttatgttgaatgatgactaagagcatcccagcagttcatccaaatctcatcctctatatacccatatggatggccatccaaaaaaagattcctcattcatatcccttcctactccaacagatcatctataccacatcatccatattacattctctatttttttagtaatatctttcaactaaacttacatttctatcttttattaagggatatattttcaacaactaaatttcaacggtattatatatcgcggtgttatttatcgcgataaaaatttcgaaatgagtaaattttaacagagataattttacctggtaattttttaattgatatatttgaattgagtgaatagtagcaagaaaaatcataggaacaaaaataaaatgatacgggacactgtaaaatcgttatttgttcaaacgttccaaaatcaatatgtcaacgatagcagccgcctgtccagtactacccttctttgctctccttttctcttctctcctcttctcttctctactgctcagcggacaaccggagacggcagcgggcgggcgagggttttgggcggcgaggtgcgggcggcagccgcacggccgcgggcgcgggcagcggggtcgcgggcggaggagcggcgggcggcagccacattgctgcggggcgcgggtggcggtgtcgcgacgaaggaacggcagccggcagtgggcgggcctccgcctctactccgagcctccgccaccaaatccagtaagtatctcctctctacttccattcctctagccgacgatgaaggggaggtcgtgatggagcaaggttgatccggaactccggatgggggcgggagcgctagcgttgaggtatggcgtgaggagagagaatcgtcatatttgacatatttcttctcgatttggcgcatcctctattttttgaggcattgataccgtatctgctggagcgccgttttctcctcttatgcactatatttcggatggagtaccggatgaaagatctgctggggatgctctaaggctgtgttcttttgagagagttcccaactcaccaccctcatttttcgcgcgcacacttttcaaactactaaacaatatatttttttgcaaaaagtttatatacgaaagttgctttaaaaaatcatattaatttatttttttaaaaaaatagcaaatacttaattaatcatgcgctaatgagtcgctccgttttacgtgcacaggaggtaagttcccaacctcagcataggaacacacccaaaatttataacaatctaggtgcacaactagcccttatttagggacctaaataacacaatcgcacaggttctaagaccgttgtgcagtttttctttttcatatatacacagagtacaaactataatttgcactatgtccgtattaatgaaaatctattatctaaaaataataatttgcactatattacaaaattttacggccaaaattcaatattagaatgcatatcaaagttccctcaaaaaaaaaatcgttccctcaaaaaaaaagagaatgcatatcaaataaaaccatgcgtttatcgatggagcataccaagacatacgttgtactcgtgccaattaacgtgtgcatcttgtatcacacatttctcaatacacaaccacggtctggaagtcatacacaatgaggtctaagtcaaatcgagtcaacgaggcacaacggtctggagtacctttcaaaaaaagaagggggcacgtggccaaacgacgccatccaagccgcccgttctcgaccgaggccaagatcgaacggccagggcgctgcctcccgagctaagcatgcgcgccaccccttcttcttccccgccgcgaccccgcatgccgcgcgccaccacccgcgacgccccccgaccatgccgacgaacacgcgccgcgcgccaaagatagccatcgcctccgccgcctcccgtataactgcgccttcgtctccggccggccatctcccctcgacccaacccccatcacggccgcgcgacgagaacaacaaccaccgctcgtcggagtccgtccatcgatcggcacggctagcgcgcccggccggccacgcctcatcggaagcttctccctcttcttccagttgcaggatcgaacacaccgatcaagtgcggcgagtacgtagcctctccgcgtgatggcacgcgctcccgcgctcgccggcgtcgtcctcctcctcgccgtcctcctcgcgatggcgtgcgccgtgcacgcggcgtcgtcccagcccccttccccggccgcctctcccgagtcgtccgaggccgagtcaccggagtctgaagagtccgagtgggctgcggagggcccggggatgctgtctgaagcctccgaggagcttggcttgggggccgggccgctcaagacgatgggcatggacatggacatgctcgacgacgacgacgacggtgctgctccgtccaagagcccggctgccacggcacctgcaggcgcagccgccgcgccggcggaggagggagacgaagaggaagacgcgagcaccgcgtcgccggcgtctgcgcccggcgcgagcgaggaggcggagggggaggaggaggccccggcgggcgcccccgacgccgaggcggaggaggcggcgagcggcccatccgaagcgtcctccgaggagccatctgccgccgccgccgccgccccggaagaatccggcggcggcgaggaagccgagccggcctcgggggaggccccaaccgccgaggccgccaccgccgccgacgtctccccggccgcggtcaccgtctccgagggccccgcggaaggtcccggcccctcggccgccgacgaggaggaggacgagagcggcgcgagcgccacgacgcagcgtggcagcctcgccgccaccgccgtgctcctcgtcggcgccgccgtctttgccctgtaagatcgacgtggccggctggcgaatcgacggtggagcttggagtgtatccatgtcgcaacgaaaaacgctgcactactacgacgcactcgttgttccattggtcaagtgtacaaaactacaaattgtacgatgagttggcccgatgcatctgttaggccttctgtgtctccatgacatgcatagctgtgtttaggtttacctttttaacttggagtaatttttatcaaactacatatattttaattaaacaatcgagaaatatagacttaagacggtgtatcatagcttccagagcctgcgtccctgtcatcctcgcgcgggcgaccggggcgaaccctagcctccggtcgccaccactcttccctcctctcccccgcctcgccaccgccgaagcgcgtcggcggaaaccgcgcggcccgccgggatggcgtcggcgaggctcctaccctcggcggcgcggctgtctctgcgcgaaggggcggcgcggaacgccaggaaggccgcgcggtggcgaggcgttgtggcaacgaatctagcgccgccaccgccggatctagcaccctcgcggctggatccgccgacgccgccgccggatctgggccgtggagacacgggcgcggcgtcggaggcgagacgtaggtgacggcgacggcggcgaggcgcggcgtggcagccgcggaggcacgacatcggcagcgaaggcatgggcgccggcgacagcggacggccgtggaagccgtggaggcacggcgtcggtagcaaaggcgcggggtgccggcgacagcgggcggccgtggcagccgtggaggcacagcgtcggcagcgaaggcgcgggcgctggcgtcagcggcggagacacgggcgaccgtggccgacggcgtggtggctgtggctagctggcagggccagcgccggtggtaactatggccgtggcctgaggtggcagcggcggtggctggcggtgcggaggcagaggctgttgcaacggtggcgtcagcggctggtcggcgacagtaggtggctggacgacggcagcagcggctactatggcgaccgtggctatggagagaggaggcacggtggcgactgtggttgagatgggagaaggcatggcggcctcggacgtctagccgagggcatggcagacggttgcatctggccggcgaggcagcgtttggaggaggggtcagagaccggcttggcgcagagaggcgcagccgatggagggaggccagattggcacgagaggcgcgtacagtgaaggaggccgacttggcgcgagaggcgcggccagcgatagaggaggtgaccccggtgcgaggaggagctgccgatggatgtgcgcggtcttcggcgcacgaaggctagccggcggggggcgccggtgcagtggtcccacatgtcggcaaatgttgagcggtggtggagcatcggtacgtcagtcgcggattcgcaggtggtgagcagcgggtgaaaacctagcccggccttggccggaccgacatcgatggttaattccccctcctgaggacgttgtcgtgctgtctcattcttcaagggtggttgttgggtgaaagccctgtcttggctcctttaagctccgacggacggcggcggcggttttccgtcgcttctcttcttgaagatgttgttttggcatcacctagccgaagcctctcgaacgattggtgcaagcacgctctaggagttggctttgtgttggttgtgagggcgttcttttgggcgatctcgtctgtattcctttattggtttagcggcggtcggtcacgcttagcggcgactagtccggtgttagctttctcctggaatttgtgtgttggtgatgtcggtgtgtgggtgtggtatattttttcctttttcctggttacgaccatccagagttgtaatcttgtaattttttcctgctctatcaatagaacctcgcaccgtctcgtgcgagtcgttcaaaaaaaagacggtgtatcataggctactgtttagcaacaaattcataaaaccataattttaataaaaaggtattatcacaaaactacatatttcatagtttaaatccattaattgcagtgtagctatggtggagttttcaacgttgtagttttctatttaaattatcaccaaatgtgcagctttataatagttttattgttggatatatagttatgtgatacttcataccaaatttgtagttttgttatatatcattgtaaatgtgtcgttttttctaaggagtaaatgtgtagttttgatatatctttagtcaagttatttatgctttcatgaaatttacttttatcgcgaggaatttggacttgcgtacgtaaggaaggggggtttgggcctcagcggtggtggaggtagtgggccgacttgtaggcatccaaaactgtttggaataagttcaccggagatccctcaacttaacaacgagattttttttgacgtcccttaaccacaaaaccagaaatctccacctctaaactatacaaaaccgttcactcaaggtccctacacactatatatgggtggtttcactgacgtggcatcctagtcagaaaaaaaagtatgtggggaccacatgtcagctgcacattcattcccttctcttctctcttctcttcttagtcagtgagggaggtcgacggtcagtgggcggagtggcaatgggagggtggcacgcgagcatggctatgggtggcagcgggcccatgtggcatc

SEQ ID NO: 63995 - DNA, 596 bp, Oryza sativa
acatttcttcacaaaatgctgcgcgatttttttaaatttctgccccttctgggactgaatgcaaaatctttttctatggtttcttttgtgcaaccaaacataagtgtgccttatactacatggcatctgcattataccaaaagtggccttaccatatggactctatgcaaaatataacttccaacttctaagaagcagcttttatggactgtaaagaaaaaaacaatgtagcgggctttattatttctatttgcgcgttgggaagttgttctgttatcctatccactataagaatacatcatgtcattaacatccattttccattagtttgtgcctgatagaattaaaatttacattccaaatgcatattttaggatcagaaaaattattttgcttgatatacaatagtaatgaatggtaacgttcttatttcaatagagaaaacgaggctcctccacagactccattggcatgtatgcagttcaatgttgtgagtgtcacaaatggcgcaaggttccgacgaaagatgaatttgagacaattcgtgagaatttcactgaggagccatggcactgcaataaaaaaccttactgctc

SEQ ID NO: 63996 - DNA, 9078 bp, Oryza sativa
ggctgggcccaaggtggagcacccggcgcgttcgaacatatccgccgccgagcttgccattagggtagactgccaccactcctctcccaccgccgtcgtcgcgtcgatcgcctctctttccctctcccgccgccgccgtccccggtccgtcgctggccacctctcgccccctctgtcgccgcgcctgcttgagagaacccggagagaagagaagaggaaaagaaagaaaagagagaaatatgggacctataccattgtctcacttacatgtgggccccacatattaattttaattatttttgctgactatgatgccatgtcaacgaaaccacccatatatactgtctagggactttgagtgaactgttttgtatagtttaggggtggagatttctggtttcgtggttaagggatcttagaatatctcgcggttaagggatctccggtgaacttattccaaactgtttcgggctttgggccccgaaacagagcacaaggcccaaggcccagatgtttgctccttgtacaacctgctacacgttccattgtcgcgtccattttggcttcgtccaaaatccaagcagacaccatcatgtgaactgtctgttccaagtcagctacagtactactccaagtactaaccgcggtaaacaaacatcgttcgctgcaaacctgcggttttgtacttttgtttactgccaaattgctcaaactccctcggtgagtgtctcagatctcgagtgatttttccctgcccgcgcagtggcctatgctttgcatttcggtttcttccaccagttcaccgaacatgttctacagacacctgaacagcaaaatcggcaggtgctgagccctgatctgcccgtccttcacgtcaacatgccaccgtcgggcgtcagagatgcagatgccacgccggctacacacgctccggcgtgtgagggcaatagcattgtgacagaatttacctagcctcatatatacttcctctttttcacaatggaaatcattctagcatttcccacatgcatattgatatcaataaatctgtctagaatcattaacatcaatatgaatgggaaaaatactagaatgacttacattacgaaacggagagagtatcacctaaaccaaaaacattactagctatatactccacagtggcttatagtgggtcacatctcccactatatctcctctctttgtttcgcctcggcaaaggaaacaaagtggcgatactcgagcagcgccacgacggcgtcgagtggcgcgacccaagcaacgtcaagcagagtgattgaggtcgtagtcacgagtggcgcggcccaagtggtgccgaatgaaacggttgaggtcatggtcgtgagcggcagcagcttggtccaagcaatggcaacaagcggagcggcagcgcacggcccaagcagcgccgagcgaagcagcgacggatcaacctcgagctctcttcccgaaggggcgtgggacacaagattgtgggcccaaatctacaattttgataaagaacgtgcagcttattttggctccttattcttgttgaggcaacgaaaaatattaacatggagagaaatctctgggttaaccggttagggttatatgatatgtatgtgagtacactgctaacatacttcctccgtcccacaaaaagccaatttagaaagggattggatacatgttttttatacaacaaattagacaagaaaacatctaatcccatcctaggttagtttttctgtgggatggagggagggtggtatacgtcgcactcaccatcgtccgtcggtggcctttgtcgcgtcggccgcgtgttacagacttacaggctcgtttttaaccggagcgcgacactggtaggctaccggtgcagcacagcagcggcagctgcactctggcgccgtgcacgtggaatcccggcctcccgactcgcggcaacccaccgcgcgcggcggcgtgttggcgggggggcatctcgaagcttcgggcccatgcatctccccaatctgccgctcaccacgtggttaaaaagcttccggccggtgggtgcacagccgtcggatgcgggatcgggcggtgggggagacgcgcgaggttgcgtacaaacctccggattacaccgaggttagcagcagcatcagattcggggggacaatttttttttttttgctttaaagtctcgtcgcttcgtcagcctcgccgcgcgatggacggcgccgtcggcgagcccccgtccatggctgacgctacgtactactactactaacctacggagtagatttttgcggagccatcgtttcgcttatctacgaaataaacgaaacgatatatttacaaacgaaaaataatttgtgaataaaatttttatatacgtattcttagcaattactcccgctgtcaggtggatgtgaaatatcttattactacgaatctaaacgaagagtatgaacaaattcgtatagtagtaggatgtgacacatccaatcaaaatcacttatattataggatagatggagtaaaagaaaaggctgaaaaataaactttgataaaaaaatctcaaaatctgcttcaaatttaaagttaaaaatttaaattttgacagataaatataaatataagtgaaaagatgatgcccttgaattttcgatggactggctttttggacagcattttggtgcacgacatcggctgcaatttcatgggctccaaccgaaattcggcggcagttgagacctgtgtcctcggcggttgatgacagttgagaaagttctcaccatcgcactgactcagatatggactagatctagggccagatatgaccttttctctggagtatcaagcttttgaccctcgaaatacgatgcctcggtattcgtcatatcagcttctctcttcttcgcacaacgctagtactccacgttgcccacataaaagtactctactctattactagttgcttggatgcttagctacactctgtaaaaacttctctttagagagcaaatcattagagcagattcaatagtagactataagccaactataaatatattttaaaaaaaataaagaaagtttgagaagagcaatgggctacagatatgtagccagctgcagcgcggacttcaagacataatgtgtgtatgacagatgggactaggtattaatagaatagtaagtaactattatatgaattggctagagatgatttggagctagtagttagctatactattaaacttgctcttagcgaagacggagtactcctactagacatgcttttttttttacaactgcaaactagacatgctctgcaatccgtataagagcaagcttaatagtatcgctaactaccagcttcaaaccatttatagtcaattttatagccaattcatactatagatacctataaacatatactacacaattatacttagtcccacatatcatatacacatgtatctaggagtccgtactgcagctggctataaatctatagcccgctgtttttcactcttctcttttatctcctctctgtacctgctctaaccacttcatgatgcatccggaattccggatggaattcagttgccgtgctaattttgtctcgcttactgctgggcccgccgcccgctgttcttgcccctgcacactccaccggtcatgattcttctcgattgcaactcgcatgctcgaaaaggacatcgactagttcttttttaaaattttctttcttcgttttcaattccaggcagctcgagttagagtgaagacatgagcaagctctgcatgaagacatttcactgcgcgcgacaacttgctgaagtgctgatgaaaacagcctttcctacgtacgctagaaaccactgatagtaaatgaggacatcatcacatcaaacacaagatccaaataaagaggatgaaaagagatgaggaagatgagggcataaaaaggttattcggtggagtgcaagagcaagcggtgagcttggaggaacaagcattgccattggtgatattatattggagccgtggacatatgaatatattcgtctgagtttaaatcatgatgcttataaatattatgtaaaaatacgttttcagtagtataaatatatttagttaacctatgaatttatttttatctttaagtttcttttaaagtatacataaagtatacataagtatataaatatatgtacacgtgatgtccatgtgtaatgatatatgtgcacatatgcgtacgaaaactatgatcatattcggagccccatcggttggtcaaataaactaaagcaaaagctaaaatttaaatttcaaatttaattttaaggtattttcaaagtaatttatttttagcattggcttttaaatcactataaacaaatatataaaaattttacctattaataactttttattttttaataaactgttttggcttattaggaagtctcaggaactgaaaagaaaatatcaaaatggcaaagggttgcaattacctgtgaacccccggggcatcacgctgtgcgcacccaaccaagttaagtgagcgccaatctctatactgcgcccactccccctcactcccacgcggcacgcaccccgctgcaccctgcaccacgctccactccacccccacccccaccccaccccacgccgcgccgcgccatgcgccgcctccgcctcgccgccgccgccgccgcgccacacggcgtcctcctcctcctcctcatcctcctgccgctcgtggccgcggccgggccggcggcggccaaggcgcccgcggccccgccggctccgcccaacgtgacgacggcgatggcgaagggcgggtgcaaggccttcgccgacctgatcgcggcgtcgcccgacgcgtcctccacgtaccagtccgccgccggcggcggcatcaccgtgttctgccccaccgacgacgccgtcagggcgttcctgcccaggtacaagaacctcaccgccgacggcaaggccgagctgctcctgttccacgccgtgcccgtgtactactcccgcggcagcctcaagtccaacaatggcgtcatgaacaccctcgccaccgacggcgccgccaagaactacaacttcacggtgcagaacgagggcgacgccgtcaccatcaagaccgccgcctccggggacgccgcgcgggtcaagtccacggtggtggacgccgaccccgtcgccatcttcaccgtcgacgcggtgatcgagccggtggagctgttcaagccggcgccgtcgccgacgcccgcgccgtcgcccgctccggcggcggacgctcccaaggccagtaagcccgcgcaccacccggcgcccgtcgtggcggacgctcccggccccgccgccaccgactcgcctccggcggaccagaagaaggaggccaagaagagcgcggcggccggcgcgccgccgtgcgtccggtggttcgccgcggcgttggccgccgtcgccatggcctccacattggcctagggcaattgttcttttttttttgtgttcttggttgatgatccattggcgtgatcgtggtgtgatggcgtgttgatgtgcttgcgagatttgtgcttactttcgtggaagaactagtggagtgcttaaatattttgttagtgctttcctagattttcgtttttttgtttgtgcctgctgttgctacttgttaattgttaattagcattagtagatcatgagatgttgatatcttatcagcattttggttttgacttgatgagtgcagttaagttgctgagattttgctacatgaaccgtgcattttaaaatttaaacccattttgcagcttttccattatttttttgacagagagatttgtcacttaaattgttggaatgtttttctgtacatctcctcgagcaaatctcagatatgaaacttatcatggtgcccgttttactgacaaattggcaaggatcttttcgttgcatcaagtgcaacttctgcagctcatttcttgttatttcagttgtcggtggagccataaggccatttgcttcagaggtcaaaacaacccaacccacacatcaaaagcaacagtaaaaaattccttaaaaagcacacagtaaaaataaagaaaggtggaagtaactgttactagaaggagaggaggagatcgagacagagatatttgacgtgatcgagccggagagatttaaggtgagcttgaaagaggggttgagattgtgccttgacacagaaaacaaacgagacattagcacataattatttatatgcattagctatcgcaaaattaaaattttgatttacataagacttatatatataaaaggtttttaaatgtaaaaaaacgtaatgttgagcagttttgaaagcgtgttaaacgttctttttttttctttagaactcagccataattttagttgcattgtgtcttttttaccgagaaaacaggacacgagaccgattccgattcgggccaatttccccctaggaggggatgaaaacgagcctttattggtagcaccgacagggctgtggatccattcggacactgccgccactcgcagctgagcgacctcgcagtgttgccatcctagcccagcatcttttggcacgagaaagcgcttcggaactgtgcccgtttccgacaagacagtgggcagcaaatcttgtttcagtcattcctcttctttggtggtcagtgatgccgcttctctgatcacttggttgttggttgtttcagtcacggcctctctaaagcttcacaatccggtcacgaacggtatcatctaatttcgtggaatccgttgataaaccgataaagactgataaaatttgaataatttttgctgaaaaaataaattttagtttggttgttttttaactttacgtgaaaaatcgagtggtttttatttttggcctagtccggaaaatccgcattttgctaaattcgaatcgaattctactagaagttgtgtactctgtcactctcttctttcactccttgcacttctttttaaaaagaaaaaagtacgaattaaccccttttatcgcggtcgtccgaaatacccccctgaaccacaaaaacggatatttttcacccacaactatgcaaaccggacaaattacccccctcgactcagtccacaatggttttggtttacgtgtcgtacgcgtggtagtccagtcagcattctatttatataaaaaaatgggacccacctgtcatatcctcttccacttcctctctctcctctctctctctctcactcttcccccctctctctctcatgcgcatgcacgctcggcggctcgtcgatcccacggaggaactcgaggagcggcggtcaccgtcgccgtcgctggtaccgcgcgccgacgccatctcccctcgggccccgcccgcatcgcgtgccctcgtccgtcgcccgtcgtcgttgtcgccttgagccccacctgcgcgccgtcatccgtcgccatcatcctgcgcccgtgtgctgccgctgtcgcgtctcggagaaggcgagcgcggcggcggaggaggcgaggggacgacagaagagcgtggcggcggaggaggagagagggcgacggaagagtgcggcggcagaggagagtcctccacccagccagccgccgccgtagccgcctctgcccgtccagccgcgcccgccgtcgcagccgcttggctagccagtcgcctccgcccgcccagccgcgcccgccgtcgccgctgctcgcccagccagccaccgtcgtagccgcgcccaccaccgccgctgcgtgctttagcgaggggaggggatgaatatgtgaggagagagagaggaggggtgcacaggtgggccccaccgaatttttttaaaggagtgctgacttgcctgccacgtgtatgccacgtagatcaaaaaccactccagagattgagtagagggggttatttgtccggttttagtagttgagggtgcaaaatatttgtttttcgagttcagagggtaatttatacgaccgcgatagttcagggggcaattcgtacatttccattttaaaaatatattttagagtattttttttcataataaacttcttttccaacccaatccgctaataacacatataaaaaattgattcatcaattattttctattgcttcttttatatttctacggtttatcagtcatagctcaatcaatcaaagctgagctgaaaaaaaaactgggaggtttcaaactgattttgaagaaataagttcagaagtttttaacttgcaaaaaaagaaggaaaatgcttgcggtcggacgtccgacgcaccaaacaaaatcggacgtgatctgctcacgacctacatactactctctccatcctaaaatgtttgaagatgttgacttttttaaaaatatttgaccgttcgtcttattcaaaaaatttaaataattattaattcttttcctatcatttgatttattgttaaatatacttttatgtatacatatagttttgcacatttcacaaaagtttttgaataatacgaacggttaaacatgtttaaaaaaagtcaacggcgtcaaacatttagagaaggagggagtatatgtctagctgttgtcttattttttttctctcagcctactgcatggttgcacatttctctctctctctcttacttttctccttagtacttcactctaatatataagtgtgtatgtatgtagaaaaaaaaaagctatgcatgcattagtagattcaaactagttttctcctaaaaatatttattaaatctacaatccgattacactattatatctgttgcaattaaatctttacaataagatcttagttgattatatttttgataaaaaaataaataaaaagaataaaacactattaaatcctaattgaaacatttttattctatatatgaaacatcgagttataagtgttgcaacactgcacctatttattgaaacactagaaaaaacactggtgcaatatttacattgaactagtgaaacattagaaaatacttattgaaacatctaaataatatcacgtgcaatatttataaagatcta

SEQ ID NO: 63997 - DNA, 4993 bp, Oryza sativa
  unsure (1)..(4993): unsure at all n locations
ctgcagcccctctctcgctctctatctctcaccgccgcatgctacgccgcccacagctcacaaacctcaccggcagggccacaaatcgagctgccggatagatatatacaccgcgagtgcgcgcgaggctaggcgggtgaatggcggaggagtgggggaggagggattcgagcaatcgagctagtagtagtaatggctcgtcacgatcagaggtgcaggagaagggggagagttgaggaggggaggtgggaagaagaagaagaggaaaatgaatgaggaggagaagggacaaggccgggctcggtcgggaggaatcacatggaggacaaagggaaacgggggcgaatttgatgacgctcactgctactgtactaattatgtgcgcgcccgcccgcgggtgctaatcgcgattctcccactgatcccctcttttcttcagtaccttcttctgggctgtcagcagctaatccgcactattggcgcacacactggcggtcaaaatcgatcgtagtagtatgccgcatgtgttcaaaatgggggtactgccaatgtgttatgagaaaccttgtggcgttggggctcatgtttcattgcggaattatttttgtactgggctcaacatttatttttcttatagtagcatagtaatgatatgtctctgaacttatagtgccattatagttttgagatgtggtaacgggttacaccaactgacatcagtattcacaaacgagtaagagttgtgatatgtcttatgggctattaattgtatctatacaacttgtctaatacgtgaatatatagaatgtcttttgtgacatgattttcttgttgttttggaatttttttttataaatgatacctacacggctatagtaatgccattattcacaaagcgtcaagttttagatgaccatgttatgtactcctaactagatgttatgataactcaatagctataaatactacttacgacatatataatacttagatggttaaatagatgtttaaagaaagagtacattaaaacattggattaagaaccacagtttctaatggattggaatattttgagtcctaatgagcatacaatttgttttatctagatgatcatgtcgcttggtggcaagttgctcaaaaatcttcaatgtggtaagtgacaacaaatcaacagaatagttcatgtcacccctaaatatttattcttgtaacacactatacatggctaaatggttttataacaaattgcacgtcatcttagcatctgctggcaaccttattatttggtaagcttggatatacagtaggtttgttcatcttaaattagaatgaacccgttggaaaactaaccataggcgccttgcgagcttgcccgatcaacttatacaatcaaatgctaataatgggttagaatacaataaatgagctttcctgaatggtggtatcttcacaaccacttgagatccgtaatgacatgatctgcaacacagagagttatattgtcttggagattctaaattaagtgcttaccgtctgacctagtacatttgtaaatacgattactacttcctctgtttgatatatattcgtctttttttctttaaaaagtacagacgcagacgctcataatacacggacacttatccttatgagcataaacacatgtatcttaatcttaagattgataaaatcatcacagacgcctagctattgacggtatgtcaccaaccactgttggaataattaattgtaaatatgagcacccctgtcaagcctagtatttaacctgatgggtaggttccaccacaattaatctaaccagttgagagctatgtccacttcacactgaacgtgtagagatgtagcctagagggggggtgaataggctttcctgaaattttctcaacaattacagcggttaaattaacagggcccgaaacctcctggtgatgaacaccggaacttccgggcaggatgagtagcccgaaacttctggagttattgagccaggaacttccgggcagctgagataaattaaaactgagatgaaaaacatgtcctagcaagggaagtttaggcacacagaggaacaagatgaagatcgcagaatatcagcagattcatacaaagatcatacacaagagagacaaagacgatttttttcccgaagttcggattacacgaatcctactctccgttgaggtgctccaaagagccgggtctcgattaaccccttgcctcacttatgaaaagatcccagaagaggtccacagccttcaactcaacacttctaggtcattttctagaattgagtgaccaccaagatccaactcaaaatttcttctagaaaagaccacaagtgcaagttgctctacctaggacaacctctgaaaactcagcacaagaatctttactcacttaccttgtttccttgtggaggtgaggaaaaccttcccaaactttcccgggacatccacaagatctttggaagctcacgggcaacacctaaccgtctaggagaagatctccaaaagtaataagcccaagtgacagcccacaagatatccaaagtgctcaatcaaacctaatcttcaagccatctccaaaacactcctacactctcatctaatctcataatctcacaagatatgctctagatttgagtggaggaagcaaatgaagcttgggggtggctagaaaaccctagaacatgaatgaacagaagtggaatcgccaaaaggtgacctggggatgaaatccatatatataacggctaggtgacgccatctagctgttactcacaagtttgaactggaaacctgctaggaggttccggataaaagtgccaggaacttccgggcagcacttaggaaatttttgcaaataaacggtgcccggaagttccggccagaacctccgggtagccctctctgtcccggggagaaaaacatttttcaaaaatgattccaaaaatcttttgactcatggataagactaagagcactttgtataccctagaaccacacttgaaacccctcttaatagtacggtttttcctaaactcaatttcgaaagtgaaaaacctagtctaatcaccttcgatgatttttgcacttaggaacattcgaattggggggtctccttgcattcttagccatcacaactcgctttgggactaaactcctgtgaataaacttgataaacacgttagtcccctttaaccaccttgtcattaatcaccaaaacccactagggggtttaagtgcatctccacacacatgttcgcttttgaactactatatcattttgcctgccttgcctttttttttcttttccataaatataatgggagtatctataaaacattcaacattttttaatgaatgttttaattataactatattataattggggtataattacattgtatctataatatagttacaacttaacttatatatgcacaaatataattggataaaacaaatggtgtggacgattagcaagcaagcattcagccatcctgtaattcgactcttggcttcagcatgcgtgtgtaatttttcccatcctgtgcaaatctcgaggcgatcagaggatcagaaaattcaaaagttttgagcagaaaaaaccgtccaatgtttttttaagccattccgaattacaattagcagagacacattgtaagatgaattagttacagtcagcatataacaggcaattctatacataaatcagttctatacatatcacagtatcactatttttagcctcaataccattgccgatcgcacgctagcagcttagccgcacggcgcttcatcttgccaaataagcaaccatctcactcctcctaaccgtttttcccaatttcccactagctttactactccacaaatctgcgtgacagcgaccgtacgtgcacgttacacttccgtggcgcgactcggcccgcccccgccgccgccgctgcacaccctgcaccgcggccgctcggtccaaacctaagcacaactctgtcgagactcgagagggaacgggtgaatcgatctgaacgggtcgcatcgcatcccgcgatgtacgctggcgacgcgcaccatactccatcccactccgccgcccgcacggctgcttctccccctcccgtgcgcgaccgcgaccgcgagagcccaagaaaggaatagctagcgcgcgccaggtagtttgccgcgcggggtggaaatgcttggatttctccgtgcggtttccttttcccccccgaggggtgggacggatcgggaatagtattatcgtacgtcgccgcccacccaccacgcgtgcgtgcgtgcgtgagcctgcgtacatgctctccacgaacgcaggggatatcgcgagagacgtggaggagatcgagtagtaaggagaccgaatcgatgggagagatcggtaatcggaggaggaggacagaataattaaccggtgtgtgctagagattatggagtccgacacagattagcactccactgctaactaagaaaaagaaatgattgattattgagagtggatgaatgggcaggcagggatagattattatacaagtattttgttggccgaactagaggggaactaggtggtgtttggattaagcactaaactgtagtcactataacatcggatgtttaacgctaattcaaaatattaaatatagactaattacaaaactaattgataaatgagagctaattcgttagataaattttttaagcttaattaatctataattagcataggtttactctaacatcatatagactaatcatgaattaattaggtttaataaatccatctcgtaaattagtctagagttatgaaataggttttatcgttagtttacgtttaatatttttaattagtatataaatatccgacgtcatagttttagtccctagtggtcttagattcttggggtcggagtcggagggttaagtgaagtggaaanntgacgcccattag

SEQ ID NO: 63998 - DNA, 25953 bp, Oryza sativa
  unsure (1)..(25953): unsure at all n locations
agccttattactggcatgaaatcagtgagacccctgacacctttatcctgatcagtagtagttaagcctaactggattcattaatctgaacacacaattcagcacatgccggcagagaatttttttcggctatctgcacaattccacgaagtgcaggttcagtaatggcctaccagttgctgctagctggtcatgtggcaagttcttcgccacgattgagccaaccgtgtaaaaagtttcgtatgccaaaacttgttagccatactgatatactatgggtgtgtttagttcacaccaaaattaaaaatttggttaaaattggaacgatattgaatggaaaagctggaagcctgtgtgtaggaaaactccgatgtgataaaaaaattggaagtttgaagacatagtttgaaactaaactcggtctatgttgagtagtagagttctactactttcaattaaggccctgtttagattctaacttttttctccaaacttccaacttttccgtcacatcgaatttttctacacacacaaacttccaacttttccatcacatcgttccaatttctttaaactttcaattttagcatggaactaaacacagcctaagagaacctttcaatcgattcgttcagtcaaaataattttgcagtaagagtagatgatgcggccattacagaaggaaacatttcatctttcattgaaccatactaccaaagcatcagcatcaggtagttccaagttttaggatacaacttacaagaaagatacattcagcaaagtccacaggtgtcatattattgccgccatcatctcttacaaccagattttttttcctctgaaatacaaaatggatttcaagggcacaaatgaagacaatgcaacttctgacgaagtgcaagcacaagaaaggtagatacctgaaaaaaaagatgaatggtcgaatcattatccttttttacaatgataattcatgaagacagaaataattaagcaagaattcagattcacgtctggaattaggtagttaaaagtcacaaaccccacctagtcgcttcaagtgctgcatctcattttgaactgaaggtaccagaaatctagagatgactaaatagtatatgcaattctaaacgtagtagtgcacctgtgcctataaatggagtactagcatatactccttccagtaaaaaatatttgacgtaactcagttctcccaacgtcaactaatattgactggaggggagtaacttggacacaatttgccacacaaaatgcatgacagagtcagaaatagatgctactaattggggttgcaatgcacttgttggacaaacaaaaaggacaggcactgggaggattattttcatgaaagctgtcagattataaatacagtgtgaaacagatactgcaaagcaccggagagcgtcagtacttctggacaagtcagaaatgcaacagaaaacttgtagtccacatgggatactgaattagtcatacaaaataaatcagttaggggcagtttaaaatgtcgaacttccatgcacaaagaggcaacatgggttcttagttgtatggcaaggttatctaaaacttcctagccagaaaatataaggcagcattctctttattctttaatgcatgatatgttgtacaacatagtatcaacactcaaaactacaatagccaagcagctgtaagggaaggtctggataatagtgacccaaatgcaactgagttttctctatacaagaaaactttttccctcttagaaacgtgattttacaagaaaatagtggataaacatttttgttaatgcattttaaaaaatctaccccaggtcacatgttatggtggaacgtatgtatatgcaacggaggcagcctgtggcagaagcagtgaaggtggaaggataagaagcagaatgcgtgtaggaaggttgttacggcttgcaatcaaattaggtttttagttagttaaagatatgagttgttagtagttagtatttcccttcaatcagcagattagttcaatttgtaagcctatatatgggcagttcattcaatcaataaagcaagccaagaaatatctctaaccctagctcgacaccaccatcacggctccagggcggtgaggtgagcagccttgacctccccctgagcatgcctacgcctttcgtagtctagggcctcctcctgctcgcaacatcttggtatctagagaccacggtcatgctcgctgatgctgcgccatgtcgaccgtcaccaacgtcgctggccgacgactggaagacaggacttgctgcggtgatcgaacgcctcaatgccatccacggccagatctcagacctcaacaaccaacaacaagcgcaccacgtcgcaatccagcgcctggaacgggctggcaacgacaacgctccacaccacggtggctgtgacgcagatagcgacagcttcaccctggggcacggaggtgagggatgccacggcgaccgccctccatgctaccacaagcttgactttccaaagttcgatcgtaagggtgacccgattcattttctcaaccgctgcgagcaattttacagggggccgtgtacgctgaaggaagagaaagtgtggctggcgttctaccacctgctcgacggtacccatcaccaccatcactaaccctagcttgacgccaccatcacggctccaggcggcgaggtgagcagcctcgccctcccgtcgagcacgcctatgcccttctagtctagggccccctgctcgcaaacatcacaacatgtcaccgcaataagtacaaattccataaccaatcctaagtcctaaccagctcaggcaacacaatagccctggtccaatcattctaaaccagagtcatttcaggtacctatcttcaccgtgttagcctcaaaattataatacttacaaagtttagctagcaatggctcataattgaatattaatttaatcggtttaatcgtccataaatcccaataagttggaaattcttttcaattttagctattggaaattcttttcaattttagctagcaatggcatatatttccttataatgttgatcgtgcatagatgatagaagtcatagaactcaatagcgggaagtgatccatttcttacccggaatatttggtgactaactattgttttattgtaaaaaaagatcaattgaaatttagaataaaatatatgcttgcatctgcaactagagggaagaacctaaaccagacctcacattacaaggcctaaccatgaaaatagagcagcagcaccgcaaagcttttgatagggaaagaaacttctatgagaacacattgtatgtggtatggactcacaggtgtacatctttatagaatttttttttcctgctgcggcacacacctctgtggctctgttgcgtccagcagaatgtgagtgaacccttgagtcaggtcaaatggccaaattaagttgagtgcactgtgcctgattcatattagctaagcggcagctacactaaggcactgtttgatttagcttaggattattataatctggattattagtagtaagctgaaacaaacagatagcttattttaatagattattacaatctataagccagattactataatctagtaatccactctaaaggtgctttttttagattattgggttgctaacagctaacaaacagcaaataatctagagaaacaaacagctaacagcttattctatgtcggcttattataatccagcttatagtaatctggctcaataatctagattacaataatcttaagctgaaacaaacagggcctaagaacacagatcgttgcactttgcaaacactagctattgcaagcagacatctgatgttgttgctatcagttaagaggaaaacaaaatacttccaaaataagctgatgaatatgaaaccaattttaatttttatctctagatcaaatttgtatcaatataatctctaaagaagctaaccaaatgagatcacaaaatgaaagaaaaagttgctactatattcagaatgcagggagttgtatttctagcaaagaactggtattctgtactaatatccgacaaaatagaacaacccgacagataagtctcattttaattgagatgtcattgagaattgactagttagtcatactccctcctgtcaggatttcagacagccaaatactactaagtgcaagtcattttcactgtctgaaatgacaaattattccatccagaggtagtaacaacatttgaaggcgctatacgcatcaaaaactcaaaagaagattccaccaaatccagtccaaagataaaaacaataggcaaagtaacaaggtcagcatttggtggctcttcttgtttctgctacggactaatgcaaagtgattttgaattttaagaataattttaggtagattttttacttgtcatcttagcaatcatgaaaagagaacaagataataaattgacaatgaaagcccataaaattaaaatcctaataaaatcaaaatgttagaattcaaaatcagcggcagaatcattcattctgattttattacgattctcactgttttgcaagcaaattcaagagccgctacatttgagtaactgttttgcaatctagcaatagttcatttcacagcattttcgttccagtctacatgcatctaaatcatatcctcaatcataaaggaaaacaaatggattcaacggggagattgaaaccgtatgcctgtatggtaacgtttcgcacaactgttttcgtatggcaaatttggcaacacaacgaggagatacggaaccctaggtccgtccaatcctagatctagaaaggtaaagtagcaaaggatttcctcacctcgaccatcacttctggtagccgccgccgacggcgtcgtagtcctcctccacggcggtgttcacgtaaggcacggggaagtccttggcggggtcgaactgcttggcggccatgtagcgctcgaggtcgggcttgcggaggagggtgcggcggacgggcgggcggtcacggcggcggtcgcgcgtgtagtacttgatgtcgtagacggtctcgggctcggaggtgggcacgacggccatcgtgtccttcgtcagggtggccgggcagcggtggcggtactccagggcgcccgggagcgcgctgcggtactcgggggaggcgcacgggccggtgatctcccacggcttcttgaagaacttgcggaaggtctggaacagcgacttgccggcgccggcgccggcggcggaggcggaggcggccatcgggatcggggttggcgtctgcggcgcgacggaggaggagaggagggagatcgaccgatgcgaagaacgcggccgatggatacagcgaggtggagaagatgctggatctcttcgatgcgctacgtggcgcgttctggaccgtctgatcgatgtagaaaggctcaagaagaaaaagcataatcgttcatgaaattcactcgcgtttttttttgcaaaaatataaaggccccaacatttcgcttatttggggataagcgaaactgcatatttgcaaactaaaaatagtttgtaaataaaacttttatatatatgttcttagcgatttaaaagcaaaggctaaaaaataaacttcgataaaaaaacaaatcaactctaaatttaatattgaaaattcaaattttgactagtaagcataagcataaagcgaaaatattgatccataagaatgagaagaagttaggatatcacgtaggtgcgaattatattttactataaagttgatgtccactaacgctcaacatgcaagtgtgtcacatcatcacccacttcactagagtattttaaatcacatgcaagtgtgccacatcatcattcactagcaattattatgagtattttaaatatcatacaaatatgacataacatttacaatcttattgtgtttttagaactcaatatgcaggtggtgttctttttctcctgaagatggagatgaatattaagtttttttaggcaaaacgatgtgatattaacgtataattattgagttttacttcgtaattattataaacttgaaaaataaattaatatgatattttagagcaactttcatatagaaagttttcgcttgaaacgcactgtttagcagtttggaaaacgtgccacgaaaatcttaatcttcatccaactcttgttggagaaaataacgagaccgcaatcaatgtcaaatcattatccccacatcatttttcatacgtatattatttttataatgtataacatgcatttattcacatattccgcgacaaaaacacggggtatcaactagttctatagaaacgtaaaacacatgaattcaaaaagtaacgtgtttggatggttcacataaaaataacaaaggattttggatgtgctttaatagagaagagagacgggaaaagttgcattggacttctcaaagaaatgataaaaagatgattgagttcatgtgcttttttcctattgatctcaaaggaattttgaatgctccttcattcaatcattaatcattcaatctttaccttctttcaggaagatggtccttaacgtttgttgttgtcaatttcttgcaaaacgatgtttcagggaatgtcgttccctcccatgtactctgtttaatatgcaataaaactttatgagttaaaaaaaagaatttggaatgctgcaatcctttgttaaaaagaacatatatagcgataattcatatgaattgctatcatttgaaattcccatgaattttcttcaaatcaaatgagccctcgaatctgcgtgggttcaacaaaaatagctataagaaattttataagaccaataagctttaaatagaatttgatttatataataaaacttattgttaatgttttcatgaatataattatatttcaaataaaatacatggtcgttccataaactttaactgggatgtaaatcggagagtggatctggaaatgccatattgcagtggagagacctaaatacaaaattctgaccatcataaagtgactatttatgatggaccacatgtgacatattaaatcaagattagggatttagttgtatattttataagtctatggatgtctcggtctaagtttatggattattaccgaaatttcttaaaaagtttccttttttactttatatttcttttccatcatctagcttattattgtccatctctcctgtcgaaatgaacaccaccgagaccgtgtttgttctttgatcttagaaactaatcctttccaggaggaaacgtcctgaaggttacaacccaaagcagctaattcatgcgctaccttattacagtttcgtgggcagtaattaatagagaaagaataaaaacagctagcaatcacatgcttgatctcaaggattactccacccatcactgataagttgaaagagttactctggagtgcattgcacagcatcagggaatctgtttccagttcaactcgcgccatacccttctcctttgccgttctgatagccacagcactgggatggaacgactggtgaccagtgatttagctggatcagttatataaagtttcggtttccctaaaaaaaaaaagaaactaatcccttccgcatgtaaaacgagcaccggcaacggccatcgctctatccaacatgtcagccagcgtatagcacgaatattgttcgcccatccaaaatcctcggaaaacccgccgtaatcccacgaatattccgtccacaaggctggaaccaggtataacaagcggaacgcctccagtgtcgcggacaggtgggtccatgtcccagcatcgcggaggtgtgtccctacatgtcagtgacgggtaggtgtcgctaccgtgtcgtggaaggtcattattggttgggatagcgtagcgtgcttggtaagggtgaggaaataatggcgtgacgaaaagaaaaaaaaaagcaggagtggagaggagaatccgccgctgcgccgtcttcttctccattgaagccaagctcccccaggccttctcgttctccccctcctcctcgagctctcgctggtgcggggagcgaagtggagaggagaggccgagagggacgagagatcgagagggagagggagcaccgaagcagcgggcggcagcatgcggccttcgctccgtaagtgtcccctcctctctctcctccccgatcgatccgccggttttctccgattcaccggaaacagatcgtctctctcttttggtcattttgccggccccttgggtgattttgcatttgcgattggttgtgaaatctttcgatctgttgcattcgaaaggcctggcacaagaatggcgcttcttcaggtgggttgtttgtcttcttgacacggagttagaggcaatggttgctgtttgttgaggcaagaaccgtgaaattatgcaaaagtgagctgtagtaaccaacgaacttgcttctgaattgcttagcggtagctcttacgacttaagttggtacggagtagtagactactactacgaacttacgagtgattctgtatctctgtgccagttgatccgatcaagttggtacggagtagtagactactactagtacttttccgggtgtgaatatttatttatttttggttatgactaggtgaaaggaatatagtaacatggagttgagatatcttctatatttagcgcagctgctcctacaagtggaattgtggattgatcggtctaactagaccaatatattagcaattgtttgccatggaactgagtaaatgatggcttggttaggcaaatttgaccaacattctgctatttttatactggagccctggaggcgggaaattcttatagagttgttagttgttatctaattttgtcatttgatatgtgctcctacattatctagtactaggttgagtttttgtgggataagggagtagagaacaacttaggtgtgacgtatgttgttccgaatgagtattagaaactttcagattcagtcccatgaattctaatcttggaacacagggggtgtttagatccatgggtgtaaagttttggcgtgtcacatcggatatacagacacacatttgaagtattaaacgtagtctaataacaaaacaaattacagattccgcttgtaaactgcgagacgaatttattaagcttaagtaatccgtcattagcaaatgtttactgtagcaccacattgtcaaatcatggagcaattaggcttaaaagattcgtctcgcaatttacacgcaatctgtgtaattagttatttttttcgtttatatttaatactccatgcatgtgtccaaacattcaatgtgacagggtaaaaaattttgccaggggatctaaacaggcccacaatgcaatagcatggaaattgacacaaaataaaaggcgatgatttttcttcttttggacaaaaaggaatctttccttttcctttgtccaaaaaagaaatctttcattggccgtattcatagcctggatgtgcacgtacaattgttcttagatatataatgaagaaacagaaaccagtgagagcagctcaataattttctagttcatcttatattctccatgtagcatccaacctgaaaaccatacgattactgcagcacttgtttccagcaatagaccatattcgtgagcagatgatgacatctttgcgctgtaagctatttttgtaggagtatttgtcttaaaaagttatatttggtaatgtgtctgaatctatccatttttaaccttgagttcaggtttctgcagtacacgatcccttaaaacaaaattaaatggttaacaatttaattactggtattcagaggactctgtgacttttgtacttatcactgatggtaaattgagaacacttaccttttcctggatagaatctctgctttgaccagataactttcttataacatgttaaggcatggtatcacatatacacattgaaaaatattcctgagataaccaaacatggttactaatgaaaagtttgggaattagttgaatttatagtcttattgtgttgacctttttaatatgtttgtatttgcattctgcacatgagcttggtcctgtatttatttgtcttgtcatcattggcaggtactatctattttcttcttttgctacttccacatgtggttttttctagaccactctttccactaccaagcaagagtaatggaatagagaagagacccttacaaacttttcgaccatataacattgctcaccgtggctcaaatggggaaattcctgaggaaacagctgctgcttacctggtacaactcagagatatgctacatgtactcctttttaaaagaagacaatggtggcggtgaatcagataccccacttcttccgcatccattttctatgaacttcctagttcttcaatattacttgatagtccttcaaaaatcaacatattgctatcttttgtttggtcttcacaatataacacaagaggtctaagatgactaaattttcacactatgtatacaagctaattttacaattataattgtgtgaacaatttcaattattcgtcgttacaaacatttgaatggtgcatatataaaaaaaagcattatttgttttgaacaatattaggccatgttgcttcatttttattcatagcagaagtataggcatttagtaatacaaaacacttcatgctattctatttgcatggaatgcaatagcctatgtttacgattgcaaatttattggatttgattccaatatgtttctatcctgcaatatttcaccattggaaaaagaataggaccatataaataatagagcactaaataatatttatctttcgcagagggctattgaagaaggtgcggattttatagaaacggacatccttgctagcaaagatggggccttgatctgctttcatgatgtaacactggatgctacaactgacgttgccagccgcaaggagttttccaatagaagaagaacctacgaggtggaatggttcaacgctactggctggtttgtaggtttgcacattacaaccaaacctaattccatccctcgttcttgtaaatgtttgcagcatcaaaagtcagaaataggaactaattgtgcatgccatttgattatttcttgagaccttagcttgaacttattacagttgaaagtagtgcatgcaagattttcttaaaatcattacctgtagtgttatgcctgcattagcaactggtattgtgccattttcagataatgccataaactatctggtgtttgctactccctccattttaaaattacttgtcgttttaggcttttagctttgtcctaagtcaaacatttgtatctttgatcatcaatttctaaaaatttgtaagtttaacatcgtaagatttgtgtttttagatccaccatgagaaatattttcatatataatttatttgttgttaaactagttgaatttctaaaatttgatggtcaaagatagaagtgtttgacttaggacaaagttagaatgacaactagggagtagcatgattggcataggaaacatgtatatcatcttatctttgtgattcacaagggagaatatatccatatttatttcttccacttactttttctccctttattttatgtttgtcatatcctttcctttttctaaattagttaaaggttatactggttgatatatgtttttaaactgcatattgctagggtgggactgatgaggatgataaacctgtgaagctatatctttttgattattcatcctaaatatacatgtgttgatatgcagtggacttcacacttgaggaacttaaaacactgaaagtcaatcagcgatacccattcagagaccaacaatacaatggtatgcggtcatataccctttgagtatcttttttcttttgtatctctttgtattatcatgattgtcagacacaatatcattactctcttctataggtcatgttgttataattttaaagatcattcacgtgcattctttttattgataatgcgatactgctgggcttcatctttaccagtctttctacagatgtggaagttaactgccaatgtttgtaagagtgcacattctggtggcatataattgtgaataaaggattaacactattttttttctatctgatggtgcaggcaagttttcaattatcacatttgaagaattcatttctattgccttggatgcaagcagaactgtcggaatatacccagagatgaaagatccagtttttatcaacaagcatgtaaggtcccccatcctcaagaagcaacatttaaaattcacatcattgtcaagtgttttccagcacaaatttgtgcttacatgttatgcagaaattttctgtgaaatgattttaatatgtctagctgcatacctttgcaggttaatcaaataattataatatgaatcatgtggactttaatgtattgctttgaatttcatgttttagttctgttatttttaagagaataggtaattgcattacccggctttgcaagaaaaccaaaggaacaaacatagtgttttacacatgaacagcaaaagaaaacatgttttagttctgtcaagaatttctttttgtcataaatcttgagttaatatttaatgctatttttctgtctgcaagaatatatattgcatgtgaataatgacgcagcagcagctgatatgccttttacctcaaaatactttaatttggtttagataaggtttacaattcacaaaaaaaaactttattcataacaaatttccagtttcggatgtgccataagtgaggaattttgtattctactcttgataggtcaagtgggatggtgggaagaagtttgaggacaaatttgtggataccttactgaagtatggatataaaggccaatatatgtcagaaaattggctgaagcagccgttgtttatacaatcttttgctcctacttcccttgtacatgcatcaaagttgacagactctcccaagatattcctgattgacgatttctcagtgagaacacaagatacaaaccaggtactaatcttgttaataaaatgtttcatatccattgacttctttctttattctggaaaaggttgatatccattggtttcaatgttacaaaaatataatgaatctggctggataatctacatctgaatgcatataacatatgtttttttctgatgcagtcatactgggacatcacttctgatgactacctagcatatattagtaactatgttgttggccttggtccatggaaagatacggttgttccagcagccaaaaactatacgatggcaccgactgatcttgttgcaagagcacatgctcataatcttcaggtatggtatttgtttatattctttacagttacctggaatagcatgtttccatgagctattgcctacttgtgatataatccgtacaagatgcgataagttttatgcattaatttccatacttcagggttcataacaccttcagcatattttatgtttaaatctattacggttgatttgaataacgagaagaatggaaacattatcgtcattgtccactttttggtctcatgtgtcatgcaatgagtattgcacattgagtaactgaatgatttgaacaaaatgcatagcatgtctttaaatttcacatgactctttgtacatcattaaggtgcattaactttctgctgtannnnnnnnnnnnnnnnnnnnnnnnnnnnnnnnnttatgttgccttttgttggcccataacatgcatacttcatgacaaaattggcaggtaattttgtatctagataattaaactcttgctgtcattgcaggtacacccgtacacatacaggaacgagaaccaattcctgcacctcaacttccatcaggacccttatgctgagtatgatttctggataaacagcatgggggtcgatggattgttcactgatttcactggatccctgcaccgttaccaggaactggtagctccacatgcgaaggatgaaactgcaaacagcctcctagtaaaaattgctcaaatgatctcccaatatgaaggtttctgatcatgttttccatttttccgttaatcgacatgcttatatacacgcattagtgatcaagggtgaccttgaatgttacagaacaaaaaaaaaaagaaaaaaatacttgttttctggtggctagcagttagaacggattgtagacacctctataactataaatccctgaattgcggggagaaatttctacagttgtaataattgtctttaaaacagttgtatctgattagttccttgaaacaaagttcattgatgggtacattgagatggagctgtttggacaagttgtcaggaactcaggatgtgtgcatacctaccagtgcagatgtgaaaagcaacaacaggaagttggaattggtattgagagttgaaatgcaaactggaaatcagtaatgacagtgaacacagctgacctctgctataataaatagtcgtctccggtctgccacttgtgcagtggcggagaccggagtgatcaggcagccgatgtgtggtcggtagtcgcatttcaagtccctttctgttctcactggaagggaaccaagtcttctccttttgataactggtacaactcaccaatctcaatgcagatggtagtgagtaaagaagagccatgaaggataaggcattcagctaaagcttttgaagggaagatttcaggccacacaacttgagcagaggaaggatggaagcggcggcggctgcctccaccggcgaacttttgacaggtaaccgcagctctacccactcctgtcctctgtcaaaagctacgagaatgccatgatgcaacactttgatcttcttcgttgtgacccgggtcagtttgatagtactagattagtagattgtgctgtgagctccagtgttaggtgataagatttctgagaattttttttattagtatcttgaattggtcatctaatcaacttctagagaaggaatatgttcatggcaatagaatattgagttctagggacgacgactttgaaggataacgtgccaagtgcagccaatatttcttttctttctcacaccccctttgaccaggacaatctagctaaacaaaaccaatatgctccagtcctgcagttcaagtagaacatgactgcataaactacatgtcttggaatttggaacagcaaccactaactaaagttcagtcctagagtctttaccaaactactactactactactactactaaaaactcttactgaaaaatatcatgggtacacacctcacggtataatagtaaatactgaaatatcttggaaaaagcttgctcttttctccccaactttagcaccggcgccccatgcatcagtctatctttgaatcgaacaaccttttgaaaagaaaaaaaaaatcaactcccatgtcttcttttattatttttgataacgacttccatatcaaatgctcccgagcttttccaccaacagtcaaaagcgtcttgctgttacagttgctgctactactccttcagttcagtcgcctgcactgcctaccactaccgaaatcttgcaattttcagtgtcaaaagcttgttccctccaatacaggcaaaataatttcagtgtcaaaagcttgttccttccaatacaggcaaaagttcagcgcctctaccccacaagaggcgatcgcgagacactacgctctgctgctgcgcgcatcgccagcagaaaatcgcagcatttgcaggctctcgcatcattttcagtcgccacgtgatccaggtaaagtcgtcagtctcactgcggctaccggccgccggccggtgaaccaccgtagcggtcagcgtgggggctcatcgatctcaccggcgaactgcttggtttttgtgtgtgtgtgcgtgtgtgtttcaggtggtggtcgtctgcgcggctcggcggaggagggcggacatccagtcggagacgtacgtgctgatggagccaggggaggaggaggagttcgtgagcaaggaggagctggagggcaggctgagggggtggctggagcggtggcccggcggcgagctgccgccggacctcgcgaggttcgacaccgtcgacgacgccgtgtcgtacctcgtccggtccgtctgcgagctggagatcgacggcgaggtcggctccgtgcagtggtaccaggttcagctggagtagagtggttcttgtgtggaatggaatgaacgcgcgatcgacgtggagtgatagtttatacacgtacgtagtaatcttcaacgcgacaccatttatctttttcagatttagaattctacggaaccgatactctactctgaaaagtaagaattttacagagactaaaattcaacccgtgcgaaattcctgtagaattcattcgtccagaaaaaaaaaggggcacattgtgtcattgtccctcgtagcgtaaatgatgtccctcgtcgttctctcgtgtcacaattcttttctgtttacttcatataatctgctctacgtttctagaaatatgttttcttatactccctctattactatataattatcaccatcgattaaaaattgttgtaattttgacctttagtaatttttaaatgtttagattataacgaacgaaacttaaatacttatgtttaatatgtacccgatacacttcaataagggagcatctatttatcagtttagaaagtattttaaaaagataaatagtcaaaatttcaatataatacttcgataagtttcttggagcactttcaacttgctctgagttagggtgtgtttagttcatattaaaattagaagtttgattgaaaatggaatgatgtgacggaaaaactgaaagtttatgtgtatgaaagtttcgatgtgatgaaaaatttgaaagtttgaagaaaaagttgggaactaaaccaggtcttagtactaatttgctaaatttattttttatatttaatttattttataaacgataaataatctaggataatcatccgtttgaaaagctagtttggtttatacacctgcagtctacagaaagtctagccatgctaaaagcagtcacggtcagccgtcagcgcaagccaagtgctgtaccctgtacgaaagcacgctctcctctctcccgtctcaccattccacaggtcgccgcaacccgcaacaaacgagctgcagtgcagtgcaactgtggaaggctgcaactgcaagaaaaaaggggaaaaaaaaaagaaagaaagaacggaagagaaggccgccggccgtcagaacaggaacgggaacggaacggtcagcggccctttcaacgggagaccccggcagcacggcatccgttcccgttcccttttattcagtcccgtcctttccattgaccgtccacatcctcccccctcctccacccgctgccacaccatccgtcgccgtcgccgtcgccccgctcgccctcgggttgacttgactcctcctcctcctcgtcctctctctgtagttgtacatacacctccccgccctccgcctcaccactccatttccgtcttcttcctcctctctatctctctcctcttggatttgtcaggttctttaccacggcggtttgatcggatccccaatcctgggttccggtggctctcgagcacagcggcggtcgggaccggcgaagaagcggcttttcgctgcggagggagtgcggtgagtcgtcttctcctccctttactgctcttgcttagtagtataggggggcttcagggcttaacaccttttttggtatgtgtatttctgtgtttgttaatttctggcccggttagaactggagctctgatgatggaggtgggctgtttctggcatgagttttttttttcgttctgagagcttgatgtgttagatgatgagctgggtttaaaaatttcttgggagtatgagatttcttgattggagataggcaaaaacgtgcaaagaatggtggaggtgtttctttttgttattgtttttgggcctaatcgagtaattactgaactatggaagaactaagtctgtgtaatagccatcgagtaaaaaaaatactgtaatatatataaaaagtaatcttttgtggacaaaaattgaaaaaaaggcgattgcgacttgattttatggtaacctcaactcttatggagatttaagaagttgttttgtaataaatatagtactaattgcatctgtatttgttgttcaattggaacagctgaacaagttctatcaaataagtttttactctttgaagttgtttggttttggtgtaagaagtggcaagatgtgctcttactatgagccttcgtggtatcttatctaatcaaatccagctagataatacatgttcagacattcaacatatgtactggagcttatttattccacaatccaagatatatataccggaacttttctattgtctttttttctacaaaatcaaagaaaaaggagaattggctgggtaatgaaaagctttgggaaaaggagaatcgatcttcaaccatgatgtgacttccacagtgtaattctttctgtttccacgtttgcttgcatattgttatgcttaattttttgaaactcatgtttcattttcatgactttattttatacttgcatctcaaattctcaagatattcttgtgagtcgtgaatcattgctgtattcatctttgaacgttagcttttctgtatttccaaactccaaagtggaatgatgttgacttgctcttttgtttgaacatgtgaagcagggaagaaaatcacctccactgattttatagaagacgttgaatatatagtctacaaaatgatggctgctgagttaattaagcagttttcaaacatcaccctgtgagaagaacaggagttatgtgatattgagcatgcactcaaggcactgcggaagaagattcttactttggattttgaaaattccatgcgtgttcatgatccgcaaaactcatttcagtacttggaagtgctgtacaaaattcggcagctgactgaaaggttagggagcttacaccctgttggggaagccaaagagcataatgagctcatagtatatgctggcgacctttttgatatggcaatggcaaggcttgaagaggaatttgtttatcttcttacgcattacaaacaaccaatagaacaaggacttgtttctttccggtctacagaggatggcagtgtggatgatttttcaagcagctcattcaatgaggaacaatgtgacggtaagacaacacagactgaaactactggaggatcagaatattttgcgactgatttgattcaacatggtgcactctctgctgtcaagtccattgccaacttcatgtttctgagtgaatatgataaggagtgttcccaggcttacataagcacacgacagagtgcagtagatgagaaccttgggtctcttcgtattgacaagctcagcatggaagaacttttgagcaccaactggaccaagttaagttcattgataaagaggtggaatcgtgcaatgaaggtctttgtccaagtctaccttacaagtgagaagcgccttagcaatcatgtctttggtgaactttcagaatcaaccgcagacttgtgtttttatgagatttcattgagctcagtcatgcaacttctgaccttttatgaatctgtagcaattggacctcctaaaccagaaaagcttttccgtctgcttgatatgtatgaggtcttaaatgatttactccctgaagtagaattcttgtttcaagaaggatgtgatgatatagttttgactgaatataatgaagtcctgctacagctgggagaatcagtaagaaaaacaattacagaattcaagtatgctgtccagtcctacacttcatccaatgcaatggcccgtggtgaagtgcatccccttacaaagtatgttatgaactatataaaagctctcacagcttatagcaaaactcttgattcgcttctaaaggacacagatcgaagatgccagcatttctccactgacattcagtctatggcaaaccaatgtcctcattttactgtcagtgcattgcatttgcagtcagttactgcaattctagaagaaaatcttgaagctgggtccagattatatagagatgatcgattacgaaacatctttatgatgaacaacatctactacatggtccagaaagtgaaaaactcagagcttaaaatctttcttggtgatgactggatccgggtgcacaatcggaagtttcagcagcaagcgatgagctacgagagggcatcgtggagtcatgttctctcttttctgagtgatgatggcttgtgtgctgctggggatggtgcttctcgtaaaatcattaaagagaaattcaaaaatttcaatctgtcatttgaagatgcttatcgaactcaaacaggatggtctatcccagatgaccaactccgtgaagatgtcaggatttcgatatccctgaaaattatacaggcctatcgtactttcacgggacgatactatagccgccttgatggcactaggcacctagagcgatacataaagtataagcctgaggatttggagaaacttttgctcgatctttttgaaggagctcaaaaaacattgtagcttgcagagtgtagaacttaaaacacagttattcttgatgaaatgtgcagttgtaatatttggtttgtattaagtaaaatggtatagttggtgattatttttatatgctgttttcctgaagttaaccagttcaattttccctgctgcttgaagtatttcataactatctgaattacagaggatgattatgccttagtaatctaatatggagttttttttttgctacaactgttcttttaacaatcttataagcaaatgtgtaattttctgaacattagtgtgctgctgctgacccggtgatcagattgtatgcactcttcactgtacctgtccagaattaaacgtttgaatcattcaaatgataaatggcatcacagttcttacaatagcttttaaaaacagaaacagtcaagctcctatccacctatatttttgcagcagccatgctttgtcctaaaaaaatgaacccttttaagtaattttattcctggatcatggttgaattactttgcaattagacaagaaaagaagaagaaaaaaaatgttaaggaatcaagaacaaaccccatacacctatggccacctctaccaaaattcaggcctgcatgggatcttattctagccgggcgggtcagccggcgcgcttctcgtcgatgtccttcttgaggtcggagggcggcaggaagtagtcggtggtgagaccgtacaggttgaagtcggcctcctccaccgtccacgtctcctccagcttccgcttgtggttgacggagccctcgccgtagcggaagagcgtgacggcggtgtggccgccgtgggcgatgttgatgccatcgatgtggcggtagtcggagatggtggactccatggtggtctcccagaagatgttctcgctgcggcgggcgcccttgccggacttcatgcggaggaggtgcgagtcctccaactggatgagcaggcccgtgcgctggctgaagtagccccacaccgtgtggtggatgatgtcgaacgccgccgcgctccgggcgcgcagcgtcgccgcgctcgcctccagcttcaggatgaagcactcctccccggtgatgatcttctcgccgatgcacaccgcgtcggagaacaggttcgcgattcgacctcgggtccagcccctgcatcgtgatatcgaagctcgttgagagggagggaagcggcggcgcggcggcgagcaaagtgcgatcgacctggagggagcggcggagggggcggggagggcccgggaggcgtgggagttctcggcggcggactggcgccaggcgaccttgccgtcgctgccggcgctcatcttgtggccggccatgatgagctcgaagtaccagacctcggggcacttctgccagagcacgaacccgccgacctcggcgcggccctgcgcggcggtcacgttctggtcgccgaggtggaactccgacgcgcacatccgcacctttcccacggcgtacatgctctgcagcccctgcaacgccgcctgcccgcccgtcgccgcgatgtactgctgcatgatgtacttggccgtcgacgcttgctgaccacacacgcgcgcacacacacgaggagggggatgaacgcgtcaagacccacccggcagcggagcatgcatggacgcgcgcgcgcgcgacgcgggcaggggagcggtggcttacgatggaggagtcgcggatggagcggctgaaggcgcggtcgtgggggacggggcaggggatgagcggcgagccgacgacgttgaggaagagctggagctcggcggttgcgttggcggggccgccgacggtggcgcggtcgaacgcctggttcttgagccacgcgcgcatgttggcgccgccggcgccgcggcgcttgtcggtgcctggcgcgttgatgagcatctcatcggggatgggcacctccagcacggtgtccagcgagtcgtcgcggtccaggttcgggcacagcttcctcatcgcacgcacgcccaccaccgccacgccgcgccgcgcatcaacgccgatctcgccacgaagagaacacccgcgcgcgcagccgccagagctctcgcccaaacaacgcgcgcaagacgcacacagatcaagagagggagagagaaacgaggggagagaaagagcgagaagagaggccggggacgtggagaagaagaagaagcatgcggccatgcatagcattgggagcgaggaataagtggatcgcggcgagtccggaggtggctcgtgctctcgacacgcggagctcggacatggcgacccggcagcgacgacgcggggtttccccacgctttcatcgcgcgaaaaacaccagcagacgagtacacgacttgggttcatgggccggtccagcaaaaaaaagcccactaactttctgctcgggagtggttcggcccaacttgtgccctgaaattgggctggaccaaatctgctcgaacctagttagtatgatctctccttttgaaatgatttcactgtaatttcaaggcatttacttgagtactgagtaggaaattcaataatatcagtgagaatgtgctgacactagcacgataacatactaaacatgccatgatgcaaacggccagttcactgggcactggtacaacaggtgtaaacacccaggacctgcagttctggtaaagaaaaagaacaggccgcgacaagctccaaagcagaaaaggaaagccaaatctccattctcccacagtatgctgcttcagttcacgttactttccggccaaattactacgccaaaagaaaattagagagcagcatggaggcaatgcacgtgaggagaagatgacgtccaagggacggggacggtgcttcgctgctgtcaggattcaaggcgctagtcgtcggcccagacgcgccgccgccgatcggcgtagcgaaggtccctcccatgatcggcgtacccgtggctgcagttgaagagcccggggaagaagtgctcgtgctcgtgctcgtgcttgtaccggtgcctgtgcctgcacccgccgtgccggttccggtgcttgtccctgcagcactgcacaagaacatgtgaaaaggaaaatgcttcagttcatgaatcatgggttcatcttccaagcacagatgctaattttattcagtttgagtttggccattgaaagttgaaggttaatcaccttgcggttgcagggtatttgcaggttcctgagcctgcacaacataaacagaataatatcgtgttaagtaaacacatcgaagatcaaaggtactagcagagttgaggtgagaaacgtactggggtcggtggaggagagggtggcggcgccgccgaagtcgcaggtggcgcccttggcctgggaattccgctggaagtagctgttggcggcgtaggagcagtgcgccgccacgttgtttgggctgtagcacgacccgctcggcgtcaccggggcgcagtccgcgccgtgcccgcacgcgtagtccagcgccttctgcagcgccgcctccgccacgttcggcctgcacacgcaccacgccccctttgcacaccgcacgcgcgcgtcgtgtgagctcggcccgtgacaacgatatacccgctacgtagctagccatttcgatcgctcactcacctgatcctttcagcgacatgccgagcaagagcagcagcagcagcagaagccgagtcgccattgctcctctgctcaccacgcgtgtacgttctgcacttctgcctctgcccctagctcggcgaatcgtcgatgctgctggtttgggtgtaactgcgctgctggttgtaggagtagttggctagcttctcattctctttatttattggcgaaaacggcaagtcaccactcaccgacgggctggtccgattctatcgcgctttccgaccattccgcgagctgtcgcctttgcgcgtagctgctgccccggccgcgcgacgaacggcgctgtttaggccgggtttgcgagccggcgtcgcccaaagtaaaggcatgcaattgcaaagtcgcgagctgcaaagccgtcacctgtgtgctgtgccgtgctctggcagctttgctgtacttgtgttcttcgtggtggacagtgagtggtagtgcttaccagataatcttgagctttttcccccctcctttttttttttcgaaaagcaaagttatgtatacacacagtatggtatatagtagcacattcttttgaagaaaaaggaaaaggttagggagttaacatgtatcctgcacatgctgggataaattgaacgtccgcgtgtgatgtctgtcaatcatcactcatcagctgttctatctgtattttcagctcaggctgctttgcactactacattcggggactgctaatttccagcagatgcacaaagtgacaaaaccaagatcgagaaattgatggaggaacactaattggtttatcagttctcaaccaagtcagaactcagaagtcaccaggcctgttcatgtggcaaatatctccaacataagaatcatgtacttccttcgtcccataatgttgcaacctaagatgggatgagacccatcctagaactacgaatctggacatgtctccataatgttgcaacctaggatgggatgagtctcatcccattctaggttgcaacattatgggacggagggagtagtatattgtaacacatgaaaaatctcttcccccttgttctagattatctaattccacaacaaacaaacgcacacaattgcttgcactttcactttgttaagttaaagcccgatgatattctgtaaactccagaattgtatcaattttaacttcataaacatgatcaacgaatcgacgaatgaaaaattaccaagggctaggtgactaaaagcagaatttattataaggttctcaagagcgaaggccagagcacaagaatgctcatagcagtacaagacttaggttggatcatatgcagcataacaacacaatcctgattgcttgaacattcaacatccaggacacacataataacacaaatccttaaacgagcaaccaactgggcacacctcagcttattctgtggaccatggacgacaaacctgtgcctagaacaactaccttaagcaggaggcttcatcagtgaagccaccttctgggaagacggccttgccatcaggtcagtccaccaggccttcacatgcgggtatgcgtccaacacggatgcgtggggagtagcccccaagcatacagtgccagccacatggcttaggtccgcgacactgatgtagtctcca

SEQ ID NO: 63999 - DNA, 45511 bp, Oryza sativa
  unsure (1)..(45511): unsure at all n locations
ccccacgacctcacctcctcatcaaacacccccacacgcacgcggctgcggcggcggcggcggcgagcagaagaggaaacaaacagctcaccacgtcgtcgcgatccaatccaatcccaactctcctcagctccagacaagcccggtctttatacactcccctatgattaccaccacctcacccaaaaaaaaaaattaaaaaattaaaattccaacctttccttttcctcctctcctccagctggagagcaagtacaggacgacggcctttacgctgctgctcgaagcttaatcaactaatccgccggagcattccaattaaattaagccaagaacacagtccctccctcgctctcgggatcgggggccaattggcgactcgatatgcttcggcttcttggcgggtaactacgactacggctccatttaagcaagctgataaacgcggcttaatcaaagattcaaggagagcagggaagcaggcagcgagtgcaacgggacacgtgaggtgcgggctagcacgtcggggggaggctgattgattcgttgcgtggagccgagccggccgggcgctgtcggtggcgaccggattggttggggtccccgcgggggttggtctcgttactgctctgccaccacgttgccccgcccccttgctgctgctcaccaccattgctcatcctaccacaggctaccacttcatcatcaagattttagcacagctactgctactcatttgatttactagtttagtactgtagtttgttttcgttgatccaaatcaactctgtttctttcagcaatgcaaatcagtgttcagtgaatggattggatgatcaccgaattttacagcgcatcatcggtcataattgatgcaagcagagtgattctaacagatagagagcaaaattgcaggcaaattaaagccagtgaaccagtgacttctgagaatgttcttcaggttttttttttttctgttgcaaaccggacagtggttaatactgtagtatgttctcccctacataacgatactaacaaacgttaaaaaaaatgttggaaaaaagaaccaacttgggaaatctgacgtgcccaccacacacactgctccaaccgtttactagccagcacttataccgacaccaaaacacgtagtaggaggcacagtacaagtggattattactcgcatcatcagtggtgcgtgcagcaatgtgacgtttttagaatgtgatttcttccagctgccatctgtctgaatctatagggttgtactactcagtacataagcattttctctgttctaaaacgaaacgacctaatattataaatccgaatacaatatagcagtttagtattgtattagaaacaacgtagcactacgaatctggacataatatagcaacgtaccatattagacaccccataatactatgatatatgtccagattcaaagtactacgttgtgttctagtacaatgaatatagacacaatatagctagctagtactcgattagacataatatgtccaaattcgtagtaggctacatctaattcattattaagttgctatattttaaaacggatagagtatgtttcaaggccccagaaataattggcataataattaatgaggtagagatagaaggtaacaaaataaggaaaggaaatgccaaacttacataaaaatatcatgaaatgaaatgccaagcttttgacaggaaaggcaaaaaaataataataaatgtataaatatatgtaatgtagaataactcaggaaaggaaatgccaagcttttgataggaaaggcaaaacaattaataaatgtaaaaatatatgtaaggtaaaattttcagaaaaggaaatgcctaactttttacagaaaggcaaacaaaacaggacagaaagctgaagctggtaagacaacagaaaactccccaaattaacttttcataatatatatatagacagagatggaagtataaaaaaaattatgtgaggtctggtccgagcagaagaggaataacaatctgaagagatccagtcagaagaaaacaagatcaaacaaaggatccgccccgtacttgtttttcagcgaaattatttgagagagaagaagcactggaggggagattagatctagctatgctggccagtggccacttgggtttgcttggagattgcatgattatatatgatcaaaatggttaaggaatttatagaagatatatagtgggatcatgtttggtaggatatatgtgcaaaaaacatcgccttttttagtcaaacttagattgcacattgctggattcatgtggcacggttactgaatgtttgaggccttccatatattgtatactacagcttacagactgcgtgtagacttcatattccctatgcaaattaagcagataagtttttttttcacctttttcagaacaatccattgtctgctccttcagagctgttgctagacacctgcagttacgtagaagtcaaaagattaatactgtccaaaaaagaaatgttttcaatacagaaagctatgctcttctggttgccaaagtcatattcttatagtattatgtttgtagtattattttttaaaaaaaaaaactgaccctgcaaaactcaaaataactttcaagaaacacattctgctgtcttgctgagaagcagtggacacacattctattcttgctatcaaactcgtatggctgcatcattctctctctctctcttctgaagaaagcattgtcaggacggaacatctgaagaaaggaggaagcagagaccacccatgaaagacagaacacatgatcagaacccaaagccaatatagaaacaaaccaagatcagatctgaaactgctcaacttgcctcaggtagggacaagtttcgtttgcatgccccatttacgacatccatccatgataactgatgaaagagaaaaaaaataagaaaagaaaagggcaattggcaatgccaatcgaatctctacgcaggctacagaacctggcaagcttgcgctgttagttactccttcctaagctgcacttgctaattactgatactagtaagcaatttgcttctactgaagtggtgtgatggcccccctctcttttcagtatttctgtttgttgatgcatcaagttggccgttgtgacatgtactgcactgacatggctgaaatggaatacgatggcaagaggcaatttcctaccccgcgttgcatctgagtaactggggcgaatgtttgttgtgtttctcatatggagtgctattaataaagattcagtaaatccccatttactaccatcatgtcaccattgggtcagtaaatcctgagaaataatgctgatcgtaccatgctaccgcatcatcggttgtactagagtatatgcccacgcgattcacatgaagattaaaaataacctcattgattaacccttctcatttctcaagatatccaggtgtggtctcccctcttctttagctatttcttcagagttcagagttcaggttgtagggtagatcttttttccccactctatctatcacatggtgattaaagataaccttgattaacccttctcatttctcaagatattaacttctttgatggcttggtttgctcacttcactgacagatccagcgttgagcatctcagagatggcaagaacacacgcatcgcatcgaatcacacaggagggcagcgtcgtcagattcagatgtgctcacgttcaatgctgctgcctgctgtaccttagcttggatgcagcgatgcaggcagcgagggtccagccattattaactcctattgctacaatactactggtagtaccacgcacgagtaggagaatcataagctactacgatgctgcttgttatttaatttaatccgttcttgtgctgccattgccggggaggacgtaaggaatcattccaatctgcatctcgatcgatccatcacccatgccgccttgctctgattgattcctccttttcaatccgtgcaatgcaatagtagcattacttacacgctgcacaagcatgaaaaggctgtagtttttcgtgtggaaatttaccgggagtagttcagttcctacgaaaatactctaaaattcctccaaaagggagtcttaaatttcaggttatcagatctcgatggttttagatgtgccgtataagtaagtctgtcgctgccaacctgatgatatactacaggctgcctgacagccgacattgtcattcagtctgtcaaccagcaaaataattcgctgcacaaccgggcaacggaaacttcactgcaataggagtcctaaattagtatactagccacagtgtgttcatcccaagaatcggggagtgttgttgctgcgccacgaatgactaacagctgattgtttatgtgttaatcgtggcgatttgtaagttggtcgcagacttgcgtatcgtgatgagaggcgagcatgggaaaaaggatggaattaacaaatcgatcgcatcgttgtaacggcaaatccagcaggagctccagcatgatcagcgtacgtgcttttgagttcaggcgcacatctttatgtaaataatttgcattaggtcgctcatcaatgtcattcgtgctagtagtatttgtttgagtttgactaaacttcaggttttgttttagacgcagacgaccactaatgattttccgtcgtggggtgcactaatagaacgtctgaacgttttctgcgtgcttagacgagttcacattgaccatcaatttagtactaaaaaattagcagaatatttagcagggtttgtactacttaactacttattgaaatagagttttatttgctataaatctttcgtattgatctgtaaagacaaaataacatagttgtaacagcgtcctaataaatacttcctaatcaatttacccaaagtaggtgggaatgaaatgggaagcttggcaaagggtaatcaatttcatgaacaatcattttctgatataatgaaacagacatcctcattaatcttcagttgaaacagacatcctgaaacatggacccgacactgagaaatttggcacggccttacttataacataacggtatttaagccaataagacgaatcaaatgaatatcaaaccatctacgttaactttgcttccacttcgcacaacagcaagaggttaccagggcgcccccatcattttttacacaaccactttacaagtcgaagaagcaacagaggcaagaagatggaaaacacagtggaggattcagctcagcagcggcttccaaaactgccgctgctcacaataccacatgcacacacaactagacacaaaggcttcccctttcaatccgagaggggggcaatgccgaaagcaatacagctaaagtgattatctttataagagaggtaactgtcagcctacagttagctctgtattatctatcagaggtgaaactaatctccatcaagttatgaggaaacgccacagcttcttcgctgaagatgttttctcttcctcttcctcttcatcttcctcgtcagagtcattgttgtcctcaggtccatctacattagatgtttcagttgcagactgcaaatcgaaaacagaatatagtaagttcaatggaccaaggcacatactaaaagcatatgatgagaatagtgcagctgcagctgaaagaggaattaccactgtagcctccaccgaaggttcctcttggacagaatctgaattatccactattccgttcacgtaaggcacatcaacagatgaagctggttctcctggttttgtaaggttctctggccctttatcgccgtattcatgttccttgcaggtgttggataaaccaagtggggcttcatcatgttcattcttggagcatttctcttctagagctgacaggctgtcaatatcagattgttagtgaagggcatgaagaaacattaaattaaaatagtcacgctgctttcaaaagttcagatagtagtgtaaaaacaaatcataccagttggaagtgatttcccctccattaactttctgaatagtactccttctgtgctttcgttttggctctaaaacttcagtttggtcacaagaaaccaaatgattaagcctcttttgaccaacttttgcaaagtccaaattcacatcttcaacatccacagagtctccaactttctttggcacaccattctggacaaattgatcatggctagcgctcttctctggagaccgtttgaatatcacctgagcacattttcgaacccaagaaatcggtgttgagactggagaaaggtctagtttccttccaaaacgttgctttggtgaagaatgggagttatcatgatgattgtctttcacatttatatcacttccaagctttgacttatcatgttgtaacaaagacagttgcttattttcagaatcaattttcagttcttccaacacattaagttgttgaatttgcactgtaattgcttctcggtctgaatgtaatagttttctttgctcttgcagcttctcccgttgattattcaaggcttcaatagtgccttttatctcagacaactcttgctctctcctctcacgttccaaagtagcttcttttctctcatccttaagtttctgcaattcaactgcaacatgttctaattttgtgttgatcatctccttctgagaattgatgtgttcgagttccttggcctttttctgctcaaactcttcctccctttccctcaaataagaatctatttccatctgccttgccttagcagaatttagcaattccaccctctggatatcaatgtctctcttcagatcttgcctttcttgttgaatcttactcagccaacttgcatgttcttgctgcatcttactcatgaactctttgtgttcacgagagagtgtttctgaattacttttgaactgaacacggagattatccttctcctgtttgatgatatcagattcattcttcagatactcagttattgctcttcgttcttcagcaattctgatcgcttccttttgtagctcctctttcttttcatcaatcagctcccattcaatctcaaacctttccttttcggcttgcagcctatctgcatcagccatgagttcccttttttgggctctgaggctgtcaatttcttctttaagtttcatctgcagagtaagcaactcatctctatctgcttgtgttattgctagatcttgttgggcttgaattgcttcccgtttctcctcttcaaagaaagccttttccttctccaaatccgatttaatcctttgtatttcttccctttctttttgaagttcattgtgtatggcttctctgtgtaacaagagcttttcctcctcctctttcaactcatctgatctccctgccaacgccttttccttgcttgctaattcagctagctgaaggtcaagattctgggatctttgcacaaccacagattcctgctcactgagagcacattctctctgatgcagcgcatttcttgtcacctccattgctgcatcaaaagacatttgtttgtttgccatctcagattcaaaatcatgttttctcctctccaaggctatagcttgttcctgattcaacctttcaatctcggcctgcagcagaaattcaagatgatttacaagaggttaagtcacaacacacattgtcaatagtgaaattggagaatcttacccgttctttacttgcgattgtctcttgcaaaattaataattcactctcccttttgtcaagcagggattccttctgaatcagagcctgcaaaagagatcaattttgttagacagaactttcgcaatgatatataggtggtaataaaaggagaaaaatatacatacttcctctcttgaaactattgcctccattttcagctccaacttatatttttcctctaacaaaaccttccgttcagcttcaagaatattcttttcttcttccactcttttctctgagtgagtaacataagctaatctctcaaggatgttctcgtccctctgattgagtagagcttgttcctttagtaatacttcctccttttcatgcaaaattttcttcatatcgttcaacgatttcctctggaggctaatttccttctctttggcctcattcctgcattagcatgcctgatttagggaaaaggaataaaagatgcccactaaactatgcaagaatatcttacaaagtacacagttgactaaaaaaattaaaagcattttgacagtgatttactgaactgaattaagctatactatataagaaagacgatttaattgaaaaggtggaacatagaacactcactcgagctcacaagaaattcggtctcttctaagctgatcttcgcgatcatcgatgtcatgtaaacttctcagtgctgcattatgagtccgtatggactctgcctccaaagattttgctagaagaagcttctcttctgcctcatcaaatttcttgtgtgcagcctccatcaattgaagagcttcagccaatttcgattcatatgaaacctttgtttcagctgtttccccacgcatatcatgcaatgctttttcaagctaccagaaaaaattgaataagggccacattatcattatatatgaattggataaaaaaattaaatctcagaatgtctcatgtacagtgaatttttcttttgttctcatagacataaataataaattttgcttctgagctattatttgggataaaaacttacattagcaacacactccttttggatgcctaaactctttttcaggttttcttccttcttccttgcttcagctaaagcagactgctgggctgcacgttcacgcttgtgcataatctcagcagattccgaagcagctctaagttgctcatgcttggatgttaactccttccgctccatcaaaacaagaccaagattgtgttggtattgataaatctacaacaaaacaagcaaagaataagataaagcagatattttatttaccattcttctgcagagcaaaacgtgtaaatttgcctttagttacaacatgtgcaataggtcctaaatatgatagcttatgacaatgtaggtatttaacatttgggcatacatccgatggtgaataggaaagaagtaaataatagactaactggtttactgatgtgcagactttactattgatacaaattgcatacagatcaatgaatggtttcggcaaataccaatgtaataatagccatggcatcttccaacattaatcgtatgctaccgcaatgcataaagcaatctactatttcaatccagacaagctaacccagaatacatatgtatagttgcaacagtagaaaccccaaagcgaaagaaatagataaataagttgaatgtaaaaatgtaaaaaaaaaaataaaagaagcaaacttatacaattacagttcagccactaactaatccaagcaagctaaactaaatgacaaacattccaagataacgattctaaacaccaacgcaaaaaaaatagcttcttgaatcattaataaacccatccagcatgtcagctgtacctaagaaacaaagaactgagcaaccaccaaaatcccaaaatgatttttcttctttcccgataactcatagcgcaccaaactcgacattagtcacacaagaacccacgcagcgaatgattccaagaggaagacttcatcgacgttccgccgattcttctcggccatcaatctttctcctctcctaggaggaaaccctccaccaagaactagctactgagggagtcaaaccatcaaatcaagaaatccaagaaccttgccatccagcacgcacaaggaggggaggaggggggagagagagagtgaggtgggtacctcggactcgagccgcgagatgtacgcaatgagcgccgccttgtcgcggcgcttgagggactcctcgtcgaagccggcctcccggagcttactccagatcgcgtcgtcccccgcggctgcgccaccacttcctcctcctcctccgcctcctcctcccaccccacctgccgaccgcgggctcgccatggctcctgcccgccgggaaccctagatctcgacggcacgatgcggcggcggcggcggcgaccacccgtcgtcacgcgcccctcgcgcgcagcagtgctttcttcccgtgcgagtagtggaggtctccctcctcgcctcctctctctctctcctctctctctcccttctctcgcacacctctccttttcccctcgagctttttttctctctcttcctttgggcggctgctcgtgtgtgctgcgcgagacggaggttttttttattattattttttactcggcttgggattcggtggagggagaagggtttggtttgatgggtggacactggacgagggactgggtgaggtgtgggaccgtggagttcagggtggaccgggtttatggaggtggtgctctaccgtattagagactgatgattattggcaagattctttctttctttgctttcgctttccatttgtactctaatttttaatttggagatcgggtttgttttaggccgatttggctgagcttcaccttcagctctactctactttttattaagctgaaaccaaactaaacaaatttaaatgcatgtgaaaaaaaataaaagaatggactgaagtgctctcacagaataaatttaaaaggtatagcaaatgttcggtttgttctacaacttcactccaaacttaggttttggagttaaatttagacattggagtcccatcaaacgtgtcgtttatttgaaacagagactttagcttgccatacatattgcttaaaaaaaacatttgaatgacttttttcacaaacaaccttgaaatgtcaactatttggcctgctgaactatacagaccttttcctcttaaaactatatagataaaatagtatagtaaaaaaacatatatggagtactacttttgacaaaaaaaaattaagggtgtgtttagttcggaaaaagaaaattttttggtgtcacatcggacgtttgaccggatgtcggaaggggttttcggatacgaatgaaaaaactaatttcagaactcgccgggaaaccgcgagacgaatcttttgagcctaattaagccgtcattagcacatgtaggttactgtagcacttatggctaattacggactaattatgctcaaaagattcgtctcgctatttcccctataactgtgcaattagtttttctttttatttatatttaatacttcatacatgtgtccaaagattcgatgtgatgtttttgggaaaaactttttgataactaaacgggccctaagcaagatgacagtatgctttccgttggcataagcccggggcacactgtaggcttggtccacggaagcatccgaggattcggagatcttttcggcagtaaataaaaaacaattaaccaacgtcaccaggtgtaacgcatactaagcatgacacgtaggtccaaatccctcgtggcccacacgtcagtctccccagctactaatcgacaccggcggccggctgccttttgcggctgccgctgaaaagccgtagcgacgcgacgagcacccccgcacacggagaccatcgcccatgacaggtggggacaggggattcggggggcccacatggaagcggcacgggaaaggggagcgatcgtgactcgtgaggatcggggttcagttgggtgggtttccggcgtggcgcccagctcgtttgagctggtgatcgcgatggcggaaaaagtggatacgtttggatgagggggatgaggtcaggtctctcagttcgggagtggcgccagtgagaacgcatccgaggtgggtggtggggtggtctggttttttatgtgggccccaccaaacttgtgcccttgactttgacggccacagtgatagccacagctgtggaaactgggaaacggaggggtttacagtcacacttaccactaatgaattttttagcttcccagtctgttggcagcaacagtccatgaacaactggtgaaagcttctgctcctaccttaccaacggtgtactagtactactactactgcgacatcatggccagcttggagaactccagccgtccagcgagcgaggcaccagcactgggtacattattggttagacacgggaaatgcagctgcgaaaatcagcgtctggttgggagttgcagcgcacggccgatcatcgtcacgaatggtgcagaagagtccatgggatgggagcggcgcgctggaggagcgcccctcttcttgcaccgtagtagtccgagagccagcccgatatgatgcccagttctgattctctcagcctaacaagccaatccgggtcgtccttgctcgcggggcgcagatcgatgtgatgagctcctgcaaaggcaaatcacaaagcggatttacgattcaataactcaagatgatgcaaaccagagactcaatgtgcttgcttacaaactgcaccacatcaacgtgatttagtcaagtacttcttccgtttcgcaatgtaagtcattctagcatttcccacattcatattgatgttaatgacttacattgtgaaacggagggagtagtatactcaagtatattattgattccattatatcccagtatcccacacacttgagtctagtacagattaacaccaccattgatgaatggaagtgtaggaaaacagcatacctaatggagcgatgatggccacaacactctcagatatattcttcaggacactgtaatgttcattgttcagataacggcaagatcataacacgaaaatggctcgtgtaggtgagatcgtcatcagaggaaataaagctcaaaaggcaagtgaagtttgtttaccctccgccactccaaggatccagaagcccattgaagaatatgatattactaccaaatctctccagaactagactaatattctgaacaagaaaaaaaaaacaagaagtcattaaactctctcacatgtatattttggctgaaaaaaatatgaagaatcagttgtattgcaagcagaatagtttatggagtagaacagaatttgagcattccataacatatctaataataatacatttttttcttagttaagaaagtttcctatcgatgacaaatcatctagcagagcaagttgttaaaaacaaatgtatatgctttatgaaaaccttgagattttgatactataactcacatgcccaccaaactctgtagtaatccattgaggccttggttcaacaccaaagctgttgatgcaatccttctcatatgaagtgtagttgaatttatctgctggaaacatactatcttcactgtatgacattggcataaccatctcggtacaagcctgttttaagcaataatggcagatatgtcatatcagataactcaagtaccttaacatatactccctctgtcccaaaatataaatgtttttttgcccatttagagggagtatcaaatatatccaatggatagaaacagcataaagttttagttgcaagacctgccagtcccatccatccattccatgcggatcatcatttagatcaaagcagtcaacagtaccagtgtagttgtagtatacatttactcctgcatatatgcgctccagaatactggttccatcaggttgattgtcaatttttgtacacaactgaaagagaaaccagataacctagtaagtagggagtagtgatgacatgcagaaaatagaacatggtaagcaggtaaggcttcagaatgttgcagcacactaaattatcattctgatatagtgatactctagattatcttctttgttgggtcttgagaacacaaactaaataatggttgatgaatgttagcaaattaaattttatcacaaaaaggaactaacttcctttattggattgccaggcaaaggcatcataaaatctgctggcattgggtaatccaccatggccaggtaactgtacgctgagctcaaccaatctgaaagttccccagtgttttttatagtcctgcaaaacattttttatacatatatgattaccgattaataaagctcaatgtaaaaaagatgtagtgaatagaaaaattactcacttgcatagatggaaagttttgcttagtttcagcagaccatcttgcccatttccttgagcatccagtgctttccaagagtcctttattgtttgaaagcagcttaaactttccctctaaaacacagtgaataagtgtcatctgtcatgtcactcacgtatattgagaataataaggaaacaggaaatgttgcaaaataaacaccttgaaatcatttgacacgagatcgtagaatatggtagaagggacaacgtcttcaaattgaaggattggagctgatgacgcgagagccccaacagcaatatgtgggtatttaagtctcatccaagcagcgagcactgcagcaatcatacattcaatggtgtcagtacagaaatacagattgaagctggagcccaacagaccaccaagccacattcaagaagaccctacggaatacagattttgcacaggcaaggctatccagttaaagagaagccttacttccaccgtatgagcccccgaagagcacgacagggctgccttctgatgacaagttcttcttgaggtcagtgagcagtacagcataatcagcaagcgcttgctcggctgtgagatacgccaaggacttggaattgttgtaagctttatccttgctgccgaatggcatcgactccccgtagtaccgatgctgcagagaacaagtaaacgggatcggatctcgcacgatcagcgcacacccaaggaagaacacactgactggtgcaaggtgagaggataaatttgcctcggcgaagacgacgagagcggcgaagcgcgtggcggcctcccacacgaggcccgagttggcggcgaaccaggcgatgtccccctcgttgccgcagtagaagaagatgggcccgccggcgccggcccacccgccgccgcggccgaccaggtaccgctgctggaagaacccatccccctcctccccctcctcctccaggaagctgaagtggtccagccgctgccggaagtagcgcgtctcgtagtcgtaccctctcaccgcttcctcggcccccaccaccccacgccgcggccgcgcgtgcggcaccgggaagcggggcggcgccctcgccagggccgacgcggcggcggcgaggattaggaggaggagagggagcggacgcatggccgctttgccgccggcgtggtggggaggagcagtggacagcggtgagctcgttctcgtcggaggtggcggcgtgcgtgccggcgcggacggaaggggagctttatgacgtgatcgtgacgtgggggcggctcacgcagtccacttgtccactcactagatggcgcgggtgacacgtgatctttcaaggtgggccccgttgattttgtgtatgggctcgttgaggccggcccatcaagaacttgttcctggaccgtgtccgtcctggcctcctgtgctccgtgtacatatatgccaacaatacgggaaacgaccgggtttttcctgcagagatagatagatcgatcgatcgatcatggccagagagggaggacgagacgacggtgatgacaccggcgccgcctctacctcgcccaacagcgtcgcaaatcagtcgtcgtcgtcgtcgtcgtcgtcggagccggagccggtgcctttcccggttcaccgcttggcgcgctactccaagtcgatcgacaaggcgatcagggagtcggtcctcatcaacctgctgtcctggagcctcgagcagcggatgctgtcgcccgaggcggcggcgcatgccaccgccgacgggctcgtgggcgtggtccggtgccacgccgtggactccggcgtcaccttctacgggatggaggggatcggcaggagcttcgaggaggagctcctcaagtccttcgacaggcagctcatcgccttccgcggcggcctccccagcaggggggagaaggtgcccgtctccgcgggcgaggcggcgcggatccgcgcgctccacgccgcgttcgtggaacgggacgcggagctgtggaccctggcccacgtcaccctggccgaggacctcgcggcgtcgcgcggcggggacgcgtcggccgcctccatcccgcgcatggtggagcgcctccgccaggtgcggcgcctcttcgaggcggtgctcatcccgttgagatcgctcaagtctattttcgatgacctcctcagtagtagcagatcaccaccagcagatgctgacgtgctgggcggcgccacctgtgacacgcctgtttctaacgcaggttcttgtgtgcccaatgtctgatgcgtctgttcatatgccaaagttaaccatatgaggctttcagttgaacctgagcatgtaagtttgctatttaaagctaaactttagttatagtttttgtctttgaggtgaattggacctcaagtttagttctaattttcaattctaggaaattttagttctaattttcagttaagccaagagctttnngtagtcagttggttagagcacccgtttagtaagcgggaggtcttgagttcgactctcaacgaaagcaatttgagtttgttttatgagtaaatttcataaaactacatgttttgtggtctaagttgcaaaaaaatcacatacattttgacacttagcatttaattatatatattttggtcgtgtagtttcacaaaaccaaactatcgatgaatggattcactcgtgagatgatatagttgtttcacataggacgaggacatggtatcttattaccagccatcacacaaaattaacaggatgccacgtccccatcctagatggaacaaccacgtcatctcacggatgaatccattcatcgatagtgtggttttgtgaaattaaactaccaaaatatatgtacttaagtgtcaagtgtcaaactgtgtgtggttttctgcaacttgaaccataaactcatgtagtttcgtgaaatttactcttgttttattttatctgtgtgcttaggtagaatctcaagaaataactaatttaaaggatgaaagtcacggtgtgtcacaaatggtcccatggtctagcggttaggacattggactctgaatccagcaacccgagttcaaatctcggtgggaccttttttttctcgtaaatttttgcttgctgctgtagtctttgcgtgtgccaccgaattaaagaagtacgaattccaaaaatatcaaaacatgttacgatataaaacggatggagcagtaattgtgttcttttatgtttggaattccaaacttactgcataaccatgaggccatttcatagaagcgttgtactactaactgggctgcgttcggcagaccaggttccaactcttcctcctcgttttccacgcgcacgtttttcaaattaataaacgttactttttaaaaaaaaatttctatacaaaagttgcttaaaaaatcaaattaatccatttttataaaaaaaattaataattaattaattaaatcacacgctaatcgctgctccgttttgcgtgccggggagtgagggctcccaaacctcactcccgaacgcagtctaaactgtgaaaggtgaagcactgagtatttgatgtcaaatctcaatcatatagaaatataattctaattattttaaaaaggaaaaaaaatccattttaagtcactgaactttcataaaatctgctcctactcttcatatcagacgatgttcatactacaatatttcaaatcatttaccttacacccctcatccataactagaactagattgtttaaagcttacagggtgcttatctagcattatagtaaaaaaaaagtgtgaagtgcacgggcggtacttaaatttgaacggatgtgtcatctatgtccctaaactctcgaaatgtaattttagatcctcgatcttgtcatgtgtatcacataggtccaaacatactccaacccgctccttaagatgacatggcatgccggtgactcctacgtatcaatagaacccatacgtcagtcgcgtatagaaaaattaagaacatatattttctcctctctttttcattttactttttaaattaaaaacatcattttctcctctctctctctctctctctcactctcatcccttttaaatttttcttttttctgtgtgagtgacatgtggatcccaccgccacgtaggagtaaccgtggcatgccacgtcagcacacggagcaggttggaacccgtttagatatatatgacacctgagacaagttaagggatccaaaatgcattttgagaattcaggaatttaggtaacacacccgcacaagtttagagacttttcgtgcactttactaaaaaaggaagtaagatccacattgattctctccttccttacctttcgtcctcatcattctctgcttggcaaatgtttcatatagcttgatgccccctccctgtatgatctcaataagggcactcacagtgcaagcacctattgtgaggtaccacaaggtgacacctagggtggagagcttcaaagacactctctccacaatgcaagcaccgctagtgggacacacatatactactttaccaaatccccaactccctcaatcattacgcccgcctcctcctctctcactcaccacgtcggctctcccttgctccctccagcagcgccggctcccctcctcctccgccggcgcggctctcctctcctccggtccgagccgagctctcccctcctccctccccttccccacgcgggggcgtccctgcttcgagcggtggagggcgacgacgacaccacagatccaactcgccgggggtcctcatctcccgaccgatggatgtgtatcttgagcgacgagatcgatgccaccctcgacagggctgtcagatttggcctggcgctaggaggagagggcggaggtggatctcggcggccgagcgacgacggtgtcgtcggggccaagcggcgacgatggcctcggggcgagcggcggaggcaacggcgctcttgaaggtgccgcgactgctggtggggctggcggcggcggcgaggccttgccggcttgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttcagctccactccacaggcaaaactcaactggggtctgagccttggtcttctaacttcgtcttcagctcagaagcactacacttctgaaaagggggaataatagcaaggctgagtacaaccaccgtactcagcaagccacaccaatgatgcagacgtgcaaggggatacaaggatggtttgtggctatttgcataaaggcggttgtaaaacattttattgagcaaaacagtaaaactgttgagtaattaaagtaacattaaaatctccactgatcaacgctacaccacgttgaacaggcccaaccaacccacctggactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgtgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaaccatgcacccacagcccaccattcagtcgcattttagttggataattacgaccatgaaacatggccaggtgtttcgagcacgcagctcaacaagatactagaaaggtctaaaactgtaattatcccatcgactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaagaaaacagtacataaaaactaaacaaacatgtagagctcaattttagatgaattttgcaagttgaatggctcaattcggagttcgaatgaattagatatgaattttagaagttttgagccatttaaatgaatttctataattattatcgaattattgcgcaattattaattattttctcaaaggaaaagcttaagcgctgacgtcatcaaagaggccggcgccgacaggcgggccccacacgtcagcgggtcaagggtatcggtccaccgtggaccgagaccaccgaggcggcccaccattcagtccacgggaaccgacggcccggatcggcccaaagccgatcggacggccacgaggcggcgcggctggggcacgggcgcggcatgaaaccggctcggccgagcgatagcgcgcggcggcgtacggccagacgaccgccggcgacagcggcgcatcgcggcagcgggcacggggagcggcggaggaggaaaaaaaaggagaagggacggtggggattctcaccgaggacggcgacggcgagacgaccacagggaggcggctggcggcggaaagagatggtggcggccgacacgggaggcgacgggaacggcggtccgacgacgcccgaccatggcggagccgcggccgagggccggcaagacctagggaaaatattggagcggttagggagagaaataggcgaccggagcggcgagaataccacgccagagaggagaggaatggtggggctcaccggcgaccgagagataccccgttccggtgggtttccggcgaagaggggcggcggccaaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtggctcggcgcggcgacggctgtggcggcgggaaacggcgaccgaagctcgccggagtgtggcagcgcgtgggtgcggcgtggggagagcgagggagagtatgccgggctcgggaaaaatggggaaacggacaaggggagcacggggattgattttatagctcaaagggccgagaaaagggccgggaancgncggatttcaagggnaagtgggccggcgtcgtggggaaagagagagacgcgggaggcggcgacgtggccggattttgcgggaagagtgggggaaaacggcccgaacgtggcgggcgaggtcccacggacaaacgcgcgcgcccggggtgaagnaggtggcggnaaccggcggcnacgtggcgggttttcggcggccatgccggcaacggcagctgccggcctgaggttggggatgaccccgacaggtggggcccacctgtcggcggctcggggagaggagggagtatgaggaaggcgaagcggacttgcgcgaggagggggcaagccgggccgacggcccaaagagaagggaggaggggaaaaggagggcggccgggcccgagagggagagaaaggaggggttgggccgaaaggggcccaaagagaggagagaggattttaatttcttttctttttattttaattgattcgatgaactttgtgccattaaaactatttctcgagctccgaaaattcacggaaaattccggagagtacattagggcacaaagaatattacaaaatattcccggccattgatttttaagggaaaattttaattctcccaataattcacttgattaaattgcttaactttttatttaatttctaggaaatgcattattaaatgatttttaatcccgaacgaaaatcggggcgttacacggctcccctctcacctcacctctcccgacgagcggcggcaaaggcggagaaagaggaggcgaggtcacgccgaatcgaagcaatgacctccgcagtgcaagattccttcccccacacgccctcatttcggcgagaaaacgtgtctcccacctagggtctcagtgctacgtacgctagaatccaagctggcgcggtaggaaactcctccacgtacgaacactgtgaagggcctaagctgtctctatgtggcttgccttgcgcgagcctagtcatccaagcgctttattctgccattgccttaacctcattttttatggtctcgcatggagatcacctgttgcacctctgttcaacggtctaacctcttgaagcacgagctcagacatcgcacgggccttgccttctattgctccatgcaatgggcgaccctcacgtgtgagagcttgcttggttgtcatcgctcaactagttccacccaaagacgtacttcctcctccgtttcacaatgtaagtcattctatcattttccgtattcatattctagatttattaacatcaatatgaatacggaaaatgctagaatgacttacattgtgaaacgaagggagtatctctctattgaagtaaccatacttcatgaaatcttgacaaggcaattatttacgtgagtttcactgtgagatgtaattgcttgtatgtggaacaggtgcggagacaagcctagaacagcttaggcttgagttctaggattgcctcaatattcatgtttaaatcccttttaaatcaccatttaagaaaaccaaatatcttatcagctaagtcctacttgagccataggcttagaaattttctaacttcgtcatagtgtggaacgacacatcatgaagattagagatacaatgtttgattcaattactttttgttacctacgcgtatggctgaataaaaagaataatatgagaaaacgcaagcaagttgattttgcaacacgattatgttgtcttcttttccctatttttacattttcatgtagtgacttattaatgtgtatcaagttatgttgttggcttggcacgactatccttgtcgtgaccacaccttcgtgagctcgttgttggcttggcacgactatccttatcgtggccacaccttcgtgagctctgcctttattagtttcgatatctcgattgatggtttgatgtttgtttaattctgtaaagttatctaaattattggaaagtttggttcgaaaagtttagtgacgagttttaaacttttatgatttcttttggacgtaaaaaaagaattttctgaattctaagaaatccttcaagcggccggcttatcgctttatcgggtcgtttttttggcggttaaattatctgggtctgttcgcaaaccgacggagaagccgctgctgcaaccgcccgggccccgcgtccacgcaatcgtttgctcgcccttgattggttcgatacacgttttcccctcgtttactcgaaacgaacccacgtggccgcgctctagagagttccacgtagctctaggtggggcccacggacacgggggcccacgggtcatcctctcaagaaaaactttatttggaccaataaaatgaatttccctctttttcaatctctccgcttccgccgcggtgttcttcctcctctcgcaggagaaaatttcgctggttgaatcggagggaggcagcaatggccgctcgagctcggtggcgaatcctcgcgctgccgctcgctcttctcctagcggtcgggtcgtcgcctggcctcgtgaggcaggcgtcgtcgtcggcggcggccaagcctcccgtccccaaggccatctcggtgagttacacgaagaaatttctcctcttccaacgcccgattggccgattcgtccttgtcgcggaacgattctgatatgttaatgtaacgatgcgcgcgtgtggcggatcgatcggtgcaggacctgagggaggcgatcgtgaaggggctggggttccagtcggaggagctcaaggtgtccgggttcgacgtgcgcgacgcgctcgtggggcaggcggtggcgtacgagttcgacatcgaggtcgggaggaaggtggtgccggtgcgcctgctcgaggacgtcaaccgatgggacttcgtcgacctgcccatcttccggtcccaggccgacgccgacgacacggcgctcgccgagatccggcgtggcaagagcgggaagcgagccttcgacccgaccctgccaccgttccagctcgccgggcccatggagctctggatccaggacggcgacgacgttaggctcgccttgccggtaagagaatttttttttcttctcgtgcttatggttaaaaggatattttcatcggaatgattttgttgttattaagttgcatgcaccaaccagttcaacccaaaaactaatattagggaagatgggcaattcagtttatatttcaaagtactgtttgtgtttaaaaacgatgaattttccttcagcaatttttttaaaaaaacatacaaagtagaattaggtatcaaagctaacaatacatcgttctacacctcaaatgtgaaatgtgtcaacagttgggaaaatagagattgtagagcataacttcaggtttctgatgtcatcttgataacaaggcaaagtttcagttgctgctataattaagccacctgacgtctcatctgattgcaattcaatttagttctatgaaattatggaagtgaatttttggattacgttgataattcgtcatcgtcatttcgtctggcgtaataggctctgaagtctgaactatttgtgtgcttgcagactttgaataacgaacaccaactttgttcacgtatacaaaagaatgatttgaattgagcttatgtgttcatgtattgtaagatttcattcagcaatgaatatgatgatttttgtcctggtgagttcaagagtcagtgttctgcaaatctgcgttagtattcttcattgtggattctacaccagaatggtttttcattacaacattagtagcttcttcattgcgcgttctgctctgaagtaatgttgagcaaatctgtatggaatatcctactcctttcacagcaatggaatgtctcacatctggaggttctgtgattcctagttagctgtaaatactgttttgtgctaggcttaaactctgaatatttacaatatgtgtttttttttagactggtcaacggggggggggggggagcttttccacctgaattttgatttaaagagagatcgagtacattaagtcagggtacatttgaacggatgggagaagatagaatttgtttccaggattctactactatcctgtcggcacagttcaatctttccgcccagagagtagcatcctctatgcactttgttgctaaacgatttagaggaggagattctcctctgaaaactacatcaccgcgatgattccagagcccccagagacagagcaggaagaagaccttgaagtgtgtacaatatgtgttgttttataattcctatctctttagaaacttgacattattttgcaaggcatagttatttctaatagttgcctcataagttggtggtatagacttttacgcatttgccataatgctaacaccatctgcggcctggggttcatttaagattggtcatttggttgccattgctgtatttaaccatgggaaggttcatctaaccattatgttacacacatgcctaacattgctttactgggtgaattactttatctactatgtattttaaatacaaaatgctaatactgttctcttactatgtattttaaatacaatatgctaatactgttttctttacagcatgatgtggaagcagggacgctgaagaaagtagtgctatcagatggtgccgtggtaacagtgaagggtgccaaggctgtgagcctccggttgccacttgaattaccgctccctctcaaccgcaccacttacaagggccggttgtcaagcttgatatccattgcgcaaacgctacggggcgccgcccggtcgaaccagaagccgctgctctccctccgcatcgaaggtccgacgtcgttgtcctcgactccttccatgtctcccaatgacaggctcaagctcaaacggttggccccaggccaagtggagctctcctcgcgtgcaatccctgctgttacagacgatgatggtgatggatcacacgcagctggattgtggccccttctgtcactgaatgggtcagatggcagcctgcaggggtttgaggagttgctggcctcggttcttggaaagaaggcaggtgagaaggggacgttcaagctgttgaaggcgcgagcttctgcccaaacgtacgtcaagatggggtttgcggtggagaagaggattgctgacggagaggtgaactggtccaacttcccggagtggaagacgaagcccaagaagttgagggcgcactacgaggttcttgctcgtgtggagggtggccaggcgatccctgaaaggatcgcgcaggtgcagccttttgaggccgacgaggccatgtccgagagcgtgctcaccgggaatgtgtcgatgtcgaagacggaggtggttcatccgccgccggtttacttcactctttgagagcagttgaagctccggttttaagtgagctgatcacggtaaatgacaagcggcgaaagtttcttggcggcgagtattattaactgcattagcatgaaaaattgttgtacggggtatgttatactggccagctttgtaaattaccaaactgaataatgaatgaacgaaccattacaggaaaaggattcatccataggcaattgtatatctttttgaaaccaagagtgccaacttttcagttactgcatcttttgtttcatttcagttaaaccgacgacgtccttgtcgccgcttttgaagttcgccgccggtggcatatgtagcgtatgcggtgcgaatattctcccaggctcctggaggatttgattggataagccgctcgtaaggacaccgtgcctccaattgttttaggctgctatttgttgggcggtgcaccgtgcacgcgagtacggcgtcgcatggtcgcggccctagtcgcgcgctcgcacgtgggcacgtggctaggcttggcttcgcttctactacggcctcccctcctcaccgacaggcatggcccacacgtcaggcgtggccgcccgtctgaacctggttttcatgggccgcccgctcgcacgcagcgcgcagccaccgccatctgggcctaggttttccgggagagcgcagcggcggcgcggaagcaacgaagcgaccgcttgcgggaagggccggagccgagccggccgcgccgcctcgcccgacgtcgtagcaaccaagccacccccgctccacgacgaggaggaggaggagggagaaggatggtgaggagagggcggaagggcaaggacgcggcggctggcgccggcggcaccggtggcagaggcggcggtgccggcagaggaggcggcagaggaggaagcggcggcgggggcgggggagggggtgttcgggaggcgacgctggtgcgcgtctcgaaagtgctcgaggacttccaagcctccgacgcccagggttcgctctcattcgtttgcccaatttctccattccattcaatggtgtctggtgtgatctgtcatcgcggtgttcgagcgagttggggatagtggcacgaatacgatactttgggagcttggttttggtgaatttgaggcgatggtttgggccatgcgcgcggccatgcccattttgtgttctctcttctctgttgcattttttattagtcctcctaatgtatgattgactaactttactggccttctagtgtactgatcactaacgtcaccaatgtttgtagcttcacagttgattctgagtttggtaacaagggaagaggaataccgtctactttatgtttgaccattgtatctcacaatatgtgacatggtattttcatgattgtcagtttgtcgctagataagttggtctgttgactgactagaaagtatttcttaggttttactacaatggcatctaacctgacaattgcacttgaattgatttgcaacagtaatcctaggtggccactagactgttgtgtaaatatgcatgagaatcaactctttgggctgatattagtgggtgcaattaagctcctgcataaaccccaacgaggagtctcaagcaaaacactattaggattctgttagttcaaagtagcacccttttattagttctcttctcataacaaccctcctccctcctcccaacaacaatgaaaagaccacccgcacacatgcttgcacactctgatggtggcaatgttttcttgtatatcttcttttcacattttttgtgcatcccttgcagagccattgcttgctactccttccatcccaaaatatatctacctttctaattcaaatttaaactagaaaggtagctatattctgggacggagggagtaggtcatagcatgtgctgtgctgtggtgttttttcttcccttgcgttgtttgcctcgactgagttttagcacattactgccccattatggtcctgcatggtagatggcatgtttaggtttcttttggtatgtggggaacttttcctgttattcttgtgaaattcctggattccaaacaggctcctatatcaattcctccactacttgtctctttctttactttttaatgaaacacacatgttttctctgttatgctgtcagctgaaaaagtcacgtatctacaaaattttactttgcagtgtacaaatttgaacctggcatatcgaaacaagagcgagcggcgatacatgagatgtgtagaaaaatgggcatgatatccaaaagttctgggtgagtgatagtctaattgacctctggaatgatgcattccgtacactggttctagtaaagagtaataagcatcttttaaacttcattcatcatagcgactgttatcttagtaggattaaactatgtgtatctgatgttttctgaaatctattaattaactataggaatggggaacgacgatgcctatctgtttacaaaagaaaacagaaccagggccttgaaacagaagaaggacctagccatcttggattttctgtggaagcgagaaatgttttgcaagatctatttatgcattatcccccagatgatgcggagctaaatgggcatactgtcaggaattctagtgataaggctgtaaagattcagtggaagccagatggtgcattttgtaggccagcattgcgcaaaccggatatattgaagaaggtggagatgcttgcatcgaaagtaaataaatccgaacagttgaggaaggttgtatattctggcaatctggcttgatatggtgtcctttttgccattcagtttagccaattcctacttttatatatgttatattggatagttttatctaattgaacttagtgttgtacatttatacagattgtccaagatagatctaaacttccaatttcctcatacaaggatgcaatttcttcgactttagagaatcaccaggtattgttctttgtgtttttatggaaataaagttgcttcactcgagcttcatcctgatgcatacatcaaaggtggtgctggttgtcttttctgttggtggcggggctaatagcaagacattctatatattaccttgtaatacttcaagacaaatcaagaaattactattattttcttgtttagtagtttcaattcttggtaggcttgactgctttccaataatgggtggatgcctcttcaggaaaatgcttatcactttcctgaacctagctatttattttgatccatgcttatctttgacatttgccaacttccagaatgaacatttcctttaacatgacctgataacaatttgaccttcatccctgtcaggtggttcttatttctggagaaacaggatgtggtaaaacaacacaggtgccagttcttttgacttttgttttgctctgttttgaccatgaaacaactattgtatgtaattaacttcactgtgacatttcctgcaataaattcagatgtatcttctcattctgttactctgtgttgattaattgatccaatctatgcctattttctgctattttgatattttactttgtgtttgttgttatcgtgttatatgtattaaaacatcctgatttgtgagaaatttcacaaaatcgatagtcaaatgtacttcttgttttagtgcccatggaatgatgtggacacctttctttttcttaaattatgatttccttggaatgatattctgcttatctggctcactcatcgtaccattctttttttaggttcctcaatatatcttggatcatatgtggggtaagggtgaatcatgtaagattgtatgcactcaaccaaggcgaatatcagctatctcaggtaattctgtcaaatgacttctctttcattgctattgtttttgtttaagcagctgagagtcaaatgactcatgtacacagttgctgagagaatctctgcggaaagaggagagtctgtgggtgacacagttgggtataaggtatgccaaattttagaattttctattatgcatttctggactgaaattgtacttattattcatctgtttgaaaatgacacccaaaaaatgttatcttttttttttttgaaaaagaatgtttttttacgaaactttgcccgtaaatttattgtgtagtttatccgtacagtgacatgtctatgataacactaaaatacttgtagatatgaatttgccttggttattttgtgcaaacaaactttgcattgtttgagaatttcttggtagaaattgacaaagtttactcaagaaacagtatcagtatcttgtattttgaaacgagtaaacaccagttttgttatttcgcttgacaaagttgagaaagtttgtaatttggactatgttcttaacttcaattttcgtccttaatgttcatatatttgtcatctatgacatgtttgcacttgtgcacataatgtggatatgtacctctgtcttattccgctgtttatttcaattgcagatacgcttggagtcaaaaggagggaagaactcatcaatcatgttctgcacaaatggtgttcttttgaggctattgataggcagggtaactaatatttcaaaagaacaaaatcagaaacgctcatttgatgatgcagttactgggataacacatattattgtggtaatgtttaatcttagaactttcaaatagcttgattgcaaattattgtattctgaactgcacatactttacactccttattttgcaccaacactgcatccatgctattagtaccaacaagtagttaaatatgatgctttttgtacaaggggggaaggagatatttaatcaaccactgggtttgtatgacactagacttgttgcagaaacttaactctaatgctctaagtagatctatgacaaccagaaattattttcccgtctagtgtgaaattatttctttaatattataactgtacttgcatttcttttgtagtttgatacagcgtattgcagaaaacatttaccaactgttcctttgtaattctgagagggcagagcatttggtgagcattaattgcaaaatggttatgtcagtgcttacctattcaaatcttgttatttgtttagtactatcttagcaccccttagcattgtccattgaatattgttgtcattgttgaactggggcaagtcatgcatcaattagatgtaagaggtattgtgcaacttagtttataactctattgcaaaaataactggaatggaaatttatgattatttgttattgagcttctaatagcatactgtcttttggtgaaatacaatgttttttttaatcttggaaagcttcatatattattgtgcttcagaactggagccttatacaaggcacttccttactgaattgattttcaatggcatatactgccagtatatattttattggtaatatgagttggcactctccttttctctttaggatgaaatccatgaaagggacaggttttcagatttcatgttggctattctaaggtattatgctaaaagctgtttcgtccacatgttgcttagattgtgtttttagtgctttaacgatcttttgccaaacaattatgtagagatttgctgccgttgtatcctcatctgcgtttggtaagaagatttttccttctagtttaaggctctatagtaataactacacacaatcatgcatcctctatcatgtatccaaaagattagggtacggctttacaaaatcctctaccagataactgtgcaaaagacaaaagttagtccacatcttttgttagtttgtctctgttgttatttttgcacagtacacatatgatcatgattttgcacaaattttgcaattgcactcgtggcatggtgctttacatctacgaacattttgttcctttttcaagttcacaagacaaaataggttcatataccccaaggaacacagaatccatatttccattccatatttgaagcacagaatttcttctgagtgtatccgctttccgttacatgagtattaactagtttaatgagcaggtactcatgagtgcaacgattgatgctgagcggttctcaaattatttcagtggatgcccatttattcaagtcccagggtttacccatcctgttagtaacacactaatttacattttgttaagaaagatattgaagtaattgatggcaacattggctcttttttctcaggtcaaaactttctatttggaggatgtgctttctattttgcaatctgtaggcgataatcatcttgatcctacaacagatgatctgaaacagagcagtttgttaacagatgattacaaaagctcaatggatgaagccattaacctagctttggataatgatgaatttgatcctcttcttgagcttatttctgctgagcagaaccaagaaattttcaattaccagcactcagaaactggtgtgacacctttgatggttcttgctggaaaaggtcaggttggggacatttgcatgcttctatcatttggggtggattgttctacacgggatcatgatggaaaatctgcattaggttgggcagaacaagggaatcagcaagaggtttgcgaagttattaagaaacatatggaatgtggttcagcaaagttaactgaagagaatgagctgctcaataaatacttggcaaccatcaatcctgagcacatcgatactgtgctaatagaacggttgctcagaaaaatttgtgttgattccaatgaaggagctatcttggtgtttcttcctgggtgggaagatataaatcaaacacgggaaaggttgcttgcttctcccttctttcaggattcgtcaaagtttcttgtgttgtcactccattccatgatcccatcttcggagcagaaaaaagttttcaagcgtccaccagcaggatctcgtaaaataattctctcaaccaacatagcagagactgctgtgacaattgatgacgtcgtatttgtcatagatagtgggagaatgaaagagaaaagttatgatccatataataatgtctcaacacttcattcttcctgggtttcaaaagctaatgccagacaacgtcaagggcgtgcgggtcgttgtcagccaggaacgtgctaccatctctactctagatttcgagcagcctcattactggaataccaaatccctgaaataaagaggatgcctattgaggaactatgtttacaggtatattcctagctaacctttgtagatttgtttcctccaataactcttgaaatcaatacttctgcaatattatggttcgctgcaataagaatgacatttatttactgatagctgttaaatgtttcaatctgtattatgcaggtcaaactgcttgatccgaactgcagaattgcagactttttaaggaaaactttggaccctccaattccagaaactgtaagaaatgctatcaccgtacttcaggatcttggtgctttgactcaagatgaacaactgacagagttaggggaaaagttgggctcccttccggtccatccatctacaagcaagatgctcttgtttggtatattaatgaattgcctagatccggcgttgacattggcatgtgcagcagattatagagatcctttcctccttccaatggctccagatgagaggaaaagggctgctgcagccaaagttgagcttgcttcattgtatggtggatacagtgatcagcttgcagttgtagcagcaatggactgttggagacgtgccaaagataggggccaagaagctcaattttgttctaagtattttgtgtcttctaacaccatgaatatgctttcaaacatgaggaaacagcttcagaatgaactagcccaaagaggatttgttcctgtagatgcatctgcatgcagcttaaatgctagagatccaggtacttttctagaaaaaattgagttctgaaacatattctttgttcatgtgatttcttttgtttgtttccactttgctttgcttaactatagtatatgcatggttgagggatacatggtattatgtaagcagcaagtaagttgattagttaagtccctagtatataatatactcagtgagaagggtgttccttttcaggatagctaactagagttttccatggttagttacaaagaaaaaccttgtgtttctatgaattagtcttgcaatatgttcacgcctatattactagttcccatttggatatattgtaggggatagtccatcccctgattagttgtattgtagattagcagttccttaagcctatgcacagcagggtttattagttgtattgtggattagcagttccttaagcctatacacagcagggtttacaacatacaaggtcatagtgcacagagtgtatatgaataagagaaccaatctaaagttagtacaagtagctactaagttacatatatcactctaaagttagtagctactaagttacatatatcattcactgtattgtagagttttccatcctttccccgttcaatctttttaattttcttcttacttctaattcacgagcaaatcgtccttgccttttctttgtagtaaaattatttttagagtatttgctggattctatttttattcttagtaaaattatgtagtaaaatcagttgtcacccgaacttcatcaatcttccttagttcctaacaaattatgctttattgcatcaaagttttaattgttctattgtacttaactgacttctaaattctgtaggtatcattcgtgctgtccttatggccggtgcttatccaatggtagggagattgcttccccctcgcaaaaatactagaagagcagtcattgaaacagcaagtggtgccaaagttcgactgcatccacattcttgcaactttaacttgtctttccgtaagacttctgggaacccattagtgatatatgatgagatcactcgaggcgatggtggaatgtacataaaaaactcttcggttgttgggtcctatcctttaattattcttgctacggaaatggttgttgctccacctgaggacgatgatagtgatgaagaggatggggattctagtgaggatgaaactgagaaagtcactttgggacaacataaagagataatgtcttctcctgataactctgtttcagttgttattgatcgatggcttcggtttgatgctacagctcttgatgttgctcaaatatactgccttagggagcgcctagcatcagctattcttttcaaagtaagatttttatatcttgcatcatctaatttaagcttgattaatgcaatacaacttgttccttttgtattctctctttcatccaatgttttctaagatgccatgcatggttgccagcatattagcaaacttttgttttacatttcagtctgcacactcccactgtcccactctgacccccgagttttcctttaaatatattgtgttgatttttctccagtgcagaaatctggataataagcatacatgaaaaatctataaggcatgtagatagactgcattgccttccgttgttcattctgagttgtctcaatcagataatggatctggatcaatagatcatcatactgctttctgcatcattcttagtacctttatagtccaattatttctgaaaaaaaatggaattatttttctcaggtcaaacatccacaggatgtcctcccacctgatcttggagcaactatgtatgctattgcgtgcatcctatcatacgatggcttgcctgctatgattacatctgatgatgttgctacaagtcagggttcaaaccaaagttcagctgaatcaagcagattctctcagggtcgtagagtcggttatattccacctggcggtttcctcatgtctttgttatcggataaacctcttaatgcgcctcattttcagaagtcctttaatcatccagatggagcttcagggcatattcggtcatcgaggacctccgtcggtagatttgatcagtctcgccatcctcaacgtaataattctggacctgggagttcagcagcacggactttcaaaagacagcgcaacggtgcacagtgactctggactagcggccgcgttttgcagatccttcggctatgctggaatattggatgaaaggcttttgtggcagaaataaaggattgctgtcttggccgggagttaaataggacttgcagccttcctttgttgaagggccatacgatggcaacgtgatgccttgagctgaaatcataatccagaaacgctgttttgctggtgacttgcagccttcctttgttcggtgcacgttgctattctgttcagctctgcttcccaacttgagcgtgccttgtaatctgatggcaaggcgacgccatgccatgccacagtccactggtgtctaaccaccaaattgtactcgttggaagagtgacccatacaggctcaacgggagtctgaattctgatgtccctcatacagccatacaggagtagtaggttggtagtctgaaacttttgttttgctctgatgatgtacgtgaagaagtggtgtgtttcccttcttcgacctatggttcttttatagtactggagtagtacagtagtactagtagtacatgcgcctaaattctccatgccatgtgtaaccacagtgatgttatgccgtgcgcctaaattttcccgttctggtttgagatagcagtcgcacccagagacgctgcgggcctgttgggaagctggataagcagctgagctcctgataatctggaaaagttgggtttcacaacttctggtttttaggttattttcaggattttacaaatatagcttctcagaatcattgaaagctagactatttagggagcttctgattataagaggaactgcagcaattccgagagaaactgcagctagaagctcctccaggaccggcctctcttctcttcgtgaagaagagaaattgagtgaaatataattgctcttgtaccaatggggcactactagcacccaaaaaataataacactgtagcaaccttgtagtactccgtaatgcacgtgtctctcaggaccacctgacctgagattgaatgtctagcaggtgccaacatccgcccgtttggaacacggatttgccacgcccatcacgttacatagctggcggatgtcgacgtgttttaatggcccaatggcaggtttaatactcgtacgtgaaaaaaggctttgctcttgtacgggcatcgaccagtgggcagtggcgccatcatgttttcgccgtactacctcgttctcgacgactcgtgccatactgtcatgcgaaactattttgtgatatgatcatcgcagtatacagcatctgaccagtactactactgattagaccaataattgcctcctattgtcagcagattattgttttatggaggatatatttgtagaatataattggaatggttcacaacttcacatctcctgcctctccaatgacatagtacaaagccagaatacgatatagagtggattgagatcggtgcagtcgtaattgcgactgcaccttaggactgcatccattttcagctatttatttttgtgatcaacagtacagatcaactgctaccgtactcgtgctatagtaccctgaacaatattttatgtcgtggtacttttgctacagcaaccggcctaatccttaccgttggatttagatccaacgtagcagctacagctgcttaagttacagtccatactactactgcatttgatccggatccaaatagagtcatccgaagtgaaataaaggactattgctacaatagcaaaacgcatagaccctttagcaattatactccctccgtctcaaaaaaaagacaaactctaggcttccgtgtccaacatttaaccgtccgtcttatttaaaaaaattatgaaaaaaaattaaaaagacaagtcacgcataaagtattaatcatgttttatcatctaacaacaatgaaaatactaattataaaaaaaatttcatataagacggacagtcaaacgttggacacggaaacccagagtttatcttttttttagacggagggagaattttgtagataagaagtgaaaaataaaggactattgctacctttcgtttaatgttatcaatcattttagcaaatttcacattaaacatgtagatgtctctaataacaaggttaccctcattaactatatcccaaatgtttcctaaagtagcagtagttgcctgcattgacaaacagagtagagatggaatgccacctctaaaactcatttgaaatgtgagagtgaagcattttgtatcgaaatgtgagagtgaagcatttcgatacaaaatatgaatattagaatgacaagtaatctacaataagagtagtactgattttaacagagtagtacaattgtgtataatatcttaggactcttaaattcgttgtaatatagaactaatgcaacaaaattaaattttatggcaaccattgcgataaacatcgtggtactaataggctattgcaataaattagtagtccttacgttaattaggagcaaccaaggagcccttaggtttattagggacaatgaagggaacaagcccgggtgctcaagtgaaaacgtcatagaccaatagattacttccttacattgtgattcaggtttcgatatagctcattgctgacatcggccgtgataaatttatgagcatgctgagctgggatcatggcgttagcaaagttatattcacaccacgtatagccgagtcaacaatcaatcaatcaaataaaatagtacagtacagtacatcgtgtttccgttactacgttctaaaatagctgctgctttttttaatcgcaaagaagttctctctcttttgaggacgcaaagaaaggttgatgctttcgccattcgcaagcgtaagcatattttgctaaaaatgctccggtgggggagagctgtcgatcccatctcaggagtgttttatattagtccccaagtcttaacgactttaaaggtcggggagtcctggtcaactttgccatgaccgcattagtttattaacaccccacgactaaactacgtattcctgcaattttcacaagatctaaccatcacccgtagttactacttcttccgtcttataatataagagattttaaatttttatttacactgtttaaccactcatcttattaaaaaaatttaaaattattatttactttttcttgacttactttattatctaaagtattttaatcacaatttttttgttttttatatttacacaaattttttaaataagataagtggttaaataatataaataaaaaattaaaatctcttattttatgaaacgggggagtagtaggccgtagcgtctccaaactctcgtcaggtatggacgcgatcgcgcgcaacggcggcgcacggcgcccgcaccccccgtgccttttaattaactctccttttgaccgtgccaggttaacctcacctcgcgaagcgaactggtctaccacaccaacacgaccacacgacacgatcgaggctcgcatggattttcgcattttcggtggacagagtagggtaggggcgtggagaggggaggtgagcggtggtgagccacacgagcagggcagcgcagaggatcgcggggtgcatgattgagcggaggggggaaggggtgtggtggggtcagtagtacgggggggggtgagcggtcggtgacgcggggtgagtccgcgtcagcgatgcctacctccgcgcgcctcacgtcacccgcgcgacctcacccgttcacgcgggccccaccaccaccaccgcctccctcgccgacgccctcgtttcgtacgactagaaagaatactccataatagaagagattttaagtttttttacattatttgatcactcgtcttatttaaattttttttgaaattattatttatttttttgacttactttattatccaaagcactttaagcacaattttttgttttttatatttacacaaattttttttgaataagacgagtggtcaaacaatacaaacaacaactcaaaatcccttatattattatattatgggatggagggagtacaatacagtactcctacgtactaaaaaaaccgggccgatgccatctttccgctaaaaaaacagtcgcgcgcagcgcagcagcagctgctgcggccggccaggcaacaagatgcaccgagttgccgagcaaaagaaaaaaaccttggggagatcgcggcgcatcgcggttgcgtctccgcgtcccgcgaccacggattttcctttttgcctgcgccgtttgcgttgcacgcggtgtgtgtgttacggcaacttctgtatcgtgtacctacgggacatatcggctcggcatgcgcaaagacggggaagccgaccgagcgagctggagcctgggaggaggagaggaggaggtggtgatttcgacggcctatccacagtacacacacgcgcctgcggcctctgccctgcgctgccccgccacctgtgctttggagacctccgtcccatattactcgtctttttaagtttttatttgtcaatgtttgatcattcgtcttatttaaaaaattttagaattattatttattttgtttatcatttgctttattatcaaaagtattttacatatgacttatctttttttatatttgcactaattttttaaataaaatgaatggtcaaacgttataaataaaaaatcaaaaatgtcatctattacgagacggaaggagtagtaggagaggataacgctgggggtttgcctctcttggccagggcacgacgtgatggcgtgagcctctcaccgtacatgtcacgtcgcgataaccatctgtccggccgctttctatgaggataaccacaaggaacagtaaaactaatcctgacaatccatgctattacaccgattctaaaatatatagtaattttaactacaaatatgaaggagcataattattttattttttaagctgctatattttaaaatttttacttttgttcaaattgatggttacaaattattatattttagaatagatggagtactgttattttcttcgagcacaagatcaacatgacaacattaacgtttggattgaactactttcttattcaacctaaacacgctaccaaattgttgaacggttattttttcaaaaaaactatttatacaaaaaattattttaaaatgataacattattatttaaatttgtaatagttaatagataagtagtcgttcaataatgatttatcttacggataagtataagctaacccctcatttaaacgcaaccttgttaccgctcttctggcaggatagactcaaatctagaccaataaatttctcacttgtttggtctaataggaattagggaagtcccaactctctatttaggatagtacttatagcattaactacattgccatgtaggacttttaacttatgtggtaccatattaattaagagagagagtgaagagatgaagaaactgggtctcatgcaaaacacagcttcaacacgagaacctatgcactagacactatcaagttttgcattgggagagaatattgtcttcataatagatgaagaataaatatgattggtagagaagagagatggtgtatttattaatggcccactttaacaaatcatgggttgtgaagtgtagtttctattgtgatgtcttattgacatggcaccatagacactgcttatggacactatgagttgggactgcccttatgctatcatacttatcacgaagaaaatgattttactggtctaaaagtatgaccaaaagttactataccttttattttagagtaaagtgtattagcggttcttaatcttatagggttgtgtcatataggtccctaaactctgaaaatggtctcagaacttgtcaaaatgtatcatctaagtcccaaattgacacatcccctttagatcctacatggcgctgatgtggtgtgccacatggacgtgacgtgtccttttattttttttccttcttttatttttctttttcttttccgttttcttctcattcttctttttttactttcttctgctcgggtcacagagaaaggagaataaaggggaaaaagagaagaaaaaaagaaaaagaaaaaaaaaataaatgtgtcccatttgtcagtcaaaataacaccacgtcatatttgtgtggcatgccacatcaacgtcacgtaggatcttgaagagggtgtggcgatttgagatctagatgacacactaggacaatttctggaacttgaatatatatcttgagagcttaagaatctggatgacacaccttacaagaaccgtccgtacactgtactttttttttattataacggatgtgttactagtaatttgttagggtcacctcatgttcgtgatctttcaacaacaagatcgtgtttaattcgacgaaaatgaccggtaatgccgagacaaggtggtgcaggctagtagcggtgaatgccttagatctctagtcagttttgtggtgttcgatcaatggatcagcccaacatcattagctcccagaggtatggtggaacgccacaggaaaggcgtgtgaagagaggcgatgccacggcatagcggcgagacgagagagagatagagagagagagagagagatgtggacggccgcagtgcacggcaaggaagggtacagactcccggtggggtgaccggggggtgaggtgatgtgtatggcaaaaagaaatgaaggagatgtgttggatgctgactgatctgaacagtagtgctactggaaaaatttaagctattttcgctcaataaaatatctaatactaggtgcataggaatatctgaacttgcacattttgagggctttttacagcacgtttaaattacttgatgctgtgagtgtacagcacatgaatggaatttttgtagactctctattgtaccacatactcatagaaaagagtctaatactggttgacaaataaccctactattggatctagattgactaaaatcacaaacactaaatagaaatagacttgccgtttgtgtagcgatgtatgtactctctccgcacctaaaagatttgtttcacagagactattttctaagtagatgtccattagatctttaatagtattttttttcgttttaaccttcaaacccagttgtactcccttctcttcctcatctttgattatcttaaacaatatcaataatattcttttatgaatagtgtgagtttaaaataaagtataccttttcctttaaaaattactagtttttaagttttttacttacagtatatattttttattaagatacatattttacctatgtttttttaacatgtttttaaaacagcttaacgatgtgtttcttaaaaacattttatgtataaaaattgctttaaaatataaaataaaaatactttcaagtttataataatataaactcatatgttaatagtttttgtattttacgtgtgtgctgacatcatcttcgtagcctcaaacacactctaatttatatttcacatgtattttactcatactatttcccaaaggcacgagagaggacggcaacaacaaaaagatcctcgcctccccacacctgaccctacccatcaaaatcctcctagacaactcactaaattatataccaccagtatgaaaaagaaactaaaaaaccatttttaaaaggtcccagatgaagaattcttttccaactcgatcccaacagaagaaaaggaaaaagaaatgaatagcaccgaggagaggacagacagaacaaatccatcggtctcctcctccctccgatttccccccttcgtcctcgtcgtcttcctcccatttttttttcctcctcctcctcctctcatccctcgccgcgagccaaagcccctggtttcctcgcaactgcctccccgcgattccgtttgacccccactgttcttctcccctaccaccaccaggtcgcagtcgcttccaatttccaaataattccctccactccggccgctcgcgaggaaagaaaaggatttctttttctctctctctctctctccccctctctccgagatccgtttcccaaacaggcggggggtcgaaagtgtttggtactttggtttggggagcttgtttgccgacgcggatctgcgtggagacgagcagaggggggagcgccggaattgggtggtttggcccgggaggcgccggaaagtgggggagcctttggattccccgaacccgccatggtgatccggcacgagtagtagtggtggtggtggtattagtagcagtg

SEQ ID NO: 64000 - DNA, 7729 bp, Oryza sativa
tcccttcgatctccctcccctcccaccctctcaatggcggatctcagtgaagtacgcaagccgcggtgagccccgtcctcccgccccaccctgatccccgttgacgacacgatgaacgctgtcaccagcgatgtccccaacatcaactagttgacgatggggaacgtcacaaccggcgccacggaagcgcgttgcgacgccgggcatgcgccgagtgtgatgagcgtcgacgagctgaatccgacgaggcccacgccctcggtgctctgcagcccgatgaacgccaagaagagcccaatcccggtagacgacgatatccggatgagcttgggaatgaacttggcgaacttggagcgcaacccaatgacggagatgaagaggaatatgtggccctcgaggaagacggtggcgagcgcggtgcggtacaggagcctgccaaagccatggagcaaacactcttcgccccctcgccgtccccctccaccgtcgccgccgcatcctccaccccaacaaccgcgcccggcccgctctccctgttgccatccccactcccgcgtgtcggcgcgaccaacgcctacctcaaccctcgccttgcggccgccgcctcagtccactgctcacccccacgtgccgccgtctgccgcctgcccctccatgccgccgtgcgcacccgcgcccttgcacgcgagagagagagagagagagagagagagagattaggaagaggtgaagaggaggtatgaccggtgggtcccaccaattttttcaaatgctgaatggtatgccacgtaggacaaaaccgctctggattggatcgagagggtaattcattaggtactgaaagtttagggcgagcaatgtctggttttcgggttcaggggataattcggtcgaccgcgatagttcgagaggtaattcatactttttcctaaattttataaagagtaaaaccccacctattatggtccaagtttcatgaaaccacaagaacctgtacacattgtcgacgtttgatgtcgcgattccagtatttgcatagtatggggatcgttggtactagggtatatgcgagattgagataaaaaagatggagacagggatttttatacaggttcgggcccctgaattgtcaggtaataaccctactcctgttggccgaagccggtcattgctcttattcaccataatcacaccagtataatatttgaggtagcctatctatctgttgtcgacttggcggtctaaagtgctgactcgtagtcgacaacatggtagccttcctcctcgaatccgtacccggcgaggtcagagatagcactagattcctctcttcggttcccgtaggtaccatattgggttttcctaggcttatctctgatgtcgatatctggcagcttgtcttggcgtatgtaggcttgtattggcttgtggctttgtggcgtccatgttgcctgtgtcccctctcctcctagggggccttgtatttatacccataggtgtcccctttccaagtagaactagggaaaccaatatggatacaatccgactagtccttgtcgtttccatgtagaactctattcatcctttcttacgtgaaactcctactatatccgaaggttgttcccgtataagacatggtatgtggtgggtcctgccgagatttagtcaactactattagatatgtggtatcaataaccctgacacacatggtacctacccttagactattacgatcctaacgtttttacagaatcacattacttatcactttgactttggcctatcacatttttaagttgtacagtcacatcttaaatttatgagaattttatccatcatataaatggtgcatccgtttttctcttttgatttaggagtatgtcaaaatagttaataatgtgatttatgaaactttagatcataatacctaacattatatgtcacatattaaaatacctatggttttatataactttggacaatataatactccctccgtcccataaaaatcaacctagtaccggatgtggtcctaaatttgttttttatgggacggagggagtaggtgatagggagtaggtttaatgaaatttaatctttataaaataagtggcccaatattaaactcaaatttcacacatggagaggtcgcatcgtctccttctcgcctcaccacatagcgtctccttgtctccttctcgcctcctcgtcccctcgccttgccaccgcccgagcaagctgccggcgtgccgggcggcagcgagaaaggcggcggcggggctttcctgcggagaccacggcacggtttaggggtttaccgggtctggggctccggcctacaaatctggcgatgcgggaggtagcggggccatgggcggcggtggctggccgggccgcacccggcggcgaaggtggttgggagggacacaggcgcgggagttggcgagcgacggtggctgaaatgcacttggcgcgcagcagcggaggggtcggaaggcagtgcggtggctggtcagcgagatgtcggcggcgacgactcttcgagtgaccgtgggttcaatggagaacggtgacagccttagtgtcgatgcccagtcctcggcaaggaaaggcggttccagcgaaggtggtttcgtagccagcggctacactaggggcggcgacggctttcgagttcgagcagtgacctcctcggttgcggtggcgtaagcgccggtgcaaggtggttcaggtgaaggtggatccagttagtgacggcagccctaggggcggcggaggcctaggagtctaggcggaagatgatatcctctctgaccacggcaaaggacgccggcagaagtggcggcgggctcggagtccgagaggaggaggattctaacgttggcagtgaccctatgggtggcggaggcttaggaatccggcgaagcagatcctttcagctcgcgtctggttggctagttctgagtggacgatgatggatggctagttctgactagacgacgatggatgaaggtggactacccagcggcgcgtggcatcggttcacttgaagcagatgaagatggcaccaatggagattcgcagcgacaatgcactaggggcggtggcgactagacgacttccactcgtcgttttcgactgtttcaagagagaatgttgggatgcagggatgtgtcaaggttgtaggtttttggttttttttgttgtgtgttctcctctttgttgaggtgtaaatctaagtgctcttgtatctttttagctatgtatatccctcgtggatacagagggattaatggaaatccattatctaaagaaaatcaaactcaaatttcaaacccttctccctttccaactctccacatccaaacagcagactaaaacctaaagccgctttctaacagtcgcaaactcgcattagcgcttcgaaatcccaggcatgttccccacagccggcggccgccggctcctcgtcctcatccgccgcgcctccgccgccgccgcggccggcgcaaaccctaaccaccaccaccaccacgccacgcttttcacccatcgctactcttcgtcccccctagcaagaacccctgaggcggaatccgccgccgcggcctcctacctcgtcgcctccgtcggcctctccccggccgccgccgccaggatctcccgcaaggcacgcttccgttccaacgccgacgccgaagccgtcgtctccctcctccgcggccacggcttctccgacgccaacatcgcgcaggtgctcccaaaaatcccgggcctcctcatcctcaacccggacaagatcctccggccaaagctcgagtacttcgcctccctcggggtggtcccctcggcactgtcccgcgcacccctcctcgcgcgcagcctggagaagcacctcgtcccgtgcgtcgagttcatccgcggcgtcgttggcaccgacgccaacctctgcgcggccatctcccggaacccctgggcactctggtgcgacattaacagcagcatgcgccccgccgtggaatcccttcgccgccacggcctcgctgaggcgaacatctccaggctcgtcgtcatcaatctcagcgctctcacgatgtcacccgaccgcattgacgggatctttggggacctggaggcgctcgagctgcccatctcgcattcgcgcttcgtgtacggcttctgggcactgtccagactcaagaggggggcatgggaggaacggatgtccgtgttcatgagatttggggtttccaggagcgagttgctcaaggcattcagggagcagcccggtatactagtgttcacagctaaaactatccagcggaagctcagtttctaccaggaaaagctgaaggttgcaccggcagatgtgattgcacatcctcttctcttgacgttcagcttggagaagaacatcatacctaaatgtgccgtgctgaatgtgctattgagggaggggaagattaagagatatgggagagagatggacttgttgagacccttgcagcgtagcaatataagtttctttgagagatttgtgaggaagtatgaggaagatgtgccagatgttgtaaaagcgtacgaggggaagattaagttcacgggattcatggattaggatgtcaatgtttgattatgctgaggccaaggcgccagctttctagggtgtattctctgtagcctgtaggtaaggctaaaattgtcgtcaaattaatgcatattgcttcctccttttttttgaactaactaacatcatataaatgaaaatggaggtaatacatttttacattgtcttgccatgcaatcttatcatatcctatatgttggattacttttgctaccgtagtacaagtaactaatagcatcatgagaataacgaagttgtgacatgttatttagcctttgtattttgtagttttgtggtttatatgcacttagagacacaattgctcttaccctaatcttcactaaagggacagtacatttatcttttatggatagccaactcattcaactgtctgtgctgaataagctaatttcccccctcctaataatggtgtgagcagagtattttcactggcacttgacaaattccacttctaagttatgctgctcaaacagtatatattgttctgtgaaatattatgacactgacaactcctttttagagttaagaccctgtcttgtttgaaattcctttttttttttcatttgtgaagcatgtcctccccatacagaatttgtttcacccaatggaattgacaaacttttcttaagagttagacctgtcatgtctgaaattcttatttataaaatatcatcctcctgtaaaatttcttcaccctcttgacttttgtaagtcttcagaaaacatgaaataactgcaggtccattgtcctgctatcttatccccttttatccttgttggtaggctaggactccattaatttattttatagaaaaacaagtttttttttaatcaaaggagccctttgtaatgttctcatgaggcattagaacttataaagttctgtggcgaacttatttgaagtttgtaagtgtccataatgatgctcagtggaagttttaggtcctgaaatgagtatccatttggttagagttgatggcataccattggtacttggtatatcaatagtctgaactgttacatgccatctgagtattcgaagctttattgatctccaaaccacatgtaagtttagcttcaatatggatcttatacatattgcttttccgttaacttgggaggaaagttagtcttgtttcttcacgcttgtagtattgctgtaatgattgttgaaacttatattcctaaaagtaagataactgttaaagtttctagcctcattttcaacggtggttcttaactttttcttataagcagtgatacatgttatgcgtgcgttttcactggatatttgagtggtaaatgcattattcacttattcacacagtagtaattcatgttttgaaatgtgcttttttttttttggttgctgatgatttgaaatgggtcttcaccaatttcattattggtgccttgtcaattttaaggattaatgctgcaaggtcagtggttccaaaaggcaagcgtctactgatgctccttgccgtagtgactgctaaagacagttatagaatcaaactctggctatgaatctgaacaaccatttgtctagattcaatgacccggaggcccgtacgcaaaaatcggttttggttgtctggaatactagtacgtattgtaaaatactagccctccgttttatattacaagtcgtttgacttttttcctaatcaaaattcttttaagtttgatcaagtttataaaaaatataataacattttcagtacaaaacaaacattgtatcaaaatatattcaatgttaaatttaataaaactaattttgtgttgcaaatattgctagctttttctatacacttggtcaaacataataacttgagtaaattttacaatgggccacatattttaaccaaggtttcataatggactagggttaaatcaatgttttcacttaacaccatacatctttacataagttttcagtttgaactaggggtgagcaaaacaaggggaatatgtgagagagcttcatatgatttacacagggataattataaaaggcaaaacactttatgttttcttccttttcatgtgtggtagttaactagttctattttctattttatttttattcatttaccacaatgtatagatcattttgtgccacttttaaacatgtttacgtcattattttagtgtgatttgctgaaaaaagttatttttagatttgctattttttttctaaagatatttatcttaataccgtggcactaaaattgatgattttaactatcttttctctggcaacttccttctatgtgctcaaccctagtccaaagtgccaactagtgcaaacatatatggtgtttagtgaaaaggttggtgtggaccttgcctattgtgaaactttggtcaaaatacatgctgcaatgtgaaatttactctaataactttaattaagaaaaaagtcaaacgagttataatatgaaatggaaagggtgaaactttggcaaaaactcactctttcattcagagattggtattttcagacataaggccttattttgtgttaaacaccgggggacccaaaatttgtaggtatggccatgcatacttgggaacggggcaaatgccagcactgctacatgctagccgaggcgaaaattattgcaggtcgtctgccgagacgggaggtatgaactgaaccccagccgcgatgcctccaggtcaaactccagcaggttgtcctccatcatgtgcccaccgatcacaaccgacgtctgcggctccgtgccggcgtccaccacgccgaggcagagcgcgcctcccttggtggccaccatcgagttcgccccgaacacaacccacgaggcacccgtgctttgcagcaccagctcgatggtgggcacgggcggccccacgcgcgtgctccccaccttcctcccgtcgtagcacagcttgaacggctccactgccggtgctcgcgggatcgcggccatctccttcgcgaacgcgtcggtcaccgcctggtggatggatctctccagcacggtgtagggggacaccgtgcttaacttggtgcccgccacttctttcttgtcgatggccagcagcgtcgcgtt

SEQ ID NO: 64001 - DNA, 17509 bp, Oryza sativa
ggcatatgtgaataggagaaagcaccccctgctggaccttttcatctaagagcaaagatagtccgtcggccaggaacaggaataggaagggagataagggatctccttgacaaagtccccgagatggagcaaatgaatgaagaagggttccattgaatttaaccgagtatctcaccgtggttatacactccataatccatctaacccaccggtgagcgaaacccaacttatacattgcctgctccaagaagccccaatccaccctgtcatacgctttcgatagatcaagtttgtatgcacttgctgctttgtttggattcttgttcttctggatatagtggaagcactcaaaggctagaagagcattatctgtgatcattctaccaggtacaaatgcactttggttaacagatattaattcatccaagaggggtctcaatctgttcactaggcacttcgaaaccactttatagatcacattgcacaggctgatcggtcttaagtcttttagttcagtgggttgatcaatctttggaatgagcacgattgcagtgtcattaacccccgctggcataattcctgacctaaaaaattccttcactgccctcacaatgtcactcttcaagccaccccagttcctctgatagaaacgagccgggaagccgtcggggcccggcgccttaattgggccaatctgaaacatagcaatggccacttcctcctctgtaaaatcctcgcacagtttatcattcatcttagctgaaaccttagtttggaagagcctagtaatcttggactggtccaagcttggggtcagcagtgtacaacttctgaaagtaatcagttgccattctcttcatttctgttgtcgaactgtgaacagttccctctgagtcccgcagcttcaaaattttgttctttttggctctccacaccgctcgggagtgaaagaacttggtgttgcgatccccttctttcagccagctaactcgtgaacgctgcagccagagcatctcctccctatacaacaaatcattcatgttgtcagtcacttgtcgaactgttgccccatcagcgtttgcctcaaggaggttggacaaccttttccgcgctctctccagttcacggccaacgattttgcatttggttctgctctaggagtgaagtgctatcattactttactgagagccttgttaatctcccccagatcctcctttgtcccatattcactccaggcctcacctatcacttcagatattgctgcttccctctcccaaaagatctcatactgcaagcacttcttcctcccttgggtccgagaatcacccgacaattgcaacacaattggacaatgatcagagcaaggggacactaagtgagatagttgggcattactaaacacatctctccaattgttccacccctctcttttgttatcataagtatgaggcagtcctctaaaacccaggtcatgcaattcacagctatgtaaagcatctcggaaagctctcatctgagactcatttctaggtctcttggagaaatgctcgtattgccacagcacctcattgaaatctcccataaccaaccatggaagatcagaggattgccttatatcttccaaaagggaccacatacgatgtctattctcaacacaaggctccccatacacaaaagtaacatgccacaaaggaccatccacagtcattctcacatacgcatcaatatgtctttcattcatatttaaaacttccacataaacagtctcgtgccagaaaagagcaagaccaccgcacattccttcattactgaccccagcaaaacctttcaaacccaatctattacgcaaatgcctaattctttccactttttgtctagtctcacataaaaacactaaatgggaaccaacctccttaaccaaggtacaaagatcacgaactgtcgtggcgttcccaataccccgacagttccatacaagcaactcatttctcctgacgggatccaatcacagatcccgtcagtttaccagcagcccccgagctggttgcttccctgtcttccacctttatgctctcccctttctcctttttaaacctcttcaacgctcgtggagtgctgctaggagctagctgaagctgtttactctcctccgctgccttgccatactccaagagtgcttgcttgactctgccagaatgcttgccatctccctgctctgttgttcttcttttgtgttgactattagtttcatccattgagccctctccaaaggaagcttgctggtgcaggttcttcatcgccggaatcatctcctccgaaggtagctgatcaacaactatatcagtgataacctcccgagacaactcaccgtactgttctggacctgtctgtgccgaaacctacaaattacgggccttctctgcaagcagttgatctatcttcccatctcctgctttctccttggactcaaatccatcatgtgcatccaccctcggtgggatcgcctcatcccattgctcacccttcttctgtctggacgatgtagagcttgcactaccagcactcctgaaggacagcttgtgtgccacacctgaagactgcactggttgtattttactgatcttcctctcaaacggtttcaaaggggagcaacgcaggtctgcagagaattggaagggttgtccacctgtgagtagtttcttttcgcagtccttgtctgagtgaccgataaacccacagatgaagcagaagtggggcaccctctcataccgtaagtcaaaatgtctgacaacctcactaccttgctccttgatcttaatggcaagctttttccggagggggcgcttaacagggagatccacacggatgcggaaaaaatcatgtttattacggccgtcattctccacatccacctcccgaacgtgaccaagcttactaccatagagatttcctctttccctcgtcatcaacaccaagggcagatcatagattctaacccagatgggtaccacctcaaaaggtacctgcgacgggcttataatcccatcaaattgggccaccaataaggcgtcccccctatgcagccatggacccccttgaactacaaactgatagtcaccctcagatgtaaaggtaacgatgaacagattatctctgagcgacttataactcataccagatttcagcctccatgctctgcgcatatcatcaaaaagagctgtggggattggtgtgcgcattgagtaataccttgataggattgtccattgacccgcaagcttgacttgttcatcttcaagattcacctcaattgcatcttcttcttcctcatagacttctccctccgtgaaggttcctggaccttcagtgtagaaaccttcagcatcaccctccagggtaccatgggaatccctatcccgactgccttctccaacctcctgagatgcaagtaccaacgccgaggccattggtttccccttcgccgatggatcccccggcggctgttgagaactttcgatcacaacttatgttgttggcttcggacgggtaatcatcttatcgaggatccttttatcacccccaccgccaacagacgccatgattgtacttttacagcctttccaagcaaaccctaggaaccgaatatggggagatatcttcttggaagacaggaggattgaccgccccccggacgaccctcctcctgttttatatgatagaacctccgagtccggatctttgacgaacttccaccatgggtaccaaccaaaaccatatcttctttgtattccatatccaattactgcaggtttgttgcagatatcccataatcgaacccaccctatagatgtatccttatctgttctggacaggaatttcagcgtttggagattgaatgctgatccgatcaccaggaacaaagttgatttctccgtagaaaagcagaaacaagaacaatccgaaagcacgagcgaaagcccggccaaacttaccatcagatcggagtagaactccatccaaatccatcgctctccacgaacaatggccgccgccgtccgatcactcgggcgtcgccaaaaccctaacatccgggaaatcaggatatatcaactaatgaatagttttttgttcgtgatatcttgttatatagatttaattacaacgaatgcaacagtgcaatcagattgtaaattggataaatggttttcgagaaaaaatagtttgaagcttgtcactatccatgtacctctctcatttggtacataaacttttcttgttgtcgctcttctctacatgcgtatgtaatagtttttttaatcagatggacataaaggggtggatgtggatccaccagtagaacagacgtccgacgaaaacaatcgcatcgtacgtccgatccgtagtcgtctaaaaaaaaaagaggaaatctcacctggacgttgtgtacttgtgtcggagaaatgcttcagcgcctcaccgttgacagcgccggggcggaagaccaattctagccgcacgatcagccacgtggcggagatctaacggccacacctcatcagcaccagaaaaaatagctttagcttagcgacgagcgcgcgccaccgcccgagcacgagaggccggccgtttcccgccctaaaaaaagcccgcgaacccccacaatatataccgctcccgccaccgccaccctctccctcgtcgcatcgcaccatcaatcaatcgatcgatcgatcgcgtcgccatcggcaacgccaccgcacgcaagcagcaagcagctgatctctcgctcgatcgatcgatctcgggaaacttggatttatacccatggcgcctcgcgcagcgctcttcctcgccgcgctcctcttcgtcgccatggtggtagtgccggtggcgagggcggcggaggagtcatccgccgagtccccctcctccgagtcctcctccgagtcgtcgtcgtcgtcctccgccgacgcgccggcggaggggcccgacgggccggcggcggcgcccggccccggcgaggggatcgacggcctctccgacgacaacgacgacgactcctccaactgagcccggccggccggccggcctcgtcgacctcgcgtcgtgaacaatccgttaatttgattgatgatctggagcgattaataaggatatatatatatggtcgtcgtcctgcgatttgattacaacttgttctctcctcgttttttttttcggatgaaattttctcattctctagattaattagtttgtaatcgcagcctatcgtatttgtgttctttggacttcatttctcctgtaacagtttttaattgttgtctactaatttgagatatggacagttttatatttgttctagcatatttcaaagcacaagtatcaaatagcttgccgctgtattgggccgatataatgctccagcagaagctcgcataattcggcctgctcgtctggtctctgcttgaaagcccaatatggcacaagagcccataggtcggattacaggatttaaatttaaaattcgtttggaaaataacacgcgtgcctgcagcctgctgctaggatggtcgcgcaaaaaacaaaaactatctgtctttcgatttgtatgagctacctatattgttacattggatcgtgtagttgaaatacgattatgcgcaatccaaatccactcgaaattgatttttaggcgatccaaattcatacgagtacattcggtctgttattcggatccgcgccatcaacttcaacttacaatgaacggatttaggttaccattaggaggcctttctcggaaaaaaaacacacctaagtgtcaggcggtggcatgacctatgcaagatttcgtagatttgcgatgagtttttttttccttcaaaatagccatcacgcataagcctctccaaggagccaaaaacaactgtgaaaatggagaaaaacgcaatcgaagaaggtgttactggctctggtatatcatgtttcaatcaactgtttacaaccctggtcatctacaattcttctcgcaaacgaactccgtgatggattggacattttctactatagtgcgcgtcatcgcacacatcatattggctaactcttccgtttcaacatacaaatagttctatagattttaaaaatacattaagatttagtataaagagtatgtgactgtcaatattgtattcgtttatggcatcccgtctccctagttacgcccctattgtcatgggagtcagatctggtgtcgtagtatagagtttgtgccgtgaacaggaggtagaggaagaggccacgagactatttttgtccaccaccctcgtcgataacacgtgctcaggttggatccagtggcaagaaggatatcaattgctaccgacaattattagttgataatattaaagtatcggatctgatacctaacaggtattatatcatttggaacatagacgttgtgcaatagcaaccctctaaggtgtttaacatgtgaagtggagagaatagtttcttgtgcattatgacaacaaaagatgataccataccggagcttgctaaatccttctctacgctgcgcagtggctctcactcgcgacgaatgtttccaaaaggccagcttcaattcttactatttactccgatctatttcacaatgtaatactttctagcattatctacatcatatatatattaataaatctaaacacatacatatgtttagattcattaacatctaaataaatataggcaacactagaaagtcttacattgtgaaacggaggaagtatcatgcagagagttaagtcgtcgttgatggaccgatctttagttggcatagtgattaattatgtttgtcacgtgtcgaatgtcgcaactcattttactagctcggtcttgtgagttgtgcgcattctagtaatggtatctatcgtaatgttatcccagagtgtgttcggagacactgtgtaatgatttatcataatcaataaagcacaacttcctctaaaaaaaattaaaagttttatgattaatgatcgtgtcctcgttcgtagcccttgacattctgcacgtgcacagccacatcaaaaatcatgatacatcatacctgccatccacgcatctaatgctggcatatgcctgccatccacagttaattaagttagggttccaaattttttcttcaaaattttaacttttccatcacatcaaaacttttctatacataaacttcagacttttccatcatatcgtttcaatttcaatcaaacttctaattttagcgtgaactaaacacaccctatatgctcatgaatgaaacttttggtttccctattattttttttaactttttgttcagccatactccattaaaaaaaatcaacgtaggtaatgatttaacaccacctaatttattttgaacaagctcatatatccaattcattagacggttgtatcatatcttcacctaaattagtactccctccatatattttaatattttaatgtatgacgtcgttgactttttaaccaacgtttgaccatcgttttattaaaaaaaaattgtgtaaatatgaaaatttttatgtcatacttaaaaaacatttcatgatgaatcaagtcataataaaatatattataattatataaattttttaaataagacgaatagttaaacgttggaaaaaaaatcaatggcgttatacattaaaatatgaaatatagaggtactacctcagtcccaaaataagtgcaccataaatatccgtgtttagcgctttgaccatccatcttatttgaaaaatttatgaaaaatatttaaaaaattagtcacacataaagtattattcatgttttatcatctaataataataaaaatactaatcataatcttttttcaaataagacgaacggtcaaacgttgaacatgaacagtgctaaaactgcacttattttgggacggagggagtagtatttttttagagaggagtaagcattaccacggatccaccgggtgaccactcattcagacaaaccaagttaatccgtccttcccgcttcgcacgcgcgctcgaccacccgcgcgcaccggcgaaacatacggcgcggctgctgcacgcgcttcgcctccgccctcctcctcctcccattccggcgatctcctcgccgcccagatatacaccaccaccaccctccggcccgatcgaaactggcattgcgatttgcgaatctatcgacgccaccgatcgacctacgcctgcaaattaaattccgcagctagctagcaacaacaactcccgaccggccgcggccacgacgcgcgcacggacggacggacgacgacatgcctcgcgcactgatcgccctcgcgtcggctgtcctgctgctggtggccgcggtggcgccgccgctcgccgccgcggacgacggcggcgccggagtcccgggggaagggaagctggagagcgcggggtccgcgattaagtcggcggccgccaacgcgttcggggtcggctccgacatcggcggcgtcccggtcaacccgtcgccgggtggcgccaacgcttaatatatttacagtattacagtggctgtttccttgtgactttaatttgtcagagtttttggaggccatttcattccatatatacctaattaattactacctaaatactagtatatgtaattaatcacgcttgcttgtgtgtgtctgatcaatgttgccacttcttgtctggttcagttgtctatcatatatacttccaccgttttttaatatatgacgttgttgactttttctcacatgtttgatcattcgttttattcaaaaattttatgcaaatgtataagatataaatcacacttaaagtactatgagtgataaaacatctcataacaaaataaataataattacgtaaattttttgaataagacgaatagtcaaacatgtgagaaaaaatcaacagcgtcatctattaaaaaacggaggtagtatcaaataaactggatttgtatatgaaaacacgttcattttatatgggtcctctataagtaaacatgatagtaatatgatagcatatcagaaacatatattttttttaagttacggggatgtcccctcatcacttttcaaatacaatctaaatggctatgtaaagtatctcaaaacatttaataacgttgctacaacatacatataccactccacaattttaaatctaaactcaaactcaaatcatgaagagaaaaagaaaaagacatatccacgaatgaacatttatactattcacgcctagatttttccttttctctctcaacatgtagattgatctcaaacttagatttggtggaggaagatatcactatagacttatacttttttaattttcttttttaaaaatactccctctatcctaaaatattactcctgactgtttcattgaatttgagagcaaaaaaataagtccctctctttcaaaatactcccctttgtttgaaaataattattgtttcagagaaggacacaatctctaaaaatataactttggtcactaatttccgttataaatatcaacaagaatatgtttttattgaagtacttttaaaaattaacctttacctatggcctccatatttatatggcaaatattttggaaattgttttagtaaaagttttaaagttggctgttagctagtcttgtccaaaacgtggattattatcaacttgagtgagtataagcatttctgtctatgtatacaaggtcccaaactataagaactactgaagatgtatatggacacatagaattggtgtaatatatcaaaatacatagccataaatgtatattttcagacaatgaagaattcataaccactttcattgaagttgagaggaaaaaaatacatctattctataatataagtatttctagacatgtatttggacaaggcctaaaatataatataaggaatgcttatatatattataacaagagaaatacacgacatccggttggagggattcgaatccatttcccgctcgagacggagatggattctaattgctcggatgaatgtctaccaatttattgtatatcaactaaatgattatgaattttttttagaaaaaaataacaaggtagattgatatataacatatcccttcatagacatacgatttgaaattcaaattatataaattgtagctaaaatattaactttaaccatgaatatacatatactatttactggttatagtttgatttctttttttttctataactcacagaaaccgaatttgaacttgcattttttttcatttgtgaaacaagatattacatacgaatttatcttatcagtttttcttaaaattcttttataactgtttagttgtcatgtaaaatttcttttcgcaaatgcgttgaaataaaataaatgggtggatgttaatgtaagtgatcaaagatgtttacagcccgagaccactcatgcaatctggctccggcacatgcatgcaattgccacgccatgctccgtgaccatcgggtcaccactcaccacttcaccagacacctcgcctcgtcctcgccctcgtcatccgcacatcgctctaccattctcgctggcttatatatacacagactccatccacgacgacgacacacatactccaccaacgcacacacatcgaccgcgcccgccgcctgcagccgcgcgcgccgtcgccgccacacgaccggagagcacacatgtctcgccagcaggcggcgccgccgctcgccctcgcctccgcgctcctgctgctgctggccgccgccgccgcggtggcgccgctcggcgccgcggcggacggcggcctcgtccagggcggcggcgaggtcgcgaggtcggccgcgaacaccctggccgtcggcgccgaccccgaccctgcctccgccgacggcatcccggccgaccgggcgccggacgcccacggttaattaattaattaatcatcgctgattcgatcgtctttaatttgttggttttacttttatttcttttttttctgtgtgtgtgattgccagtgtggtgaagctactacaggctatatgatccaagagatgtagtacttaagcttgtgattgatcactacttcctccgttttaggtttcacggtgtaagattttctaacattgcttatattcatatagatgttaatgaatctaatcatacatgtgtatagattcattaacatctatataaatatgtataatgctataaagtcttacatagtgaatcggatgaagtattaattattatgtatgttatagtgggcatgtgccatgaaataaactgatggaagtgctctgtaattcttagttcgatggattttgttcgtgtttatgatgttttggtccttttggatggtgaatgtatatatagtggatacaatcgaaacaagcatgcgtgtatgagtgcctctgtttagcaaagtgtgttcagacaatatttttgttgaaccatacccatatgtaattaattttaaccattggattaatattcatcagaaaatatttttaaggtaaaccacgagaaataatctcgagaacaaagaggtcctacttaatattaggaagaaaaaaatgacttaattttcttaaaaaagacccgaaaagcatataactgcaattaattaaaagaatccagcaaaacctatacggagagcgaaaaatagaacaaattaatgttgccaagctagtcgcaaaacagacaagcaatacatactcctctaggaaagcataaaaatataaatatatgcaagtgaacacatttgaaaatacatggaaaaaaggtcaacaaaaattagtgattgatttttcatactggcgtcgagtgataggtcttttcgaaaatgcttaatctcgagcgttcgacgtgggatgaaatatcagacgcatcattgagtgggtcccagcaccgaaccaatctcccaccttttcctcccaatcctcgaacttatccccattcccttctctcgcatctcactctcttcgtctctacctctcgctctcttcgtcttcgatgccttcccgactcccgagatacgatagtaggaggccggcttcccaacctctaccaccaccaccggcctcgtcaaccggttcggtctctacatcctcgacgtgtggttggccttgcagctggtgcccacgaagaagcaaggcgtcatcccgaagacgcagtggcgacgacgctagacatggccgccggggatacctgatgttgatgcggttagtcctagacgaggtcgcccacttcatgccgctagtcgtccgaggagcagcaaccggagttgacaaagaagacggaggtaggtttaactttgtgttgcactttgtgtattaaggtgtttcattttgttttgattcgatgttgcatatattgattcttgatgttgcaatcgatatgttctaattgcatttggttgaaaccacctctgttgaagcgatgaaacatttttccctgattgatgaaacatctgaaacatttttcatcgagaagtgcaacatgtaaagcattttgcaacaatacggtgcaacaccgtttgatgttttgcaaaatatctaaaacatttttctctgccagtgaaacatttggaacatttttattgaaatattttttatcaagagatgaaacatgtgaaacatccctcaacaactcggtgcaacaccgtctgacgatttccacaagatcggacatccgatccgtagcagcctccatgtctttttcgaggagagagtaacgtattgcttcagagagaaatgtgcacgccatgtgaggacctaatgccagcttccatccacccaagcctccatgaatcccatacacagaaggagcgaattctataacagcggcattatccacgagctttactacttaaatggccttccactgatacaacactggccttttctccttttaatatgtgaacaaaatcttttaagtatcatatcatattctctcattgatcccttgctagatgctttacgtatgacacatcctgaaaatatatatgctttgcacatacgacgacattcttatgtgtaaagtgatggtgtacaggaatataatacactgataattaagcatggtgctggtgcagagcagactgtctagttagctctactgttaatttctcagcgatctgtatatatagttggattgctgctctcaccttgtgtttggctgattggctcatctctgagtcattttgtgatttactattagattgctatactttacaatacccaagatgagatctgaagtaaattacacgtttgagctcgccaaggttgcaagtgcatgggctggcataggattatgaatggatggtgcagatttcttctaatgcaatttactgtagcatctctgcattttgtactccaatgcagaggatcccaatgcgggctgcatgcgcatggaagaatgaagtatgaactatgaagaataattcttgtaggctaagaccagtgatccttgaggttgatgatggcggtttatgacaggaagcaactgtgcattgagccatcgatcgatcagacgatcacaatgacaggaagcaacctgcaagacttgatctgtacacgaaaacggcagcgggcaagaacacaggaaataggatttaccgcatgcatttgtctttaatcgacgagttcttgtatatcagagatgaaatggcaatatatcgaagtcttgaaccctctttaccccctacatttcaatcatgcagcgttgcagatcttcatgtttgtgtcctccactcgaccactcgtcctacgtagtgttctgaagaatttctgcagaccaccccttcatttccgcttctctgcaacttcaggtgccatttcttctgaaaatgttggcccatttgaattttaggaataaaaaaaaaccataggaataggaaaaacagaggaatctgacaggaatgaaatgcaaaacagagtattgcataacacaggaataaccgtttgattggatcataggagaaacatagaaatcaggtgagagagatagactcgaaggaaattttccaagatgttaaagctcttgctaaatttcctccaaaatctctataggattgtccattccataggattttcaaattttttttgaacgactcgcacgagacggtgcgaagttctattgatagagcatggaaaaattacaagattacaaccctggagggtcgtaaccaggaaaaaggaaaaaaaaaccaccacccactcaccgacatcgccaacacacaaacctaggagaaggctagcaccggaccggccgccgctaagcgtgaccgaccgccacttagaccaacaaaaggacatagacgagatcgccccctaggggatgccaaaacgacgtcttcaagaagagaagcgacggaaaaccgccaccgccgtccgtcggggctcaaaagagctaagactgggctttcgcccggcaatcacccttgaggggtgagacagcacgacaacgccctcaggagggggaatgaaccatcgttgtcggtccgaccaaggcctgactgggttttcaccgctgctcaccacctgcgaatccacggctaacgcactgatgctccacctccacacaagctctgccgacatgtgggacccctgcaccggcgacccttgccggccagcctttgtgcgccaaagaccgcgccacacccaccggcagctcctccacacacctaggtcacctcctccactgccggccgcgcctctcgcgccaagccggcctcctccaccggacgcgcctctcgcgccaatccggcctccctccatcggccgcacctctcgcgccaagccggcctccatctccgccgcccacgcctctcgcgccgagccggcctccgctgccatcggctgcgcctctctgcgccaagccggtctccgacccctccaccaaacgatgccgcgccggccagatgcagtcgtctcccacgccctcggctagccgtttgaggccgtcatgcctccggtgacggtcaccaccaccgcagccgctgctgccgaacgcccagccacctcgcagtcgccatcctcacctcgcacctgactccttccccgctgccgacgtcaccactgcctccatagtcatggtcgccgtcgccgctgccaccgacggcagccaccgcctccacagaccgccactgtgccgtcgccatccgccaccaagcagccagcaaccgccccgacgacgccgccgccggcctccacgccgtcgcaccatcgccaccagccgctgcctccgttgcccgctcgccccgacgctggccgcgcatctaaggatgcacccaccgccgtctgtcatcgtccagccggatccggccgtcacggagtcggacctcgtccacctctgctccaccgggcaccaccgtcgccgccgccaccagcaggccccgccgccggtcacctccccgccagatccaggcgtggatctggcggcacttccaccgccaccatctctaccaaccgccgctgctccctctcccatgcgccactccctctgccccgccggcgacgcctcctccgcccaacgccgcgagccgccatggcctccgcccgctgcaggaaacggcgccgccgacctccgccctcgggtccgcccgcgtcggaaaccggaggagcgagagctgcgagccccgctgccgccgtcctggcgagacgctggctttgccggcacctcgctcgagcggcggcgaggcaagaggcgagggtggtgggttgcggcggcggcttgggctgtcgccgcccgtgccgccctcacggggaggcgacgcggggaaaaaaagttagttataggattttcaaatgatagaatagtatctgaaactcacatgtttgttttactaattgtatgatataacctgactacaaatttccaagaagtcccagtttctcaaccataaatagttttatcaggttatgctagtgaaccctgatatctaacaatgcaatgttgtaccgcgtggtatgcacacatagttcaccttatgttattgaaattgattgttcttggctagaggtaaacttcaacctggatagataaatcttatgcatttgtgtctcagtaatggattcttgatagattacattagccttgaaaccctgctcggtaagtcttttcaaatgatagaatagtatttgatactttatttcaaagacatttgtaggattaaaatcctccaaaatttatatgttttttctccaaatcaaaggggttaactctacccggcatgcagtgaccctgtgtgtgattcctgaattcttctacagtgacatctgaaatttattaccagtgttgtcccagataacaagaagcaggtactattccaggtctcaccggagagacgacacgatgaagaacaactccagtgttgtgccttcttgcccgagatacgtcggtgcacacgactgctagctccatccatctccatcgagatgtgttgaatttgctagtaggaaaaagtccacttgaggttactcatagtgtggttgggtttcaaaacttgtctttaaaccgaaataccatataaaacatctctggtcttgggtcatattaggttgtaagcattattgctcctggttttttttatattgggtacgacccaatatgattcgattttgcaagattagggatgcattatatatgggtattccgggttaacgaacgaattttgaaactcgacgaaacgatgaggacctcaaaagtaaaccttttccttcctgaaaccagtggtagacattcaaatatgggccggacaattgtctcgcgtagaaaaaccggagccgttcgcggggcaccgagatgggccgcctatcacggagaggagacggtccatctcgggcgagtcgagcttatctcactgacaggtgggtcccacgggacagccgaacctccagcctctgccgtccgatcacttccccgcatcggcctcgtccccccctcctccccacacatcctccgcaacgcagcggattcgccacagatctctcgccccacgtcgccgccctcctctttccaaattcaaaaattcccgatcccctcctttcctccgccatctctctcaaactcaaagcatcggcctcccccttggccgcctcctcgaatgcccaaaccctagcccgatccagccgccgaccgacccacctcgagggagcgccatggaggagctgttcatgcaggtgttcgaacggcgggactgggtggcggcgcagttgcggcagcaggtggagtcctacgaccagtccctggcttgcgcgctcttggcgccggccgcccccccccgccgtggctcctcccgtcgcgccccgttgcgccgcagggtgagttgcttgctgctgctgctgcccccttttcctctcgctcggttccattttccgtggggtttgggtttgcgattgaagctaggcttgggcaagttgatgggattttttggtagatttaaggtggcgcaggcttaattt

SEQ ID NO: 64002 - DNA, 8041 bp, Oryza sativa
cggtaaagtcatggtcctgtacgccggtgggctgtatgtgtaaaacatggaaaagttctccagaaaaaatgaaaacgtcggtgacgtctacgcagacttaactctgcagggcagtacggtgctgctgctgctgctacggaagctgtggatctcctagttacgccagccaccgttgccatcatccacagtgctagtggtacattttgtactctctcctcgtagtagtagcatgcagcagcaatagccacgggtactgcacgcggcgtcacggacggtggatcgaatcgaccgaacggctggtggtggcgggggcacggaaactactgcagcgacgcagggggaagcagtaaatggtccgaagcttaggtaggaatgaaaaaaaatagaaatagaaaaaacaaagtgtaaaacagataattgtaaaacacggaaaaaatcatcagattggaccgaaaaaaaaacacaagaatcagatgagagatatactcaaagaaattttttcaagaggttggttctcttggtaaattttctttaaaacttacgttcaataagctattacagataaattttatagaatttagaaaacttcattcctttaaatcaaatgaccaaatataaaaaatgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggcgcggacagatcccgagctcacaaaagggaagcggaagccaagacttggaccaaacatcacaggcgcgactgggaactaggccgaaaccctaaaactcatcgtagccggcttgctcctggaagaactcctcgtcagcgggatccgcttcatcttcttcagcaagggtgagtacaggagtactcagcaagccatgggaaataagtgtttaatgcaggcttcaaagaaaggccgttgtttttgcgattgattttatttaaactcttttttgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactatgctaggaatcacctcacatccgcccatgaccgtgggcacggctgctcgaacagttttaataacctctgcagagggggcacactttacccacacgacattactaacccggatcatccagcccgtgcagaacggccacgactagagaccttaaggctttcatgacaaagaatttcaaaagccgacacaggttcaccatatgccaacgagaggggtcccagaccaacaccagattaggtcccagaccatactgtgccaggaagccaaggggtcctccccgacaccaccccggcgaatccacatgtctcttagcatcatggctcccccgataagctagttactcagccagaggtgtcccattccacccatgtggtcgtacttgtcttatattcggatgaaattccaaggaaacggtccttaagtgcaagagcgggaaaccgtacacccggtacgttcctcggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaatgtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaattttggaagttgaacggagtcaatcggacttacggttgggaagatattgaatttctaagattattggatttttggtctaaaggaaaaggatttatttaaatcctttttgaaaaagaaaagaaaagaaaagaaggaggcagggaaattagactttcctcgggcggctagggcgcggcccgagagaatggggcggctcggccgagcttaatgggccggtcggcccaagaaggcggcccaaagcgcgcgcgggggcggggaggggagagagagagccggtgggccgggtccatcccgcgtggtcccgggtgggacccgcttgtcggcgactcggctcaccgtgagcgaggtgcacgtggggcatgctagggtttggggagggaggcgcggcgcatgcgcgcggttcgtggaggacgcggtgcggcgggcccacgcgcagcctcacggctcgcggtggaccgcgtgcgcgagggggctgtcggtgacatgggaccgggagtatcatgactagaggcttgggcagccgcgatcacccacgtggcctgaccccctcgggggggggtcgggcccgagggtgatgtggccgcccctccctttgttctccccgaggggtcggaccattcccgtttcggccccgagggccggggcgccccgaccccctgtgggtttggcaccacgtatatgggttaggtgagcacagcggggctcacctaaccgcatttattgcgggttggatgagcgcgtcacgccgcatgtaatgccgcgcagcgagctcgcttatccggtccgtgaccaggcgcagcgtgtgaccggtcagatcgcgggttaggtggtggcaggtggcctgttacacgcctcgccccgtcccgtcggaatgatgagagcctccaggcacttatccctagccggagccggcgtgccaactcctggggttggcacgtcagccccggccagatacatgccaggcttcatcccaaccattacaaggaagtaattgtatgaagaagggcagacgtgcggcatgctaaactgacacatggtggacaagaatgaccggtctgtgactggtctgacaccggtcacgtcatcggcaaacaaactgtgctcccacattgcgtctgcagccggcggagtggaggtaggtatgacccgtcccatcgaagggtcattcggacaacagccattgcaaatctctgcccattaatgaaggattgacaaggtgatcccctgtgtcaggcgagtgtcggcgctgggtctcactcaaagacaagctatgacttagcttctaggagaggtggtgcatgtggtatccccttgagatataaaaggaggaccttgcccaccggaaagaaaaaaaaaggagagaaaggagaagacgatagctgatagaaaacaaagagtagggagagggtctctagagttcaaacgctcttgctctccacctctttataatttcttcatacacagatccaccagaacacaggagtagggtattacgcttcccagcggcccgaacctgtctagatcgcccgtgtcttgtgcatttgctctctcgcgaaccattccacatatcgagggcttagaaccttactcagcgcccccggccgaaccggcaaaggggggcctgcgcggtctcccggtgaggagccccacgctccatcaggggcggagggaagcggcggaccggggtctgcttgacccggtcgcggccgaggtggcaccgacgtggcgcctacgtggctgccacgtgggccggcgggaggtagacgacgacgccggtcgaaacggacggcggacgacagcggcgagcggcggagcgaaccatggcgatacaggcgaaggcgagcacactgggatgttgcacaggacgaggggagacgagccaatggctcggattcgccgggggatgctcgacggcggcggattgcggcggcggcaaccgacggcgggagaagggggaaacagcgatgaggtcacaaggggccgattcccggcggtgagagcatctacgcggctacgggaatccgttgctagcgtcggattgggcggagctacgccgagcgaggccggcgacgagcgggcgctacggagcacgggcggcgacggcggcgagcacacagcgagcagcggcaacgatcggggcggcgccagctagctacgggaaggctacacatgctactaccgaaaactaaggggaggagatggatcgaggagggagaacgggggaatgcactaccgagatgaggcggggcgctgtgacgagaggccgacggcacgggagtgatctctccggcctcgggccggggaagaggaagaaggcgagcgcccggagtccccttccgtgtcctcgctcgtgccggctcctccgacacgtgcgacggcgaacggcgacagcgaacagagcacgggaggcggcgacaatggagtggaggcgaatgggagaggaaaggaaaggggggggaagcttgggtttatatgggcgacaatgtcggtttgggagaggggaaccgactttggacggtcaagccagcgagctggcgctctggctagcagccaaatcggcgacagggaggaggggaatgacgccggcagaggaagaaaaaggaaaaaggaaggaagaaagggggcttgccccttgccactttgggaaaaggaggaggggatgggggcgactcggcagagggaggaggagctctgcctccgtcccttggaggctagcgcgcggagtggcgggggccgggtcgatgatgacggcgatgacggcggggcggtttggagcggagcgacaacacgggcggcaggcgcgggcaggcgcggcaggcgttggcggcggcggcgactggccggtcggccaccacggtgcgcacgcgcgcgggcggcgcggcgatttgggcggcatcggcgggaacggcagcgagagcggagagggaggagggctcggcgcggctcacgggcagagcggggagagagagagagagagagccggggagcgagggggagatgggccgagagggattcggcccatcgaacccgagggaggcaaaatagacttttgcggagggatttgatttgggaaggatttggattcgggattgaactcgacgatagatcggggatttgagatctgagatggcacggacactagacaataagcaaagaaacggatttcgcaaatagggtttttaagagatagtttttccgctaggcgccacgacggaacgggcgctacagaatttctataaaattcttctactaaattcttttgattcaaatggccacaggaatcagataagagatatactcaaacaaattttcctaagaggttagtccttttgctaaattttctttaaaacctagattaaattagccattgcagataaattttataggatttgaaaactccaatcctttaaataaaatgatcaaatagaaaaaatttctataaaattcttctactaaattcttttgattgaaagggtcttaggccattctcaacccaacacactagacatagtttccataagctccacatcatcaaaaaaactagtactagacactactcttacaatgcaaaaaccattattccatacttaaatttagtgctacttatctcacatgatgtcttggatattgtgtagaaccatgtctcatgcaaaacatggtttcctttgctttcctcatttattcatttgccacgtcacttttcatcttaggtagtaacttatttaatgctatagacaccattcttgtcattgggttgggaatggcattaggagtagtacgtccgctgtacgctgcacgagccggggagcccaacggttggtggctgcctgccttcgccaatttatttcgccgcaggccgcacagccgatcgatctgcagagcagcagtaaaaacgctcgtaacgacggggtgttttggaccggaggaatggcaggttccagatcgatgcaaattcgcggtgaattcttcttctgctactgctactgctgctgccgctgcgttatattagctgtgatctgggctgtgaagtcgctcgggggatagaaaaaaaaattgctcgtggctgtcaatgtgaatgtttgttggtgcagataggtcgttaggtacttgcatgatggtgagggttttgggggcggcttcggatgcaagggattgggttacttctagcacggttggtgttactacgtacgtacgtgcatgcgtgcgaatgattatattctagcttcaagtgcacactatctgatcccagatcaagtcgtggtagggttcatacactgggttgtcgatatatcagttacaccttacgagaaagatatggtgaatgcctgttttcagacaaaatatcttttttttttagaaacacaggccaataaatctatgggtatatctatacctttgaattctaaggttgtgtttgtttctaatggttgggaacctttctcctctagcacgtaaaatgaaacgacggtgttaacacacgattacttaagtattagctaaaaaactttaaaaatagatttatataatttttaaaggaactttcctttataattttttttgaaaaaatacaccattcagtagattgtgaagcatatgcgtggtaaaagagagagtagagattggaaaagtgtatgattaattaagaagagaattggagaacattaaaaagataagaaaaacgagatgaaacattatagtatacgattaattaaatattaattattttaaacttaagaaacagattaattaatactacctccatattttaatgtatgatgccgttgacttttttttcaacgtttgaccattcatcttattaaaaaaatatataattataatttattttattgtgatttgattcgtcatcaaatattctttaagcatgacataaatattttcatatttgcacacaaaatttgaataaaacgaatggtcaaatgctagttaaaaagtcaatggcgtcatacattaaaatacggatggagtatgattttctaaagcaattttcgcatagaagtttttttataagaagaaacacaccgcgcagcactttgataggcgtgcaggcggaaaatgaaaaattttcctctcagaccctgtttagatcaatttgatgtggcaattttttttagaaaaagttttggtggcaaaagatttggtattgaagttttgctagttggtgtttagatgcatggtaaagttttaccattttactagtaaagacagagagagcacggttcccaacatacttttttggtaaattttgctactctaaactttcaaatgacaaataccaaattgccaaccttttctaccagtgtttagattcattttagcaaaagtactctaaaacagcaaaaaaaaatttgttattttggagaaactaaacaggacctcagccatcttgtgccgaacacagctaattaattggataattccaaaggcgctccgatgtaaaccaaaaatcttacacattgatttcatgtattattgcgaccatagatactgttgagagtttgtaataaataaatcacgtaactggaaatagtgtgcactctactttactaattttgaaatttgtaattaataaatatgatatcgtaatcatttcgaactctcagttagtttagtgatatgtaaaattaattataatattccaatttactactctgctatgttccataatatagtaaccgagaataagacgagagtacaacaaataatctagatagacgtatccagattcgttatattatgaaatatgtttcatccaattataggctgctataatta

SEQ ID NO: 64003 - DNA, 7748 bp, Oryza sativa
gccaaagctgcttttgcgccagtcagaaagaatcaccttagggaagttgttgctcctagttgaagacctcaacgatggtggttgtttggtccagtggttttgtgcttggctccagatctgcagggaagatgttgacgggagtattgggaagggggggggggacaagctttgcgctatgacatcggccgggacactaatatatggtcatatggagataaaaaggtaatcactagaaagttgactgcctctagatgaaggttgtcgtcctgttgctcgcttctagtcattcctttgctagtacttgttgtcgtcaatgcattggttgtgtgcttgtccactcaatcaatggccccgacagtgatgatggcctagtactgaatgggagtttctcttggttgatttggccatcaagcaatttattcaacatccacaaattgcaggctacctcttcctcaaccactttcgttcaggtcaaaagacaatggttcattcgtcgccatcctaatctttcacttgaaggtcaactagactttagagatggcttcatttttgcttccaaatagtgggtaccatgcagggttcgccattcgcgttgagcacggttcacgtgtgcaaccttggttcacaggactatagtcagtgttcctcatatttagatttagtggtgaactccgtgaaaatcatttgctgtgttcggtgaagctcataccaaaatttacgacgcaataacaaacctctcatttgtgccattccgtggaggcaaccgaagggaattaccggtttgtcaagcagtgtggatatttatagaggccgttggatgtagttgtcgcggcaacgccgcagcttcctgtcaattgacaatctttatcactgtttgctttcattatgaagcatgtttctttagtctagttacccttccttttaacaaggatggtacaatgctttcacttattttgtatggcgatgtacttgggattattcccctgatccctgactatctctaataaaaatgttcttgagtcttaaaaaaaagaattcttagttctaaagctgcagaaaaattgaaattttcttgcacaccttaagacaatgttttagccttgatacctgcaagttatgaatttagcccatctttgtagtttatcatggttgactctctaatacttcgtgatggtgaaagctcttccaatatatatgcatggtcttaaaaaaatcataatgacgtatttcacgaaaaataagaagagatggcaaaaatgtatataagactaatatattgcagttgttctattgaaataagaagatctatcaaagctatgaagaaaatttttgtattaacgtttctgcttaaaaaaactttacaatctacttggtctaataaaagttgttatacatccatcctaaaatataataatttttagcattcatttttttttcaaaaacatatcaattccaagttgttgggttctgtatttgagaaaacaaaatcaaaacttaactatttgatgggaaacaccatatgaaatcttgcaaatttcggattggatcactttgaaattcatgcaataccccataaccataacacctcctctcctccctcctcactcctaccgctgccatgacttggtcaagtgagcgctcgatgccccacctcctgtgtcgttgtcgtccaccacactaccacccggctaaactggtggtcgaaaggtgccgacaaggcacccctagcaagcctcttctccctttcctagccctccttctacttaagggcccctttgattcgcagcatagaaaaaacgcaggaataggaaaaacacaggatttgaagtggtaggattttgaaatcctatgggaagagaaaacagaggaaaacataagaagatccctttgatagaggcatagggaaaaacaaatgaatctgcacatcacttcatttccaagaggtctgacctcttttttagtttcctttgaaatccactgataggagtgcaatcctatggaatttatacttgccttttctatgaatcaaagaggcttgaagaaaaaaaatcctttggaatcccattcctccaaaaatcttttagcattcctttaaatcaaagaggccttaagccagattcaccaataccacccgccattaacgttggcccgctatcttccttcatccacgcggctctctagcattgttgcctacccatgtccattatttctcattcatagtcgtatcactgtttccacaacaatccatttaaacccgttgataccctctatccctaaaccctaactttgtcagggcattgcatgttattaaagcttcgttggagtttaaggagaaggagctgagattgtgggagcgcgaatcaccgaagcaaattgtgaagtaagaaatttataaggttttaggcccaagtctaggataacaaccatttatccattaaaagaagtactcagaataaatccccttaatcccaaggggtaccgtgaaaaaaaggagtacggctaaaccctcgcgagtccccactcttcctctccccgttctgcatcaccatgttcgccgccatctgccgccgccggctcgccgccctattcccccaaatccgcggtggcggcggcggcgcatatcatgtccagtccaacccccaggccgccctcctcttccacagctactcctcaaccgccgtcaccggcggctccgaccccgagccatgccccgacaccgtctcttacctggtctcctgcggcctccccccggccgttgcccgtcacacggccgccaacacccgcggcctccggatccgatccaccgagaaggcggacgccgtccgcaccctcctccgcagctacggcttctccgacgcggacgtcgcccggattgcccgcagcgccccgctgctcctcaccgtcgatcccgaccgcatcatccgccccaagctcgagttcttcgccacgatggggttccagcccagcaagctgtccaccgcgccgctcctcctcgcgcgcagcctcgagaagcacctcgtccccaccatccagttcctccgcagcatcatcggcagcgacgacgggatccgccgcgggttctcccgcatccctcgcgcactcctggtcagcctggacaactgcatgcgccccgcggtggaagcccttcacaggcacggcctcaccggccgcgaggacgtgtccaaagtcctcgtcctccagatgggcgtgctcatgctgtcgccggtccgcatcggcgaaatcttcgaggatctcaaggctatgggtatgtccatcacggacggccgctttgccaactcgttccgcgcgatgtgcagcatgaggagggcgacctggctgcggaaggtggcgctgtaccggagctttggcttgtccgagagtgaggtgttcgaggccttcaagaagcagcccacggcactgcttggcgctgacgagaccataaaaaagaatgcgtcgttcttccgcgacgcgctaaagcttgaaatgcgcgaggtaatggtgcatcctgttgttatggcatatagctttgagaagaccatcctgccaaggtgtgccgtgttgagcgtgttgatgagagaggggaagattaatccagatatccagttgcttcatgcattgcttggcagtgccaagacattctcagggaggtatgtagataggtttgctgctgatgtgccagacgttgttgaagcatatgagggtaagatcaaattcaaaggattcaagggtcagggtcagggtgtttaagtccacggaagccaaaaggctattcttctggagcaaaatcacttcaggttgggttgtctgtttttcttttagagccattgagatcaaggcatatgattctaaattctaacgctgtttcatggagcagcattactctgttgttggaccatggttacttagtatcatatatttgtagtttagcagtttccattttgaagtattctggtcttgggaaacctagatacatgacgtcgtagtgatacctttaaggccaattcctctatcattttctgatttcaaacaatctcgtaaattaacttaatttgtgattttcaaacagttctttcttcaacacacctgaaatatctgtggtttgtctgtgtagattatcaagtgttcagatttcagagtttccttatatgtggttatcctgcagctttacgtataaatctggcattgtcattgagagaaaatgcaagctagcacaatgaggacatcataaaacaagtatagtggaaaattatagctagtggcatgaggcatggcttgcaatgcctataaggcaaagaactaagcttctaagccttgctctccagatcactaaataagtggatttactccctaatacatagtagaatgaagaacatcagaagaaaactaattactggtatattgatatgcagatcaatgctaaacttgaactatttccactgccaccataagagaagaaacatatatttatccctatattttaattgaagattacactgcagtaatcgtgctgtactgctcttgaagcttgccaggttaaccacccacaataacctgcatctaacatgtgcttaggacttgtcatctgcaaatctttgttgtatgattgctaagaatgttcaagagtatctgatagtcttggaattgtgaatgcggagttacggtgacttctttgaactagtttgatgtactgttcttgcgaggtattgtgaagttttgtgaggaacttgctcaaagtttcagtgtccttaattctgcttagtgggagttttaggtcctagaatgggatatccatttggttgagagttgatgacatacaaatcatacttggtactatatcaataggctgaactgttacacaccatctgagtacttgagtccttgttgttctccaaaccacatgttattttctttgctccagtatgattcctgaacttatccatattgcttccatgaacttggaggaaagttagtcttgtttcttcacgcttgttgtcttccttaatgattgttgaaatttattcctagaaataagcacactgctaaagtttctagcctacccttattccttaatgattgttgaaacttattcctagatagaaataagaatactgttaaagtttctagcctcatattgaatagtgattttttacgtttgatacagcagtgatacatgttatgcacacgttttcactggatactgaggtaactacatgattcagtatttcagttatccatacagtagtaactcatgttttggaatgtgacattttccctctaatgatttgagaggtaattaacaagcatgacaactgtgtatttatcagtttaattataggtatcttgacatcttttcatttttaaggatcagatgctgcaagcctgcaacagtggttccgaacaaacggtccaaacggcagggcgtcaactgatgctccttgccgtctattaatgcagacaaaattttattttatgtatagatagatgaagttatgaaacatgctggtagagaaacgctcaactggcttgatgtacatacctctgttggtttaggtgaatcgctgttcaatcgtctctgtggtgcacacaatccttttaacacaagtctaaggataggggcataacaatgaatccataaatctcaataaatttatattgaaaatgtatgcatgtgaatgctattatgagcgcaagaatttaaactctgatgcttaaagtataagcacgactctaccataccaccaaatctctggcgcttcctctacttgagattttgctgacacatggattagtgtgaatgtgattataggcataggagattttgaactagtgaagtactatttggctgttttctttcctcttttttcccaacccacctcttttttctcacacgcacaagtacgtttttcaaatattaaacggtatgtttttacaaaagttttttttataagaaagttgttttaaaaaataatactaatttattttaaaaaatactaatacttaattaattatagaaaagttgttttaaaaaatcatattaatttattttttaaaaaatacaaatacttaattaattatgcgttaataaatcacctagttttacaagcccgaggattatttgctaacctcgtgtgccgaacacagctttacacacgactctacctaccactacacctatttgagattttgttagggcatcagcaatgtgctcgcaaaccgggtagtaagcaataaatacactcttactacctggtattaagcattgtggggctagtacataactacaaccgggtcatacccctactaccggaagcaaggaaatagaatatgcatgtacacagtgttttctgacagcaaaagcattgcttctcccaaccgttgtatgcatgctctgtccttgctacaatttttattaccccatggaccccaccttactgccaacttacagatataagcaatgtggagcacgtctccctctattaccgcctgtcatctgggcccacgctaataccgatgtggatagcaaacattgctgatgcccttagcacttagagtacttgtataattatttccctacatatcgtgttgactttataatgcattaagaattgaattcgattacaaacatgtttgatgcaactttttttttcagagtttgaggtatctcgttaactaattactttatctgttgcatgatatagtaacgtagtatcagataagacgtttgagatatctcgttaactaattatttcctcagttccataatatataatatagcaacacagtattagataaggcattgtattagggatggtaatttaacccgtttgcccgtttacccgtgggtaaaaaccctaatagagttgggtttgttctccatttagtacccatgggttttttattaggtcaaaacctatacccaacgggtatacgggcacgggcaaaaaccaattgacatgtggtcactcagttaaattagtataaatgccaccatctagtactgataaacttgtaatgcttgtattgttgaacttggtacaactgtaccctttctttaaattgcgataatgtctctctgcttgtagagatttgtggttgaaatgttgaaatgtgagtttgtgacaggtaaacgcgcatgcccgcgagcacatggcgcctgcggacaacgggcatgggtagtgttccttgcccgtcatgtagtaacggatatgcccgcgggcatgaattacctcgcgggcacgggtatgggtagtcactatccgtgcccgtcgtgcccgactgccatccctatattgcatagtataacgaatataaacagatacacgtctagattcattttactatgaaatttctcgtccggtactaaattattatattataggatggagggattagctattaatctaagctgcatatggatgaggatattattgcatttcagaaaatgttactactgtcaagtcagttgtagtttgaaatagagtaaattttaggaaaaggtatgaattaccccactgaactatcgcagtcgatcgaattactccctgaatccgaaaaccagacattgttcaccctgaactttcaataccggacgaattacccctctcgacccaatccagagtggttttgtcttacgtggcgtatgcgtggcaatccggtcagcattttatttataaaaaaatgtgggacccacccgtcatactcatcttcccctcttcctctctctcctctctcttctctctctctcatgg

SEQ ID NO: 64004 - DNA, 722 bp, Oryza sativa
ctgcagccctacattgttcaaaaacactatttattcggctgattactattcagtttactgtttattcggctgattactattcagtttactgtttgttcggctgattactattcagtttactgttcaaattactgttcaatattgttcacttcgagagatattttaactttaggatctttgcagggtggcgaatcctacttagacagcctcagaagcttgtttcagatgatgtaaagtcctactcggtactcaccgtatgcctcacctatctgtctttttagaagcaacttaaaaagatattccaagtcacacttgttctagctaagagtttatcgtctccccaggcagttccaaccgaagggaacacttctctacggataccgattctccagacgcctatgcaagatgcaggctaaaaacgagaacaaaccgaagaggtttctcctatagggtccttagcataaacacttgtctagaactaacgtgcaggaatacttaaggaaaattacttcatattaaatagataagcttacatacggttttcccttttgggaaacccgaaggtaggtacaagcaagctgttcttaccttacacagcgttataacacaactccttgcttcaatacactatgcaaggtaggctaaagtcactactactaagaacggtggaatggagggtgagagcgcgcttggaagctttgctctgaatggtgtcttcgttg

SEQ ID NO: 64005 - DNA, 12845 bp, Oryza sativa
aaatggtactgtttacacgaatgattcctgttataaaaacgggggtctacaggtggcctggacgcgccgcggtccgccaccgacgttgccttcagtcgccgtggtccgccgccgtcgtcgccaccgtcaccgtcagtccccgccgccggccacccccccttcagatctggccggaaacggcgcggatctggccaccaccaccgccgccccggacagctccgccagccgccgagcgtgggaagggcgaggcgagaccccgccgccgccgtccttgcggctccgcggctttgccggcacccgctcgggcggcggcgaggtgaaggagggggcggggggaggaggaaagcgtcggcgcgcgcgtcgcctcccgagccgcccgggggagggcgacgcgagggctattcgccgatcgatgtggcctaaaagatctcaactggatttttacttgttgtttctaaatatggtcaccaaactttgatttctcggatatatatcgcgaaacatgcatcgcatgtgcacgattactagcaatacaaaagaggaaaactaactccacctttcccctacaagactacaacatctaagcactttccaataaagccatacaaatggacaacgaatgccaaccaatgccacatgaataggccaattcttacttacctagtgtaaaaaaggaagaccgactggacactggacctttgcacatcgcttaaggcatgacgttgccagataaaaaccagacaagcgtacaactagttgttgacacctttttagtcacgccacaacacgatcggaatccacctaaagttttgcagcgtatggagtctccaaccaccttgatcttgagaagcccctgatcaagatgggtttatagatcaaaagcaactaacggagccgatttagacaaatagggataaacacccgtcttgtgggcggaaccgaatgttttagggacaaacctacacagatgactcgcactctcgcgacgaagacggacaactttcaaagcaaaccaacgaagatggatgaactaggctgaaaactaggcaaaaagtatatgtgatattgaaagaacgattcaattggctaattgcgctgttgtagattgtgtgcctcaattgaactggccatggcgactacaacaaaaacctcatataaagacacttttgtagaggtgttctgcaaattgcctctaagatctggtgttttgtagtgtagagacactttacacagacactttgaaaattgcgtagaaaacttttactttagagacactttagagatattttcagcacattttattaaattatatcttgtagaagtattctttcgacactttaaaatgtacctgatatgtaaatgcatttcttgagatattttaaactttgtacaaacacttactttttagaatgataatgtaaactgaagaactaaatataaataactcaaagcacaaacatacaagtaacgacataaggttgagttcgctagtgcattgaagataaaaatgatttgtccaagagatcttgagctcaaggatttgcaatagcaagggaaaaatattttactccttttttacattggtttcatagggttgtggtacaatttaataatttaatgcctctaccattttatagacattttataaaatgtctctttgcgtttcatatggttgtggtataatttaataatttaatgtctctagaaaatgcccataccattttatagatattttataaaatacctctttgtttgtacagacaattcaccgtaagtgtcactagaaaatgcctctaccatcttatagatattttataaaatacctctttgtttgtagagacaattcaccataagtgtctatagaaaacgcctctaccaacttatagacaatttataaaatacctcttgtctgtggtgaaaaatgcctctaccatcttatatattttataaaatgtctctttgtttgtagagacaattcaccataagtgtctctatagaatgcctctaccaacttatggacattttataaaatacctcttatttgtggtgaaaaatgcctctactatcttatagacattttgtaaaatgcctctttgtttgtaaagacaattcaccataagtgcctctggaaaatacctctaccgacttatagacattttataaaattcccattgtttgttgtgaaaaatgtctccaccatcttgtagacattttataaaatgcctctttgtttacacagacaattcaccataagtatctctagtacatgcctctaccatcttatagacattttataaaatgtctcgttgcttgtagagacaattcactataagtgcctctaccaacttatagacattttataaaatgtcttgtttgtagacacaattcaccataaaacacttcttaggtattttattttaaaatgcctctacagtattgtaaaaacatttaaaaagtgtctccacaaagcatttttcttgtagttggctcttattttggggttggtcttgccttccataggtatctctccacgtcccactaggtgtacaaaccaaataggactaaagaaaaccttagcccaagcaagggaacttgagaaacgacaaaatcaggcacggagtcagactctgccagtctatctggccacatgccgtcagttagaccggccccacactgtctgtctgaccggctctatgacgatagtcagacttgtcgcgcgtagcaagctaggtccttttcaaatttggctatattttcctattttcgctttaggtgccaaatttagggttttatgtcacatactccatccaagataaaaaaaaatctaaatctaggacgaagggagtaggtgaatttgtcatattcgatggagaaggaaaaaaaaaagaaaacttggaaaactgtctagagccttcgcacatagttttcgaatacgattatgctttaaaaaaacaaatgaattcacaggtaatagcagctaaacctctcaaatgtaataccagcaaaaccgtttaagaaataccagcgaatccttagaagcacctcaaataccaccatactttttatttttcgtgacgtgaaatggttacgttgttgcaaacaaagcatattattttgtctatagtatgaaaatcttgccccagcgatctctataaatactgagaacctctagaaagtactccaaactatcatcagccatcactttcccccaccttatcaatctgccctcctgaccctagaggtgaccatcatggctcttgaggtaattatgtgatctgatttttaatttctactttgtttcgctttcgctctcatggattagtgatgtgtgtagtgttattcatacatccacgcctttttcctttcttgaatcagacaccctaagtccgatttggattccgaccctctttcaaactctaagtagtatttccccttataaaatttcttttatgggataggacatgagaaatttgagtccaattcttaacatgtgtccatgtccttagccggatttggattctaactccctttcgaattccaagtagtatttccatgtataatttcttctatgtgatagggggtatgacattacaaatccgactcgaattcagaacaagtttccatgtccaggtgacacagatcaagagtgttgatgccgtctgttctgatcattcatgtcaactaataatcatcacttccttaacatgtaacttatccaaatcataggaggcagagtggccatgatagggattttttatgaggtccctcttggcattagtcctatgatatgcacgttcttcattggtagcacaacttacttgtgtcagtgagacattagcgagcggcaaatcgtgtcgtaaaatgttttgagtgtcatatcctagaaccctaccatggttacatgggcgaaataccttatattataagaccgacacacacaaacacacacgcacgcgcgtgcgtacatatattagctatgatgtattagctacataagagggggggggagggggttctctaggagccgtgatatactgtataacaacaatatagaattgaacaccctatttatacttatatctttgattgaggagagttattgcaaggaagaaaatgcactatttcaacaaattattctctactaggtttccctggatagcttccatatacatcataaactttatgttctacttcaattttcttttctgaaatataactaatatttttcttctaagttctccttccagtcaaacttaatagtttagttttcccaatgtcaaatattttttcctggagtagttttgaacaaaatgttggattttttatatttgcttgtagaattgtgaagatatttggttactttatttcatagaagcacacatatttgtaactagcatccctttgtttatttaaagtacttaaatttcatgttttcaatgtttactgaagatgttccaattatgtcttgcatgatattattgacaacaacaataaatttatatttgacaggggaaaccaggtttcattaccatgtacgccatcacatgctgcaaatgcgagaaatggcgtacgattccaacaaaagaagagttcgaggtaatccgtgagaactaccccgcgaagccatggttctgcagcaaaaagcgcgactgctcatgtgagcaccctgaagatatccagtatgacaccagccgtatttgggccattgataggcccaacatccctaagcctccgccgaagacagagaggctactgatcatgaggaatgatctatctaaaatggatgcctattatgtcttgccaaatgggaagcgtgcaaagggcaaacctgatatagataggtttctgaaggaaaacccagagtatgctgctactttaccactttcgagcttcaacttctcaacacctaagatagttaaggagactgtttccgatagtgcaaagtgggtgatggcgaagtctgagagggaagagcagtgtatgcaactagacgcaaaagaagttccaagttccagcagcaagtagttaccattgtgacctctgaatctacatacgcgttactttaggtgatgccaaaaacttaagacaatatggagcagccaccttaaaaacctatacttctccttccttgtttacctccagaagttatgttatgttttgcactacatgtgcttttgtgtgttgaaccttttcattctacctcatgtcgaatcctgcaaagttctggagctattttcatgtggtgattttggatattttctacatatgctttgtttcgcatgtatccggaacttctcgttgtaggtccctattttaataactatacatattaacgataattaattaaatattagcttaaaaaaatttaaaagtgaattaatataacttttaaagtaacttttgtattttttttttgaaaaaacatatttttcacagtttaggaagcgtgtgtgtaaaatgagagtaaagttgggaaagtgtcccgaacacaacctccaaggtaggtgcacactgcacatcaccgtatgtgtgccggtgatatgattgccgtgtgatgccgtttggatggctgggcaaggcccgcatcccgcaagggtcaaaaccctgtcggtctatccccgtgaaaaggcccgctttgccgtgccgtccctctactctcgggattcactcccgctgtccgtcctcgtttccgccccccacacaccggcccagcaacgcggcccgaggcttcctcttctcgcctcgcgaccgctccgcccaacctccgccgccgccgacgacgacgggcggccaaccgccccaccgtcgagtatggcctcatccccgtcaccggtctcgcccccctcggcgccctccacacaggtccgcctctcgccctttcgcctcctcgatcgtacgtcgccatctacgtttcctcgtactggtatttccccccgcagcttctttggtctgttcctccgaatccccgatccggtttggtgtatctggtggtggccatagcatgctcggttgttggtttcatctggttgtttggcttgagaaattgtgccaaatggtggcgcctgcatgttgcgactatatgcgtggatgcggtttcagagttcagaataggggtttggttattccactaggttattccgtaggatgaaatctttaatcaaatagtatcgtcaatgccaagaacaggtgagggaaggatcgatttagagccttaacttaatctgatgagctgaaattgtgccattttggatagaaattgtaggcgtgttgctttgtactgctgtgaatacatgaagcctgaagtttgtttgtcagcaacgggagtttatgggctgtaaagaaataaaaaagatcagcttgcattggtttctcaaaattttgtttgagatccaagaggaatttagaagcatgaaggataatggaatccgtccaataacaaaaaatgcatatactttagattgagaacataagagttaatgtattacactatttaatacttttgcagttcttaagttctgatgacattttatacattagcgaaggggggctgcagggaatggagactgtagagggttataagagaaagaggaaaatgaggacttttctacttagagctgtctgaaccatttcttcacatcactgggtctatgaaacaattttagatttcttcacaaaatgctgcgcgatttttttaaatttctgccccttctaaaaactgaatgcagaatctttttctatggttgcttttgtgcagccaaacataagtgtgccttatactacatggcatctgcattataccaaaagtggccttaccatatggactctatgcaaaatataacttccaacttctaagaagcagcttttatggactgtaaagaaaaaaacaatgtagcggtctttattatttctatttgtgcgttgggaagttgttctgttatcctatccactagaagtatacatcatgtcattaacatccattttccattagtttgtgcctgatagaattaaaatttacattccaaatgcatattttaggatcagaaaaattattttgcttgatatacaatagtaatgaatggtaacgttcttatttcaatagagaaaacgaggctcctccacagactccattggcatgtatgcagttcaatgttgtgagtgtcacaaatggcgcaaggttccgacgaaggatgaatttgagacaattcgtgagaatttcactgaggagccatggcactgcagtagaagacctgactgctcgtgtgaagaccctgctgacatcgaatatgatagcagccgtatatgggtccttgacaagcctaacataccaaagcctccagcaggaactgagagactagtgattatgagaggtgatttgtctaaaatggatacctactatgtcatgccaaatgggaagcgtgtaagatgcactgcagaggtggataagttccttgaggccaacccgcagtacaaagatcgcttttcagttgaaagcttcagctttacaacaccaaagattgtcgaggaaactgtttctcacaactccgtgtggaagtctggaaaggctaagaagcaggacaagataaatgctttgagcaataacaattaatttctttcaaaagactttatattatgcttaggtgatgctcatctcaggttgtggtgctaccctcatctactttgtgggctggtcaaatctgtttatatttgcacttagtctgttcggtctctgtgatctgtgtgttatgatgcgctgaaccttttctttcttcttcattatgtattaactcttggcaaactttgagatggttgagaagggttgtgggtatgttggccataactaaccttagttataggcatgctcttttgttacatctcacatgtttacttttcatacttctacgttgtgaaatttgatcatataacctccctttagattgaaactaggatttacccacctgacccacacatgtcagtggcacaaaatggtaattccttgatcctcattttccagataggaaaattcaacaacaaagtactaatacaagttgggtcagctgctatcatgtgagagctgtttctatttgagatttctatacatgggtattgctaccagaataatcatttgagatttgatttgatgtaatatgttaggtttccatttaagattagaaaccaagcattagcataaactaattccagatcaggaatgttcagtaacaacatataaaggatagcaggtgtgctgacatacctgtgaccaaaatcgccttcttccatgttgtgaaatggctcttcgtttttagtgtgattgtgcagcttgtgggaagcccgtggaagcgcatgcatcaagtcctggtttgcattgtgagatggtattgcatgaggctttagcagcaaatcaaaaaatacaatgtgtaagaagcagtggaatcagatagtgctgtcttacatgaaacggagtgctcaaatctgtggctaagcccataagcacttcactcatcgtgatcagactttgaatgtggctttttttggattcttgtctcctgcatgacttgcagttccgttctcgcaattcccattttgactgatccacaaaacttcaaagccgcttcttcatctctgcacaatcaaacataatcatatgcacggttccaaaagttagcagaaatcattccaggtcaatcgattcaaaaccatcaggtattcaggtcagatgaacatcatacttttcagtggcctgtctcttgggtcattctcatctcaaagacttgcagtgcaatctgcactgttcctccgacttatcctacttcccaacttttttctctgtcataaaacgcacaatcctgtcaatgatcaagaccaattttcacggacaatgactcaaataccaggtctctgaaaactgcttaccttccatagcctgtcattcaggccctttccatcctttttctcgccgggctaaagaaggaaggcggccaaattttattcagagttgaggtagttcgtcatctgaattatcttctgtttttggtcgagcatttgacgatatcttcgtatctgaacagcagcagaagtttgccctcagaaaaatcacgagccctcacaaaccctgttctgccactccctaaagtagatctcaatagctcttaaaaagaagagtagatctcaaatcctcaatacagcttaacgtgccaaaaattgccaacgaggctgaaaaccatggccaatttgaccggcactgtccttgcaaacttgttaagaattcgctacgaaattcagaacggcagaacatgtagtagtatacaagcatctgtggaccatctttgcgaaggatccagggagcagaactctgatgaaccgtggccttctaacagctgcatttgtcttgttattaatcaaatctgccgaagtgtcaacttcacaaaacttcaaaaagcaaaagttatcagtgagtcgtagtcgtagaaacatcgacaatgcaaatctaagtagtagacaggttggtctccagaagaatttatgcgatcttctgtaaaaaaaaaaaaccagttgtttgttgcgacagttgaattgataagttgccagagtagccaccttcgccctgagaggggcatctgatcgaacaccttcacggcgagttacgcggcgcccccttcgtgcctgaacctgaacacgagaaaaccacccccatgacaacgccatgagcgcgcgcgagctccgccaaacacggccgcgtgtgccaggaacgcccggtctcccgctgaacctccatgcgccacaccggcacactttcgccgagcgcgcccaacacaaggagcaccccgcgctgccgtcgccggcgagcgtgcgcgcgccgcgcgcgagtggtggataccttggcgtaggagtgggtttcgtggcgtatacctgagctagcagtgccggattagtaatgggcaatgggcgtggagaacctagggcaccgacgatgaagaggcacggcggtcggagtcctccagaagttgaaatgttgaattctttcctgggaaaataaaccggcggataaaatcgtgccacacgcgtcaggaaggaaagctttcaatcgtttcatttccttttgagaaaaattgcttcgcaccaaccatcggggaaaaaaatcactgcacagtataaaacagagatgttctcaaattagtatcatgtaaatgttcatgtttgtttcatatcgtgtccaaatatttggatgaatatatatgtttctgtcttttgtgttcggtttattttaagaactgctaatgtaaggcatatcaattttgggatggtataaattataggagatcgatccgtattcgcggcttccttgagacacctttactttgcctcatctgccacgagcatgcataccagatcctcgtgtcttcgtcccaatcaagtatccatggttcaagtatgtgataccttgtcgacgttgttgccctctcaattcatccttggtatcttgttggcatagcctcatccacgatgttacctcgatactttatcagctcaggccttgttaggtcccactccaaaaattttcaccatatcacatcgaacatttgaacacctgcatgaaatattaaatataggctaaaaaataactaattgcacatattgcgattaatttgcgagacaaatcttttaagcctaattgctccatgatttgacaatgtagtgctacagtaaatatttactaatgacggattaattagacttaataaattcgtctcatagtttacagacggattctgtaatttgttttgttattagactatgtttaatacttcaaatgtgtgtccgtatatccgatgtgacacgacaaaaacttttacccctagatctaaacacagcctcagtcgttttgggagtttgggtaggtggtaccttgtcggcgccatcatttccaaaattccacctttgtaccttattggagtcttcaccatggttcatcaatccctagtactcacgtattattgctagcccctttaggcccttcccagtgcgtgtacatggcatgttaccttcacctgccatattggactcgcttacgtgtcgacgaggctcgcgcctctgcttagccgctcgccccttatctgggagacgagtttcttcgttgcaacgagggcgcgcagcgcaagaaaccccctccgcccctgcaacgtggaggtcgtcgctccgattcgtcgcttcctcgcgccgccccgaaaagtgaatccccaaaatcaccctcccaccccaccgattcttgcctcccgcgcttggatttgggggagaagcggtgcagtggatgggcgaggagaagtggcgcagattgggagaaacggtgcggtggatttgggaggagaagtgtcaaatttggggagagaagcggcagatctgggaggagaagcgcgtggtgtggtgaataagaagaagaagctcggtatttttttaaccgaaggggggtgggtgggacggggaaccggcccgcagatgggaagaagtgacgggatttttttctgtgtagaggataagcatgaaggggcaggtggggaaaattaactctgttttcgttcgactgggagttccgacttgatagcgtattgtgggtcacgagcactgtggggtgtgtggcctactggccttcgggccaattttatcgcacaaatgggctagaagcgcgctatgcgtgccttgcactgttactgcccttacaagtataatgtgtggtactattagagtattgttccataagtatcggagttgatacccacatatatcattgctggtacatatatggttagttttgttgatctaatcaccacgatacaacatatcatggaagaacgtagggagagagagagaaagagaaaagggaattgggtcgttgcgctatcaacatggagaacaacggatgggttattaaggaagggatgaagggaatgtgtaacgccccgattttcgttcgggattaaaaatcattaaataatgcattttctagaaattaaataaaagttaagtcaattcaatcaagtgaaataatgggagaatttgaaattttcctttaaaaatcattggccgagaatattttgtaatattctttgtgccctaaaatactctccggatttttccgcgaattttcggagctcaagaaataattataataatacaaagttcatttaatcaatttaaataaaaagaaaagaaaataatcttccccttcctccctttcgggctcggcccaaattccatcccccttcccctccggcccgcctccctcccctctcctctttgggccgctcggcccagctcggctcctctccccccccaaagtccagaaaacccccacccggcttcccttctctcttccattagctgacaggtgggacccgcgaccccacctgtcatccccttcccctacctccagccaccccatcgccatggaccggcaactgccgccattgccaccccaccccgccgctaaaaccgccggctctcgccttccgcgcgcacgtccaaccgtgcggacatggtcgccacccattcctcctcattttcctccacttttccccaaaaatcacgccagtttgacctccctcgagctccacgtcgccaccccacgtcgctggccggttgcctcctgattccggccctctcggccacgatttccctctcctgagcctatataaacaccccatgcgaccctcgtccatttccccaattttttcgtactccccggactctcccccgctctccccacgcaaaaccgagccgtcgccactctccggcgagctccggccttctctagccggcgctctcgccatcgccggactgcgccgtcaccacca

SEQ ID NO: 64006 - DNA, 845 bp, Oryza sativa
ttaattacgcacagtcaagctgtctacttacaattgaaaagcaatttgttgcttggggaagttcatcatgcaggacagttgcacacttgcactgcagtgtttagactttttgtggggagccacagcgggtaattccaagggaagagtttaagctgcctgctgttgagctaaactgtgtctgtctatggatttcttctgctgcattgccttacagttcatccttttgcaaaagaaattctatagacatgaagctagcctgaatactcttgtaaatcgaggtgattgggtaataagtgttccttagcttaatcgatcagatccttgtgatctaaataacattgcgtgttcaatcgacccacgttgcatttaggtcctattgtactgaagccttccataaagccatactgcagcagcactattgggcctgcttgcttttgtcccttttccaactattggctttaacgattgtcaaccaccggaactgctcttaatgtatgtggtatttgactcttacaggaacgaggacactgtaacactatactgaataggggtgtagttcttgtgctaaattgctgacacattgaactttttattgcaatgtttcatccgtaggctggacaccagcatgtgagtttaaactttcgtggaataaactattcagctgaagtgtatttgaatgggcataaagaggtacttccaaaaggaatgttccgaaggcacaccctcgatattactgatgttcttcgtccggatggtaaaaatctgcttgctgttcttgttcatcctcctgttcatcctggtgcaattcctcctcaaggaggtcagggtggtgatgggctgcagga

SEQ ID NO: 64007 - DNA, 1626 bp, Oryza sativa
cagtatttgctgttgattggtagttagatttgtagtactaagatatgtcttatcttgtaataaattaacttattttgggacggatgggggacagatggagtagctacaattttcgcacactgttaggattattaagaaggtaaatttgctgatatgaaagagaggagaaaggagagaagcattgatattaaagttaacaatgacttaacatcaactcttaaaatttataaaaggaacctttgttgtaggaggataaaaaaggaaagagtaataaaaaaaattgttctgtagtccgtacattaattgttagagcctttatcgtctcaactattatctctgaatagtctttaaacgtactaattaaaagcctatactagaatatctacctttgaacatatccttataactcatcatactattactacaattaaattttggataacccagaattttgggagccctgtagttaaccctgaactcccatatacacgggcctgatgaaacctcactgttgattcaaacttctatgaaaaaaacatcttcgacagcttgcccacttcaaacataacataggaaatgggagtattgtacattcacaaattattactttgtaccatgatcactcctgctttaatcactattctccatacatacgattgaaaatggttcggaaaatttctggatgattgaaaacggttcagaaagtttccggattccgaactgttttcgtaaacgggaaacattggacggaaattttcaaaaccgaaaacaaatttggaattcttttcttgaaaacaaaaagggatgcagtaatagcactatctgtcagaaagcgaaataggtcaaaaactttcttggagaatatctgaaaaactaatttaaaactttttttgaagaatgtttaccgtctcaaagatgaaaatttgaacttgacaaagtgtttatgaaccgtgatattatccttatgatacaaagtggaaagtggtactattagctgctaaaattttaaatttttatctattgttttagaaagaaattggaaactcggtttccaataaatattcatcattgttttcacattcaataatattctattctgttttgatattcgaggttttctattcatattttttaataaaaaaatgtaaacgaaaatgatagatatggttcccgtcttttttgagtcgttttcattcctacttgtatgttcatatcaaataaataccacacagtcttttcttgtcaaaaaagaagtcacaccaacttgccaaaatgtgtgttagctaaggtgtggcgatcattaaaagacgcgcaagaatatgttgaccacatattaagtcaaggtgacaagaaaaatagagagtatcacgtgtggagtccgctgcaaaaatgtggcatgatatatacacttgtgacagcgaaacaaacaacagttttaaaagttttaaaaggtttgacagtgtttggcaaagtactcactcaaataaacaccctctttaattaggagggcaattttactaattttgaatcttgagacgttaagatatatagatacaacctcatattttatcaatttttaacattggaaatgttaaatattgataaaactaaaactgttactacaag

SEQ ID NO: 64008 - DNA, 21323 bp, Oryza sativa
catgagaaaattaatctgctccagtcagaaggaagaagtgctgcttgtggccagaagaggtcagatgcagatggagttcaagtaaacggtggcccatcatctaagagaagaagaataaagcgtcaatcaaatgctgctctctccagctctcctaacacaaattcattgtctgtggtccaccaagttgatattgacaatcatgtgttaccccttggaaatttctcagggaagtctcagccttcaggccgttacttcttaagggatttagggtcctctgggagcatgtctctcaagtcagaggagaggaatgctgtgagtcacggcaacatatcagtatctagtatccataataaaaccagcagttctcctgaaagatataataaggctagtttagataatgaaaatgggaattctccaggacagttacaaaatacattagatgttgtgaaaacaaccgctgctttgcctagctgctatggtaccttaattgataatgagaaatcatgcgcagaagaggtacgtgttcatcaagtgctctgtttcctttctgttctgaaatcttacaaattttagttcacctgaagagctcaatcatactcttctattgagataatatgcagctaagtactgaactagtgatgctcagactggccgtaggatctgttatacttttactttctaataaatcttgaatatacagccatgtagcctgtccattttgttgttttggagtaagtgatatgggtacaattagatcataactaaattttgcatacagcagggcaatggtaatgtagttttgcatgtaatattgcactcattttcataaaaaataatttattagcatttttagccagtatgttaggcgatgctcacttttttggttgtgaatcagaatttaatgcactgaaaaatcgtctttgttggcaggaaaatccttgcttagaaggtaaacacgcaaatgatacttgttcgagtgtggtacaccagcaaatgactcttcagattgataacattgcatctcagagtgtaatattaaattcagaaaattattctagagagaactcaattactatatctgcaagttatgtttcggatcaaaatggtgatcaagcacatgcaccaagtgcattggttcgtgagaatttaagttatggctccagtgtagaacttgacaggagatgtaaaagtaatggttcaaagggaagtttgttgtctggtgctgctattactatgcaagatggggatgaatctgttgactgtgatgccacaatgccggaattcgagcgatttgatgttcctatccaatttgacagcccatgtgctgagacaaagacatctgaagccctttgtgagtccagaaaattagtcaccctcagttcaaagttctcaaattatgacactaacacagaaagtggtgtgagccacctattgtcagccatgtctgggaagcctataaacttccctgatgatttgcaacaatacagagcaaataatgatagaagcataactgacatttttggagcatgtggattgggacttgatgattccttttctatttatgatgtcacagcttcatgttcttcaaatggtagcagtgcaaaagagaacaatgacaatccattgaccccatcagttgaaaaatatggcctggggaaactgtcagctagatctggatctagttcagaacatatgggctctattcctgaactagaatgcttccgaattgatgaacatagcagcatcgcagaagaaaatgaataccaagggatgttacatggatctgctggtttgagttactcgcatcagttgccatctggcagaaaagcacttcaggatatcactggattatgtcaaaacactgtaaattctgcctctctttcctcaatattcttggatacaggtaatgagctcaatcatcagacagatctcataaatggtcatgccaacgataagccaaaaaacagtcttgctgcttcaaccaagagagagagaaaaatatctgattcccttcatcctagattaaggaggacagaactacataacagaaatggaagacaccagagtgaagccaatattgacaaacaatctaagcctagcaatattgttgccaatgtgacatcatttatacctcttgtaaaaccaaagttgcaacctacaacagcatgtggtaagtgctagtacttttaatatcattgtttatttaaaaaaatgttagtccatttggctagtgatgctttgagcttaaaaagaatttgaatggtgctcatatatagctttcataaattggacttctgtcttgtagtgaaaaaagatgtcagagtgaaggcacttgaggcagctgaagctgcaaaacgccttgaagaaaagaaacaaaatgaacgtgaaatgcgcaaagcagctgcaaaactagagcgtgaaagactgaagcaagagaaagaattaaagcaaaaacaggaggaacaaaagaagaagagagatgccgatgtggctgctaaaaaacggcaaagaggagaggaggaaaggaaggaaaagcagagaaaaagaaaatgcactgaggaggctcggaaacaacagaagcagcctacagaaaaaagtcttgctgtgaatgatgagaaagatgtttgtcgaaaaacatctgtgagtagaagcaaaatattttatttctatcagtgtttcctagaacatgtttttgttactgaatacattaattattgcaggataatatagagctgacaaaacctgatgggagaactaccgaacctgctatgaccaatattccaaacagtcttgaagaggtacgctttgtttatttaacttcgttgtgaaagaggggcatagatagaaatctgtatttattggtactggtcaattattgtgtatattactgtgtaactgatgtcgtaattcataagccttagaatgtgggcaaaatgtttagatacacacaccaatagttttatttgcagatggagcaaaacaactaaatgttgccaagttgacccgtttgctcttcatagcttttgttctagagtcaacaatagttctaacagtgtattacttcctgtgttgtttctgaaaacttctttcagtcataccaaatgtctccctataaggattctgatgaagaggatgatgatgattttgaacatgagcaagaatccagacgtaggaggaaatttattccttcgtgggctcggtatgtatccatctaatcaaatcccctgttcaaaattgcagcctttatttgagaaaaagttgtgtgtttgatgtgatgcactgatgcctaatgtgaaagctcatcacttgtgggaaacaaatgtagcttccgtattatgtcaaagattacatgatagtcttttgagcacgatgtgaagtgactatggaagcttctttacataaatgttaaacatattttctattttaacactgattagcatattgttgctatggaagcttctttacataaatgttgaacatattttctattttaacaacttgcatacttctttttgctgcttgttgcttctgtgttcataatgaagtactggtcctctagcttttctatttacaaagttgtctgatttgcaggaaagaaaacttggataaactcttgttgtccaatcagagtttagaccctagagaactttttgcacaaaagtgctccttcaacttatctgatggtaacctccagctcatctctgtcataaatttatttcggttattactgctgctgaatttgtcttctcttgcctgttctctccagttctttcagttcacataccacaacgtggcttcagataagtttccatttgacggactatcggcaatacgtcattgccaaattacatcatcaacagttgtgcatatgcttggacggcattttcttgtatgctagaaattaatcaacgtagcagaaaatttgtttcttgtggaatattagaatttagcaggacatgtgttgccacatttgtatacatatttgggcataaccaatttgtaccagccgagttatgtttatgaaaacctttctgggcagtacagtaattaccgagattatggatataaaccagacggcaaagtgaccacgacaatacatttggaaacgaaaactacgtgattttggcacacaatctcttcaaagtgacgaaatcaactcgtgttggaagtgaaatgattgaatgagagtatgggactgtgtaaccaacagttttctgttctttcgagagatacaaccagaaaatcaaaaggtaaacgaaaagttttcaggaagaacttctgtatgtctcccagttttcaggaagaacttctgtatgtctcccagttttcaggaagaagaatagccgttaactatggtcgtcgtagcttgccgcttgctccggcgctatacctgttcgccaccgcctcatccggccgggaccgtgtccgaccctcgccggcgatcgccgtgcttgtcccggtgtccggcggtgtacactcgagttcgtagcgcacaaaaagtatcacaacaaatatgaaacattaattatatgagatttgttccggtccaacaaaatatacctcgagataccgatacttcgaggtactttttgctgaactgtagcaaatctccgtactgagatgcacgatacttcgtcgatggccatggcggagagacgacggccggggtggcgagatggacggcaatgacagatagatcagagagcacacggccctggcagaagcgaccgccgtcgtcgctgctgccgggttgtgctctctctcttctgtcatcactctcaagtctcaactgcccccctcccccatgacatcctcctccatggctcaatcgtttgaatcctccctaaacaaaaacacgaaaagaaaaaagaaacaaaagaaagaaagagcatgatcagtcagactgaacagactagactcacgatgcattcctacaattctacccatgcatcatgcattgttcacaagtgaaaaaaaaggagatgcagctcaattaactttttcccactggatcacagctcctgctcgtcggatggcacggcgagacgaatagacgatagttgttgccagccaccagtgtgcgatcgagtttgtcatgtgtgtgccgcaacagtgtaagctctcgctctcgtgatggggggtgttgctactttaactccaggtttccccggaacgcggcgtgaacgtggccgcggccaggggcgcgccgcgcgcggcagtggctatatctatatgcgtgggcgcgacggcgacgccatggcgatcgagcgcgcgcgcgcggggcatggcgctggcacgcgacggggaccaggcatgccccgcgcgcgcgcgcggcgattaatttcggcgtgggcgcgcgcgtggttggcccttggccggcctggcccctgcgctgcgcaggcacagcgcaaactgtagcggctcgtgcgcggcgcaggcaggctgctcgcggcctcgcgtcgagagcggctttgggtcacggccatggcgctgcgcgaggcgctgagatgggcgatccggcagacagcgttgcgtgtcccagctgtgcgcgtgggtctccgcagagcccgtcgtggtaactggtaagtggcgttagggatgaaaacggagctgtttgttttttgtctgctccggtgaaaaatgaatacggataccgtatgtttgtgtgtcggtcatatttaatccttttttatattttgacataattcgtactcctctctgtttcaggttataagagtcaaaatcaaactgctttaagttttagaaaaaaacagtaatattttcaacccaagaaaaatttattatgaaatagattcaattattgatttgatgaaactagtttagtattataaatattattatatttgtctataaatttagtcaaacttaaaacaatttgactttaatcaaaatcaaaacgtcttataacctaaaatggagggagtatttattttttatctgagctattcgtgttcgtttctatgtctagcaaaatttacgaaaataaatatggtatgaatatcaactgttagtatccgctccattttcatccctaagcggcatagcgctagtgtagcgtgccacttgcagcggcatatgtgagtgtgtcatgtaattctcacttgtgggtgataggaccatctgtgcgagaaaaactgtgaattgcgatcgaagcaaattttaatggaattgtaacaacaaaaaatgtaacgtagatgaagttgacctctgtagtaagagtccagcaattcgtatcgatgtaaaaatttgttgttgtggtattagtcactgacgtgaccgtccgatgagctgacgtcattcggacggcggccgccaccggccacggtggcggtcacctcccggagcatcagccggaggcatctcctgtacccgccgacggccatctcgacgagctcgacggacctcgccttctccacctccgactcccgcagcgtctgctccatccgcgccacctcgccggctctcctccaggcctcgccgtcgcgcacgccggtgaagcccacgccgccgtcgcgtggcctgaccatgtctccggcggcggcgtcggcggcggcggatttcttgatcaccatcacgtcggtcaccgcgccgctgatccggaacgaggcatcgaggagcaacccgcttggtatgtcccagacgctgacctcgccgtcctccgtgcacgtgacgaggttcttgctcccgttcgccatgccgacgccgacgagggcggcgttggtgttgccgcttgcgtgccatgacgagctcgtgatggcggcggggcttagggacgcgacgtggacgcggccgtcggagccgccggcgaagaggcgggcggcgaggtggtccagggtcagcgagaacgcggtgcatgggagcgtgagggtgcgcaggtggctaccgtccttgagcgtccagaccttgcacgtgccgtccatggaggccgtggccacgacggcgtcgcacccgccgcgcccgcacgcgacgcaggtcaccggcgcggcgtgcgccggcacgcggtagagcgagaggtcggcggagacgctggcgtcgtcggcgtcggcgtcgacgtcgaggacggagaggagcacgaacacggctacctcgccgtcgtagccgccggagacgaggagcgagccgtcgtcgctgagctcgaggcacgacacgggggcgctgccgccgtgggcgcggaaggagcgcgcgacgtcgcccgacgggagcgcgatggcgtggacgcgccctgacaggccgccggcgaggaggtgggagtgggagccgccgcgcggcgccgcgacgagcggcgcgaccggctcggggaccggcagcgaccgcgcgggcgcccgcgaccaccagtggaggaggagcacggagccggcgcccgtgacggggcagacgtgggacgcggcgacgaagggcgccgcggcgcccggggcagcgacgacggcgaggccgtgccgcgacgtgttcaccggcgccgggaactcggccacgacgtggcccgacaccgcgtcgtaggccgtgaccggccggccatggcaggccgcgaggatgagctcgccgtcgccggccagctgctgggaggaggaggaggaggaagaggacgccgccattagcacgcggcgaccccgccgtgctgcgtgtcgcgggttcgccggtgcaaactgaagaagggaaaaaaaaaggagtgtgaagtgacctgtttggctctgattatttgcgcttttataagtataaaaatagttttaacttgtagcctaaactagtagccgtttcattcagagcttttccaaaacggtaagctagcttaaaagcaagcgatataaaagtacaaaatcaaaaaaattgggcttaaaagcctaagcggataaagttatgccaaaaataagaactgtaatattagagcaagtttaatagtatagctaactactaactccaatttatctatagccaatttaatagcttattcatataatagttacatactacactatcaataactggtcccacctatcatacacacactgcatcttggagtccatactatagctggctacaaatctgtagcccactgctcttctctccccttatttatctttttaaaatatatttgcagctgacttatagcctgtatctgctcttaaaagtaggtctcagtaactgtaacatacctctatgttttttactccttgaatgataacaaggatcatgagaaaaagaaacttgcaatttgataatgttatacacttatagagtatgtgcttaacggtgtcttgttatactttgccgtttacaccgatgattatttgcgttcttaacattttagggcttgttcaattaatcccatataaaaatgattaagaggattgaacgtgattaattccacgcattgctctgattcctacaatttgcggcccatcccgtgaaaagctggatcagcttttcaaaatccggcccataaatttgatgggccctaaataaattcgtgtcctccacgaggagagtatatgggcctccacgaagataagcccggcccaattttatcgctacgatacttctctatcaccactcctcgtcttcctcctcgcctcatctccgctccgctccccactcgcgctcgagacgccatccccagccaaaaccccgagcgaacgatggagggaggagccctcgcactcccgcacttccgctcgcgcgtcggcatcggctcgcccatcctgctctccgccgaccccggcgccgcccgcaggagctccggcgcctccggtagtaccccgcatttccacgggattgctcattgtttggttaatcggggctgtcatttgtagcttgcctctcatgggggatttggttggttgttgtttttttttatgtggaagggaggagtagggtttcgagggttaatccaggagcgtatccgagaagtgcaggtaaattgaggggagttggaggttgctgcaggctgcagcttcgtcgtgctgtttgattggttaattatggctttgccgctgatttacctgatggataaactgtaaatttggtctattccatttgttctgcgaagggagaggtaggacttggaagcgtgacagcccggaggctccacctcgccgatcaggtaaaaatgctgcttggtactgagaatcactcgtgtagcaaagcatgtttggttgactgattaggcactaggacagtgttttcctatatgaaattgaaccgtgtcactggctgcatgacattcaactgccttatgtcacatgtggcaaactggcaattaatggaatgaagatatactcacctaaattcaaaactagttgcacagcggtaaacttcacatgtttgattatgtgtacagaagggctgatggcctgatgcattttgtaaagtcggcaattcttgcacctggaagtcacttttacaaacttttggaatagtatttgcatgtgttatacaaaagtcacacatatgcttattggagtaactaaggtggacttgctgcctctagactcattttctggtaaaagaacaaaaatagtaaaggaaacccatgcttggggaaagttaggtgaactagcaatcccttctgtcatgtattctcgactgacgccacctcagatacttcagttgtagatttgagtactgagcaaaaggttacacttacacagtgagatagttgccactttcatgaccttaaactttagaacattgtcatgtgtgtctggaagtgatgaattgtatctttctaatctcaatccaggaaccaggattgctacatcttacatactgaacgtactgtgctaaacttgtgtattgtttgtttgcttgtctacctgcaagcacttgtattcgtcgcatcctgaaagcattgttgtttgttgttggtgtctgctgacttatcgtgcaagtgatgtgagtctttactaatccaaacattctatctttttcaggaattactagagttccaaatcgtagtcctgagatgcctactgaaagagcaggtatctcatcactacttgaataacgagagctattcacttctttaacccaattcgttttttctcttagggaggactaaggtttcaaatgtaaatttggaggtatctcatcacagagcaggtaaaacattaatgatatggtactatgttagcaagaaaatttaatggttctttgttgtatctattattcattagtttactatctaattctttggccatgctttaatttttcatggttttatttgtctttatcatttgcattgtttgtgtcgttggagcagttgcagcagtgaggttgctaaggattgagaaggggaaggcatttgtggaccttttgaatgagaaaggaaacagttccggagagaatgagatgagctatgtcgaaaggacactagggttcagcatacggtgtttggataacagggatataagattggtaaaattacatattccgcatgttactttgttattctattcaccaacttcgatttgttcaagaaggtttgcaccatgatggttatagctatcaaacggcaattgttgagttctgagtaaaagataaagtaggaggcggcctgcagaatgaccatatgtgatattgtcctttctttatttgataacatgtacctaactaattgtcagtgttgttttcttcacttatgtctactcgtacgtcatatgatataatgtgtgaatgatgctgaaataatgtgttcatgggttgacaacattccttagaagacttgtgtatgactctgttatacttggattgtaggttactgtcatagtcgctggaactgtgcgttggaaacggtaccttgattatctgatcatgtcactctgtagtgaggagaaggtgttcagggagatggaaccactacttctgcaggtttcttctatatctcttacagtatactatattctttattgacaacctatattgagaaaattaggtaagtaccatcacaaagctgtggaaattggaaaatactattgcatgttagatgacatgtggaaaataccaaacaatttggcctgcaactacagtagttaactccacactgtagaatctctgaagtttagcatttttggtttcagatattacgaattggtttctttgaaattctcaagctcaatgtgccagcttatgctgctgttgatgaggtatgttgattttttatatgtccttgggagctcccaagggccttaaaaagctcatgtctatgccaaccatatcaaattttgtatcaaaaagcaaaataatgtggaaacgtatatctctttctctgtatgctttgttccataacggagtttgtatgaatgctgttgttttatggtaatgataatacatttaaccatgatttctccacagtttttgtacttttccttttcatttcctgtagtactattatgagttttatggatggtggcgataaaagggcttttgaggatgattatgttcctggacatgctacatttttgttaaattatgatatttgccagtatactatatctaacctaataaagtgaattttattgatactgctgttataatattctgaagctgattcacctgtttcactgatcttttgcattttgtcctttctttgagataggcatgtcatactgttaccatttgtatttctaacgtacctgacaaatgtaaagaatctagtaatgcttctttcaaatcacaattttagaatgtaaggcttgctaaagtagctctaaggcctggtgctgggaacctggtgaatgcaattctgcgtaaacttctactgctaaaggtatgaattagaactaatctagccagcctgatcagtaggattgcactgtagtatcgttattttgttttttcaattcaggaggcaaactctcttcctcttccaaagatagaaggtgatgatcgtgcccaagctcgcgcactttccattatttattctcatcctgtcgtaagtttcgtttaccctctaaactttagtttgcttctgtttcttagttttctgtgtgctagattattcattaatcaacataccaattccacttgaccaattatcaatcaatgcccttgataactaggattgtggactcacgtggaattcaatctactagttctatctggcaaatatttgttaagaacacaacagaatatctgtagaaatttcattttttaatctataatttgttttcttctctgcagtggatggtgagaagatggattcgttttctgggcaaagaagaagctctaaaattaatgaaatggaataacagtgatcctcatttcagtataaggttttaagccaaatgatgtactgtaatatacagtcacctgctctgtttatgcatgtccatatggttgattcgtcttttttatgccttatatcatagggtcaacacagcaaatgggtatacaagggctgatcttatagatcgattggaaagtttgcaggtgcttccattaagctttagtaccttctgcttgatcaatataaggcttaataaagttcataaggaagcaagaatgaatataacatgtaccttgtgctatattatgcaatggcatttaattatgtcattcggctcgctgcggggtatataaattcattatatagagctattcaggactctaataccttatccatattgatgtcacattctgccttgattatttgctagataatttgatttccttttatgtaggttcattatgagaagtcaactatggatgaatttgtccgtattcaggagggtatgcaggtaaataaactgatagttggttttcaatcaacgactagtcactagtgctgtgttaaacttaaatcaatatgatgtattgacatccttgtatttttttctacaacgcaatatgttcagtatacttacaaaatagcactgtttcaaaacctaaatttgttcgtgcacataagatatcgacattgattgcagttctaagaaagtgaggctgagaggcagatgatctaaaaagaacttataagaaataatcctgaaataatgtttgtgcagtagcaagaaaggggagataattttatacttgtgatgccttagatgtttaatgattattatttcttttactgttcagagtataagtattgatcaccacatgtattggatcagtcaagttgtgtatctcagtagctgtacaagttcgtttattttgaaagaaacaacttttttgaagcctttgtggtttgcaactttggagatggagcaccaccattgtgccctttatacataacaaaatatctgcattcttttatatttgcatacttttatatgaacattacttttactgttcttattttcttgataatacctcttgggatattatttcagaattatcttaatttgttccatgtacagactgtcctgcaagctggactactgaaagaaggcatgtgtgctgtgcaggatgagagtgcaggcaagttatgatagttatttcttgaccgctaagcatatgccttaattagtacaataagattactatattgaagtgatgttgactgcaaataactgtacatggcttatgactatggaaatcgtttcagttttactgtccgtcacttccattaacctgagtttttcctttatccttgaggtttccatgtctaagtgatagtggtacttctcatttgagtaagcacttgatacttatgctaagacatgaagaatctattgtaggtcttgtggtgtctgtggtcgatccacaacctggggaaacaatcattgattgttgtgctgcacctggtggcaaaactttgttcatggcagcccgtttatcgggacaaggtaagaagatggaattgagagagggttcaatcatctgttgatatcacactcataacaaggtagttgtaggaaacttatttttttatgaacatggcacatataaatagacaatgtatttagcatgttatgtccataaaaaatgacgcacaccttcttaatgaaatgaagcacagttctcatgcgtttccgagaaaaagaatgacacactgaaatgaattacttttcacatcttactgcttttattaacttattataatattgagcacctgcagacattggttgttgagatctagttaatttgtcagatataaaattagtgagtgcagtatgtccatggagttaaaatgaagaatgtggtggctttcttaatgtttaattgctataagtaactgttcacgagttcatccttttgcatcagcaacgcgaaccagcatttgtaatttttagagcaaattccaggaaaccttgcattttattacaagcaaatataactcacatgtccaaaatagttttatgagaactcattttgacgttccatccagaggtagttccaagtcatcatggatgatagtagcttagagatttgatattgtggacttaccatgtagtctgattcagggaagatatgggcacttgacataaacaaaggtcggttgagaattctcatggaggcagcaaagttacacaatcttgatgctatgatcagtgacatccatgctgatcttcgactatatgctgtaagtttaagaggaaatcccttgtttctaaaccagaaaatggggaacaagaatatagaaagtccccataaatctaaggatactgcactccaatggaagtatttattaggaatatgactagtggctgttatgagcttattactaatcgttatccaaatgtatgatgtggaggcttatacatatgaaaaaattgcagaaggaaaccactgcaacatttgacaaggtactgttggatgctccatgctctgggttaggagttctttccaaggtatctttgttaagcaagttcattattttgctttcactgaactaatctaaatcttgaataacaaatgattgatgaactgataatccttaatcctttttccgttcccaagagggcagacttgcggtggaatagacaattcgaagatttggaggagctaatgtgtttgcaagatgagcttcttgattctgcatcaatgtgggattccttctcctgcaaatctgtgaaagaaaatttatatggctaacatctgatattactttctggttttgcctgtaggttagtaaagcctggtggtatattagtctacagtacatgttccattgaccctgaagaaaacgagcacagaattgctgcttttgttcagaggcatccggtactagttcgtcttaacatcaaacgtggatcatttactggaagttaataaactcaatattaagtttgatttgagaaaataagtcccttatggtttacagtgttgttggtaatattgagcatgctagtaaaacacgtgctaaaagcacatgatctctggtgcaacttagactgacttatctcaactaacgaggtaataatcacaaattcagttgctgttggcacatgttaatccagcttttggaagatcccatcattcacactacattttaatattgttaaccctgatagttcagatgtgagtttaacagtaatatagctttcaagcatattaagtctccacgaaatgtaaacatttaagcatgttttaccacttttttagtgaaccatctctataaccttgacatcatttatatactaaaatggagttgccacataatgttgtattttttcgcactaataatttcgcttttgacaatattttatgctatgcatggatatgttgtaaatcaattttatgctgtaggactttgtcctacagagcgtgcatggatatgttcctgctgaatttgtcacagatgagggtttctattcctcaagtccaactaagcactctattgatggggcatttgctgctcgtcttgttcggtccgtcctctaggagttcaacaaataggtgagatttattataacaaagaaccactctatttttctaacactgtgcatcgagttgctcctctaagaagcaaatctgcagtatctgcacatgcatgtaatctctcctttcacgttactcattaaacagcatggttctttggcttcataaaagagagagaagaaaattggtctttatattcctcgtttcataattttatattgcttctcattctgtatgcagataagctgtcacaatgaagaatgctgaggtcatcctgattcctggcaggcaaactgcattttgatgatgatgtaccacaagatatatatgttgagagctagaggtacccaaaaccatacctgctgacttggccttcacctgagcacatgttttatttcttaggaccacacggagtcacaatttgtattcagttctccaataatttaaatggtcgtacttggtgcctcggtgattaaaacttaaaagataatctctaaagttactgccttaatggtgaaatctgattggatgtttacatccaaatgtaaattggcatttattgattcagtttagtcagcaaatatattttttgaggacacaaaagagttacattataagcatttgttgaaatgcttgtaatactaaacatgtacttttacaggagaaaggtacttaaggaatttctataatgcaagtacacttcctgtgtatcatactattatgtgctttttttagtgaatttctctgctagtatctgtaggtagatgatcactaaacatgcatgaaatatatcaggagaaaatttattctaagaaatatctagtattttatcaggaaggccaacattacaaagccaagggaagctagtgtgactgatgatggtattctccctttgtccttccttaggaacattgcctcataaattgggatactagtgatcactatcattccacagaggatgacctgggttagaaatacattccatggcatatttcatacacctgtcattatttgacttagcacttccactaggcagacgaggttgagtagtgcaacaattacaatgatcacatattcaggatatgatgacccaagttcaatgatttcttgtttatacctctttgcttcatctctattacttacctttgctgtaaccgcaaatgtcatcttcgacagtcctagcaacttacggatggtatcaatgaggtcgtaaagatatgaggtaattcttctaaccatccacatcctttgtccattccaacatcctttcaatgtatcccctgataataatgcctcatatagactgtatatattcttcacagttcacacataatacatatacgaagggtgtagcccatggactcataatctaaatggcatataaacataggattagttttaataagagcaatatgaaaccaaagtgaggtttatcatgtaatattacctctgggaatagaggggtgcccttcacaagcctagtgatggaaacataacataataaagcgtaggcagtgagttggatgcccataacccaaataagcaatagcccatctgtagttgtaacttaatttttccatgtccaatcaagaaggggcagttctttgaaaaaaaaagtgttaaattatcctcaccccatctcttgcgctgcagtattgtctgggcaagtgttgctggacccacacccaaaagtgctgctctttgaggattgatgtaaactgactcccatcctctgcaatttatcgccaattcagtgaagattatcttctaccgtgcaaccatattttatttcaatctcatttccccactgtgtcctatgttcacaagtgcaggttgctaaagattttgccttctcttcaatctcatatatgtctgcctgtgttttttcctttattcctctcccagtcttccttgtagtctttgctgaacctcctacacaaaggatctctcttatatggaaacgtccagtaccaatgttatggattggctagggtaagggtcctaagaccgggggataggcgctcgccctctaatagcagaggcagggcttctctctgctgagctaaaagaggctctgaggcttagggctaactttagagattgattgattgattatagagtccatggggtccctttatatatatagggaggacagactagatacataaggaactagtctctagtattatataaaccaatccaatctctgtctctagctttctaataaacctcatctctttcctaactaggtaatctcctatatttatgtgacttatttctaatttatcatgcctaaactgttgcatggccttggcccatgcccataacaaccaatgtagggtgagccaacagcactgtccataccacacatatccaccttaacattgaattgttttgttagccgaataatgtatattgatagtatagattattaaaaacaagagaatgtattaaaagtacaatttgatacaacttacctcattgagaacaaggagggaatttccatatatattgttcttggtcatgttgtatagttctgagggtactgtacaaatccgattttgtggcccatttcttcatcaaggaagaagcacaacgtacctctgattgagtcactgttattggaatacatgtcgcagtccacattcaagataatagggttgttacatatctatatttcaggattgaaatttaacatattttaaaatactttcaggaataaggcatttcctgaatgttagaatactttgtgaaaatgctgcgataaattgttcattgaacaatgcacaactgaccatatggttctaactccatgcattttttttctgactgaagcaaacagtagcaatacataaccttttggttggttgttgcacttgtagaacctactagatacttcttttttttttttaactgaaacctacttgatacttcatttttcaaaatgaaagtgtggaacaacttgttgcattgttgtatttattacaaaatgggtaaggtaacctctaatggaaagtagggattttataataaatttgttaaccttgtttcaaggtaaaactaaacaaggttagggaacacaccaaagcgttcatagcccaagatttgaagttatggtggtactgaggcctcttctcacgtgccatgtataccaggcttggtagcacatttccgtcatcatctactacattttggcttttcccatctataagtatctatcaaagaagcaacattttttttagaacctgaaattcccaaaatggaagtagtatggatttctttactttgtaatcatgaaatttttaggacagtaaagcctacctgaacaattggcggatgatttttgaggcaatttctgagttccttccatcaaatcctttatgattcagtttaatttcttcaggaatttttcctaacatgacagctgtatcaatcctctgtcatttctttgtacaggtcctgccgataaaagaagatcagttgccataccaaatgttgagaattataagccgtaattatctgtgagtgcatattcatcccatacttgttgattatcgatgtcttaaagaagaatgttaagaaatgcacataccttgataaatgaccattcttttggggtgcacagattgtgatgcccttctgactccacgaagaaagcagctggtggccttggctcaatgttataactttttgcagaatggtagccagtgctttgcaaacacggaggcctcccatagagcatagaaagtaagaattgaacctccatcatcagaaaggtacactcttaatttttttgacgggtaattgtatgccatgactgatacgacggtagatatgacaagacttggtggttctgagtgtgggtctgccgtgcatacaaagatatccagcttttttttcatgcatgctccaaatgacatgttaaatgtgtttaggcttattgtggtaaatagctgtttgaatgttggctcgtgtgtaaaacaatagaacacattttaaagagatcttcccttcaatgatttaagctagctaaactggtctacctttaccttcctttagtttaccatcttcaattttttgagatcaatatactagaaacaaaccggacatgttctgaagtccttttgctaaattcaaagcataaatcatcaattttttgttgtgtactgttagagtataccgataggattctagaggattcaattgttacggtaggataggattggtttccatttcatctctgagattccttgatataccgacctgggaggctaaatacaacgaacccatattacacaatacatctctttctgtacacactttcatgtacaaaagatagttctgttccttttgcagccatttttagtaaagctgagataagaaatgttgatcttttagattattgtatatattttgctaacagaatctatatactcctattatactacctccggttttaaatatatggtacctttgattttttttaatttgtttgacttttttgtcctttctagaaatgtttgtgcaaatagacaaatatacaaggcacacttaagtacttggatagatctagggggtactcttttcactttacttataactaagtaattgaataaatattgctgttcaaagtttgaggagaaagtaatggtgtcgtatattaaaagaacagagggaataccattatatgcacgaaatattttgagccctgaaactctaagctgcaatagtttttttattattttcttggtgcattaatatgcgagttcctacccgttgtagttataacttaggcccttaaaaaaagttatgacttatgatatgagaagttgagagaaaaaatgatgttgtaagaaaaaaaaactgctgtcctggttgtccagtcatgagatttctttgttgcaatgtttttttttaagaattaacataagatttgcgcatgtgtataaacatatggagaatacggtataagatttgcatatctttgtattaagacatgaaggatacatataagatttgtgcatcttgatctttgttgaaaggctcgttacatcagttttttgaaatccaaatttggtcggtcaactgacatttcaaacactgtaagcgagacaccgttaggttgccttcgtaggaaggagatgagaaccaatctcttgtgcacggaaaacggagcgatccattagcgcgtgattaattaagtactccctccgtcaaaaagactcaattcttgggtttccgtgtccaacgtttgaacgtccgtcttatataaaatttttatgattagtatttttattactgttagatgataaaacatgaataatactttatatatgacttatctttttaaattttttcatattttttttaaataagacggacaatcaaacgttagacatggaaacctaggaattaagttttttttgggatggagagagtattagctaatttttttcaaagagtaaagtgtattggtggtcctc

SEQ ID NO: 64009 - DNA, 2703 bp, Oryza sativa
  unsure (1)..(2703): unsure at all n locations
cgtatacctagctgatttcaacggtaatggcttctgatgagcgctataactgtgcggttttcacgagtaccgccaaaccgtgggtgacgataaccacaccctagatcaatcagatttcttacagttataaattctacnntacctccattcccaaatataccagattttagttagatgtaatatattataatacaacgaatctggagagaagcatccaaccaaaatctcttatctgtgcgtttagttcacactaaaattagaagtttggttgaaattaaaacgatgtgacagaaaagttgaaagtttgtgtgtatgaaagttttgatgtgatgtaaaagttggaactttgaagaaaaagtttgtaactaaacacggacatatatatatatatatatatatatatatatatatatatatatatatatatatatatatatatatatagggacagtactaaattatatcgggaacccttgtcgcaaattgcagtgctagctgcactaggagtacaaatccctagtacagcgtagtactccagtcgccggctcgccgcacaccatcgcccatcagaccctgccgccgcggtctcttctcgaggcctcccgttccctcttcccggcgagctagcgcaccgcgcgggagagaaaggagagcaaaaaggatgggcggcggcgagtgcaggagcaacgactacggcgccgccgcctactgggacgcccgctactcctccccttccccctcctccaccggcaccaccggcggcggcggcggcgcgttcttcgactggtaccaggcgtacccggcgctgcggccgctgctccgcgcccgcctccccgcctcctcccgggtcctcatgctcgggtgcggcaactcccgtacgcctctactacctcttttacctgcgtgccttcactcacactagcttgaaactatctgcgtactcaaattcaacgatttcggcgctaattcgtcgcgcgcgccacatatttttgggaatgcactggagtagtagattaccctgttgcattgttatactaattatacggtcacacctatccgttgcatgatgcagtttgatcttattttggcagttttgtcggaggacatggtgaaggatgggtacgaggaggtagtaaacgtggacatttcatccgtagtcattgagcagatgagggagaaacacgttgatattccacagcttacatgtagtgttttcattgataatttcaaactcatagtttgtgaattatggtttctatgcaaggtctatttacttggtgtcttgtgttttaagatttccagatggatgttagggacatgagtttgtttggtgatggaacattcgattgtgtccttgataaaggtaccttaagaattttatttaccgaagcttgctaatgctcttgtggaatacttttttatggaatttactgaataaattcatttatggtatttgtttatttttcaccactacacttaccttgttatgacggaattatggaaatttctgaaggtacattggacgctatgatggtaagctttacttgttgcacaaacaacattttagctttctgatcaggcatgaaatgaaaaatcatctgaccattattgttgttgcatttgatcttactattttagtgtggcgatgatgctcctcttggtgcttccaaaatgctagcagaagtggcaaggtgtctggcatgaaagtttatccttttcactcttttcaaactagttggttcccaatgattcagtatgtttcatgttgaactatttttccccttgcaggattcttaggcctggtgggatctacatgttggtacatcctctaaatctaaacaatacagtgtgtaatcattttgcgtgggatgatcttatggagcgatgatgttcttttgcagataacatatggttgtcctaaggaacgagtgcaacttttgtaccaatctggaagccacaaaaaaattgaactgtacattatgcgtaagtatttttcttatgctatttcttgattcatggagctggacataatttgaaattccagaaggaaacactgaataatggggagattcaggtttgactgattccaaagggaaacattggttccaaagattggttgattctaatgggaaatcttaaaactttgatttgacgctatgcttttaatttctcagttggacctgataaaatttactgttatcattttgcagccacacctggataccagttgaaatggagcaaaggtgtttcacttgcacaacctatcatggaggaagtttcattgacagtggatggtcaattaccacctgactatgttcttaaagatccagagtcacattttatttatatttgcaaaaagccagatgccgctaatgaagctaattctgtggttgctaatgaaggggaaaccataacttcaaaatgatcttttgtatccttaatttgcattttgttttgggttgctgacgagccttggatagtatgtgctcataataaattttgtcagatgttactgttggatgaaaatcacgaccctctttagccgcctggggccccaaaggttgccaatctgtgctcgatatttcttctcggaacttggaagatgtgacacaaaattcatatgtatttcaatatgctttggaaggggccagctgagttgtgttaagcttgtttaaaacgactgagttcctgtttatatcgaca

SEQ ID NO: 64010 - DNA, 4759 bp, Oryza sativa
aagaaagggagaaaaagagaataaaaaagaaaatggaaaaactttaaatgggtcccatttgtcagtcaaaatgatgccacattatgtccgtgtggcatgccacatcaacgccacgtaggatcccaaaggggttatggcgatttggtacctagatgacacactatgacaagttctgggacttggatatgtattttgagagtttagggacctagatgacatacccctacaagtttaaggaccgcccgtatactttactctttttcaaaaataaattaatatgatttttaaactgcttttgtatagaaactttttgtaaaaaatacactgtttagcagtttgaaaagcgtgtgcatgtaatacgagggagaggagttgggaatatgtggtgccgaacatacccttagtgtggagttgtagacgagcagtaatatacatgtctttttttattttacaaaatttaatatactatctccatttatttttatattttaagtcattttacaattgtactaagtcaaacatgttcaagtttgaccaaatttataaaaaaacagagcaacaatttcaacacaaaataaagatactacaaaatcccaatgcaactctgtttcataaaaaaaaaagccaatttctatggatgaaaacatgcacggttcagattcatctccctacagtgtctttctttagacggaaggagtatatatatagggcctgtttagatcccctcgcaagttttttcacctgttacatcgaatgtttggacgcatgcatgaagtattagatatcgataaaaaaactaattacacagattacgtgtaaattgcaagacgaatcttttaagcctaattgctttatgatttgacaatgttgtgctacatgaaacatttgctaatgatggattaattaggcttaataaattcatctcgcagtttagaggtggaatttggaatttgttttgttattagactacgtttaatacttccaatatgtgtctgtatatctgatgtgacacggcaacatttttcaccattgaatctaaacacaggcatagtcttgtaatatgaaagagagagaccaagttcttgaccgttcgatttatgtgttaggattgatggtcattcatgtcaaaatttatgcgtgtacgaggatccaatttgaagagagagacagttgtaacgcacaaaagtgaccaacctctcggcgagcctgtccttgaacgtgcggcggcggacggggcacaccaccggacggcctacctgcgtgacgacccagtaaacggtgtaccgtgtacatgacctccgccgcctccatccctacccacgccgccctcccctcgccgccggccggcatgtgcgtcgccctgtagtacagcaccagcagtttcccggcggccaccgtcgccgcctggaatggaatctgtacaccgccctgccgcccatattctccttcgccaacagccgccgtcgtcgtctacatcgccggccgatcagctgtcctctctctctctctctctctctctctctagcaaattaagctgcttatatgcgttttctctacagtgagcacttggctaacatatatatagctctcgatcactagctcatacgaatcatttgactatgcatatctgatgcaggaactatagtaaacgtgtaatgtcatgctacctcttatctgcatgtaggaacataatacccgaagttatatgtcacaggtcataatacctgatcacatgttcccaaaaaagaagttcctctgaattatatttttgaggaagagggagatgcctctcccttcctgtgaattatatgttctttttttcctgaacttctgttctaggcatctatatgctgatgatcattaacatgtgtgaaatattcaagagaatttcatgaaatggcaatgcaatttattttcatgatcatcatcagaaacacccaatgttttataaggcatcaaatcccattttagggacctcaaactattggtactaggaatgccaacattacaaagccaattgaagctagtgtgactgctgttggtattctcccattgtcctttcttaggaacattgcctcataaattggcatattaatgattactatcattccacagaggatggcctggggtaaaaacacattccatggcatattccagacacctgccattatttgacttaaccctccaactaggcagacgaagttcagtaatgcgacggttgcgatgatcacatattcaggagacgatgacccaaattctaggatttcttgctcatacctctttgcttcatcgtgaccgcttacctttgctgtaacttcaaatgacatctttgacattcctacacattttcggatggtgtcaatgaagccatatagatatgaggtaatgcttttcaccatccacatcctttgtccattccaccatcctttcaatgtatccccagataataatgcctcataaagaccgtagagggtcttcacacaaaatacatatatgaagggtgtagcccatggactcataatctaaatgacatataagtgtagtgttagtttcaataataaacaataagttctaatgatagaaatgaatcaaagtactcccttcgtactcgtaaaggaagttgttttggacagcgacatggtctcccaaacataactttgacttctgatatatgtatatttttatgaaagcatttttcaagacaaatctattcatataatttttacattttcaaactcaacaacttaagagttattcatgatttatattcccaaagtttgacttaaacattgtcctaaacgacttcctttacgagtacggagggagtatggtttagcaattagcattagtttaatagtacctgtgggaataggggggtgcccttaacaagacctagtgatggaatcacaacataatagagtgtaggcagtgagttggctgcccataatccacatatgcagtagcccatctgtagttgtaacttgatttttccatgtccaaacaagaaggagcagtacttcgaaagaaaaattgtgagattaccctcactccatctcttatgttgcagtatattctgggcaagtgttgatggggctaaacccaaaaatgctgctcttttaggatttatgaaggctgactcccatcctctgcaatgtattgccaatccagtaatgatatcctctgccgggaaaccgtatttcactccaatgtcattaccccactgtgtcctatgctcataagtgcaagttactaaagatgttgccttctcctcaatctcatttatgttctcttttcctctttcctttattcctctgttccagttttccttgtagtctttgctgaatatcctaccacaaaggatctctcttctgtggaagcatcctgtgccaatgtagagacaaccaccaacactgtctaaaccacacatctccacctttacattaaattgttttgttagcgcagaaagatattaatttaatgatagaacaaattgttgcaaacatgaaaatgtattgaagttacagtttcatagaacatacatgatagctaacattgaaagagtttccatatatatcattttgggtcatattgttgaagatctgagggtactgcacaaatccaattttctggcccatttcttcatcgaggaagaagcataacgcatctctgattgaatcactattgttggaatacatatcacagtccacgttcaagataacagggctgtcacttatcactgatgatacccttatctgcattttaggataaaatttaacatatttaaaaatattttcaggaacaaggcatgtcttgaacatcaaaatattacttgagaaaaatttatgatcaattgttgactgaatgatgcacactccatcgtatgttgtagtttaatatgcagaattgataattgagaaaattatgtgatcaattgttgattgaattcatccattgttcaactatatgcattttttcttactaaagaaaatataatttaatgaccttttggttagtggttacctgtagaacctactagatacttcattttttaaaattcaaaatgaaaatgtggaacaacttgtcgcactatttttgcatttataagaaaattggtaatgataacgtctaatgagattagggagttcacaataaattagttaaccttgttttaatattcaaatgttaaaccaagttagtgaactcaccaaagcgttcaatgccccagctttgaagttatggtggtactgaggcctcttctcgcgcgccacgtataccattgttggtagcacatttctatcatcatcaattgcatttcggtttttcccatctatcagaatctaccaaagaagcaatatttagaacctcaaattatcaaaactgaagtgttatgaacttctttactttaatttgtatagtgaaaaactttgtgctgttttctgggacagtgaagcctacctgaacaattggctggtgatttttcaaagtaaaatctgagttccattcatcaaatcctttatgctttagcttcatttcttcaggaatttttcctgacatggtagctgtatcaattctctctttcattttttcatacaggttttgccaaaaaaaaaatcggttgccatgccaaatattgagcactatgaagttatgaataggacatatatagtttctagttatatgtgagaagcttgactttaatgtggggccctacctgttgattataaaaatctcgaagaattatgcttataaaaatgcacat

SEQ ID NO: 64011 - DNA, 15384 bp, Oryza sativa
gacagaatacgcgctcgatcgatcgtccactagtatccccaaatttaggaaatctcttttctacgcacgcagcaaaatctaccatgccagacgatttaattaattaattctcggttgcgtgaaacaacatcactctctttttgtctcttctacaagcaatcccgaacaggtaggatcgattcgttcagaaaacactcacccgtagattgaggaacagccacgcaccgtgtaaacgacgcggatctggaccggtcgatcaacagcaagcgacgaccgcgatcgagcacagcacaagtcaccctgtcgaaacgagccactattcacccaaatccacgcggagtactccggagatagcgtcgaccaagcgcccgcgcgcggtgcactcgccggccggcgcgcggcgagccggggagcagacgctggcagctaccggcggcgaatcggaggaggaagggttggggatcgtgggggaactcgagtggtggtggtggtggtggacgcctcggtcttcgagtggagcgagccttcgagtgaaacacacaaacgcgtggcgtggcgtggcgtggcgtggatgctgcgactgcgactgcgacggttgggaagcggacggctacgagcccgtctccgttcttcctactgcggggacgaaacagacggtcggacgggcgtggtcgtcccgtcccgcgtgggagcccctcggcccctcggggcaatggcaagtggcttgataagttgatagctgccgtccgatgtcccgaagcttcggccaaagagcattgatgagatacgtgccattgcagaaaagggaagacgactatggccgtgttagttccttttcaatttttttaattatacggttacatatttaaattattaaacgtggactaataacaaaacaaattataaattccacccgtaaactgcgagacgaatctattaagactaattaatccgttattagtaaatgtttactgtatcaccacattgtcaaatcatggtgtaattaagctcaaaagattcgtctcgcaatttacatgcaaactgtacaatttcatattcgtttccactacaagaagtggattaaattttggattttcgtggcacgtttttcaaacggctaaacggtgtgtttcgtgtaaaaactttttatatgaaagttgttctaaaatatcagattaatccatttttcaagtttataacaattaaaacttaattaatcacacgttattaccacctcgttttgcatgaaacacttaatcttcatcttcatcttcaggagattcaaacaccaccttaatgctccatgcatatgtgtagacatttgatgtgatggaatttttggaagtttgaatggaactaaacacaacctatttacgagaagagtttagaaagtatatgttcctttcgatttcataattctgaatagccaacactgtccctactcctaaatttctacttcgggctcagtttagttattgagatttcaaaaacaagttctccaaattaatcatttgggttaacatagtccttagacccacaaaatatgccttattagcatgccaagtcattctcgaatgcaactatataaatgaaatgaccattctacccttataaaccatatagaaagaaagaaaagaaaaaaatagaggaaaaaagaaaacaaccaaaatgaacaagcaacctgttagttcaagtcagtctccacacatgctcttacgtattaccaggaataccattacaataatctgtaagaatcatttttactttcaaaaagaacatgccaatcgaaataaaggaggatcaaagttgttgattccgtccgtcatcggtccctgcccgacttgagataaaattggatgacaaatcaaactcgtatttgaaggcctcattatttggcttatgcttattcttataagctaaatttaaactttagaacttaattttggattcgattttttggttttttattgtactttattttaccataatagtttttgagtcactaagaacatatatataaaatatttgcacacatatattattttatttagtaataaatgattcggataagcacatgaataaaacgaaacaatgggttgtgattatttatccaccgacacatatgtacaaattaaattggctttaccgttgcaacgcgcggatatcttttctagttatattagaaaatcaaggttaaatatatattttgtagactgtgtcattgtccaaaacatcaacaattatatatggaaccgggcggagtattgtaacgccccgattttcgttcgggtttaaaaattattaaataatgcattttctagaaattaaataaaagttaaatcaatttaatcaagtgaaataatgggagaattaaaattttcccttaaaaatcaatggccgggaatattttgcaatattctttgtgccctaatgtactctccggaattttccgtgaattttcggagctcgagaaatagttttaatggcacaaagttcatcgaatcaattaaaataaaaagaaaagaaattaaaatcctctctcctctctttgggcccctttcggcccaacccctcctttctctccctctcgggcccggccgccctccttttcccctcctcccttctctttgggccgtcggcccggcttgccccctcctcgcgcaagtccgcttcgcctccctcatcctccctcctctccccgagccgccgacaggtgggccccacctgtcggggtcatccccaacctcaggccggcagctgccgttgccgccatggccgccgaaaaccgcccacgtcgccgccgtttccgcccacctcctccaccccgcgcgcgcgcgtttgtccgtgggacctcgccgcccacgtccgcgccgtttccccccactctccccgcaaaatccggccacgtcgccgcctcccgcgtctctctcttcccccacgacgccgccccacttcccctcgaaatccgccgctccccggccctctcctcgcccctttgagctataaaatcaatccccgtgctccccttgtccgtttccccatttttcccgagcccggcatactctccctcgctctccccacgccgcacccacgcgctgccacactccggcgagcttcggtcgccgtttcccgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgcttcggtcgacgtcgactcgcgccgttgcctccctcagctccgcaaggacgaggaggaccttggccgccgcccctcttcgccggaaacccaccggaacggggtatctctcggtcgccggtgagccccaccattcctctcctctctggcgtggtattctcgccgctccggtcgcctatttctctccctaaccgctccaatattttccctaggtcttgccggccctcggccgcggctccgccatggtcgggcgtcgtcggaccgccgttcccgtcgcctcccgtgtcggccgccaccatctctttccgccgccagccgcctccctgtggtcgtctcgccgtcgccgtcctcggtgagaatccccaccgtcccttctccttttttttcctcctccgccgctccccgtgcccgctgccgcgatgcgccgctgtcgccggcggtcgtctggccgtacgccgccgcgcgctatcgctcggccgagccggtttcatgccgcgcccgtgccccagccgcgccgcctcgtggccgtccgatcggctttgggccgatccgggccgtcggttcccgtggactgaatggtgggccgcctcggtggtctcggtccacggtggaccgatacccttgacccgctgacgtgtggggccccgccctgtcggcagccggccctctttgatgacgtcagcgcttaagctttttcctttgaaaaattaaataataattgcgcaataaatcggtaataattgtagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagaatccgtcatttcggaagtccgcggtcgcgaggaaaagagttcggaagattgtttgaagaagcaaggcaagtcacacattccccttgagcatgttgatcccaatttataaatgttttaccgtttgcaaataaacatgcatgtcttgctaattacatgggatccgggtattacctatttgctttcttgtgccatgtttacttgctatctgtcctttgtcagcattgggtaataaatcgactagctcatgttacttatgtgacctagctagaactgtatgcttagccatgcttaattaccactagctcagttgatgggataattgcagtattagacctcctagtatcatgacatgacgagctgcgtgctcgagacatccgaccatgtgtcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcatgttcaacgtggtgtagcgttgatcagtgcagattcaatattactttaattactcaactgttttactgttttgctcaataaaatgttttacaaccgcctttatgcaaatagccacaaaccgtccttgtgttccccttgcacgtctgcatcgttggtgtggcttgttgagtacggtggttgtactcagccttgctattattcccccttttcagaagtgtagtgcttctgagctgaagacgaagttagaagaccaaggctcagaccccagttgagttttgtctgtggagtggagctgaagccccgctaggatcgccttttccgctgctgctgcttttgtttcggtgtgaagactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaagtatgattttgtaaatctacatgattaaggacccgttttaacatgccgaaagcaaattaagtgcgggtacataaaacaaaagttattagcatatagggagtgaatcttaaactttcgagggacgtccgtcattgattgcaatgtcacttaaatagttatgaaaaaaaataagaagatgtattaacgtgtgatatatcactctataaacatgcaacttaaaattcaacttgtacatgtcgcaaaaaaattgattgtgaatatacgttaactagctataatttaatttgtttttttgttgtgatatgtagaagttgaatgtttgtgaagtgatatatcacatataatacatcttctcaattttttttataaactatttgagtgtatgcaaacaacgaggggtcatcccctcgtatgaataattgagtcttagttatttcaaacttgaaaaatgaatttatatgatactttaaagccacttctatatataaagttttgttatgaaatacattctttagcagtttgcaaaaatcgtaatcatgtttaaacaggtgtaagtgttgtaatatggagtttagaggttgtccagatttattgtcttagattatctaattcttttttagattggtttattttgagtcgagacgagttgttgctagcttaactgtgaagaccgagatttaggccctgttgggagcttgtgccagcccaaaagctgcttctgctagaagctgccccaaacagtccacaacttctgagaatctatagttacatatactaaaaaatgaactaagaaaacagaagctggagaagctgggtttcagagctttttcagatcctatttcttagaatgtaaagctcaccgaacagacccttaatggaaatgttcggttgatcttccaagcgggaagtccagcactcatttttctgcttcgttcacgcgacggtacgacgccatttgacaattagaaggtgtagtacattgtctttgccttctctacatatgaccagacaaaatgaaaagaaacatactttctagattggcaaatattcatgtagtatatgtcacgtaattaatctcagactagtctagtacggtacaacgacagcaagacaaacggcggccaatggctcagaggcgcatgtcgccgacagtgacgccaattgattcattgcttcgggtgaggcatcagcgagcgtacatcgatcgatagtgaacttagtgatgactaaacgctacaaatcgctgcacatatatatcaatcatggacaaatgcagattaattgtcacggacaatgacgagcacttgaaaaaaacggctcatatattgtaccatgtcagctgaaaaatattcaaaataaccgtgggcggtacgcagcggcgagaaatgtctaccatgcgcgaagaaaaatggagcagataagatagctacgtgctgttcattttacggaagcaaaatagtttacctttggttgagtgattcatatcctgcatactatattcaaaattaaataaccgtttgtccgttttcaccatcaaaatcgtttgttccatatccgtcgcttccagaattatggttgcatagtgttagtgtatggctgtgtttggatacaaacttcagttcttttccatcacatcaacatgtcatacatacacaatttttcagtcatatcatctctaatttcaaccaaaatccaaactttacactgaactaaagatagcctattattagtagtcagtagagtacaaaacttcacgtcaattttttgcttttttttaaaaaaacaagtcatctccaagtcgtcacgtcatcaccgtaatgatcggctaaggtggtgtttggatctagggacttaactttagtccatatatttagatactaatttagagtattaaatatagactacttacaaaactaattatacaaatgaaagctaattcacgagacaatttttttaagcctaattaatccatgattagagaatgtttactgtagcatcacataggctaatcatggattaattagactcaatagattcgtctcacgaattagtctaagattatagatggtttttattaatagtctaagtttaatatttataattagtgtccaaacatccgatgtgatagatacttaaaattagtcccatctaaacagagtctaaagctagcatttcgcggaacgcgtcgtctaaggaaatctatgacagccaattgaattcctcgtagtacatgtccaagctcatcttatgctcatgcatcacagacaagtgataaattggcattttactattcgtactttgaccgataatgacatacagtagtaaaattgagcagcaaaggttagtgtccttgtaacactctgcacctggtttagtgatatgtcttccagataacaccaggaatatgagttaagataacaaaaactctgccctagtcaggaatatgatgatgtggatattgaccgtaaggcagggtccataccgaacatgcataattcttcaaaaattcacgggaatttcaatcggtttgttgcttacagtatcacatattgcagaatttgaattaagattactgaattgttagtacaagagcatgcatgacgccattcccctggactcctagttccattagtacaaggactgggcttacgagatacagtaagaaactacaaggacggcgctcacgacaagcacttgaattagtagaatccaagagcatgacaccgtttcccttgtaccgttaataccgctgcttcaacttgcttccttttttcttcccttctaaagtcagcgagtacttttccggttgcaatgaacatgaacttgtacatcacaattcacagcctccaagcagcttccagctaagcaagcagctacagtaaacttaagtcgaaggtgctagtgtctagtaggctacttgctggccgactgttatgcggataataaatcgtacgatgtatcagtataaaagggtgaaaagggatataatctattggttatggtgacctgagtaacatcctaatgttttgagtttaaatcttcatatgagtgaattttagattgatatatcccaaagtctttagttcaaatctccttagcagtaaatttcagactgagttgtttgcgggactaacgccgcatttgtttctctagcttgggaactcattccctccgaaaaaaaacggagcagtccattagcgcataattaattaaatatgagttttttttttcaaaaatgggtcaatatgatttttaagcaactttcatatataatttttttttgcaaaaaaacaccatttagcagtttgaaaagcgtatgcgcggaacacgagggaaatggttgggaacaaagagcaacgaacatagcctaagttaccaatttgaatgacctcgtatatctgattggatgcggatgccagacaaaaatccccttctctaaaataaataaataaatttgtataaaaagtatttatggatacattttatatacatatgttattagtgtcagtgtcagggttatgataccatatacctaatagtaattgactaaatctcggcaggacccaccacataccatgtcctatacggaaacaacctgcggatataggagaagttcttgataaggaaagacaacctgagttctacatgaaaacaacaaggattactcgaattgtatccatattggtttccttagttctacttggacaaagggacacctatgggtataaatacaaggccccataggaggagaggggacgatcaacacccgagacaatcaacacccaccacaatctacggaacaatagatcaagacagaagccacaacatacaagccaacacacgctaagacaagacgccagatatcgacttcagagataggcacggctagtcccctacggtgtttctaggtactgtcaggagagacgaaagcgctatctctgatctcgccgggcacgaacttaaggaggaaggctaccctgttgtcgactacgagtcagaccttcagactaccatgtcgacaacagttagatacgctaccccaaatattgtactagtgtgattatggtgaataagagtaatactggcttcaaccaacaggatgtaaggttattacctgacaattcaggggcccgaacctgtataaaaatcctcgtctccgtctcttttacctcagtctcacgtatatcctagtaccaacgatccccataccatgcaaataccgaaatcgtgacatcaaacgtcgacaattagtgattagaagataatgctgaaaactaataagagggcttagagaatgcacaaaatggatgaatcaaccagcaatggggtgtaccgtgtaccgtcagaaaccgtggttgccgccttgccggccgccatatcgccttgcatccgcttgccacttgccaattcgcatgggtgtgtggccgtctgtgtgtgaggcgtccaaacggttgtttcttggctccctgcctgagcatgtttaaatgatggtcatgatctgacctgacacgtgggctaatccacgtcatccacgtgcgtggaagatcaaactaaaaattgacactccctccctccctaaacaatattacaatcactttcaaactttgacatggtttctaatatgccattttcaccaaattatttccaataaaaagagtctcatattatattacatattataatagtttgtttaaagataagactattaacaccattttcacgatatcaatatttatgatcttttattgatcgttaaagttaaaaagtgtttatatttgtttaacggagagagtagaatattcagtatattggttaccagatggaacttcacttgttgccacggaaatataggttcatagaagagagaatttagaacatagattgatcatttaaaaaacctaaaaattagttgttgtggcatcatgggaaaagagaaatagtaaagataatgtagaacataaattaattctcggagtgctagaaacaattaatataatataacttaaggagagaagagagatgacaatgatttgtaaagaagaaatcactaaaccttacgcatagtgttaaaatgtcataaactaacgaaatgctttaacttaggaataataaaatgagtgaacaacactttaaaccaccatttattatccaaactctctttgcaagtacatcaatagtctcaagaagacggtacggtcggtaccctcatgcggatgttctcttttacttcatccccctaaaaaaaagccaatctagaagaagatgtgacccctcctaatacaatcctaattcgttgtggtaggaggggtcacatcctcttctagattagcttttttttttttacggaggaacccgtacatgaggaaaagttggatacttggattggatatactagccagacaaaagtgaaaaaaaaatgtataaaatgtgatctaaaataaactttgggtaataaaacgtggcaaaccatctcatgccgaaaactaaaaacagacactgttaaatctctcgagcatcatgctatcacaacggtgtataattttaagcattcgtcagtgatatatcacaggatagcgcatgtactgtgcttcaaagccgagttgcttcaagctaacttctagagagttttgacttcagttttatgagttccagtttacgctttgttcctttttttttccactgtacaaatacatatccatttacattcatcaccgttacatcaagatgaaaatagagagaaatttcagattctatggacgttcaaatgctgattatactccagccaaaaataataataaaaaaaagctgattatactctcgcaaaaaaaaaaactgattatacactggcagtagcagtacatgtattatacacttcgcttagcgcgcgaaggcctcggtccccaccttaatggcgccaaacccgccggcgcgcgccgctaggccgtctgccgaggcgccccgcctcaccggcggcgtggccttcagcgtggtgtccgcgacgaactcgcacggcgcgtcctcggcgatggtccccatcgccgcgcccttcttcctcggcgccgggacggcggccgccgcctcctcgaagggccccttcttccccgccggcgcctcgcgataatacccaaccttcttggctgcccccaccgccggctcggccgcgacgcgccgctgcctcgacgcggcgcggacgaggtcgtcgacgtcgcgggagctcagcccccgcaggcgcatcgtcgccgtcgcggtcgccggcctgccgaacccgcggccgaccgcgacggcctccatcgccgccggcacgcggcccgcgcacccggacatgccgcgcacgtagaggtcgcaggccgagtcgcacgcccgcgacagcgcccggaacggcgcccccaggcacccgccgccgccgctcccgcccttcttcttcatctctctccgctccggccgctccgcgcgcgctgcgtcgaattggcttctcgcgctggcacgaggaagagtggctcgctgtcctactactactagtagtactagctttgattgctttggtcggcttcgggatttcgtctacggggctcgaggcttcccgttttatagagcaatgtcaacgggtggcggtgacgtcggcgaggagacgaaggcggcatctcgttccatcgcgtctccacctggttgcaaagtcttgaattggcaatctgctccgctcatcggtggggccgatcgaggcggttttcaggcgcgggtttaactcatggaaatggtcaggtttcgcgtgtatttttgctcgatttcgtccacggttttgggataggatcgattgatcgagatggcaaggttgagcagagctgtgtcgggagaatttaggatattcctcggtaaattcaataaattttagttgaatttgactgtttcaaacttaaattcctgagagagaaatcccctaatcttaaagtattgagaacaattcggaaattttacttggagtctactttcatcccataatggaaccttaaaattttatggttttcgattggttttcgtcgaaaacgtaaagatcggtgagcggtgaggtgcaccttgtctgagtcagttcaagttaacagtgtgtgtggaaatgtgattaagttattacgttcagctaagccgtcgcagttgcttgtttcagcgctgcaactgcaaagtggaaagggtaaaaaggagtcatcaaatctgttggaagaaatgcgatgttattagttctttatgatgctatatgctaatctttcttgcccgtgagagaagttaccgtaagctggctgttgatgttggaattgcgaagacctaaggcgaaaaatggcagaaaaacacaccgccgtcacatcatgttaaaagcgaagaaatgttgagcgcgttaaggaatggactaggagcaagtgatgaagtgaaacactgatgagaagctttgctttaccaggacattttcatttttgtgcgtttctgtaaagccatttcgtttcgatgacacagagaatttttcattttgagacttgaagaagagtacctgtcctcgagaatccagagcttgacatttcgcaccaagacaatcactcaaaatgcgcgtgttaaattttcccagagataagagactgttcagttctcagaaagaaataaaacgtctgaactcttgtccaaagccaaaccgtctgctcaatcttttttttccgggctggcgaaaagatgccaaccgatttttattaagcaaagcactccatcttaaaatataacaactgatagctttcataatttatttaaaatataacaacttcttcacaaatattcttttctcaaccaatcataatccttcaccattcaaaattttccatttaccttcccttctccgccaatcaacattctcattaactatatataaatctaaaacttcttatattctgatacagatgtaatacattaccagagatacaatgaggaagaccatatataatgcattaaaggggttcaatgagacaaatcctccactcagcctgcccaacgacacccactctagctgcaacgatgttcctatcatcgcgcccttccttttcgcggtgcgtcttaagacggtcaccttgcaataaataaccttcttggttgttcctatagtaagcttcggttcggtcttgatttagcacagcggacgaggctgttgtcatcgagaggaggtgagggaacaagtttcataatatagtcaaatgccagctttaaaaaattgacgcatcatttacatccactctaatagtctacccatataattattttattaaatatatatcgcacaattaatacttaacccacctctcatacaaacgtaatatatttgaattccgtactgctcgtttttgttctatcttcttttctcactccacatgtatttatttctcactcctccatatgtatttataggtgtacttggtcttaagagagagtacagaataagaagctagtgcgcaggccaaggaggaggtagacaaggctagtggatgattgattcgtgcgattagatcaaactcattccttcttagggtgtgtttaggtcatactaaaattgtaattaaatttgattaaaattgaaacgatgtgtttaaaaagttggaagtttatatgtgtaggaaagttttgttgtgatgaaaaagttggaagtttgaagaattattttggaactaaacacggccataatcccggtagtcttcggcttttacatttttattctttgaattcctacatgggttcatgatcatctcgtttttcctttttcagcagaccaaaacagttcagtttacacggtctaaattcggtcccctttggtaggctgttttttaaaacagcttgtatagttgtatgtatattttgccttatcttttataattgttttaattcgtgccaagtttgtaagtataaaagttatatatacataattttttttcactggctaagagtacgtggaccataattcattgggtaattttaccattcttgaaaagttactaaaagttattacactttctattgtgaaatttggtacctctagataagtacctcaatgtaaaaaatttatgtaaaatttagatatctcaagatacttttttaagaaccataaaattttcataattgaaaaggaaacagcccgaaaaagaaatgtaggcgggcctaccactaccagtacacattcgtgagtatcgtcgatcctgcgttttacagagaaaataaactattttggacaacattacagacaggaaaatttactgatagagtcctaaaatttccaacaataccttggacgtattaggggagcttaaaattctaaaaaacaattggtcagtagccagtttctgagaatctgaaaaagttggatttcacagcttctagcttctaattcattttctggattctacaagtacagtttcttagaatctaaataactgtacttgtagaatccagaaaactaaactgttcggaagagcttctgattttggaagaagttgcagtagttagaaactcccccaaacagacccttagggtgtgtttgagaaggagaggattgaggagattgagaagatacgcaaaacgaggtaagccattcgcacatgattaattgagtattaattattttaaacttcaaaaatagattaatatgattttttaaagcaactttcctatagaaattttttttgcaaaaaac

SEQ ID NO: 64012 - DNA, 1445 bp, Oryza sativa
attatgttgaatacagtctaattttaagacaattataaacatgctatgcagaagctgttatcgttctttctctagactgtggtagatcctttttcatttctattaatggaaatggagggctcttgccctttgctaaaaaaaattgcagaagctgtatatactgtattcaaatgaaaaaaaatattgacacaatcaacatagtatgaaattataatgtcaaaccataaacgaaaagctatacaagtcaacttacagttcacgcaaagatgtgattatccccagtgtctgcggtactgttccatttaatttgttgtcctgcaggtgcctacagaaaagagttttttttcctacgtagtggataagtaagcattattcaaatagtttgggaattgactagctaaggaatagcttacagtcttgtgagattcctcaggttgctgagatttggaataggtccagacaagctattgtttgcaaaagatctgttcatggaaataggttaattttggcattcactcagtttgatatatatgcagcagaacttacatatcagtcagagcggtgagccttgcaatatcagatgaaagatatccagagaggcccatacttgaaaagttcctggtgtaaaccaatacagaaaattgttaccacaaaggggaaaagaataaaatcaaataatataagcaccatgaggataactcacagtgagatgacacgtggtatttggcctttatcacatgtaactccagtccaagcatatccatgaggcatacatggatctccattccaatcatcaggtatattttgaaggcttctcttaatagcttccagggcatgtgctgcagaaattgtggagtaattaatacgttaatctaataaaaatatgcatatgcagactattcaaaggtggtaatcaagtaaaagcaacttggtgcattaccaaaaaaatcagtcaatagttcaatacagatacttaaggaagcaccattgttgtggtggtggagtcatgggtgcatgaatccacccaccaaggttcaaattctggtgtccacaaatatggatgtatggatcctagttggtgcaaaggctggaaataatacttccattatctaaatataggtgatgctacaacattaacacctcacagagttacaaagtgaaatgtactgtggcccttttttttgcgagtcccatgacctgatatgcagcaacaaatttccataaaacatattttgatgacctgctgctacatatataatgatgatttgttggccacataagtgccaccaaaggcataatacataagttgattatttggttagcaacagcttgtattgatcaatactgccacgaaatttagtcatttagtttaacctattacgaaaaaagatacaaatggaagaaaaaatatatgtagcgactgacataccatcccgaggaaatgt

SEQ ID NO: 64013 - DNA, 6560 bp, Oryza sativa
aaagatacactggaagcacgtaatgatctgaagcatatggaacaacgcggcgaccttcacccggaaccaaaggagaaaggaagccattacttgagtccagccagctacactctaagcaaggcagagaaggaaagtatatttgaatacttggagagcataaaggtaccgtctggatactccacgaatatcaagcgaataataagcatgaaggagaagaagttcacaaacctaaaatctcatgactgtcacgtgttgatgacacaactgctaccagttgtaataaggggtatccttccagaaaatgtccgggcaacaataacaaagctatgtgcattcatgaacgcaatttcgcagaaggtcatcgatccggatagattagaagcccttcagaatgaagtggtgcaatgtctcgtcagttttgagttgatatttctaccttcatttttcaatataatgacgcatctgctttgtcaccttgtgaaagagatccgtattctcaggcctgtgtacctacacaacatgtttcctttcgagaggtacatgggcgttctgaagaagtatgttcgtaaccgtgctcgtccagaggcaagcatcgccaagggttatggaacagaggaggtcatcgaattttgcgcagaatttatcgaagaccttcgcccaatcggggtacctgaatcacgccatgaagggagactacggggaaagggaactctcggaaggaaaagcaataatgacggtagacaacaatttattccgtaaagcccatttcactgttctgcaacactcttcattggtagctccttacatcgaggagcacttggctctagttcgcgccaggaacatcggtaagtccgatgcatggattacatggcatcacattgatactttccccacgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatgcaacaactgccacgtattacggtgccatcgaggatatatgggaacttgactatggtcctctcaaggttcctttgttctggtgccaacgggttaggttgactggtggaggcataatgattgatgacagtggtatgacaactgttgaccttaacaaggttggatactcggacgaaccttttgtccttgccaatgatgtaacgcaagtctttttcgtgaaggacatgtctagcaaaggaaagaagggcagagggcctaatgagcctaagcgtcaagtggttctcccaggcaaaagaaaaatcgtcggagctgaggacaagactgacgaggattacgatcagttggataggcaaccccctttcacggtgacgattgaccctagcatcctcctatcaaatgaagacaccccttactcacgcagcgatcacaaggagggaacaatagtaaggagaaagtacgtgcggtcaatcgtcactgccgatgtaatgccgtaattattgtgtacacgatgtaaactattttggatgtattgattatccatataaatcaattgatgtatggcataatttactatcattcatatgctacatttaattgaatatcattcatatgctaattataattgactagaaaatttttaaaagtattaaatcattcatgtggcatttacagatgttaattagagtttttcacaatttaatttactatctttcatatgctacttatatatgactattcgaatttttaaaagttttaaatcatgcatgtggcatttacatatgttaattagagtttttaacatttaatttaatataattcctacgctaagtatatatgatgattacaatttttattaattttaaatcatgtagtatgtacatataaatcttaattagagtttttaccaatttaataatatcattcatatgctaagtatatatgattattagaatttttattaattttaagtcatatatttgcttattacgatttatccacttaatttattacagacaaaaataatttttcaaagtaattgtcattaatctttgtactttaaataatgttaatgcattaacttctattttagaaacacatatgtaagcaaaaataatatgcagtgctataatctttagtccaggttcttaaccctaaccgggtttaaaaagaatttggaaatagcgggaaaatatatttagtcccagttgatgagaacaacgatctttagtcccggttattctcaacaaccgggagtaaagatatctttacttccggttgttctcatcaaccgggactaaagatcgagggctatatatattcccgaagcgcgccctcgtcttctccaccaacacttaacgttttcggtcgatcgatctctctcggcctctctccttcgccgccactgcctagggcaaatccccgcgccgacgccaccgtatctcaccgtcgtctcgagctcgtcgtcctcgccgccacttccgcctcctccgccgccgccgcatctttggggtgagagccgccgccgcctctcccttcatcgatctccgatctcgatctctctctccgtcgtgccgcccgccacgagacgccgtgccacaacgacaccgcgccacgccgacgccgcgccacgccgccgccttcgccgccgcgcgcgcaaccccgccgcctccacgccacgccgccgcgcaacgccgccgccgcatgcaacgccacgccgccgccgtcgtcgccacgccgccgccgccgccaccgccgccacgccgccgcgccaagcgccggaccgatgccgccacaccgccgttaacgaacacgtgaacgagaacgaacacgtcaatatacgttgccgcgagaacgtgaacgagaacgagaacgatcgaacgaaggagagcgagaacgagaacgatcgaacgaattaacgtgaacgagaacgacaacgaacgtgtacgagaacgaacgtgaatgagaacgagcgaatgaatgtgaacgtgaaatgcaatatatatatatgttacttcgcatttatcctaatacatattttttgtatcttgcagaaaagacgtgttgtcggagtcgtccctcaagccggagtgaagagctagccctagaaggtattcgtgcaggcaagtgacgtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgatttttaatataagattattttatttgtaattagacttagtatataattactgactacggaattggtgcgactcctagcaattgacaatttttgtcttaattagacttagcatatacgacagttacacttagcatacatgactctttcagtcttagcatgtaatattatttgagttttaatataagattactttatttgtaattagaattagtacgtaattattgactacggaattggtgcgactcctagcaattgactattgtagtcttaattagacttagcatatacgcacgaaacacttagcatatacatgactattttagtcttagcatgtaatattatttgagttttaatataatattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaatcagtacttgaacgagaaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataatggaagtggaagaagatggacgtcctagtgccccggccgtagccgccaagaactatgtacgtcacagcggttgggttgtgcgggataacgtgcctgtcagtacggtgtactggcgaagaacaaggacacgcggagatcatgagagctttgtcctagattcggagaaagagatgctgtggaccataatgctcgagacattcacccttcccgcgggtacagaggacaaagtgaaaaggtggactctgaagaaaatggcagaacagtttcagagcttcaagggagagctgtacaagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcactacttggggtcaggaggctatagcgtcacgatgccgaagtgggaggagatggaggctatcttgattgagaggggtatcgaaccggcaaccgccaattggccggaacgatcgaagttctggtactatgctcatggtggaacgctcaacccagctgatggctcactggtcttcggcgatcagatacgagaggctgcgcgacgactaacagatgcagtggaagcctcctctcagggcacgttccgatcggacagatatagggacgagctgacactcgccctgtagactccagagcatccaggacgaacacgagggaaaggggtgattccttagaagattggtttcaaggaggacatccacacgtacaggagtcggatgaggagtaagagagataccgaggcgaagattgcagatctagagttccgggtatcgagctacgaactcagcatgcaagaggaggtgacaaggaaggttgatgaacgcatagccgcacatcggtcccatgatccccagccgaccattcctcctgcaatgatgagcccgtcaggaaaccgtagcagctgtgccttaacggggcaggtaggattacagagcatggacgccattcaaacacaggacgaatcgacctgtcccgttgatgacatcactcagcagacaccatctgagctgcatattccttacaagaacttatcaataaaggtaagctcgtagtttatatattttagatttagccattccgctagttgctgcttatatatgttgattactaataaaaaatatctcacaacatgaaggtggcgtcgggcatggccatcccaacggacccttcaggtacttaccactgcaggccgattccagcaggatactcgaaggtcgaagttgagttggtcgaaggcgcatacgaggacctcgagctggattaccctggaggagacggtgagacgcatctacgagacacaagccatgccattattctatggcgcaggcggtacatcatcctccctgggcgacaagcggcgtctcgtgcaccatctcctcctcaggatcttgcaccgtctcctcctcatgatccgccagcaccgtctccaccttaggctccagcaccgactcctcctcaggatcctgcaccgactcctcctcgggctcctacacctactcctccgcaagctcctcttccggcacctcaaagtcaagggcccccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcgaccaaaccaggagatcgagccgttggtgaccggtaaagaaatgatgatagaacaatttattactgacaccggtctaactacggatcaattgctaggagtcgcaccaatcgaaaagacggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggaca

SEQ ID NO: 64014 - DNA, 2256 bp, Oryza sativa
gtgcctcttccctcctccccgggtcgggatttggcctctctagcaagggaggtcgtccccctgtacagtgactcttagtgacaggaaggggtagggagcaatggcgttagcggagacaatgatggcgcagtcggacatatccgtgcatggacagcgagcggtgatggagttcgctgattcggcatggccgtgcccagatctacatccctacccgtttccgaaccccccacgataaatctggccagagttagcgcgacatagacagcggcagcggccggctcgtagagacaacgacaacagcgggagggcgacgcaggtgacatcggcgcaggtgacaacagttggagattggcgtcaagaggtcaatgcaggcgacggcaaggaggccgccctggctgacatcgtcggaggtcaacgcggcgatgataagaagggcgacgacgacagtgtgccacaaaggtatgcggaggctggttggcgggggtcatcggtacagcagtgtccacgcattgagataggatagtcggtggtggagcaatagctgcgaattgactagggagagcggcaggtgtaaacctagcccggccatgccgggcaagcaatgacaacgcttctggtgtcgttctccctcctagggccgtttttgagtcgttcctggtgaaaaccatgtcttggttctccttgaggtctcaagggaaggtggcgtcagtgctcattgtcactcttcttcctggagatgtcgtctaggaggcctccttaccaaaacttctctctgacagcttgtgtgtactctctctatatgtttgtcctcttactacgacaccctaaattctgcaagttgatcatattggcgggccttgtgggggagagcggatccatttttctctttcaccctcttccccttcaatcccgaagatgtgaatagagtttgagtttggtgttcggctgttagggtttggtttagtgcggttcagcggtagtttcgttgttggtctagcggcatctggtccaatgctagcgttgttgtgtacttgtgtgtaggcaatattggtgcacggtggtgttttttttttcgttcctggctactgcctttccagggttttagccttgtgttttttcctactccattcaatgaaacaacacgagtgtctggtgcagttcattaaaaaaaatactggaaaccaacttactacttaatatgtcccaaaatatagatattattttaacatagcaccttattttgaataaagttgtttctctatcgatctttatctctcaacctctgttcgtcctctgagtcttcctctaaagtgtcatatttatcctctgtaacaattatccatttagtttattcaccaactttttttctcaaccaatcataaattttcttcaattatttctatctattttctaaatattcgtaccaatctaaaaaatacttatattttgaaattcgcttcttcgttgttttcaccacttttgaaaatttgaaaatatttatcactacacggttacctaggtatcaatttccattttactcttaatttgtggagctaaagtaatgttcagttaacgtatgcatttagaattgcatacctcaacaacatagggctgggtcattttacttagaaaaaggttaattgtattgtattggaactcgaactctccgtggttgccacttgccacatcagtttgttcagggtgatttggactttttttccacaaaatcagtataggatttaaaatagatttactagacagatccatagctcaagcactaattgccacagcctagaacaggccgaagagggccgatagaagggaaaagtacaccgaaggtccctcgacttgtcatcgagttacaaaatcatcccctaaccgcaaaaccagatatctgatgtcccttaatttacaaaaccgtttactttaggtgcatcggtggttttgaccctggttttgtcctacgtggcggctgagtcagcgtgggacccacatgggccccacatatcagcatgccacgtcaatggccgctcctcccttcctcctctctgtctctctctccctctctcacttctcctctcgggcaggctagccagcgggtggggatgaggtcgccgacaacggacgtgaggacgagggggtcggcggcgacaggggcgaccgagtcgacggcggtggcggtgacgttgaggaggttggagatgaagacggcggaagcgtatagcagtggggaggagcaaaacgatggccctcgcc

SEQ ID NO: 64015 - DNA, 1068 bp, Oryza sativa
tctcccaattaagcgcgaagcttccgtgctttactcacccaagatcgcgatcgagaggcgcggctcggctcgggtcgctatcggagatccatcgccgtcgacccccggatgccgtggcgcgaggctcgcccaagcgttttttttccgctcgagcgttcgagggttcgagctctagctgacacggcgtgagcgccataaattctcctgcgctatagctctcgccatcggcgtcacggagagaacagaggcagctggaagctgacacggcgcgggagcgcacgcacaggaagccgtttttttccgcgccacggacgcgagtgagcgctgcaggaaagcggcatgtagcagttgcttgaagggaacggaggatcagttcgagatgccatacggacgatcggacaggagtcacaggacaagcgagttacgtagggaagcgcacggctggcaggaagagaagataccgccagataatttgttgtagcgttaaaatctcgcctttttttatcgatcacgaaagacatacacgaaaacctgcgaccatataggcatcttcttcatgctacctcggtttgatcaactcacgctttttaaacagctaaataatatatttcgcggaaaatttttttatatatgtagaagttactgtaaaatattgaataaaactattcgttaagtttataacaattaaaactcaactaattatacgttaatggttttcttatttttggtgttctaacttctttatttttatcttaagtagaaacgaacattaccttatatttacataccaacgagcacatacattttaaggtgtacgtttaacatgcgtttaacagtaatatatcatccatatcctcgttgtgtatttatttattagtgtttatgcaactactataacgtaaaactgaaaaaattctcagctcagcaaatttaatttgtccattcctgtcatccacttgatagtactagttgatagtacaactgcgagagaggtttttcgctgatgaatgcagtgacatttggtcgtgcactcttgcaaccttgtgagttgtgacacagaatttgagg

SEQ ID NO: 64016 - DNA, 3772 bp, Oryza sativa
ctttccccaatagaaaaatctgcgttgaatgggctagtgtaagcctaatttcactcgaaggaaaagagatgcacttgggcctagactctgggcttgcgagccaaggttagcaaaaaggtgggccggctggcgtcttggcgagcagctccggtcgaagtcctaccctcctgtgagctgtcgatcgtgattcgtgcaccaaaccattcgtcggattgtcggaaggtagcaaaaggaggcacagaccacaggtagctactccctccgtcccataatataacaatctaggatcgtatgtgatgtatcatagtactataaatttggacatgtctcctgtccagatttgtagtactgggatacgtcccatccgattctaagttgctatattttggaacggagggagtacagtgaacggataggttgccctccgtacgcccatgtggcagtcacgaagcgtacagggtgttactctttcccgttgcaagaacgaaaaattgctgtcaatttttgggaccagcaatccctttctcaaataatatgcacgagcaactctaagcgagatctttcattagcttatgcaggcaaaattgctgcgtccgcataggttagccggtgtgaggttgtgctgattggcaattgaccaacgcagcattcacagattcactatcatcatggcacaccgaacatcacatctcagcgaacgggtgctccaccaatgcaccaactaatgcacgcacaaatgcatagcgcaccaatgcaccaactaatgccggtagtttgatcagatatcccagatgtgatcttgccgatgggttatccccaccagtatagaagtgtttagtcacactgaagtttggatgtttggttgaaattagaatgatgtgactgaaaaattatgtgtatgaaaagtttgatgtgatggaaagttggaagtttgaaaaaaactttagaactaaataggacctatgactacaactatctttcggttgtcacgaagaccccgacgtgttgtcacgaagatcccaacgtgaacgtgacggagaagagtataaaaaaaaacacgatccgcgctgaccgccgcgccgccaaccggcaactctggcactcgcacgccgggcacgcgtttcacgtgtcgaagcgaagcgactgcacctgcacgacgacgacggaccggtctcgcggtctcctccggtcgcgccaccccgttccgactcccgtcctcaccgtccccgaccctccgcccaccactccctcggtcacttcccccaccccacccacccaccacgccgccgcgactcccccaccgttccacgcgcacgcgaccacaccactgctctgcacgcgacccgggattacactacacggtacacagccgcgcgcgcggactactggccagataacgcatcgcagattcgcgggaacacccctcgtggcgcacgacaactattcagtagtcaagtactagcgccagccaaagccaacacgagtttgcacgggcacgactccgcgccgcggcggccgtctcgtcctctctccacatcatccccgttccctcgcacaccacagcgcgcgcccgcccgccagccatcccgctgccgtgccgtctccatcttctatccctcctcctgctgctgctgctgctgctacttaccccgcgatttctcttcctcttattactcttcctctcggctctcgctcgctcgctccccgcgcgatttctccacgccgcacgccgctcgcgagttagggatcgatctcgtcgggggcgggcgggagagggagagggaggagagatggcgggggatggtgtggactgggagagcgtggcggaggccacgtccggggcggtgggcgcgctcgtcagcaccaccgtgctctacccgctcgacacctgcaagaccaagttccaggccgagctccagacgcagccgggcgcgcacaagtacaggtaagcagctcagccagcggctcctctctctctctctctctctctccctctcttcgccatgtggtggattgctgatccccttgtcaggagcttgctggggagatcgccgggttctcgatcgagaggcaggcgacccgtcggaattgggatctggctgctactgattcagtgtttgggctgatcgtgatgcactggtccgattgacgtggataacctggcgttagcggcggatgtcgtgatcttcgcataggccagttgataatttccctgggatagaactgtcgttgatttcttatttggtggccaaaggatgcagaaaaaccccagccatgtctcctttcgccagctttgttgttagaaggggggaaaggaactttagacctagtgtttgcattatatctctgaattaggctcacacttcacaaggagttcacttaatctggaatcgtatagtatgttggcactatgttgattggttggagattgtttggttcagctcccagttgcccaccaataggtgttggttatagaatggtttaaccaaataggaaggattatgcaccccacaaagagaaaaaaaaaagagagagaagggttatgcatatagagattttttttctgtggccaatcaatggactagtcatgaaaaagaaaaaaataatcagtgggtggaaataccttgtaattttttcctgaaccaaaggggtccaatacctgcttgtattgaaagccagagtttttcaggagataatatgaaagagaatagagttgggagcatctctggcactaaaagcaacatatagtacatattaggagacaccaccagattcaaagagaaattaccaaaagacaacagcagccagcatttagttcatgcaggttagttaggcatacagagcaggtcatagagcgctgaaaaattcaaatgatcttgaacctcaagtataccacaaaagctatatatttttattcaaggtcactaccctccacatcagtaggaagctcactaagaaataattttcatgcaaagatcttaatcttgagaggtattttgcctttccatattttgtttaccgatcgctccaccacaagatataagattgtagagggactttggcatgtacatgttatttttctcttccataacatccacctggatgatatggtccagttaattccttattcattaggttttgccagctaactctttgtagcatttgggatgtgcattgaccttgacattttcacatattggtacctcacttgattgcacctttatactcttaaaaaagttaaattgatttgggtgtcatgcatttttgccagcgtttgatgtatgtcctggcatccaggccttcatggtgttccatctcttctgaagttctgagttactctgtttcatacaataagtgacctcacgtgtttattttttccaggaatctttcagatgtcttttgggaagctgttcagaaaagacaaattctatccctatatcagggccttaagacaaagaacatccaatctttcatttcacaattcgtttacttttatggctatagctactttaaaagactctacttggagaagagtggagcaaagtctatcggcacaaaagcgaacttgttagttgcagctgctgctggtgcttgcacagttgttgttactcaggtaactaacgccataagtaattagctaccattcactgaaaatcgtttttacctgctgacctttatgtgttcatctctcctgtgttttcagccactagatacagcatcttctagaatgcaaacaagtgcctttggaaagtccaaagggctgcgggcaact

SEQ ID NO: 64017 - DNA, 871 bp, Oryza sativa
ccccccccctcccaccccctaaaagaaaactgtttgtaacatcagaaacacatagtctatactagtatatagttaatcagctcttgccatttagtatttaaacatgatccttttcttatcttctcatcgtttagcttccataattataaattagattttaaaacttaatttttaagttgattgagtttcttttatcatacttcatttttcagcattgttttataaacctctaataaacataaatataaaagttttacccctaaactattttttattttttccactgcccaatgtatcgtgaggagttccgccggttcccaactcccttccttaattagaacgtgccaatagctgctttaggaaaaatccaagctactatcgattatactgtcatcacttcagaggttcgacttgaggaatttggagtgtgatgcccctgcaattgcaacgacctaaacctatttgtatggtccaccgtgatttttccaggatagttgtgtcttcattttgatggtacttgtcgttttaacaagaacataataaaaagtaatgtttgaccactattttctattataatacatataaaaatattaataaatatactattttattagagtaattttaaaaattaaactatacatatggatattttagaaataatttataattaaagattttaaaatttcacattagacttgttcaaaacgatcgataagtattacgaacatgaaaagagtattacattgcacatcctaattaaaaatttttagcactgtaccctccgtcccaaaagaaattaacttctatggataaattttttgccgagatacgtccagaagttgttcattttaagagccagtttaagtttaat

SEQ ID NO: 64018 - DNA, 645 bp, Oryza sativa
ctgcagccccgccgaaggtggtgacgttgggctggtacccgccgttgccgaacgcgatcatgtacagcgcgatgtagaagatccccagctccgcgccggagtgcggctcgcagggcacgtgctccgtgccgcacccgaccggcctgatcaggtacagccgcgacgacagggacagcagcgcgaggcctgcaggcaaaacaccgtgacgcgaacgagtcagccgcgtgatccacatctcctgggcgtacgcgcaacgcgaccgcgatgtgccttgggccgatcgaccgaccggtcggcgccaccacgtactactctatgcctctactatatggaccatccactttcgacaccagcatacgtgcagatacaatccacccagtacagagtacaggccgaattaactccactctggacagattctcccgcaccaatcgctgttactttgtacgtacgttcctacgcatctatagaccatcatttcccgtgaaatgggcaatcagaacggaaaaaactggtcactgatgattgcccgaccaacagatcagaccgaagtagctagaaacatgagatcaatcgatcgcaccgagaaaggcgcgtggttttcagatagaactgcggagagagagggatgtgccgtgtggtggt

SEQ ID NO: 64019 - DNA, 609 bp, Oryza sativa
cattccttctcctttacgaatttcagtgtccccaacaacattgtcaagataatgtgtatctgatattgccaatggcaaaggcttcttgcaaaagaaatcatggtgggcaagcaatttatagtggcttataaatcaacagcaccagtgagctccctagggcctgaaatatcagaaccaccagcatttcaagcaaccaagacatggaaaaggacatgtatcaaaaattatgttacaaaagagaaaatagcttataatgaacagtcgtcgcactggtaggctcaaaagtcagcactgatttaaatcacagcaaaaagaaaatcactgcataacacccccaccaaaaaaaaattgaccacaaatatttcaagatgtttgacagtgtttccggtacatggagctcactcagctcaggacaacaacatgatgtttgcatcagataaccaatacaaatgattatggtggcatcagctacacgccaaataaagcacagattatccctgcttattctttaaacatagttgggacgtttttgctggaaatcttttgatgttcagaaaaaaaaatccttatcaacaaaaaacctaccttttccaaacttcttgtcatcag

SEQ ID NO: 64020 - DNA, 3828 bp, Oryza sativa
cggtgggtggaccggaggctgagggactcgttcccggtggaggcggcggaggcgatgacggcggtggcgctgcggtgcgtggcgagggacgcggcggcgcggccggacatgtcgtgggtcgccgccaaggtgtccaagctcttcctggaggcgcaggattggtccgataagttccgcatccccaccgacatctccatctccatcgctcccaggtgaaggtgaaaccccacccacctcgccggagactcactcaccgcccaccgcacctcgccggagactgactgaccaccgccgcatcgcatgcatcctcacagtaaaaaaaaaagatgcaatttttttttacagtaaaagatgcatttttttttgacagtgtaaaggatgcttttttcttcttttgtggttttgttgttcatcaggcgatgtatatagatagatgttgctgtagttgatgtgcagcgcgattgagatcctcctatgtagatctgtgggtccatatgttagtgacaacggtacggtgcagtcgactgcagaggatcgtgatcctcacttctagtacaaatttatttattagtactgttaatgtaggagatttagcctaacagtggttgacacgatgtgattgtgagtgaggtaggaattgttaggcgaaaatgcaatcacacatgctaacatttgaaacagagcctgatgatttctggatgtacatatatactatgcgtgaatggaacatagcagtcaattggatgatgaatacttaaaatctaaactcgaaaactatcaatgtcatgaaaccaattttcctatagtttttaatggtgcccgtagaaagttttaaagacttgcaattgcatccttttttccagcgtttgatgtggacgtgtctggtaaatctggttttgaattcttcgtcgttccaacggagagaaatttgcgttgcctcctgatcatccatccctctttgatagtgcgcgtgtcgtaacaacgaatctgattctcatctcgagcaagatttttatttttctttttccgcttgcttgtcatatccacagttcatgatctcgtccagcgaacatattctgacgctttaacaacgatcgaatattagactgaagtggtaaaaggttgagaataataataataactcttactccatccgttttacaatgtaagtcattctagcatttcccatatttatattgttgttaatgaatctagacatatatatctaaatagattcattaacatcaatacaaatgtagaaaatactagaatgacttacattatgaaacagaggaagtataaaggaaggatcacaattcagcccatgctatcctctcctttttcattttaatcgatccaaaggcaagcactttgaaaccttaaactgagctttacaacgcatagaatcaaacattcattctgattagctcagatgagacgtcaggttatcagatcaacgcaataagaaacaacagtttccacaagaagaacccaccgattcttcaaccaccgaaagcacagatgcaagcagacacaagaggataaaaagggcagaaaaattcagtaatagcaggttcaatgggactacctcttgggatataactatgttagcactggtgctcactggatggaaatttggttcaaaagcattcgattctagctatttttattggagtccttctgtctgaacttttctgaatttaggggggaggacgggagaacagttttcattcacatcctctcatatgataagagatccgcatggtaaaaccaataatacattacaacaagtgttaatccaacatgaacgatgatgtacagttccatcggctggaaagttgtacacatttctatctgcttcgctgtttatggacccgagctgtaggcgaaaatgccggttagtcgcagccgctgtagaagacatgcgccagcagatcagatcacagctttgctcatcgtcaccaccctctcagtgactaatcaaacaggggagaaatggaggttagatacatttcagcattagtgtcattcatttattcaagaatatattgttgatatttcaagaatgtagataattctaatgtaatgcagaattatgctcttgtactagttttttacatctgatctagcctcaaaaagtggacctgtacttacctaaccaacttcctatctttgtattgatactgccacgcgcgcttagtgggggacaaaacaaagtaggtcaaaggcaatagggtgtaacatcagatatgggttgaactgttctgtgaggtcaatgtctaacaccaacttcgtcctctatgattacaacatgcattgccatggcatacactggaaatgtaatctatcgaggaagaaatcgaattgtctgaatgtattatatagcaacctcgtgaatttttcatacaaccagaaacaaataggatatcaccaaaaatggttggcgtgcgaatttcaattgtaagagctaataattagtattgctgagcattgtatttctatggcaatttaatcagagtggaagtcaaattgttggtaaagtaggcagttgcaggagataagcttaagcacacaatcacctcagccaactgaaacctgccacttcattctgttaaaaaaaagagcaataagtgccctaacttctggaattatcaagtgcacaggaattcctgagcaggtttggtggtcagacaagtgctcagttaataatattacattgagtgcaaatctttctttaaaatgttccatgaacgtcacgctaccagttcaaatcattttcacattttttaaaaaatatgaaaataaatcgaaacggaacaactatacagagcaacagtggcatgtagagagcaaatatcagcatgtcccttttttttggaagggacactgcagggaatcgctatatattgtataaataataaaaatatctgtcacttgcatactactagttatgcataccttgaagccggatttggaattcgtggaaccacccaacattttcctcgctggttttagtatttgaaaagagcacatcagtgtatcatctacactcatcatggcaccagcattatcaaattctccacagtaattaggggccgagaatattgttacaagttggcggttagcaaagaactcgtacccatcttcgacaacctgaattccaacaaggcaagaataactgataaatcaattcacttggtaagaaaaataaaaaggtcaggtaattgtgagcatggggcacctgatgggctcgacagatgaggtctaaatcatgcttctcaagaaattcagacactttgtctggcccgaatgtatatgagacacctcgatcattcatagcccacccttgtgcgtcattggatggatcggaccaaaggagatcacaaagtaacccagtatcaggcacatccgtggggcggttgaggttgagtatttgatccagcttattcaactctggagaaagacctccgtgcatacaaagaatcttttcatctatcaatgctgccactggtaagcagttaaaacagtcagtaaaagtcttccagagttttacactgaatctgcgcttgcactcgtcataaaatccatagatgcggttgaccgatgcacattcatggttgcctctgagtaggaagaagttttcagggtacttgatcttataagccaaaagaaggcatatcgtctcaaggctttgctttccccggtccacataatcgcccaagaagagatagttggactgaggtggatacccaccataatcaaacagcctcaggagatcagaatactgtccatgaacatcacctgatcagaagaaattatgcaagatta

SEQ ID NO: 64021 - DNA, 26253 bp, Oryza sativa
gtcgtagcgcgccgagcgtacctcgcgaagaaggcgggtccggggaaggtctgggagggagcagcccgcctctccgccgtcgcccgcctcgtccgcctattcgccgccacccgcctcgcccacctctccaccgctgctcgcctcgcccgcctctccgccgccgcccacttgcctctccgcctcgttcgccaccgcccgcccccgctcaccgtcgaccgcaccgccgtgcgcaccgtccgccactgtcatgccgactgccgagagagtgaggtcgatggcgtcgatgctgtccaattttttttaacaaaatctatcataattgcttcgaatttgacaatttttagtaaaatctttcaaaatgaattaaatttctcaaatttatgccaaatctgtcataattggggcacattttatttaatttattttcacaaaattctgtcaaatttaagtcaaatttcacaaaatgattcgaatctgtcaaattaatgccaaatctgttacttgagcaaaaattattacaaatatttcaacattgttgaatatatacagtcaaacaagcaaacaaaagggatataacagggtcaaataagcaagggcaaaatggactatttacccctaaattaacaccgtcacctcacccaaacggaatagggtcagaccggagcttcgtactcgaaaaggagggtcaaataagcaaagttcaaaagtagggccaattcggcaattacagttcaaaacagggtcaaataagcaattgcccctataaattagcaaacgatagcacattcaaacattaagagaaattatgaatatgagtttcgttcaatctttgaatttgatatggacagaaaaacttgataattacccctcatctgttatctttgtgcaatggcacatgatatgtttgcgtcaaccttatgggatgtagaagagactaaatatcagactatctcctttcctgcatcatcagtgcctctctacaaaaggctgtcaacagagctctcaagctgaacaacacaaaattcagaggaaaatttcttacagaataagttcattaaaaattatctttgttaaaattaacccttgtaaaatcgactgagaatgtcccatcagaaagcaagacaaaagcccctttctcatacatcaagttacaacaaatctttctcgtttttgcttcatcataattcattcaaatagtacataaatgctatgagaactgagaaatatccatgcactcttttcatcaaaaatcgtaattcagttccctaatagggaaaataatgctttattagtacactaaaatcataatctactcccatttgttcaaagtttgttacattttgggacggagataatactttacttcattcaaataataacactagttcaattcccaagtataaatgggtaagacagataatactttgtcacacacacacacacacacacacacacacacacacacacacacacacacacacacacacacacacacacacacacacacacacacacacacacacacacacacacacacatatatatatatatatatatatatatatatatatatatatatatatatatatatatatatatttgcacacaatttatatcaaaaatcaaatggccacaactgccctgcttctgacaaatacaataatactaggtttcttagcaattaaagaatactatttttctttagcgtttctataaaactaaaaaaaaatacaaacgtcgtgaagaaagtacaagtttcagaattgaattttcgtataatcagtattcagtaggctccagtacatcaatcagccccttgttaccaccaccatttacattagatatttagagacagtgtaagggagcgttgcagcatagaatgcagatcagtacaactgtagaaggcaaccactctgtctacgaatgagttgaaacgcatggagcagaaaaagggttggatcttggatgggaatgggatcaacaagaccaagctagtttacagctcgcagcatccagctgaggtacgatccttgtgtcctgataatacgactcctcgtgccatcccaggacctcctcgtcgtcgtcaatggcaagagggccggaacgacggggatgtacgcgactacgcggccgcagacgcgcccggtgtgcggccgtgcggcaagccggcaagtcggtggtgagagcaaggtgttgcatcggctgtgtggcggagagacagcggccggcgtcaagaagaggcaaatgcacctgtgaagcttctggcgcgggagagcagaggaggggcggcggcggtaggagagtaggagagactagagaggagactgcggcgaccggccggcccgtgctctgatggaccgttcgggctagatccaacggtagaaatcgctccagcctccagtcccaccacggatggtaacagttttgcataaagcccccttcttatctatgatcgcgctaccactggaacactggaagtggacctatttgttttcataaaaccccctattttgccctaagttgtgcataacccccccccccccacctgttttggaccgctacagtatttcgctaccaatgagtacagtacagaattgggctatttcaaaaagatccctggtagtgatattttatgcgatgtgtatccttcccgagcacgcacactcgccgccgcactccacttccccaacacgccgccgccgccgccgccgcccgagctcgccgcgatgtcatggctcgcgcgctcaatcgcggctaccctctcttcttcccactctgatgaagatggcgataacctcgaggcgagcagcggcgacgaccatagggacgagcagccggacaccccgagcggcggcggcggcggagtcaagggcgacttgtcggagctgaccgactccctcacccgcggcctctggggcgtcgcttccttcctcgctccgccgcctgcgcccgccgccgaagccgcggagacggctacgggggcggtgggggagggggaggatggggctcggtcgccgcggatcgccgggatccggagcgacctggcggagatcgggggcagggtgaggagcggaatctcgttgctctcgaacgccaacgccgtggcggagatctccaagatcgcctcgtcgctcctgccgttcgggcccggagaggacgacgacgacgacgacgatgccgaggctgtgggcgtgaccgaggaggtggtggagttcgtgaggcacatctcgacccatcccgagacgtggctcgacttccccttgtttgtcaacgaccggcacgcggatggtaagaggcagtagtatgaaacttctcttcctggatctcttcagcgtttgtagtgctttggtttgcttgcatagaatgctggattggttattttggtctattatacattcatttaggagaccattggttccagttgcttcagtgcttaggcttcttgctctgttcgctctgatactaagattgtgggatcttctgtcataattttagcagcttggctccagtcatgtttatttactaaggtttaatgtgggaagggtagttacttacaattaagagtggcactcaattcttaagatcatgttattttgaaattgagttcatttgtttacatgtatgaaggtttgccaggaaattgtaattcatgttaatagaaacttttattacttcatgtggttgcatttgctgatgttagttagacagagtaggtacatgaactgaggtgggttaatcgtttgttttactctagtatcgctagggctgtagttcaaaatttcacatttggattgtattaattcaaagggataattagtaaatagaaagttcgtttgccaaaatgaaaaaaagagagtaggaatggcttgtaattaaggaaggtttaaaagtatcgaacacaaaccttaatgtcgcatttcagtaatcttgctttttgtaaaaatgtctaatgagacttagatcacttgacatgtaagaactgtatgaaaccatcatttctgctgatacatcagtattaactatgcatttatcagaggctgtatgctataatcgacttcaccggagacattgagaaacaataaattaaacgagggacaaactattacacaaacttgtaacacacatacaacactgcaatctgattaatcacctaaccaacaaggcaacatcagaataggggttttgtcacaaattaattcaactgtcgaatcatcactttaacctttagtgttactatttcggtcaaatagctccaagagttgaatgctccctacactttgtggaagtctagctatatccaaggattcaacgtcgctaatgatgtgattacatgtgcaaaatctaatgggatcaaagtatatttcatccaacaaatttattatacattagcttttttacatgggtttaatatatgaatttctaatgttctgttatttatagcatgatcactacttgcccctgtctctcagaaatgctgaccatggtttcctatttttatttgcttttataccttttggttctaacttgccatagtactaggtaacaactgtgttctggaaattggaatggctagaactcgttaacctgttacatatgcatatggccatcttcaatatgtagggaattactgttaaatggaggccatgcatgtatattgttccatcatgtcagtcatgccttacttgtcgtgcctgactggtttcctcaattcctttgcttactgcaatgcttcttgcgtacagattttgaactgtcagacacacaatatggacatgcattggctatagagcgtgttgttccaagcttgtcatatcttaggaccgagctttgctctaccaatatgagtgaagcatgcttttggaagatctattttgtgcttcttcactcaaaactcagcaagcaagatgctgaacttctttcaacgccacaggtatattccctgctcttcagcatattctgtctttatggcaaacattcttaagtaattacggattatcatgtcaacttgttacaatgcatgctttcctacacatagccccataaccttttttttttaacaaaccgtctatgcatatatattaccaaatggtatatcttgtttccaagttacaaactatgataagtcaggtgtgtaaggagaatgtaactatgtatgaacttaagaatgtaagttaccgaagcccaaaagttgcattagattgtggctgccagtgtgggagcataaacatagaggattacttttatgcttgtgtaagcgtacaatcaatatttgggctccacttctcattatagcatcaaaattgggcattcttcacttctcattgtagcatcaagaatttgttgcaagtttcaaccgacaaaacaaagctaaactacaggcatatatttagttaattatcatgttgaatatatccagtcttgtcaattcttttggtggaaacacttggcagtgctgaaaaatcatagccttccaaagggaaatatcagtgacgttgtagaactctaaaccagtatccagaacagcaggaggatatgcttgagaccttcgtatttgtgattttgaactgattttatattatatgttcggaattatgcatctaagcatgtagatctgcattcccaatttaattatgtatgctatcagcacatgtgaaggctgtgtaacgtttgattactaatcatatagtccatgtatgcatgcccctatagctcacgttgagaacatgtaacagatgtatagattgtcgatcatactgtatattttgttgttaagttactatcagtatatatgcagtagcaattttcttgtaattagtaccctatctcgcacccccccccccaaaaaaaaaaaaaatttcccaggatttgattttttttgtgggatacagggagtacattgtaacagaaaatccttattgcattgtttttactccactggaaggtccattgcgcatacacttttgctgcatttcaccttctttatcttttatttcattcagatcctaaaagcaagagaagtattattgcaaagttcaccgacaaagaaaaggctgggacctgatgatggttcatcacaaaactggaatgttgcatctaccaaaggtgacaacagtggaatgtctgaagcaccttcattggaagaagcaacttctgtaccgatgaatgtggttgaggctgacaagcatccgatttcagtcgctgaggtggaaataatagacaagtccgtggttgaagaagagctggtggtgaaaaatgagaccaagagtataccttctgactctgagaaggctaatctgcatatcacctcggacgatgatgataaagaggtggaggactggctgaaggatgtggctcctgtgtccagcaaaacaggcaacgtcaattcagcagggcaggaggaagacatatccttcagtgatctggaggatgaagaggatgattgagagacggctagcttaagcagcgcagccagtactagttccctcggttcaatgtcgcaaacacaagacaacggctagcttcatgaagaacatcaactgttactgaatgatcgaaactctgcagctacagcaaagggaaccgtgttgttgctgagtgacggattcatcctaattgcatgttgatgtaatgatgtatttatgttcgctctctttttgtacatagatatatacactatgtcacctgcgtgtgcactgtatatccacgatagcgtgcagcactcatacttactggattctgaatgcaagatatcctctcatttgctgtcaaatgtcttagaatatcttatgacgcatttaagctggcactacgcaaaactcgacacacttcccctcttactctagtgctatacgaaattcgaagctgatatacttatctacccggtattccctcgtctctaatgataacattcgtgatttatatgtcgtcgtcatcagcagtttccaatgtcgacatacatctgcatccccaaaacagtctctgtaccgctaactccagcagagcggaccataaaccgctcgacgcctcgacggagcggagcggaggcggacgacaccacgccaacggctcacgtttctcgctctcgctgcctcgacatgcaatgcaaacgcgcgtgccgcgcggctatcaaccgccgaaacgcctaacgccggcgctgaccctccccgtcccctcccctacctggcccctgcagggtgtggtccccactccgcgccttgcttctgctgcgggctccacctgtcagccatccccaggctgcttctgctgcgggcgtcgcgtgtgctacgtgacgacaagcgccatctctcctcgcctgattacaaaagcacacgcgctccgcgttcgcgttgcctctatcgcgcttccaccattcggccgcatcagtttctggtcaccacgctctcgctcgctagcttcgtcggagagaccgagagatcgatcatggaggcggaggcggagacgacggtggccgtgacgacgggcggcgagggggagatcgtgagggggaggaagctgctgagccacggcaaggtgttcgtgggaggggtgccgctggggacgagcgagtccgagctccgcgcccacttctcgcggttcggcacggtggccttcgtcggcgcgcccaagaacaagcagacgggcgccgcgcgcggcttcgcgttcgtgcagttcgtcaaccccgacgacgccgccgccgccatcgccgcggggcccgaccgcaacgtcatccgcggcaccacggtatacacacgcacaccccaggccagatccggtcctgatcgatctcatgcatcaatcacacacgctatcttctcatctcttcgatctccgtcgggtgatctcactcgatctgtccttgatttacatgttctcgtcctcttgcatcatgcatgctttgcttccgcggcccgggtgcaagtgaaagagcgtgggatcatcgattttttgctttgctgcgacgaggttggcttcttgcgttgttgcatggtggacttagctcgtagcatcgtgttgctcggcggcgcggtgggttagtttctgttcagtactcgtcgtcgacctgtgaccagttgaccgcagtattagttaactcttaagtcttaactaagtgatggttagagcttgattagaaatggtatgcttttggtgatatgttaattctgtctatatgcgtccttggtatcataaatttacgtgtagctgcgaattacagctgacctgtgtttgaatcataatttagatgtaattattatagattagtggtaagagtatgattcgttctgctcatatacaattgattgtatttaaggcattgtaaagttatttttagctctgacgaaaactttagttcttactgttaatttctttctttgtgacttactttgctaatgtggttcgtcgtccacaggagtaaaaggtgtcccttattattagctaactgggattgtttgattttcacgtgttgtgcccaagtgttacgaatgaattacattatacttttatattaaactagcatagtggcccacagaaattgcgcagcgagcatccttatattttctcttatataatagcatatattttttcttattttattcttaaaatatattaaaataataacataattttaattttgtactaactttaccaaactaccaatgtataatatttatattgtattgtatatacatgatagttattaattatttagtatcggagtttggttatttctaaattatatttctatatggagtttagactcatcttccaatattctttattttttaattctaaatttctattacttataaaatttattcctatatttctcattttaaaatttagaatttcagttatttctaaattatactcatgtgtggactctaaactcctcttccaatattccttttttttaattaggaattttctttatttgtaaattgtatttttatatgaactctaggcttttatcccaatatttcttattttttaattatgaattttcattatttctaattgtatttctatgtggactctaaactcatatttcaatattctttatttttttatttctgattttcagcaacttctaaattatattcctatatggactttgtactcttcttccagtatatattttataatttcaaatcttagttatttataaattatatttctatatggactctaaactctaattttaattttattatttttatttcaaattttaattaattctaaattcctatatggactttatactcttcttccaatattccttactttcttattccgaatttcaattatttcttacttgtaatcctatatgaactctatactcttcgtctaatattctttattttttcattccgaatttcagttatttctaaattgtatttccatattgactctatactcttctttcaatattcgtttttattttgaatttcaattattactaaattttatttctatattgactctatacaccacaaatggacctttaatttgatatgtagctagcctgcttgcgtgtagttgtagtttacgatcgatttgccactcacatggattcacttcatgtaggaccaccaggcctcgcgcgcgcgtgtgtgtgtgggtgcgcgcgggtgtgtttgtgtgtgtgacacaatatatttttcatacttactaattatattcgaacacatgagctgttctctagtacatacaatgttgatcaactctactggttttttccccagatggatatcaagttagcccaactaaagccatcagccggcggcccacaactcagtccaggtgaccagaagaggaagattttcgttggcggcttgccggtgtccgccaccgaaaagaagctcaaagaatacttcaacaaattcggcgaggtcaatcgggcaatcgtggtcatcgaccttaacacgaagatgcccagggggttcggcttcatccagttcgcatcggaggagtccacagcgagggcgctcaagaaggacaaacacttcctctgtggccagtgggtggaggtgagccttgcaatgcccaagcagcagaatgcagcttctggcactagcaaattgtcagttcaggctcgcccgttttatccgacgacatcatcaaacttcacaaccgccgctaattatcctgacgtcgttaatattgtccctatggtgacacctatgaactgcgtcatcagcaatgcttttaaccctcatatcggctttgaggtacccgggatgatacttagtgatggtgtgagcaattctgtcagtgctaattactcctaccagaacccctacttgggaggtggtggtgttcagcctcaaggctcggcggtgtatcttcaagcagcacattattatagtggtgtgatgatgtgaagctcagaagctgttccaatctatgcctaattatcaagtcatagtgtcacacaatatatgtggtttatttacttcatttaattttcttcaatcttgcttgttcgtttaaagaactcatggtatttagtttcaactatttgctctggcgaagttcgatgtactcacttccctgaatttttcgatgtgtgtaatagtgagctaggtcgggaagaattatgatttcttaactaactatctaaatggctagatatatataatctctatacacagactttcaagttaagtttttaatagttttgggtgtcaagtgttttcccaaggtttatttacctttgtttcttaaacatcatgtccagctcatttttgtaagaacataattttgaaaacatgcatatgctttttatttatgtcattcttaagtactcattttcagatcttttacatatgcatatgtttagtattcggtacttaagagtgatttatggtccttgatagaggtacgaataactcctcttttaatctcaaggagggatgtaaatcacttcagcaaacataaaagtggacattttatgttgtctatggactatatgcatggcaattgattgtatttatacaaggtttctaaataagcaagaacaatgcatgcataccatagtgaaatgcagatcaacgtgtgtgctaaattaataagtccagatagattaacgtgttcaattaatattcagattagtacatatatatctccattaatattcctgctgttgctacataaaaaatataaattgactacatatggataaatatattgttctaaagcatttttcacaattttattttaactttttttatgtaatggaagtaattaacttctcgctacagcagattaaactatgtatatgtgcatggatcacattgccattcataagtttttaccaattaagatatatattatgcgctaccaatgcccatttatctactagtcaactgtgtgtcatcacattaaatttcagagattactgttattggtcaaaattgacaaatatatatagtcaaatgagacgctttcgtgcctttttaatttatgatcactcgttaacatttcgttatagttgattaacaaaaacaatgcgattgactatattcttttgttgagcagataacaaaactcctgatcgatattgtgggaatgtgggttcgctcttcaattctctctattattgattggctgtgaaggctgtttcccaagcgattgatatggtcatctggctagctgtttgaagactagctagctaagttgatcatactgttgaatgaagccaaaatattttcccttttttgttaattacatcatcatcatttatctagaattcctgattatgttggctactcgtacctgctgcatgcatggtctaggatcatatgaacttttttctttttctgaacgttgagaaaagaacctgctaatatgttaatctggtgttgtctggcgtgtatatgcagccggatatatatacatgtatatgaaggaactgccaacatgggttaatcagcggtaacatttgcatttctcatgacacattttgaagctttttcttcttgagctatcattatggttacccaggaggcagccagctagcaggtattgcttctgaagaaataatgatgatacatgatccatattgcatctaactagttataactaccattgctatctcctggtcctgacgtatctgcaggtaacgaacgaactgacaatgcaccatcaggcatcgatcagatcacaccacaagccaccgtggctcagaccttgggtcaacacggcccgacccacgtgcatccctaccgctgaccctctcctccctcccctcccctagctacctggccctgcagggtgtggtccccactccgcgtcttgctttcccggagaggcggagacgccggccccacctgtcagtcatcctcaggcggctttgggctttggctgcgtgcgtcgcgtgtgctgcgtgacgaccgcaccatgtctctcctcgcctgattacaaaaacacacgctccgcgcgcgttcgcgttgcctcgatcgcgcttccacaattcggccgcatcagtttctggtcatcacgctcgctcgctctctcgctcgctagcttcgtcggagagatcccgagagatcatggaggcggaggcggagacgtcgacggtgaccgtgacgacgggcggcgagggggaggaagctgctgagccacggcaaggtgttcgtgggaggggtgccgctggggacaagcgagtccgagctccgcgcccacttctcgcagttcggcacggtggccttcgtcggcgcgcccaagaacaagcgcttcgtgcatgcagttcgtgaaccccgacgacgccgccgccgccatcgccgcgggacccaaccgcaacgtccgtccttcgcggcaccacggtatacacacacacataccccagatcatccggtcctcccatcgatcacacgctctcgtctcatctcttcttctccgtcgggtgatcgatctcactcgatgtgtccttgatttacatgttcttgtcctcttgcatcatgcatgctttgcttccgcgcccgggtgcaagtgaaagagcgtgggatcgtcgattttttgctttcctgcgacgaggttggcttcttgctttgttgcatggtgggcttagctcgtagcatcgtgttgctcgcggcgcggtgggttggtgattctgttcagtactgtcgtcgtcgtcgttgctatccgtgaccaggtgaccgcagtattagttaactctcttaactaagtgatggttagagcttgattagaaatggtatgcttttggtgctctgttaattctgtctatatacgagtccttggtatcataaatttacgtgtagctggcgagttgtagctgagctgtgtttaattgcatcataatttagatgtaatgattatagattagtggtaaaagtaagattcgttctgctcatacaattgattaatatttaaggcattgtaaggtttttttatattccgacgaaaactttagttcttgctgctaatttctctctttgtttttttaaagaaggcaaaagctttgccttgtatatattaataaagcaggagaaaattagtgagatatatacagggttagccgaaagagagcaagaacccgcaaaaaagaagacaaaaaaaaataggtattaagtgatatctcccaaaattacaaactcctgcaggattgaagccccctgctttgacccatgctcttccttcctccttgatctttgtcaaaattgaggacggcgccgatgcattgttgcggaatattcttgcgtttcgttcgcaccagattttccacgggattaaaatcaccaaggtcctgaggggcctgcgcggggtgcttggggactccgctacgagggtccaacattgatcgactgagtgacagttttcccaattgtccatctgaaggtcagtcctggtccatctctgaatttctgcccatatcctctttgtgagtctgcatttggccaggaggtgtaatgccgattcgtcaacagtgtagcaaagtgggcaaatcttttggttttgccatcctcttttctccagcctttctgtcatccatactctgttttgcgtgaccagccaagagaagaatttgcacttcggcagcgcctaggccttctagattgactgatagaagacggatttggcagccccaaagaattgaagtcgataggccgatttgccgagtgctgcccatttgctgtgaggttccatcgaatgctaccatggctctcgctaatttctctctttgtgacttattttgctaatgtggttcgtcgtcaacaagagtacatgtagctagctgggattgtttgatttcacgtgttgtgcccaagtgttacggatgaattgcattctgttttaattttatattaaattatggaagatcatgccatgatagggtttcggactaaggctgggtgcatatatagaacacctcctagtctccaacttcttgtgcttgctagggcctagggcactcaaggtcagacgtgtgaggatggcatttttgcatgtgtgcacccaaatcttcattttagcgtgggactgagcaaattcaatatacatgtagcttaggatatgtgttcatatgtagctagcccgcaaattcaatatatatctccaaaattaaataacacattttgcatgtgtacacccaaacccaaagttttaatttacaccacaaatggacctttaatttgatacgtagctagcctgcttgcgtgtagttgtagtttaggatcgatttgccactcacacaaattttacttcatgtaggaccatcaggtctcatgtgcatgtgtgtgtgtgtgtgacacatttgtgtgtctctctgtgtgtgtgacacaatatatttttcatacttacaaattatatttggacacatgagctatatagctgttctctagtacatacaatgttgatcaactctactaattttttccctagatggatgtcaagttagctcaaccaaagccatcagccggtggcccacaactcagtccaggtgaccagaagaggaagatttttgtcgacagcttgccggcgtccgtcaccaaatagcagctcaaagaatacttcagcaacttcggcgaggtcaaccgggcaatcgtggtcaccgaccttaacacgaagatgcccagggggttcggcctcatccagttcgcgtcggaggagtccacagcgagggcgctcaagaaggacagacacttcctctgtggccagtgggtggaggtgagccttgcaatgcccaagcagcagaatgcagcttctggcactagcaaattgtcagttcaggctcgcccattttatctggcgacatcatcaaactttaccgccgccccaaccacgtctcacgtttagcccatttagcctgatataactgtttgacaagctaaccactaaatgtcttacccactatttaaaatattgcactccacaccaccaccccaaccacagctcacgtttctcgctctcgcctctcgttgcatctatatgcaattcaaacacgcatgcgccacgtggctatcaaccgccgaaacggctaacgccagcgctgaccctcgcatcccctctcccctacctggctctgcaggttgtggtccccactagcgtcttgctttccccgagaggcaaagacgttgggcccaagcccccaactgtaagtcatcctcaggctgctttgcctgcgtgacgaccacaccatatctctcctcgccttgttacaaaaacacaagctctgcgttcgcgttgcctcgcacttacacaactggactgcatcagtttctgatcaccgcgttcgctcgatcatttgcttcgtccgagagatcatggaggcggaggcggatacgacggtgaccgtgacaatggaggagcagcagcgggaggcgacggacagcgagggggaggaagctggtgagccacaggaaggtgttcgtgggaggggtgccgctggggacaagcgagtctgagctccatgcccacttttcgcagtccggcgcagtggccttcgtcgacatgcccaagaacaagtagacgggcgccgcgcgtggcttcgcgttcgtgcagttcgtgaaccctgacgccgccatcgccgcggagtccgaccgcaacgtcctccgctggcaccacggtatacacacaccccagatctggtcctgtcatgcacacacatgctctcatcttctcttctcttcttcgtcgggtgatcgatctcactcgatgtgtgtgtgtgtgtgtgtgtgtttgtgtgcgcgacactttttcatacttactaattatatttggacacatgagctgttttctagtacatacaatgttgatcaactctactgttttttctcccatatggatgtcaagttagcccaaccaaatcctcccgttggcggcccacaactcagtctaggtgaccagaagaggaagaccttcctcggcagcttgccgacatccgtcaccgaatagcagctcaaagaatactttagcaaattcaacgaggtcgaccgtgcaatcttggtcaccgaccttaacacgaagatgcctaggtgggttcggcttcatccagttcgcgtcggaggagtccgcagcgagggcgctcaagaaggacaggcacttcctctatggccagtgggtggaggtgagccttgcaatgcccaagcagcagaatgcaacttctggcactagcaaattgccagttcaggctcacccgttttatccaacgacatcatcaaactttaccgccgccgctaattatcccaacgtcgttaatattgtccatgtggtgacacctatgaattgtgtcgtcggcagtacttttaaccctcatattggcttcgaggtacctgggatgaaactgagtgatggtgtgatcaatgttgtcactgctaattactcctaccagtacccctaccttggaggtggtgaggttccgcctcaaaactcagcgatgtatcttcaagcagcacattattatagtggtgcgatgatgtgaagctattccaatgcgtgcctaattatcaagtcacagtgtcacaaaaggggtgtgtgtgtgttggggggggtgtcattgagatatataagttggcaaatcctaggagcaaaatatatttttcatacttactaattatagtggtgcgatgatgtgaagccattccaatctatgcctaattatcaggtcacagttctgtcacacaatgtatgtggtttagttaatttccttcaattaattttcttcgatcttgcttgtttgtttaaaagaactcatggtatttagtttcaactatttgctctggcaaagttcgatgtactcacttccctgaatttttgggtgtgtgtaatagtgaggtagggaagaattatgatttcttaattaactatctaaatggctagatatatataatctctatagagagactttcaagttaagtttctaacggttttgggtgtcaggtgttttcccaaggtttatgcacctttgtttgttaaacttcatgcatgtcgatccagctcatttttgtaagaacataattttgaaaacatgcatatgctttttatttatgtcattcttaagtattcattttcagatctacatatgcatatgtttagtattcggtacttaagagtgattatatggtccttaagaggtacgaataactccttttttctcaataagggatgtaaatcacttcagcaaacataaaagtggacattttatgttgtctatggacatatgcatggcaattgattgtatttatgcaaggtttctaaataaacaagaacaatgcatgcatactatagtgaaatgcagatcaacgtgtgtgctaaattaataggtccagatagattaacgtgttcaattaatattcagattggtacatatatatctccattaatatttcttttgtttaaaatataaaggcaaaatttgactacatattgataaatatattgttcttaagcattgttcacaactttattttaactctttttatgtaatggaagtaatgaacttccactcgtcgctacagcaaattaaactatgtatatgcatggatcacattgccattcataagtttttaccagttaagatacatattatgcgctaccaatgcccatttatctactagtcaagtgtatcatcacattaaatttcagatattacagttattgctcaaaattgacaaatagtcaaatgagacactttcgtgttttttttatgatcacttgttaacatttcgttatacttgattaacaaaaacaatgcgattgactatattcttttgttgaacagataatgattgtgggaatgtggccgggttcgctcttcaattctctctattattgactggctgtgaagactgttcttccaagcgatcgatatgggcatctggctagctgtttgaagactagccaagttgatcatactgttgactgaagccaaaatatttcctctttttgttaattacatcatttatctagaattccttattatgttggctactcgtgctgcatggtctaggatcataaggaacttttttctttttctgaacattgagaaaagaacatgctaatatatatgttaatctggagttgtctggcgtgtatgcagctggatatataaatgtacatgcaagaactgtcaacatggattaattagcaataacatttgcatttctcatgacacattttgaagccttttcttcttgagctattgttatggttacctaggaggcagccagctagcaggtattgcttctaaagaaataatgatgatacatgatccatatttcatcttataactaattagctaccattgctatctcctggtcctgcaacgacccatctgcaggtataactaattgtcaatgcagcttgatgaacaccagtaagttcaatcatatcggtagctccttcaatttgatttaattcactgcagcatcttaattcgtggatatgatcgtatgattgatcgatcaagcctttcctttcatctgtgctagctagaattgtagctctgacatgcatgcttcatgtcattttccctctttattttgtgcttcacagacagttaacatgcattgttcgatctgtcatccggtggcgcgcatgtctcgatcggtgtttgctagatgccatgcacacgggagaacggggagatcgattgatcggtcgtgcatgtgctcggctaaaccatcgacgagcttatctgaatccatccgatccatgtgagctctggcaaaaaagctagtgtcgaatctcactttgcatatggcaaggctgcttcgatctctaggattgccgttgtttcatcagcagcagtacgttcgttccaggctatcgataggctgtcaagtgtcaacatgaatggttgctatgttctgtttggaacgcagcaatttcacaacaaaaagaaaaacaaattaattcgatgcagtacgaatgatcaaagcttcatcactcagtagtactccctatgtgtactgtctaatctggttatagattattacggaggatatcttaggacggagagagtgcttgtgtaaaaaatcataggaaggatgaaaccaaatagatgacgacgacggctgttactgtatagcacgattcttccagccacttttgatggttccatagtttatattcttcagtttatcagccatagcaaattaaaacgctatttttagcattgatcttgatcattgtatattactagaaaaaatatccgtgcgttgcatcctgaaataaaagttacaataaatattagaagtttgggtttaatttttatgatatatatcccttaaaaaatcatatttttacgtggacatggtaacttgttgaaaatagtatattccttgactaccaccttcaatatcaacacataatttctgtgatagatatccctcttcccaacttctactctcattttccgcacacacgcttctcaaactgctaaacttgtgcttttttaaaaaaaatctatatgaaagtttttaaaaaatcatattaatctattttttagctaatatataattaatcttgccttaatccatggctttgttttacgtgacagtgaagggttcacaaaccaacaaaacacagcctaagattttatggaaaaaaaaccttctcgtaaaataaaatggttctagtagtatatcatatactcctattgcctatatgttttcactcgctcctagttttaacgtgttagagttgttaaccacgaccattttctgttgaattaaatcgagaaaggaagaaaatgttgcaaagttaatgaaatagagaatgttgaataaggcagcaatgtggaaactggaaaaaaggaggtgcttgtttgacaacacaccaaactatagtcggggagagagagaggtaagtaaggataggattgaggaacatatataatcgaaagcagacccttacatggaatgcaaatatggtcatgtatgtttcaggttgcaatctagttctagaaatagatcctacgctaacatgaattgcgcattgtgcgatatcatccggaccctcaaatccaatccacttatatagaaaagaaaaccactacagctttaacctaatcacttcaacaatggcacctgtaggactggaccagaagcaagaacaaaatctgatttattcaacttaaaaaataaaaagcttaccatgtatttgtatgccggttttaaaatctgctcaacaattactacaaataaattatggaaggaaaatatgttggggtgcttgtatatgtgtatcttgtttccagtttccacatgtgatcagctttaacggaaagaaagtagcgttagaattggaaacgatatgttgcaacggaaaggaaacaatagggaaaggaagcggagttcgtctggctctcgcgtctacctgcgcattgagttataggaagatggaaagaacgaaaataacggatgaagaaaacaatatgtgcggtgaaaaattgtaatgacggactaaaaaagatgtggcgaacaaagagatgcagactttttaaataggttagattagattttttttcagtgttaactttgtagaccacgtgtatataaatgttaattactccatccatttcaagttattaggcgttttgactttgttcaaagtcaaactactttaagtttgaccaagtttatagaaaaaagtagtaacatttttaaccaagacaaatttattatgaaaatatattcaattattgatttgatgaaactaatttagtattataaatactactatatttatctatataaacttagttaaatttaaaacagtttgactttaagtaaagtcaaaacatctcgtaacatataacataagacggagggagtactgcgaaacgatgacatccaagtacgagaacgagagcgatggtgcaaacaaaaaccaagacagacgtacgtacggcacgcaggcaggcagcagagcaaccaagcaagcagatgagacgtccttgtccagttgtactactactctatcgggacgatacgcagtggagtacgacgcaggccaaggccatgaatgaatccatgacgtgtgatttctcccggggaaacaaacagggtcccttgatttgtgacagatcaactaaagcgatacatgaggcatgagctcgatctctcgagctggatcacttggatcaacaagtgaactacgtttgtggttagtaccatatacttattccgtctcatgatagttgttactctaaattatttagcaaaaatgactatagtgccccctattaaatggtatagggttaggagtagaatgaaaaaaaattgaattggaggttattgatgtgtcaagagttactgtaaagtgataaactttttgggacaaaatttgaatcctaaaacgacaactattttagtacggagggagtatctcaaaggattttcagaaaaaaacaattttgaggaatttttaaggattaggggtgaaatatcagcaggcagataaatcccatttcggaattattgattaatagaggtataatagcgtactgcaagtggaagacatgtaaattatcattagtataataacatgctgcaagtggccacaaacatatctgcgtcaagatgcaggacaataatcgtacactaaataccctctctatttgcatccacatgggattgttgctaatgcaagagacaaatccccggtacttaagcctagctgtccttgccaagatagcgacacagcacaactcaaacagatctttctctgaaaatgtgaatgtatattacaaaggctagaactagaagtactgaagtagtataacccagccatacagctttcatgtacaattgtacatcatgatattcctctcatgcataattcatactacataattgcaatcttgcattcacaaaatacatgcatagagtgatccattgctgggtttctcattactatctttcatcaaaaggtgtactattgagtaccacagtatgcatccatagtgatcggccaaagtacatttaaaataacagtatctccatttgaaggtaaactgtcaagtaagtagaaacaacccattctaaccactgagaattcttacaaaagaattgagacatcaaagaccatcattgcaggccgactccaaaagccatatatctacacccccaacaattcagagtctccgatgaattgtaaccccccatcaatgggaccagagcttcttgtctttgcatcaatattgtatcgttttccctttaccagaacttctctttgattgcatatccccctccaaagaaaaaaagaaaccgattataccacatgtattctatcactcgacttgctcgccgatcaagtcgaggccgacaaccaagaatgagaccccttggaacagaaggaagtagaaatgtatgccttgcaccgagagcaggcttcgagctgctgctgttaatagaaggaaggagagtgccagctccttctggtatatcctattgtgttttttctttttcgaatcctttttcggatgggactccttcgctagggaatcaaggttgggtgcagacccaactctctgttgcttaggctgcttctcaacaagagaaacgagatcgccctcagaagaacggcccgatttcttggtcacaacccactcgtaggcgctcccgagctggaacaagccagaaatcatggcattgaattttgtcactgacatggtattctcaaacagaaggtagggaacaataaatgggaaggatttgggtgctgggagaatattcagcaaggacatggttgctggaatgtagcacaccacccatgcagggagctcagcttcagggacaaacattgtcatgggaaggatgatgcagaaaagtgtgaaggaatagaagggcaatatgagtttgcgaaggagaaagaaaaggaagatgaggttgaacttcttccatactccaatctgcagttgaggtaagtaaaaatagttctgatcagtttcaacgactaaatatgtataaaacattgacaaatgctgttagtgtaaaattttgaattccatcgtagctgtgttttgatagaagtgaagttatctacagcatcaacaatttgccggttagcaatttatttgcagagtaattctatttacacccagtctttttttccagatgaagctcaggttagcaatttatttgcagagtaattctatttacacccagtccttttttccagatgaagctgtttagtctgtgtttgacgtcatgaaacatttgactaaatgagctgcaggtccattttactagtgaagaaatcagtctatgaaacttatgctctgtaactaacttgaagcgaaacaaggttcatgtaactattagtctgatgttgctcttgtaatgtactggtagatagtaaaacaatcccttgcaactatgcatcctgcagatgtttattggcaaaacaactgattgtgctagattatcctactgaatgcagccaaaatcttctcaacagaaagaataagggatgaacctaaccatgtagtggcatgctttatatgatgttgtcaaaaatagcttttggagtatgcctacgagagaaggtccatacctttgatttgatgatgtcgacaaaacagagtcgaaacaactgcatgggaccagaatgccatcgatgttgctgctttctgtatgcttcatatgactctggcagctcacactggcactgaaaggataattgtgtgcaacaatttgaattgtcatcacaagtttgaatacaacacagaacgcacataaaacacaaggaaatgtatgcaggtacctcgacatcattaatgtacagaaacttccaccccttgagatgtgctcggacagcaatatccatatcctccactgttgtcctctccatccatcctccagagtcctcaagtgccttaattctccatactcctgcggttccattgaacccaaagaaattgaggaatactccattaacctgctgttccacctcaaagtggaagcacagattaatgttttgcagtctagtcagcaagttctcgtctttgtttacaaaagaccatcttgcttgaaccaatccaacatcttcattgccctggaggtccaacacacaactagtcagtaaatataattttcattgccttggacacatataagaatgtaacacaagtccacaacatcagaaatatttcagctataccttgaaatggggcacagttcgcttcaggaagtctgcttgtggttggaaatcagcatcaaagataacaacaaactcataatctttaacataactgcagttcatggctgacttgagatttccagccttgtagccatcacggatcacccggtgtcggtacaatatgcggacaccctctcgctgccatttctccacttcctccttaataagtgcagaggtggcagcatcatcagagtcatctagtacttgtactaagaagtttgaccttggccaatccaggttgcagacagcaccaatggattgctggtacacctgcaaagatagaaattaaaaggaataagctaaatttaattgtagttctaacatgggtgttctgttagccttttttgaatgtcatgaacatagaacacatcacaaaggaaacaaaagtaatgctactcccgactcccgagcttagatcagtataacatcttatatctataattgtttttctaaattattctttatacattttgttgacgagaattaaatgaattttgtaaagatacaaaactttgaaacataaaacagtgcctttaaagcccccatccccccccccccaaaaaaaaaaaaaaaaaaactgaacatgttcttaacttcttattcacatattcaaatccccaaattaaatctacaacccaccaaacgcttcatatcaggaatacccataggccagaatgtagattatgtagtgatcgtctactttgagtcgtggacaaaaatcgaaaccgtttcatcccagcatgtaaccatcactccaatcccaatattgaagtatgcaagtagcagccaaattttgcctcagtggcactacgaccaagataccccaatctaaatctgccgaattattcctatccacttgttgagttcccccccaattgcagttcaaagaccgaatctttcggtctctgcaaaccacagatgcggccatggcactcaacgcccaatcctaaaaatgcaaccttgcgcaaatgccgaagcaacaaacaattggaattagttatgtttgttctcgcagctcacctccttctcgttgcacattggaatctgcacgaggaccatggggaactcgtcggcgccggcctcgacgtcgtccgaccctttgccgccgccgccgccgccgctagccttgggcacaggcttgattcccttgagcttgatccataagcagccgaggcagaggatgaggcggtcggcgctctggatcaagaagaggacgacgcaggcgttggcgaggaactggagccccggcgcgaggtactcgaggcggacgcgcagccaggacgcgtacgcggcggcgaagaggccctcgacggcgagcaggtcggggacgacggcgtgccagccctgggcgtgcgccgcgacgtcgacggcgaggaggagcacggacaggaggaggaaggcgcggaggaagccgtggaacctcgcgcgcagcgcggggctctcccccggcggcgccgcggcggcgtcgtcggagtcggtccgccccgccgccacccgcctccgcgcggccgccgccacggacagcgccgcggacgccgcgcccgtcagcttccccgccgcccggtgcgccttgagcagcagcacccacgtgatctg

SEQ ID NO: 64022 - DNA, 35895 bp, Oryza sativa
tgatatgcacacaccaaaatcaacacatgattctgctgggggagctgcaactctcacttctccggggcagaattttggaaaggcgaagcattcatattcagaaccatctgatctttatggtgctcatttctcgagggatgtgatttcagtttcaaaggaactttggattggttcactgggaaatagtgctgcagagtcactagttagatcgaaatttgaggagtttggccccttagcaaacttcttattttatcccccaaagaattttgccttggttgagtacgggaacataatgcatgctgttcatgcatatggatgtatgcagggttcctctgtttggggtggtggtctccaaataaggtatttagatagacttataggcagcaagggatttgctagtggtatagctgttggtgaaagtcgtcatatttatgttgctaaagttaagaacaaaaaagataaagatgaggtgtttgatgaattaaaggccgcagggttgaagaggccatgtagctttacagatatttccagtgaaaatgctttgcttcttgaatttgagacagcaactgatgcagctgctgcgaaagcccatattaggcgccagcttcatccagatgtctgttcccaggacaagaatacttctggtcatgaactttttgtgcggaacatagacaattcagtccctgacatggagtttatcaatgcattttcacgatttggtgaggtcataaggtggcagttcaataagcttgatgggaactgcttgatagattatagatcacctaatgctgctgccactgcaaaatctcacctgcatggtgcaagatttgggctgaagtcaattagtgttgaatcgagatctgtgcatgataaaactttgtcgccttctgttccaatgctagccccgagtgtttctgacagcagtcaccatgagatcaggttagctcaaccttttcttatcttcttaatcctgtacagatataaccatggttgatggttgcaacagttctaaacttgtatattttttttatcatagctcccaaagtgtgctaagtcggtctgttgttaatgcaacttttctagacctggtcaatgcaatttggagtcatcccatgatttgtacgatcatatgcagtgggtggtattggtttgcatatgccatcgatctatttgtgcacctgttttattagcatgttattttttttccagctatcttgaatcttgtgaaaatgcactgttagaatgtaggatgctatcgctgatttgacatacctattttttgctgatttagatcctctgttggatattttgggtattgggccatttagtacccatcctttatttttggtgctgcagcctcctatcctgtatgtgcaactatgcatgtatctgtatatactttggcgctcgtatgtcaaatactgatataatgtcaaacttccaaagtgctactgacctaccattacatggttgttccttcactgcttagtccctagttgtttgctggtgccttatgtgcattgtatcatgctagtggctgctttttcaaatataaagcttcatacatatagccggtatttccattagctttgcctttgattgcatttctccaactgcatgaaagtctttttataggttttacatgcactaatattgacgtcaagcaggcctgtggacaaaaatttcgtcatcttaggctttcatatatcagtgccacctgatgatcgtgaaattatttggttaaggctgcaacctgcagaatgtaaaaaatatatggtctctgtaacatgggttttttttttccatgtgggtatgtcaagcttaaatattttccagaatactgatttgtatgtcttccctttccattgagctcatggtagaacattatgtcaactagtgttgtttgttatgctgctctttacgatctgcttatattttagtaatttgtatacctaaattaaggttttgagtgcttgaaagtcatttgttgcttgcaccttgggagtatcacattgctgctgtatgcaattgattgtttaattttacacatctatgaaacaatcaaatctgcaggaatccaagggtttcagggtataatgcaggcttcacagtaccaacagagcgaccaatttatggtaagtctagtattctttaatttaacaaattttgcgagtttgtgcatgagttggctccatgtaacagtatggttgacatgcaggtccatcggctcccagagctccacaaggcatccttccatgcccacctgtttctgcacaccgtggtcctgtaataccaccgccacctattcaaacttcttttgtccgtcctgtatatcctggtccaggaagtccgtgggaaaatactaccccaaatccatccttcagtcacgcttctcctcgaatgatgcctggaagtagcttccgtatgaatccacctgctcctcttccttttataccatcttctgttacccctcttacacagtttcctggaggttcagcacagcagtctgagaaaaggccacctccacctccacctccaccaaatgtagcccccccaccatttactcgtcaagatataccacccccaccaccatctccaccaccactacctattactcagccaccttctgtgccaccacccccaaattcccctcctccgcttcaacctgctactgacccttctgactcacaaaagcaacgttctcatcctcgatggcagggctctctttcaaaaagtggtttacattactgttcaatctatgcaagtagaatagagttggatgcttgtagatatgaacatgcagtttctgaaccgacagggtaagagatacatcaatccagcctacacattctattattacaacattacatattctcctaaaacattcttgtttgcacatttaggtggccttcaagattagatgtgacaaagcgaacggattaccaacatgtgaagacaactttctccaatactccacctagcaaagtaagactctagaaggccatgtactatttcagaaatacttctagcctagtgtaattttacagtttaagtagtctcaccataattcagtctctttttttctgttggcataacttttctgaagactgttcttgtattttcaccaatcatgctttatagttgtgtgtttataccatgtttcatctaaactgcaccatgagaacatttctacattttgtccttgatatatatgaatttaggtgccaggatcctcagcattgatgcttgttaatttggcacaagttcattgcataagggatctccattttatcatcttggttttatttgagatgattgagctaaaattaagtaataagtgaatattttatacctggatgtaagggaataactattttgagattttttttaataaatgcagtgctaatacttctatgttgtttttaaattgaaattcttgatatttaattcagctaatggtgcatggtcatatctctgaacttgaaatctggcaaatagcatcttttgctatttagttcagttcactatgtatgcatgaaaagcagcagatcgttaggaatgggatggtgctactagaagttaccccctattaagccataagccgtgagcagctaatttatagccgattgtgcggtcaatgatgataagccacttgtaggttagcatggctatgtttcagatgtggaagttgatatgtcaatgaattttctttggagtacaatttaagtacttgctcattgtggggcaaatgcgtccatataacgatttatctagattaaacagaaaggtttttaatatattaagagtaaatttcacattgggcgacatattttgaccaagatttcataatggactaaggttaaatcattgttttcacttaacaccatacatcttacataagttttcagtttggactaggggtgagcaaagcaagggaatgtgagaaaacttcatatgatttacacatggataattataaaaggcaaaacattttatgttttcttccttatttttagtgtgagtggtaattaactcttttctagtattttatttttattcatttgcccctatgtatatatcattttgtgccacttttaaacatgtttgcatcattattttagtgtgatttgctgaacaaagttgttttgtgattttctatttctttctaaagatatttatcttaatactatggaactaaaaatgatgatttgaactagcttttctctgacaacttccattgatttgctcaaccctagtccaaagtgccaactagtgcaaagatatgtggtgctaagtgaaaaggttgggttggcccttgcccattgtgaaactttggtcaaaacatatggtgcagtgtgaaatttactcatatattaatgatggggctgatgtatttcagtgtggtgcagagagaaaatctcgagctacttttatctatcgcatctcgcaggggaataatgtttactgtttgttatttcactttgcagagagaggtctgtcggctattaccctgttcgaatggtgatcagaaaggggtatgattttattatatacactgccaaccccactacctgaatatctatttttatatgaaaccacattaacccttcactacttatgtgtgtttatcttgcagttccgggattttatatcctatctgaaacagagagaatgcgccggtgtgatcaagattccatctgtcaagccattgtggtcaaggctactatttatccttcctcccacgcctgaggcctgtgggatgctagaacttccgccccatccgaccgaatgcctaattgcactgattttgccaaaggagacgactgctgaagcgacctaacatgattgtcgcgtagacacattccgtaacctcgttgcttccagtttcgtgcacagtaaacaattttgcatgaatgatactaagttcctacagctgcttatgaataatatgcttccagtttcgtgcacagttaacaaattttcatgttttcttttgacgagacaccaatactgtacttattccttttgctgcataactgatatatagttgctacaatatcacagaattgaccggtgatccggaatttttacacgcaaagatcactacagggacatgatctgacgaaccgctccgtgttctcttcgctgcttacttcaccacatcggaatctaggtcgaggacgaaggattggtgacttgcccggcgaagaccaccacgccggtgaggtcctccttgatcaggaacatgaaggggtggtcggcgacgaagtccacgacgtgaaccggcgccgatggcgccgcgcagccaagggtcatgacgacggcggtcgccgccgccgcctcggtgccttcctcgttcacctcgacgaaggactcgtggtagacggccgacacgacgatcttctccgcctccggcgatgactccaccatctccgacaggtcggcgccggggtactcgaacggcaggcgcagcccgagctgtcgcagcgtctccgccgcgttcgtcttgtacgacagggtgaacctcggcaccatgaaggcgcccacggggaccttctccgtcagggcggcggagctctcgatcagcgccgccgggtcggagcacagcttgcgcagcatgtcaggcaggccgtggcgctcgtcggggaggtagatgtacatcgagaagaggcggccggtgtcgcggccgcggccgcggccgccgcgcgcgtacgggagcctgaggaccttgtagccggcgcggcaggcgatgtactgccacttgccgctcgacatgaacggcgcggagacatggccgccgtcggggaggtagaagacgtcgtcgctcgtggaccgggcgtcgaacttgctttcccagtcgcccttgaagtagagcgcgttgccgaggacggccggcgtcgcgcggtccacggcgtctttgggcaggaagtccttgatccggccggccgtcgcgctctcgaaccactcgttgatctctcgcctcgcttcctctagctgtacgtgcatccatcgaccaagagagattatatcgtaatttttgcggcaagaaccaaaatatttcgatggatggatgaatcacatggagatggaggagaggtttgttagtcaggcgcgggggctcaccttgtctcggaaggacaccgggcgcgcctccgcgcggtacttgtcggcgacgacgcgcgcgtacgcggccttgaggcggagcgcggcgtcgacccagacgccgttggcgaaccgcaccttgggcccgccgcggtcatcgccggggccgctgtcgtcggcgagggagcacagcgcgacgtgggacgcgagcgccgcgtgggcggggccacccgcggggccgaggaaggcgatgatctggtcgagcgtttcgccgcgggcccccgcgccgaggagcgccagcgccgcgtggagcgagagcggggagacggccaggtttttgtcgccgccgccgccgcgtggggcgcgcgcgaggtggccgagcaggcgcatggccatggctgtctcgtcccggacggcctccgcgagctccatggctgagcggcctctcgagacggtggggtttttcttggatttttggttgttgttgttgttgtgtgtgtgtgtgtttgcgttgcggcgggtgtttttttctctcttttgtaccgtggaatggtgggattgggattcggttacattccccgtgacatgtccccagtccggaatggtgagtgtgttgggcgcgggaggttgtgccgcgtcgcgtggatgggacgcttcgggataatgttgttgccaattccagggttccacttccacatacggctgtgtttttttagagagaacagtgtacaggtggttttggactaggtccctcgcattgacatgaaaattgaaataaaatccgtgggctgtgaagatatggttagttatactcccagtccgctctaatccatagagttagccatacctactacactaataaatacccaggtaaacagtaataatcctttgttactggtacatcaatcgactgaccaactcttctcaaagtctttacacggcgcattaagcgatcagcagattcagaagcatattgattgactcaattaggtaaaccaggacacaaccatatatccaatacatccatcagttacaggtttttaccgtcaggagtagaaaatgagtagtacatgaacatcaaagcatcatgaatatagcgaatgagattccgcgggtactttgagagaagaggactaaatgagttattactgcagtcttgtacgtcaactaacttgcgaagtgctacagaagaaaagctaacttgcttgggtaacagccaggagttgtagtcccgaaactctctccactccacagtaaggatcagcatctgttgacagtgttaatgtgtcattctggctcaaggagaagtcacccggttaaggagacgatttgagcgtctcaatggagttggcgtggtaacatccttcttctccacctttgcagcattttcctgatgcagaaaacaaaaggaagtgaataagtagcactgctacccacagctcgatattgtgtactaaaacaaatgcttgaccattatggaaacatattaatgtcagcagtatgatgataaaagacttatctaagcatctgaacactatgtgtagcctgtaggtgtaaagataagtgtttgaggacactgaattttacctcctttttcgtttttcgagcactagggcttttaattgctgtagtttccttctgcatcttcaccacatcttttctcagagttactgatggttcctgaactgcaacatccccagcatgttcatttgatcctttccgggagcttcctcttgagctacttgcatccacaagtgagaactccccaagcaatgccaccactggaggtctcgagctgtcaatgtctctacggccaacagaatagctgtctggaatcctagcactgccagcatcatcttggtgaactttctgaggacgattcccggaatcaatctgcttgggcagtggaaattgcacagcattattgaggttgacagatgacactggtatgggctctggcaatggcacctgttccctgaagctggcaaataggtcaggcttgtgcaaaggtgatagtgtagggatcttcaaattgacaggcggttctactttgggaactgtcagttgcacaggttgtagcacagattgtggtgaagggagcactggcaatcttggatttggagctaaaggggattgttcaagcctacgtgttgacactgatgcacccttaggagacctctggaaacacttgagcatagcagctgcaattgcaaatgctgcaacagaaaagcacgccaagatctccatcaagtgaagttttattgaaggccacagtgattttaccatagctactattgcctttgcagctgcagctggattctcatactccaatagctcggttgcctgatccaatctgtcattttccaggccctctccatcataccctacctcgttgttttcttgttctattgtcttctccatggaggccaactgctgggagtgttgcgagtgatcctcccctgcctcctcctgatgaactaaccctgactctccctccaccatatcagcggtgtaggttgaaccaatggaatctgcagtgacattttcattcaggcttacaacttcacccaattgctcggcattctcagaggttgcaaccatcaattcactcagttgaaaatcttccttggaattctgcacatcctccacggctctgtccccaatttggcatgtaaattctccgaatggaacatttgggcatgaatctgccaaacccatcgcagcaatcgccatgaagtttttacgagaaccacccatggggccatacagttgggctgcattttcactgccgttgggcacagtttgatctgtagcttcttcaaacacatgatgtgaacccatcatctcagttggtgctcgcaactccagagaacctacttgatgagcgctagcatcatgcacgctcccagttgttccagcaaaatcgagccccatttgtgaggtaggaaagggagaggagctcatacaatagatgtagcagcaagagcaggccgcggcgacgagcagaagaagcagccgccgtgcccacccaccacgaggagacggaatctcaatctcctcctcctcggcgtcggcgcggtcgagaccacgaggagacggaatctcaatctcctcctccttggcgtcggcgcggtcgagttcggcttcgccgcctctcaccgacgacccggaggacacgcactccgagggggtgggggtgggggtggccgaggtggcactggacgactcgtcctccgcctcgcgctccagccggaggaggatctcgcggcgcttctcggggttgtagcgcaggaactccggccgcggcgtggtgtagttcgtcttcgggtcgtacggcccctcgccgcggcaggagagcgacggcgggctcgtcgcgggcttcgcctgggagaagaactgcggcggcgacgcggcctccccgctcccgtcgcctccgccgttcctctcacccagcaccttcttcctctccagagacgcggtccactccgccacggcaccgagacgccccggattctcgctccacgccctcacgttctcgtccgcctccgcgtcccttcgcctcgtcgccatgggacttcctcgcggggaacctgcacacggcgcgtaaaagcggattgagcgacgaagcaaccgaaaattgaggggaattatacgcggagaggagacttagattagattagatccgggcggcagcacccactcaccatgcggaagaactcgcttgggcaaatccatggcggcgagggggttgatttgatggttcggagcggcggcgggtgtcgattcgggggggtgggatgatggggagatgggaagagacggtggcttggggatttgaaccggtttggatcttgccgaccgttggagccggcgatgcggtttttatacgcgcgccgtgtgacactcgtcatgagtccggacgacggtcgagccgcacgtgttgtgtcgtgcaagtagccgagtaggagtacactcttgtcttcggagaattgcagagaaattgctcagaaacacaaggattctattaggagaagtttgcactgtttacatctcatcctaaaatttttcaccctatcatatcaaacatttgaacacctttataaaatattaaatataggcttaaaaataactaattatacaaattgcgactaatttgtgatacaaatcttttaagtctaattgctccatgatttgataatgtagcactacagtaaacattttctaatgatggattaattaggcttaataaatttgtctcacgatttactgacggattctgtaattagttttttttaatgtccaaacaccccatgcaacaccctatataaaactcaatgtgacacgctaaaactttataccccttatctaaacaccccttactcctactttatccttcctaaaataaataaacatttttttacaacagctaaacatccattacctacctttagaaaccaagccttcccaaaataaataaacatttttttttacaacagctaaacccaaggcaacagtacacacgctgatttaagtaaaagaaaaatagtacacacgctgatttaagttaaaaaaaacactacacacgctggggttagcagctaaccagcaagtctcatggcctgtttagatactctaaaatagtaaaacttttgatattttagagttctttttgtcattttagatctaaacactaacagcaaaaggtggcaatttgatatttggcatttgctagttcatggtagcaaattttgctaaaaagtgctctgggaccacaccctctctctttttctctctctttagtgctaaaatgacaactttaagatgcatttaaacactaactagtatttttgcaatgccaattttgttgtcaccaaaacttttgccatttgctatttcccattccaggccctcacaaaaaaaaaagggagctcctcccccaccaaagtttatatcatataacaacctagtagggagtatatctgttcacaacatcgacacaacctcaaacccagcctatagcttttaaggcatggccaacgcaagggatacgctcaagtagatggggcaacacccccccaaaaagctaattaatttcccacggtgcaagttgcttcatgtggtagtctcgttttttatttcagcccctagtgtttttcactttagtactcacaattttccaatttactagcaatgatgcacgtgcgttgcaatgggtaaaggtaattttaatcatgtatactggtggaacaaaaataaaggaatcataatcataataataatattaataaaataaaattgcagtgacctttggtcaaaaagataaaaatatataattaattttctattaattccattagcaaaaaataatataatacgaagtaggaaaagttattctcaaattttagcaattttcaaaaggcttaaatagagcaaactaattatataaatgaaaacaaatttaatcacctaaataaaacaattagacctgtaattgaaaatctgttgccagttcagttaaacatgagcctgcgggtgtgtgtgatatatatctctcactcgtatgtcgtgatcttttttttttgacatagaaaaaatgcacgtgcgttgcgatgggtaattaaaattataagaaatataaaaatattatatgattaaggtttagttttacatgatatgagctctttaagaaaatatatttataatgaaataaaaaagttcaactgaagtgacctaaagtgaacttgttttatacggagcgtacacgtggtccatgaggcggcccaatagtgtgggtggcctgggaatagaatcgggtaggaacaacttaaatgacataaagtgaacttattccgtgtgggcggcctgggaatggcgttcggcctgacacgagagaagctagagccgtccgatctgatagacggtcatcccgacctatataaaagttcaacagcccaaaccctaaccctaaaacatttcccctcccccctctctcaaaacaatgtggtggcggcccgacatccgacatccctgcgacggcggtggcggttcagcagcgacgacgacaccctccccttccggtgtcggcgttttcttggtgttcttgaatctgatcttgtattcttgtagtagtgttttctttagaatttaggtccaaatttgatacggtgtctcatttttttctttcttttctttttttattttttgccatcggagagggattaaagcggaatcgatcgcacgtgcgatggaatttttttatggatgaaaactataacccataagccatacaaatttttttaattaggaatatatagatattgaatcggactttcttttttttttcattttttcgcccttttttcgttactacggatgtcaaaaacgtctttaattttttttaccgcgtcacatataatcagattcgatttttttcgcccgatttctttttcacgcttttttttcacggatggacgatggaaatactttttaatttttaagtagtagatatagagatacagatagagatagagagagaaacggaaaacttttttcgcaacttttttttttggaatcggacaaaaaaaattttacgcttgttttttaccgcgtcgatggaatcggattcgatttgtttttttaccacgccatgtcacatataataggattcgattttctttggaatcggacatgtactttttttttttgacccttttctttaccgcgtcgacagagtcggattcatttaattttttttccttttttcacccttttttaccgtgtagaccgagtcagattcgtttctttttttttcctttttttcgtccctactttttttttgatcggactcattttttttcccttctttcgccctttttatcggacatgtttggtttttttttcacacggtttttttcgcccgcggatttttttcgtccgttttttttatcggacatagtttttttggtccggtttttttcgcacggtttttttctcccatggtttttttacagacgatggaagcaactcttattttttaagtaaaaaaaatagagatatagaagtttaaattttacgctaaacacctaaaaatacagaaattaatataaaatctctcctccctccccctttttcccaccaacaccccaaaatcccctctccccacgccgtcctacttcaccattcgagctccgccgagctcctccaccctcttccctctgctcgagctctcctcctcggcggcatcgcggcctctcctctcttcttccctccccgacggcgactctcctctccctctccatcttcttctcggggtaggagcaacaacgacgcggggcaacggcttggggtgaggcatctccccaacgcggctccttgcccgttcctcgcccaaaaacaacgataagctgatgaaactacctggccctctactgcgtgtcgcggcactctgccaaggtgtggtatcgatcaagctggcgtgaatattcgtctcaggaaggatgagaccacgctccatgctggagcgttggctatgacctcagaaagaatgttgtcggttttgtaaaccctgactaatgaccttagctcaaccagggcacccgtaccctctgcaagacactaagtagcctcacgaaagcacgacctcgactaaggcgaagtcacggactcttggcatggcgagccaaagcaactcgtggcatcggtgcaccgatcagtggaagaagacaaaacagatactgcccctagctagaggtacaagggaattttttttactagtactcatgctggcttcgtgttaaacaaagcacagctaaattgctaaggcgtcccgcgttcgtgcaccatatacatagatcgaccgatcgaagcagacaaccgtacgacgccgcgccgcgcgcggcgtgcacgcacgcacgcacgcacgcacatcgatacgatcacgcgaccaaaacacacactccatctcacatagtcacagccggcctcccacaacccgcacgaacacgtacacaacagcacacacacgaacagacacgatcgaacccgcggaggcaaatttcctcgtgacgacgcggcgacggacggcgcgcgcggaacacgcacgcacggcggagctatagcttagtcttggctcatcatgcggtggaagtcgtggaagtcgagctcgccgtcgccgtcgtcgtcgtaggcgcttatcatggcctcgcactcggcgacggacgcctcgtcgccgagctggctgagcacgcgctgcagcccgcgcggcgtgatcctcccggaccccttcaccgcctcgaacgccccgaacgcgcgccgcaggtcctcccgctcctcctcctccccgcccttccgctccacgatccgcacgaagtcctcgaacgccagcatcagcccgccaccgccgccgccgctctcgccgccgcccgccgcgccgtcgagccccatcgccgcggcggcggcggcggcggcgccggagtcgtcgcccatggacgcgaagaactcgcggagctcgtcgccggagatccgcccgtccatgtcgcggtcgaagtggccgaagatctcccggagctccgccaggcggtcgcgctccctcccccgggacgtccccgccgacgacgacgccgacgaggagaacgacctcgcgccgacgcccgtgggggactccggcggcgagacggccgtggccttgcactgcccgcacgccagcaggctgggcaggctcagcttgaagctccccttcggcgacaggcgcctcgacggcttggagacctcgacgcccgccattagcaagagagagctggatttatgcgaagctagctaagctttcacttacttaggattcccgagcttagctagtgaggaggcagcgtgagtgtgcgagcgtatatatagcggaggaaggcgcgagactcgcaatgcgaagtgctgtattttacggcggccggcagcacgcagcaggggaagtttcaccctactttttctgttttttcttgctttccgtcagaaggatcgaccgatccaatggcccatcagtccatgcatgtttggcgagttagtcaccaatggtcactagcaggtaacagccagaaaagtttgtttgttttccgctctttttaatgagaaatgactcgttctaaataacagaaagtgattgaggttccgaatgaagtgacaatcactagctagaaatcaaaccagaataaccatacgtagaagcataaatatgtgttctttctagaagtatcattatgtgttctttctttgagaaactagctgcgttgcaacggatatttttaaagataaaagtaaaagcaaaaattacaggtttatagtatagttagttaattaggcatataatttcatcttcacaagcaaccctacggaaatatactgctagatcacctctttttatctatttccacaagttatacgtacggtcggataatacaagattagaagcttataattcatctgtagatgaaaggtgaatttaaaggttttgtatgtaaccccttataatttcttgaattaataattctagagtcattgacatgttgtgggtaccttatgtttatgatagctagtttgagtttctggtgttggtgtagacttggacaccaccactaacatcatttaaaatagtatagatatgaaccatggcaagttattactaacttattaggttggaagttctcatggtgcatttcttggaagaccatttgcttcgtggggaactggtttcccccccccccccctaaagatatgtccttatgtttatttttgtttgtaactcccaaatacctataacaaaatcttaaaaatgataatattgatgcattaatgaactatcacccccaaaagaataacttaaaattttcttcataggatgagaggagaaacaatctacacattgagtagtagaagtattattcattcgttattttcttcctcgcaaacaaaagattttttttagcatgcagatcgaatttaaacttgcatattgataaagtgatactccctccgtttcatattataagacttcctagcattatccacattcatatagatgttaatgaatataaacacatatgtatgtctagattcattaatatatatatgaatatgggcaatgctagaaagtcttataatatgaaacggaggaaatacatcgcacaattatctatgttattattttctaaaccatataaatgacatacaaataatgtgtgtatatcccctcataaattaactctcccatttatgcagataatgaattgtttctgtggtttcggcatctccggtgggcagcatgtgttcctaacatttgcaacagagagtgcttagcatagtatgtggagttgtggacatttggagtacactaacatatatagatatacacgcgtaagataccaatcagacaaaaccacaaaatactgcgctcgagtgctggttcgatcagacacccctgaaacatcgaggacaccgctgtaagtggtgtgatgctcatgcaagacgcaagccgtgaatacaagaggaatcatgcatggatattacgtgattattcctcgtataactatccctctccaatacagagctgcaattcgaaaggcggccggcctcctataccaaattgctgccgtgattaattatttacttcctaaatctcgcaaaatcccaatcagatatcgccacaaggtcgatggcacaaagcagccgcccacgcgctcaatttacctgatcctcgcacgcatgcatgtacatgttgccgatcaaatggccacatgtttatcgcaattgaccatgcacgcatacgttggctgcgtttgttcccatctgtcaggtggatgcgcagcaatcacacaacactcgtacccaaccttttttttcgttttttctgaatgatcaatcgcaagttgcatgcgtcgccggggggcgggttcaccaccgatctcacaattctcacctgaaccactactcgcggcggccggaaaggcgagcagaggcccgagggagataacgtcaggtgttcggtcaggccgtgcaggaggaaggcgagaggaagcttcctccgctagcaaaagaggaggggagagacgactcatgggctcatggcacgggcaacgcccacaaaaaaattgcgatcccgcagctcgtagttgcatatactcttgcatagttgcatgcgtggttggttaaatttactggtgacgtgcatatagctttacgatgtgccggaagataaggttgtaaaatttgtcactgatcgcaccgtgataggtgctgctctagatatttactagtaccagtttatcacattaattatagagtgtatatatatagaccatgttgcacacttgcacttaattctttgacgttagtcatagagtatatgtatatatcgaacagtgtccattgacgtacgtttcttttctatttttgtattttgcggggaacacttgcacttaatttggcttctaagtaccactcgaggggtttagaaacgtcaatggacactgttcgcctaatcgaggggtttgaaaaaaagcgttgttcttgtcaatggacagtaccctagcctagatgcaaaactgcaaatgcacctatttagaaaaggtacttttaaaaaactgcttttgagtgaaaaacttcaaatctaatctttatatgtaagatatataaagattagaatgtagttacgacataactaggatgataagccgctctcgcggtttcacgggcgcgtgtgtcgcagttgcgcagacatggtgcgtatggctggtgtggacccggagtgatcacacagcatggcacatacgctggcactggacacacggacgtggccaagatgggacgttcctggcctggggttgatcgacgggggcgtcaatctctcttaaggggtgaggatgtaacatcccagcctagggcttaatagaattaatagaatactcatatcaacaagttgtaactttttttccggaagccaatctccaaagaactcccgggttaagcgtgcttggcctaaagcaatttgggatgggtgaccgaccggtaaattcttcccgggtgcacacgagtgaggacaaagaaaagacatgtgtaagcgggcccggcctgggagaggcgggacgttacaaaatggtatcagagccgactctcgcggtttcatgggcgcgtgagtcggtttcatgggcgcgtgtgtcgcagttgcgcaagcatggtgcgcatggctggtatagaccgggagtggttacacagcatggcacatgcgttggcactggacacatggacgtggccaagagaggacgaccgggagtggttacacagcatggcacatgcgctggcactggacacatggacgtggccaagagaggacgttcctggcctggggttgatcgatgggggcgtcgatctctcttaagggggcgagggtgtaacatcccggcctagggcttaatagaattaatagaatactcatactaacaagttgcaactttttttccggaagtcaatctccaaagaactccagggttaagcgtgcttggcctggagcaatttgggatgggtgaccgaccgggaaattcttcctggtgttcccgggtgcacaccaggctatcagatgtaagcgagcccgccctgggagagtccgttacagccgcgaaatctgcacggctaatattgttatattttttttcctcaaataatacgtatatttttaatttttattattaaaatatattaaaatagtaattttgtattaacttaaccaaactaaccaatatataatattaatattgtattgtatatacgtgatagttattaactatttttaatttttaatttagttatttctaaattgtatccatatatggacttttgtctactcttacaatatttcttactttttagttgctctctattatttataaattttattcctatatagattctaaacccttccgtcaatgatctttttttaagttatttctaaattgtatttctatatgagctctatactcttatttaatatttttttaattctaaatctcagttatttttaaactgtatattcctatataaactcttctcctaatatttcttatttttaaatcctaaattttagttatttctaaattgtattcctatatgatatgaactctagactcttctcctagtcttttttattttttattttgaattttagttttctctaaattaatgtttttaagtctggcttacaattagttttaaattcctctatggactctagaatcttcttataatattttgttatttttaattatgaatttccattatttctaattgtatttctatatgtactctaaacttatcattcaatattcgttattttttaattccgaatttcatttatttctaaattgtactcatatatggactctagactcctttttaaatattttttatgttttaatttcgaattttagttatttctaagttatatttttatatggattctaacttctacttttagtttccttattgtttaattctaaattttaattagctctagatagcatacctgaatggactctagtctcctcttacaatattctttttttttttaattttgaatttaggctattttaaaattttatttctatatgaactttaattttctcttagctctaaatcgtatacatgtatggactctagtctctttttctaatatttcttattttgttccgagtttaggtaatttttaaattatgtttctatatgaaatttattttttttctccgattaatatgagatttctatgccgtgagagcgaatgcggagtttttttatattactttaataagttagtgtagttacaatataactacacttacagtatagtacactatagtacaatgtacctacatgatgtataactagagtgtagatttgtggagtgtaaaactagtgctagcacagtgatgaggatggttcaatggagtgacagagcaagcgggattgatccccttagctcacgtcatccctgttaatttttttcccaatctatctatgcacgaatgtcaggatggatcaatggcccaaaaatcaaaagattttcccttcaaaaactgtcgtaagatgtatagcaattccgttcagaaaatactctttcgcattgtatcctggagggaaggcacgcactgaggctattcacagtgcacgtagatgtcattctctctcatgcagccagctcagagactcccctccacctaggcatagcttggagcctcgccaattttggctccccgttcttcgtcagaatcgcagctttggggcccacaagagaagaggtgaagaagagggagggaggggagaagcgtcgatgccgatgttgtcgtcctccccaatctgcgccggccgagactcaccggccgcgccgccccccgatccatgcctgccaccgagggaggaggccggacggggagaggaagcggcagtgcgccagatggggagcttcacccggtgcggtcgaagcttgggccacgccgccgcatcgtcgcctccaggcctgacgaggagagatggaggcgtggagcttggtgccgccaccactccgccgatgctcaaacgcctgccgccgccgccgctcgaccgccccgccccgctccggtcgccgcctcgctttctctgccactgcctcgctaccttcggctggtggggaatagatagaggagagatgaaaagtgagggtagacagtgggacccacttaaaggagtatgcactgtgtagcatgtagctaacaatattcctgggtgtttttgagcttagttggcatacgaaggctccataaaaactcaccgcgcactgctaatgcccttatgcacagcattggccttccgatcgaaaaatgtaccgcctctaggtagggataccgaggcgtttcgtgcgacgtttactcgtacgtcgtccaacttttgcccaacacacggggagaaaagtgctcatcagctttccagttaagttcggtctccgcgcgtgtctccctttggaaggtcgctctttcactcgtttgccggagcgcgcgcccgcatggcgagctgattcctgattgtgagagtttttcgtctccgcgcgcggctggcgcgtgtgctggcctttggtaagtttcggcgctcccctttttgccgggactactgagcatgggagctgagcctgggatggactactgagccgctggctctgaagggaacttgccttgttacctgttctgatgcttctcgcgctgggcgtggttaaagcggagctgcgcctgcaccggaacgacgttttgctttcgtgctgctggtccaaggggaagaaaaagttgtatgtccatcacgacgaaccaacatcgtgatttgttcggggaaaaaaaatctacctcccttacccgtaaaaaaagtccaccaccctttactgtagaacgagcatctgaatttcctcactccaccacaatatcaaacataatagcatataatagcatatcgtccaactattaaaaccgattcaataaaccttcccggatggttttgacaggggtttcatttgacgttacatttacatggcgatacaatcaaccaaaaaaaataaaggaaaatgaaagacaaccaaatgagggtggtaaacatgatggtagagctagggtacattcggcgatggcaacggtagcaatccaccagagagacacccacgcgagaataccgagtatattcctcgcatcgttgtgccagtcgtaggtccacaaccgtgcacatcaccgtgcggcagaaacgtctccacatcctccgacaagctttcaccgtgacaaatgttgcatgctagcatacacaagtcatgcctagtgatgagagagcaaagagtgtggtggaatgggacaacaagtgcagcacgagagtcgcatcaatgtaggtgaagcgacgcatgtgagtaaggctgagatgggcgctaacaccatgttcgcaacttctcgtctcaacagcaacaataaggtaggccctgagttggcctacttatctggtgtcgccagtagtgccagcgactcgagcactgccgccccatctccgtgttacctttgccacaaggtagtctgtgagggagagagagagaggaggaagaaatacgttatgtgaaacatgtatcttttatttttctaactggactaaaaaactgcccgtgcgttacaaagggaagaaaagacaagaaaattgagaagaagttgagaaagatttacattatttaattaactaaaatacaatttttctggaatactggggtatttctaactaggtaggtaaagtaagcgtgacaaataaaattgcatgctgatttaacttttgttaaattatccatgattaatgctatgttcttatgtgagtgttgggaaccctcacctccgacacgaaaaacggagaaatagattaatacgtgattaattaattattagcttaaaaaactttaaaaatgaattaatatgatttttaaattaacttttatatagattttttttgcaaaacacgtatcgtctagcagtttgaaaaagtgtgcgcgcggtaaacgagagagtgaggttggaaacatagacttaagaacacagcctaattacactctctgaatttttcttggaatttttagaggccaattgctaattctaataatacaaacaccatgttagtatttatttaaataaaaatctaaataaaaaccctcttttctatatgggccatttatagctcattttcctcctcaacccgcacaagagccagcccaccttcctcccttattctctcctccacctcagcccgtgagcacatgttcggcccagcaagcaaccgaatgtctaattggtctcccctgttctctctcacactgtcacgtggacccatcgcgacagtatcatccctaacctccgtccggactccctcgggtgcctgacgccgcctgaaactgcctcctctgtaaaatccagccgtacccttggagataatccaaacttaattgagaggtttctatcctcatctcctactctttccgttttctcaagaatcagagcaaatccgcttcgtatcgagctcgaaattgagttctatcctaaacaagcgaacctacagtttagtcatccgtttcgtttggaagaaaataatgtagtggatgatgacaacgatggacgaaaaatcgttccggaagccttacttatttttaattaggtataaatagattatcgtatcggataatatcactgtgtagagaaaaaaagataaattgaactggttttgacatgtaaggatacggcgtgtctagtttaggcaaaaaaaatgggactcctgattttgtgggtgaggaaggaaattcagacttggagtcatcactagctggagtcagcacaaggaggtaatatagcctttattctttgctccggagcctgccgcgttgcatgtgtttgggctagcaggccgctatgtgtttgggtcggtaaagagggaggcctacctgagtcaagagggccctagaagtggccggactccgaacagaatcgcggaatcattgccagtccgtgttgtgaacgatttcggactacgactccgtgtcgtaaccaaccaaggccctataaagccacgtcccccgaggcccatcgacgctatcgtgttcgcctcaatcgaaacgcgcaatcgccttcgaggcttcgatcgatcgttttgttgctcggcgcccccggagacgtacgtcttcctcccgagagcaagagagacgatcgttctacgcgccaatatcatcaagatgtcgtcggagcagcaggcgagcgccggccaaccggtcctctgtgccagtggctgcggcttctacgggaaccccgccaccctcgacatgtgctccgtctgctaccgccagcactgcctcctcaacggcgccacgatggcgacggggccctcctcttccgtggccgccgcgagcgccgctaccgtcgcgaccggcgcagttacgtctgattcctgctccgtgccttccgctgaggttaatggcgccgcattctcctccaagaacaaccctgagccggcgacggtagtagagaagaaggcgccggcgaaccggtgcgcgtcgtgcaagaagaaggtgggactgttggggttcgcatgccgatgcggggctacctactgcgggacgcaccgatacccggagaagcacgcctgcggcttcgacttcaagggcgccagccgcgacgccatagcccgcgccaacccgctcatcaagggcgagaagctgaccaacaagatctgatcgccgtctggtgcaaactagccatagatgcattttaaattgttaattcagcttcagtaggctcacaagtcaccactcccatgataacggtgtcgttgatccgtgtaatgaatcgccgtaccttgtcttatgcaattacatcagttaatttgtatctcttctctgacgatccatggtgtatcggtgtttgcttaggccatggtcgtacgttgatcgaggtcgcgaaacccggtcgtttctggcgtgcgcggtgcacccgacgccggttaccccagacgtacgctgtcgtgagctcatatctgaacactagacgagcaccaagctagtcaggttgtcacggccagatacagtggccttgtaatctgtacttgccgtaagtgaacatgtcgcgcagccatgtggtcgacggagtcgaacagatctgagtagctgaacattgaccaactttatctttattctgctctgctgtaaaacgatcatactacattcatacttaccgcagcccatgcacaattgcaatggaatcgtagcaaacaatgtgacacgcgtagcgttctattatatctgtagtatgtgtagttagaatcttttcgcttcaacttgcttcttgaatggttggcagctcaacaccccctccccacacctttatccgctcctctgctagcatggcctgccgtccaaaaacatttgaaaaaaaaattgaaactaagccgagacgatcagcttcgactagtcctttgatgaagcgagctcactgtacctctttctgccatttggttctgtagaggatgacaagcagaataacagtctgcaggattgttccgatcagcatccccacccaaatcccctgcattggttagtacacaacggttaccacatctccctgcaagaaaatcatcactgaaaaataaaagtttagaccgccggctttgtctgtcttactgttgcattaaggctcagcctgaagccaaaaacggctgcaataggcagaccaacgagatagtagcagccaatgtttacgaaggcaaccgatgactgccaccctgccccaatcgccacccctgcaatttgtgccatttaccaatggcacaacatagttgcatcaacaagtgtcaaatcctgaagcaatttgagcatatatttcacttgattatagaatggttctgtacctgatagcaccggctggatgctgttgaggaatatggtggctgcaagaagatagcccagttttgcagtctccctgacgagcacgtcgtcgtccgtgaaaagcctcggcagctgcttcctcgccacgagagcgaccagagtgaaaactagcccgacggcggccgacgtgaccacggcgacgatgaccgagaatttggctgctttcgggtggttcgcgccgagttcgtttgccacgcgaacactgacagaaaaaatgtgacaggcaaagcatgtgtgtgagctcagaaaattaccagtgagttgagtggaagcaacgcataggataagtgcgttacctcactgcagcgttaaagccaactgcaaccatcagtgtccagagctgatagttcatgctgtttacgacagagtaagttgaatcgtttaaacttaatgttcaatcgttgccaggtataaaaatatcagaacattgctaattgatgtactaaccatattgaaatcgcaccaacttgaatctctgggttcttcaggcaacccaccagaatcagcactgctgtgtaataccacatctccaagctgcaggcaccaattcatccatgaaaaaaatattttgctaattttcaccgtgaaatggaacttgaactgcatgtacaatgctacgaaccacagcataacggcggatgagagggagagcttgacgaagccgccgaggctggtgaatgctttccgcgagaagccgctccaggcctccgggaacgacccgccgacgaggtacgcgaactgcgccgcgttgagcagccaccaggacacgtcgccgacgagcgccgcgccgacgacgccgtggccgagcctggcgacgacgagccagttgagcagcgcgtgcgcggcgagcgcggcggcggagatggccgtcacggcccacacccggctctgcgcctggtagaacttctgcatggggaagttgacggcgtacgcgaacagctgcggcgcgcaccaccgcgcgtaccggccggccaccgacgagatggccgccgactgccggagcaggcgcagggccggggacgcgaggaggtagagcgggagcagcgcgagcgacgtggcgaggcagatgacccacgaccgctgcaggtagacgcccagcatccgcggctgcccggcccccaccgcctgcccgcacagcgtctccagcgcgctccccatgccaagctgatcaaaacgagcgcgacaggcgccatgaacaaaatgcctagcgatgatcgatcacatcaatactgaccgtcctggcgtgattttttaccaggaggccgaaggcgaggccctcgacgacgccgttgacgacggagacggcggcgagctcgaccttgccgatgtggccgacgaaggccgcggtgacgaacccgatgaggaactggaagatctccgtcagaatcaccggcccggcgatgcgccacaggttcccggactcgccccgccagttcttgcggtggccagcgccagccgcttccgtccccgccggcggcgccatttcgctcctcagccccgtgcgcgcgccaccctcagtacggttgtgtgtgtgtgtgtgtgcacacgacgacgcggtacacatatagagcagagacaagccacgcacagtgtaacgtagagcagacaagccaccggtcgtggtcgtacgacatctttgtagctgcgtgcgtgcactgtggatgcggttgcacggcggatcgatcagcatgctagctgaggtgtggggggggggagagcgtttagggtcgcgcaacgtggacgatggagtaggtggccgtggacttacagggcggatccagaaaatctgtttgttagtatcataacgtgtatatcgatatcatagtatgctaattatacttagaacataatgttatagtatatggataaccagttttattttaggttttaccgaaagtcgtcggtgtcgcctgacaccgatgtttatactgtagatccacccctgacttccagtggatagagctcctcctgagttccgacataagcccgtctaatccatttccccgtgcaacgctgttgcggccagccgatgtacaaccgtgccggtgtggcatactacgacactctgcagaggcgtatttagttagctcagtagctctagcttgcacacgtgctggtgacctggtgtgcctccgagaagtttatcaacccccagaaatcttctcctgaatgctgaatctgagttgactaggcagctaggccgcctgacgaacaacttatgggtctttaatatccacggtgtcctcgttgtcctgtcattttctagtttctctttatttgggatacggtgcttcacgtacagctctcaccgggtgttcgtctcgtttggcgctagacggctgaccagcgctactcagcgcgttaggcgtaccaggcattcttctatggccagcattcctttacttgtgctgatcttctctagcacgcaaagaatcctgccaaatgcaagttcttcctttgatttgcattccaacagtgctcctggacggctgatctcctccagaaacgtggcatcgatagtcactcggccttccccttttgcgcccaggatctcgagacggcgaaccacatcctcctcgaccacgtgttcgctcggcaaatctggctttgagtgttgtcgcctcctagctgggctgccctctctcccccgtggcagctggttccaggactggtggccgtcctccagggcctgcttacctgagcacctccgtgacagcttcgactccttggtgctcctggtctcttggcaactgtatgagcgaaactctagggttttcgactccgttctctcctcagtttttgtggttctggagtccatccattcggaatgccatatgtggtctttaactggcgtcgccgtttttgaggatttgttaggagtgtagcgtggcttggctccttcccgctgcttgaagtctgtttttagccaccgtagtttctctaagcttcagtttatttttcatttgctttttctcccttcccctaacataagccggtctggctgattgtgttgtgtaactaaaattctttttcttctaatatgacgtgatttttttgcgcgtatgtgaaaaaagagtaggcagctaggcctccgtggatatctggggcaatgcaaataaagtccgcttacactagcaaaggttctgaagatgatccaggtaatctggacactggagaagaaaggccgaattgtcgagggctgttcaaatccccaccggcgtaaaaacagatcccatttcgatatgcacagttgagaacaaaaaactgaagatattgggacgtggattttcatctctcaatgggacatcctctcatagtttgcatatcatctaaatagttataaaaaaattgaaaaaaatgacaacatagattaatacagaatatattactccacaagcatgcaagaccaaattcaacttctataaattgcaacaaaaataacaaattaaattgaaaatagttatttgtaactatatttgttatttttgttacaacttgtagaagttgaatttaaacttgcatatttatgaagtgatatatttcataaatttgcataaattttacaacaggcatcctattccttgggttaatttgatttggacctcttattactctgataaattaccacatgctattcgcccaagaggttccttttggtggaaggatgtgttgcaatttctagatattttcataagtctgtcaagttgtaaagtgggtgatgggaaaacttgtttgttctggagtgatttttggaatggtaaagtcaggtcagctgtttaccctagaattcactcttttgccctctctcacaaggactctgtaagcataacttctactaaaagcatagcacagctttttgctctgcctttatctgaacaagctttccaggaatatgaatccatgagtgaagcagaccccttaacttattatctggtgataaagatgtttgggcttatgtctgggggaatggactgttctcttcacagaaaatttatgcaataaatttcatgcatgttcaagcccctgggtacttaagttggatttggaaaagcaaatgttctatgaaagttaaggtgtttgcttggcttctcctaattgacagattaaacacttatgatatgctgcagagaaggcactaccctcctgaaaattctaatctagcatgtgtcctttgtccagctcaagcaagggaaacatctttccaccttttctttcaatgtcaattcagctcagattgttgggcgcaactgggaattgtctggaacctttctctcaattttgatgatatgctgctgcaggcaaagatctcatatagatccactcattttgttgaaaaaattctctatgctgcatggaacatttggaagcaacgaaatgctttcatttttcagaatgtaccaccttcggttgtttcctggaaagctctctttaagattgatctttcccttttagtctttagattaaaagtttttgagagacaagccttatctcagtggataaaccttttgtaaatattttgtattccttcttttaatttaatttattaactgtggaggcttcccctacagtgtttcccttaaaaaagggtgatatatttcatattaatctatgttgccaaaattttttatattttttatgactatttaggtggcatgctcgacacgaggaatatcccctgagcggtgaaatcactttcccgagatattgccactgaactaactcataagtccagtcccagtatttatattgccacagcccacaggtaagtcacagtaactttccggcccaaaagaaacggaccatatgaacaggtttttttttttttgagagagaccatgaactagacttgagttcagcttgctgagtggctgattcaacgccagatctcactgcaacaatcaagcttagtaagattactactagtccattaatccgaattagttggataatcccgagaaaaagaaacacggttggataaacatcaaactcagagctgagaggcctatggattatggagctccatgtacaaattattttggtgatggctacatggatctactattcagtatgccaacagccgaccaaaatatctgaaagcatccttaggagtctcgagatatttactccctctctccaataaaaaaaatcaaagtatttggtgatgtctggattcatatctagaatttattttttttatgaaacagaataagtatgttccaacatcatctatagtactcatgtttcaaacaaattttccatcaaatgaaactgagtgtataaatgcaaaattgatattactgttggacctttgatatgcccgagaaaatagccaacttttagggatgaatctgaactcatccctagaagttgctcttttttttttacagagcgagtacaggctagcaaaaaaaagtacaggtcaaattgctactgttttatggaactacaaatgtctaaattatactgcacagattctgcactcaatggatcaccagctaaaaaacaaggtaaaaaaaagataatcttagttgatttttttttgcattattgaatagtactgcaagttcgttttctgatcggggaagaatattacaagttacatacatcgccattaaggtacataaagttttattaccatcttggtttatctcagatcaccaaatgcaaagcaaggtagatattatggttatttggtgactcggattaaacaaactatgctgaaacagtaagaagtaagtattcagatattacttcaagaaattacttcaagttcatatagtacttgtatgggataaaataaggccatgtgcacataaagagaacagaaagtagaaaatgtccggtacaatattttaaattcagaaacaaattccaagtgctgatttcagatacaaccaatgatgtattgatgtatatgcacaatcaagaatccatatatgacacaaataatgcaagatattatccttgcgacagccacaggacaaggttggaatgcaaatgcattatgaaaagataacaaggattcaaacttcacttaaaaactacaaacaagacttgcaactgcacaagtaatatatcgagaagcacgacaacattatcagctaccactcattatcacagaatcctactagtaactactgaagcatcatctttgtactatctctccacactgatcaacccgtgggagctactacctaatattgacacaataaaaccgtttcatacaggctcatcaccgaggattggccatagctaactgcacacatctaaaacacaatcaagctggcaatcacaagaacaccaaccagaacaagcaataccttcaagaacacatcaacatgctggccctgcggtgcctggtgcgggaaaccatggccatgccagccatggaacgaatgtccatacccgtaaggaaacccagcggcaggtccatacgccgccgcctgcgggaacccatgaacctggaagctcagcaatgggaaaagccccccaatggccgccgagaaagtgtagttcccccagcgaccgccggccacaggggcgccggcgccgcccatgaaccacgggtcgtggtgcggcaaatggtcgtggtgatgatcaggctgggaagccgtcgccggccgctgcccggccggccggctggggatctggacgccggccaccgacctggagcggggatcggtggaggccttgccgcggccgtagagggggacgagcttctcctcctcgaggccggccttgcagacggggcactcgcgggagtgcgcgtggacgtggagccactcgtagaggcacggccagcagaagaggtggccgcagagggtgacgacggggtcctgggctagctccaggcagatgttgcactcgaagctgcccgagtccttggcgccgccgccgccatcgacggcggtcgccgacgactcaccgacgcggttctccatgagtccgaggtccgatctacaaaacgcgggaacgtaccaaccaactcatgagctcaagccatgaatccacgaaccgatcgacagaataggcgctcgatcgatcgtccactagtatccccaaatttaggaaatctcttttctacgcacgcagcaaaatctaccatgccagacgatttaattaattaattctcggttgcgtgaaacaacatcactctctttttgtctcttctacaagcaatcccgaacaggtaggatcgattcgttcagaaaacactcacccgtagattgaggaacagccacgcaccgtgtaaacgacgcggatctggaccggtcgatcaacagcaagcgacgaccgcgatcgagcacagcacaagtcaccctgtcgaaacgagccactattcacccaaatccacgcggagtactccggagatagcgtcgaccaagcgcccgcgcgcggtgcactcgccggccggcgcgcggcgagccggggagcagacgctggcagctaccggcggcgaatcggaggaggaagggttggggatcgtgggggaactcgagtggtggtggtggtggtggacgcctcggtcttcgagtggagcgagccttcgagtgaaacacacaaacgcgtggcgtggcgtggcgtggcgtggatgctgcgactgcgactgcgacggttgggaagcggacggctacgagcccgtctccgttcttcctactgcggggacgaaacagacggtcggacgggcgtggtcgtcccgtcccgcgtgggagcccctcggcccctcggggcaatggcaagtggcttgataagttgatagctgccgtccgatgtcccgaagcttcggccaaagagcattgatgagatacgtgccattgcagaaaagggaagacgactatggccgtgttagttccttttcaatttttttaattatacggttacatatttaaattattaaacgtggactaataacaaaacaaattataaattccacccgtaaactgcgagacgaatctattaagactaattaatccgttattagtaaatgtttactgtatcaccacattgtcaaatcatggtgtaattaagctcaaaagattcgtctcgcaatttacatgcaaactgtacaatttcatattcgtttccactacaagaagtggattaaattttggattttcgtggcacgtttttcaaacggctaaacggtgtgtttcgtgtaaaaactttttatatgaaagttgttctaaaatatcagattaatccatttttcaagtttataacaattaaaacttaattaatcacacgttattaccacctcgttttgcatgaaacacttaatcttcatcttcatcttcaggagattcaaacaccaccttaatgctccatgcatatgtgtagacatttgatgtgatggaatttttggaagtttgaatggaactaaacacaacctatttacgagaagagtttagaaagtatatgttcctttcgatttcataattctgaatagccaacactgtccctactcctaaatttctacttcgggctcagtttagttattgagatttcaaaaacaagttctccaaattaatcatttgggttaacatagtccttagacccacaaaatatgccttattagcatgccaagtcattctcgaatgcaactatataaatgaaatgaccattctacccttataaaccatatagaaagaaagaaaagaaaaaaatagaggaaaaaagaaaacaaccaaaatgaacaagcaacctgttagttcaagtcagtctccacacatgctcttacgtattaccaggaataccattacaataatctgtaagaatcatttttactttcaaaaagaacatgccaatcgaaataaaggaggatcaaagttgttgattccgtccgtcatcggtccctgcccgacttgagataaaattggatgacaaatcaaactcgtatttgaaggcctcattatttggcttatgcttattcttataagctaaatttaaactttagaacttaattttggattcgattttttggttttttattgtactttattttaccataatagtttttgagtcactaagaacatatatataaaatatttgcacacatatattattttatttagtaataaatgattcggataagcacatgaataaaacgaaacaatgggttgtgattatttatccaccgacacatatgtacaaattaaattggctttaccgttgcaacgcgcggatatcttttctagttatattagaaaatcaaggttaaatatatattttgtagactgtgtcattgtccaaaacatcaacaattatatatggaaccgggcggagtattgtaacgccccgattttcgttcgggtttaaaaattattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcataaagttcattaaactaatttaaataaaaagaaaacaaaataaacttccccttcctccctttcgggctcggcccaaaatcctctctccttcccctcccgcggcccggcttgcctccccttttggcgcaagtctgcttttcctccctcccggcctcccctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgcggtccaccccacgtcatccccttcctccaccatttcccccacttctcccctccaaaaccggcgccaaactgcccccactcacccacgtcgccggcgcccctttcccccttcaaatccgtcgccaaccggcctccccgtcgactctcgaggctataaaaacgatccccgggctcccctcctccgtttccccctctttcccaagcttccccatgcccgaaaccactccgccaccaccaacctccctccgccgccgccggttgccatctccggccggccacctccgccgccgtagccgtccccgcgccacgccgcttgcgccaccggcctcgcgacgcattggcgcacaccgtccgcaactccgtttccccaaaccacaatcaaaacaccgattccatcgctcacccgagcaccgccgccgtttcgccgccttcggcagcctcttgccgccgttcccgtccacctcaagccaggccgccaccaccact

SEQ ID NO: 64023 - DNA, 2294 bp, Oryza sativa
  unsure (1)..(2294): unsure at all n locations
cgcatcatcatttgtttgtttaatcaatcgatcttggctcgtggacgatactacatgcagtcacgtcgctgtacaccatgcctgttgtctatagctcgcatgctgtttaattgcatttaccagcacaattaattatcccgatggagtcaaccgatcgatcctttccttaattttctctctattttagtctagatgtgtgcatgcaaatattgggattttttgagagaaactaccctaactgggaagttgttcgtgctgaataattgggagtttttgatcgacttaattaggtactagagatgacagatgacttggtaatattattccacgtagtaatttacatttgcagtgcaacttgaagctagttgcatcataatcgatggatcgtgcatgcgtgcctgccgaagacggcagccagtcggcatcgatcgatcgatcatcaattgggttgaatttcagacagccagaggtcggtcaggtcagaattggatgagccacttgatcgatcacttactcatttctatgctttcagatcgatctagtgcactgcatacataaggcaggcatttttttttcagacagtggatgaagctaggaagaggtccgattaactgaaaaaataatgagtaataataagtatatactaattaactacaccattcattgtattgcaggcaaatgcagttcaacttgtgttccagcaaagatgcaagtgacagtatactactacagtaagcggcagcgcactagtcgtcgtcgttggcccaaagggtcaactagatagctatagggatactgtgattcaattgtctcctcttcagggttcagacgagctagctagtcggtgaaaggaccattgttctactgaaaataagcacacggatcaatagagacggcatatatcccttccttcaaacccgatcaacaagatccatgggatttttcatactttgtttcatttatcatttgttgcaaaagaaaatgatttgtagagattctgaatttaacttgtatgccatagtttacttgcaatacctaataattaaactaatcttttgatgcagatcatatgatgagcctaggcatttaaagatgcacaaaaatcgaaagtttgactaaaagcgtatctaaaacgacaattataccccatgaggagtgtgtttggcttcaaccaagaaaaggtaagcatgtgatttgtgggaatgttgggccctagcacaatatgtttaattccatagcaattaaacatctcgcaaagcacaaaaagatcagtagccgtttagaaaaacaaacagcgaatcaatcactagaaaaaaaaacattatcctcttgtttttcaactggaatgaaccaccaacaaagaaaaaacaacattggcaactatgctctcatgaatgaaattatagttgaaacttatgcactcctacagtcctactccctccgttaggtaataagttcatttttaattccttttatttattccaaaataaattcacttttaaattaatcaatactacatcgaaatttgtaaagtaaagaaataattacattaaaagtagagtagataaagtgatgaatagttacatcttggatttaataaagatgagtattttagtcttttgttgtattagcatgtgtgaaataaataaaaagtaaacttagacctgatttagttcctaactttttttcaaactttcctagacacgtaaacttttaatttttctgtcacatcgttttaatttcaatcaaattttaaattttagcgtgaactaaacacaccactattttggaaggtagcagtgaaaaacaaagattgcaatgcaaaattgcaacatgccaatatccagttgggcacatttgacctgtctctgacctgacaaccctccttgtccatcatcatcttcttcctcccctcccctcccctccctctcatcaagggcaaaggacaaaggcgcaagctttattagctggccgcaattcaactctccacagcagcagccgcctcccgatctgggcggccactagctcaaccaatcaagcaaccaagcaagcgagctcggagctcgtcgcctcgcccatggttaccctctggaagcggaaacccaagcccaatccggagccggaggagaaggagaaggaggaggagaaggatcatcggatgtgcaagaccaagagctccgtcgccaccgccttcatggccgncttcgccttcaccggcaccaacccaagaaagcatcagcatcagcatcagcggtcggcttgcgccacggcaacccagtacttcaccaccttct

SEQ ID NO: 64024 - DNA, 16572 bp, Oryza sativa
cagttaggtcttcgtcagttccagcatcaggaggatcatcagcatcttcttcgctaccaaaaactgaataatcatcctccataagctgaaaagtcagggtctttgttaggtcgaatttatggcatcaccaatctactcaaaccagtgttaaggcagtgttgtatcacatgtaattaataataaaacattcgtgcgaatatagacgagcatctaatgctagctcgtccaatttttgcactatatgctggaatatcaaatgcaaatgatgaaacaaacatatgtaaggattgaatagatccatgtctgcgatggcagcatgtttctcctatcatactgtaaacacaccaatgcatacctcttttgaagggcaatctgacacctttggtgaactgcagcatgaggaataatatctgccgcccgtttcaatgccatcagctctcaagtcatctacacttcctgtatggctggtgccacctgtgtcactcatccatgcactgatcccgaaagatccgaactggagattgactggctccgccttcccaaatgtatcatacatgggattttttgttgatttgtcactgcttgtaccatcgagacttccattgccattgtttttatccacatgccaagctttggtgacactaccgtcagtattaaggatagccatcaaatttcttgaagatccctgtctttgtatcaactgaaacattcccttggaacccagtgagttagcagcacgctggttcctgtattcctcattcactacagctacagtgtttgtgttgaggtcatacaactgctccccagcttctcgcctgcgaagacagctgaaaaccgtggcgtgtatggccgccacactctggtcaacattagtattgttaatcttgggcaccagatgcttgtctgcacggttacaaaggtagtcctggattgctctgatgttccggatgtatttgatatatctgttcttcgctgggtctagtgtcatgtactttgcacgtacagcgaatcgctccatgtgtttctcctcattcgcaatgtataccataaatggtattatggaagggtgtttcttcattagccccatctgttggaaaatgaaaatagaaaaggctacatcagttctctagtatgcaacaaagtataagtaattgatgcaaatatctaactagtacgcaacgcaccacaaaattgaggcttagatgaactccctcaacaattacagattgtttctgctcctcccaggacgtaattaatctgtccaggctgtctattaccatctcgctttgcgccttgaacccttctattgccatttgcttgctgccgatcaactccgttctaggaggcaattcggaggatccatgatgagctttatcatctgaagtgtcgtctctgccttcattggtattaggatgagaaacaatgtcaagcttctgtgccttccgttttgcctttgcctgagcaactgcaacagggtctaagcattcgcctgcatgataggttgatgcatagagaagaggattttgcttctcatccgtaaagcctctcatcatatggcgtatggaatcagtagaaactactgtcgtgatacccaatctactaccctgagaaaaacagacagaccatatcaagtattaatcaagacccagaatcattcattgttcggtaagcgatacaatcttctgaaagcaatgaggtaattgataggtctagaaaggattttttttttcaagtggattttgttctacagacgttttgcattatactttaacatgtaacaaactactactatgttgctggtacagtagagcattcactcatccggaattgtatggttcgcgtaagtgataaacataccaacaaagatgatagcgtagatttgccgcatccgctagtcccacataagagtactgtcactgattcctttctctccttaattctgaacagaacaattggaaaatgcacagttgcacaaaaccattgttatttcaatgcattcaggtagctttccattggctgtaatgaactgatgattggtaactcattgtaacttctgaatttataaatgcagaaacaaggaaaaacatgttacctgcaagcaagaagaaagtcagccttctggtttggccccacatacttgtatgaagagagggcatcacatacaacacttaggaacttctccctagaaacaacgatggttgtttgggtcttgtataactcgaagggtatgctactaagagttgcttccaaaattttgggcttcagcatctcaacatcttttacaagggaaggggcattttcttcattatctgcagtatctgatttggatgcatccaagaattcactcctcatcacattgaacaccctcttgctaatctgatgatgccaaagaaagatgaaaaagaaacttcttatcttcacaagtcaagagagaaataaaaaaggacactttgtgcagtctgatctacagaagtaggcatcagcaattagtttcttttgcagctagccaaattgtgccttcagagaaaggaaaaagatgtcaaacagccatgaccaagtcagggaagaacaacgcataccgagtgggaacccatgaccaactcaagtcaattgctagatactttctagaatggcaacccatcaaactacaggcccaaggcaaaaagatcaagcaaggcaaacaggtctacatcatacagcatggtgttgtctttgtcgatagaacataataataccaagaaaggtacagtaattctcatcagctaggcaacagtttgcatggcagtatatctctgacaatgactcgtcacaaacaagtatatttccgaaaggacaagttcagtatgcaacaagaacatatcttgaaagatatgctgggtttttggacataaaaattgcgcggaatcagaaccaagtgaggcgctgggtgctcgaatttgacaaaggttccggtttcccctgcaaagaacgccctcgcgcaaaaagatatcgaaaatgatgtgagagagtttgatcaaatcaacagcagtgtgtgtaaagacctgacttgagagagtctggatgtgagctaagaacaaatctgcacatcaatcactaaaacccgtcacctttctttgtcaagatcatccatccccccccccaaaaaaaaaaaacatacaacatccagatactatactcggcatgcaattctatcaattaaaccaagaacaagcaagcaattcacagaaaggagcaaaaggatctatcacatcagcacgtgcaaaccatacacaacgctggatacgagaagcagcaaaatttccagtcgaatcgaagcggaagaatcacgagagagccaatcagatcgccaccagttggatcggggccagattaggcagaaattaagcgggagagagagagagagagagagcaggcacagtttttccattgttgggatcaagatgaacaagaagatagaaagatagataggtattataccttgaaggcatggcgagccttgcatcccatgagttggagggtgccctgaagcacggggcgcgtgtagcggaaggcgcggcgagcggcggcgtctgagacggcaatgtagaggagcttgggcggcggcggcggcggcggcgcctcctccgccatgtcgtcccctacctgcaaaatcaagaatcaagaagaggcctcccgcggcggcggatcaaagcaaggcaagaagcggcagcggcggtggcaaacctcgtgctcgtggggatgaggaggaggaggaggagaagggggttttgaggaggcgcattgcggcggcatgggcatggcgatggcggtgcgcgggcggcggcaggtgtcacgacgtccacgcagcgcacgcccatggcgtacacatggcctcacccctctgccgctctcggcgtcctcttctacccttcttcttcttcttcttcttctctctcttgtttctctctctatctgtgcttgctttctctctctctctctcttgtcttggtttgattaaccttcttcctcttgggtcttcgcttttggatttgtttttcgcctaattttctcctaattttaagggggggtcattaaatctagtggagttgtgtgtgtgtcctaccttattcttcttctacctcttctcttctcttcttctttgttccgcttttatagtgttctgttctcccttccttgttttggattctttgcttccttgcatcaatcaaatgcttccttccttgcatgtgtcgatgcctaatgtgtgtgtgctccaccctttggattagatataacatgcaattcgagctcaaatatattacttttatgtatccactctttttttaaaaaaaagaaagctttacagattgaattgtactattgccctgtttattttagctaataattattacgagcacgttttacaagccgttaattagtgcgatttttatattaaaaaactattgaacacttttttgggctattttttcaaatttttaatatttatttcgattgtttatggccttaagtaattgtcatgaaattagaatacgtatgtcaaacggcgtaggggaaaaaaaggaatatatgcaggtttcactttttttggtgaaagtagccggtcaaaaacgtactctctctctctctttgtttgacaaaatgttaatgcaccatgttatgtatggcattacaatgtcaattctacgacggtgcaaggatttgaccgtgcaatgcttgttccaatggtcctctagcttccttgatgatactagctgtttttgctaggcttttctacaagggaatccaagaaagtctttagcttaattagcctcgtctattcttctcttcttagttgttgttaatattaaacagcaatgttaacagttggtcaatgtctttggtgtataggacacaccttggctcgttgttcttgattgctccaattaatagcacaagatatatagtaatactaagagttaagtaaaaaaaaaaagtctctggatgaagaagcggttgcagctgcacaacgtgatgaggagcactcttgtgttaatccaaagacgtggacaagacaaatcttttggatttgtttatctggcgctacggtttctattactgccattcaattgtttgttagtgccactactactccagttagcgtacacactgagtcatggatgatgtgtaatcagcttctgattgctagcagtggtattccagatttttctttaaaaaatggcatctctatatgttcaattgctcaattcaaaattttcacgtctgtttgaaaaacaaaatcatttggcaaatatctagatataccgattcattcttgaattagcttagaggggtatagtgtgggtgcatgtatatgaacaggtgtgtgtgtcagtgtttcgtaatttttttttttttgcaaaattggaaaaaaaaacctttccaaatattcttttaaaaattgaaaccttagatttttttttctatatgcatcattcgttttatagtaatagatcatatcaaatttataaggtttgtagtctcacaattttatttcattgaatttttcgtataaactagtgtctctgaaaataaaggaaacaagggggaaaaaaaggaaagagagagaaaggagagcgggtcgcggggggtgcagaccgcgtccgagcccagtgcgcgccaaaaaaaaggcgatcaacggtcgccgcggcgcgccgcgttgggtgggcccacccaccttcgtctccgttggttagtttactgtcttgctcttcttccccagcttagcttagcttagcttagattagctcgccatgaatcaccttttttcttcactcatcagaatatcaggccagcaaaacaaaaccaaaaacttgatacgcaattagtcctttatcagctgatcgaaaagacgaaaccaaagagctaggataggagtactggtagacagtagacggtggacgaagaatccaactctctctctctctctctctctctctctgcgtctttctttgttttctttccttctttcttttcttaaaaaaaactaaaagaaaaattatactacctgaaatccaactgcttttgctagctaatgtgtacgcgaatattgggaggattgataaaattgtgtactgtcagattctctgatttatctgatccagcaacgaaggagattaagcaaagcaactatcaataacatacttcttctcctagatggatggattgtatatatgctctctcctttttttttcggcaatcagttggctttaatttttgctcttctgctataagaataagaatactattcttccttcataaccttcgtttcagactttcaggattattaaaaaaaaaagaggattctgggaggaaattaaagtgatcgtatgcaacagtacaaattttacacgtgtgcggtgcggttgccgccatttcttttgacattctccgttcttcttcttgttcattcatgtcaggctcgacttcctacagcagcatcgtgagatgagcaggattcctcctgtttaatgctttgcgttagccagaatctcttttttttttctttgtttcctttcttcaaaaatcaaagcaaaataagaagacccaatgaaaggaaatccagagagatattaagtaattatagcaagcaatggcacaaatgtatgtgtaattgtgtttgccgcaaagggtcaggcctgaatcctgaagaccggagccaaagaaaagggggcttttaactatttgccactcttacgaatggtgcttaatgatttgtcactaggcccacatatcattgacagggtgtgtggcaaatatttaattgccatgtcacaagagtggtaaatagttaaatttcccaaagaaaggagcagagatggttaagcaacttgtaagccgaactgtgaagaaaccatggttatgcaaattctcgttaaccatagatatccatggatataaaatctttgtttttatggtgatatttttaagtagttttcttgcttttagttaagctgtgattttgttatttggagtcgttcgtcttgcatcatctataataaattgtttgtaatttttttgaagtaaagattagaatgaattcttttattaaagaaaaaaagtatataataaattgattgtaattttttgaagtaaagattagaatgaattctattattaaagaaaaaaaaagtagagcagagatatacaaagactagtaggatggtcggtctacaagagcggtgacggtgcctgaactgactgaccgaccatttcaacattcaaactgcctgcttcacacgttcatttattcagaaatcaattatcaataggaagattatattacagataggctaacatgttcatctgtgattggataagagtagtacgtaacccttgaccatgcagttcaacattgtactactcctctacctcctagtccttgccgacctctctacagaagagcagccccttcagaaaacgaaaggttgttcttttcttttcagatgagaaaacaaagagtttggactttggagtaatagcttgatctttttttctcctctcttgtctatctcagatgggtacagagaccttattagttgtgatcacactgtgctggtagagcatatatcacctgctgctacagttaagggagcaacaaatgttcagaatttcagaacaggaaatcaacttgagttcaaacacagggaatgacaacttgggggtgtttagatccaccaccggcaaaaaatttttgccccgttatatcgaacgtaacacatgtatggagcattaaatattaacgaaaaaataactaattatacagtttgtgtgtaaattacgagacgaatcttttaaacctaattacactatgatttgataatgttgtgctacagtaaacatttggaaagggatgccatactgtgccatatgagctttgggcccaatagtaaacaaatgggcctccattattgaatactcctctcgtagtctcatctcatgtcagttgatgctgctccatgaacaaactgtaggagtatgtcaattatcattatcattattggtattatatggtggcattcgttccgaatgaataattgtagcctcattccggcaaaatttttgagaaataataatacaggtgaggtgattgataattgattcagggaatgcaatgcagtgcagtgcagctcagcagcagctatatacgggaccggaccggactaagacgaaattattccttccatggattccatatttccatgtatcttctatatcatttggagatatataatcatcaccacaatgtcctcctcctactatcagatgtccatgattgtcatcagaccaacaagacaatgagcaccagctttctttctgggtcatcttgatcaacctgggtcatcttgatcaaggaagaaaagctttgcagcccaggcatcaatggtggtgatggtggtggttgtgagagaacggccaccatctcctcttcctcgtcgtctgcgacctcggcgcatctgatgtacaaaaagaatcaagaaacaacagcagcttcagattgattcttgaggcgaacaagacagcagcagcttgtgtaatggtggttgcatacgctggcgacgaagaccggacatgcattgcatcgtatgccaatggcaggcagggcctactcaccgttctgcggatatatggagttgtagtgaacctccgcccaaaagctcaacagcaccactgcaatcaatcaagtcaaatggggagcatcagatcaagccaaacctgtcatcatctatgatctatccactatgatcacttgccatgtgcatattagtacctttgttggacttctgaacctttggttggatctcaatgtagcacgtatccttgaacgatgtcatcacgaaaatcttaactccatactgcagcagattgtagcgttacattagaacggctttggaaatagaaaagactagtctttgtcagctctgatttgtaatgccatgaatgagacagcagggagagagatttgtataaacaccttgtcagcagcagcctgtagagtcacatggtcaccccattcaccatttctgttagtttatgcactaaaacatctgttaggcaagcattcacatgcacttggtttgtattaacaacaaatgattgaattgctgtggaacatactgtgatactttctccaagtaatcgtcatatgccatggggacatatccatcgtaggcatcacggttacttttaagctgggagacggatggttcatcagaaggaagagagatggaaggatgcaaaataaagcctgaaactagggatcctggagcaaagattaatgcagatatttacctggctcataatctgctgcctcacaaactcatggtgatcgggactttgatacagttgatctgatagtgcccgaaactggggaggttgaggaaacacaatcagcatcaattgatacgtctttcacaacgcatgtttaacagcagtaatgaaactttatactaatattcaagcacatgaactaccccaaccgctgatatggtaatgctaaaacttcactattaacactataggataaccatgtgccaaagcagagggggtaaaggaaagatatttttaggggaaaaatggtttaatagggaaaagagccaagcatcatggtgaggttgttagttggtactaacctgacagttgccatctcctttcaccttgtgctcaactagttcatacaacctcaacctacaagattacataaatacaaatttaaaaactcaacatagatacagcatgtatagtaaaaaaaaagttaaggaaaaactgaatcatatgttagtaacttggcccatcacagaaagcgcaattctttcagaggcatttgtaacacaaacagggtatgataaggtgtgaggcttgcatatataacacaaaagcagtatatcacttagaactgaaactaagttgacctttctgtcagcctttcatggtccatggtagcttcatcgactgaagggatctctccattaattttaggaacatgctggacaaggcagaaacaagtactttaaccaaatgtgagaatgtagagagagacgccaaactaattcacagtaggttcatttccatctgatttctgaacaattattggaaaagaaaaggacagtagctctactgctatgcaacagtataacactgtgggataatactagtttaaagcaataactagcatggttttagttatttgagaagttctgaacttcagataactgttgtgccttgaaattatgctgatactatgcactttgtgcatttatgttttctcaggatacacacaacatgggcaagcaataacatatggcaaccacaatgacacaaggaattcagtatacatggcttgaaagcaaaactcaatccacaaaacttggacaaaaacagaccaaagaatatccaaatttaattgttctttcaatgtacctaaagactcatggaagcatttggtgtcacatccgttatttaagtccaatggcatttaaaggaagtggtccaattgacaacgatataaagcgatactccctctcaatgagattttagccatggattaataaacatataaaggtgttttgtaaatatattagctactatcgaccctgcttagtagctactaataacttaataataaagcaactgcccatgtttcatttggtgaattgaacagatgttaggtccttcctagtttcctttgaagcaaaacttcctatcttctggtggttcctgatgcagatcaaaaatcataacaacactacttattaacctggcttcaaagggtcaatagacttacgggaactggcaccatggggtaaaacctctttcctacttcttcatccattgggaaactgtcgtcagtgtctgggcatgaattggaactagtcggctctatatagactgtgtcatggtcatgctcaccagcatttcctgcaccacaccaaaagcattagggggaaaggcagaaggaacaaatattttgcgagtcaaattacagatattttcactaccaggatggtagatgcctactgatgggttgtacaaatcatatgtcagtgcagaagaatgcaagtgcgtctcatccagatgtgatgcatctgcagaaccaaaatcatatacatgaggaacactatctcatttttcatagtttttttctgtaaatacatgcatgtcattccacaaaactacctctagcataatggaggtcacaatagttgccatcaccgtaaccatgaggaggtccatagtacccgataggagcaaaagggtcacggaaaaggtcataaccccagtggaaattttgatctttctcacacatgttcatccgttgaaatcaagctctgtcaaaaacactcccctggcaagaagattacgatttaagcgtcagggtattaacaccagatagagagagcaaaaaaaaaaaggctgatattctcggtttcatcaaagttgagctctggtgactggtgagacttgacagaaatgcgtcatttcatcatcacattaaatgtgcgatgataagaatggcagattgcagacagctaacgaatcattacacagtcctccagggaccacggtggaattattagatactctagcgcgtcctgtgtatcactccaagcaaccaaatcagcaacctaatactaataagcaagaacaaaacatttttcgttcgctgcacactgactgaaagggtccaatatcgttatccccaccacaccaacaaactaaaggttgcaacggtctaacaattcagtccaagccaatccaatacttttctttagcaaacttaaaatagcctactgctttgtaactacatctgatatgtgcgtttaaccttttgatacgaacaattaagctagtattaattaaaaaataactatacctgtatctaggtatattgcttttccgcacagctattgtctcaaggagaaccaatgatgaaaaagttgcaaaagtattataatccaacaagcttttcccaatcgaagacaaacaaagaaacaaacacgcggttttgacctaaagtgtagcttcaacgatcatgaaccaaactgctgctaccttaacatgcaagattgcagctttcttcctttcggttcatggacctaatcatttccaataaagaaaggggaaaaacataaaaaaaaaaaagcaaccctttttgttgcaccactgccagttcataagcttacaaaatcaccagacagcgcgataatccggcctagaaactcccccccctccccccccccccaaaaaaaaaacgcaatatgaaaagagatgataaccaaaacaaaaaaaatcagtacacgaacatctcaagatcacacaaagtttttccctcctgcaaccgcatcgatcagcaaagctatgggagtaaataaacttaaattagaaaaaaaataagaggaatattcgaggaaaggactaaccgcgtgtgctccacctacgacgaaattcctcgcgtccgtgaggggattctgcagtcgaaaaaaattggatcctttcgacggcgagccctgcgattccccggaatacgatcctgagcgcggataggagttggggacgcgagggtagaagagggatcgagaggtcgaggaaaaaccggagcagattacgtcgccgcggcagatccacggccactctacgagtccacaccacacggggcagaactcaccgctcggctcgccgccggcgaggcacgtccgcggcggaggagcggcggcggtggtggatgacaacgccgatgagcggcagcggcggcggcgagggatcgttcgggaggaggcgggcaaccacccggccgcatgaaatcgacgcgcgaaggagtcgagagcagccagccaccggagaattcgtggtgggattgacggcggcgagagagagagagattgctgcgtgcaagaagcgcggcgagagggagaagaagaagatgagacgggcaaaaaaaactgcttcttttttcttgtgttcttgagttttttttttttttttgaggtggcatatgctcttgtgtttatagcgtggtgcgtgtgtgttttgtggataggaccttgaaattttgttgtttgtttgtgggggttggagtgaacaagatggccttctcctcttgtgtggcggcaaggacgacggctctttgaaatttttttggttgttttatttatgacattttgttgaccttttgtttgaatttgatgagaaaaaattgacctaggaattaggtaggagtatgccagaattgattttaaagactggtgattaataaaatgaattggtttttaatactacgtctcagacagtgtgctcgtttgattaaataaagtcgtcatgtaatttgaccggtttttttctatgttgttctttttctaccttttttgtcgagttgtgcagagttcattgtaggttttagaagctaacttattatagtgatttaaaatggatacatattgataaaatatggttcacctttcttcgtagccacatgattttgccatgtttgacatggaaaatataaggtcttttttaatccaaataaaagagttgttgtataagttatgtatgttttcaatttttttgttaaattgtgctaagttcattgcaagtttttaaaagctaacttcgtatgtgctagtatttaaaattgataaatattgagaaaaatatggtttatctttcttcgtggccacttgctttgtcgatgttgacatttgtagcatggcaaacatatggcccataacaacaatagtaccactagctataactaacataatagaccgcactgtgttggaggaatggaaggactgaaacatagatatcgataatattgtgataacacaggctttctgcgtaatgggttaggcaaaaaagaactcgtgtctcaagagtttccttttgtagacaatgaattgattcaatttagagaaaacaaggaaattggtgataaaactctactacagtttgttcaaaatgcactagtcataatcccttgagaatattctagtaccctatttctaatagaagaggtacctactgaaaatcgctccaacaaatccgcttaagaaaaattacaaagttttgaactcagaggtttttccaagggatgcatgttgtttcaacctctcaccaaaacagacaagaggtatatcactgaaaattaatacccagccatatgggtatatgcagtgcgcgaatacgtttataccccacccaattagaataagaggaaataaaacataaatggagaaagttctcgtgataagatcagccaatagaagaaaaaagtctctaatttttcaaaccattctaagcatgtgaaaggtcaatagcctaaaaataaaaaaacctctactttgtgcaagtgataagagagaatatgaaagattttcctatttttcttgattttcttaagatttttttaacctgaccatgaatagacttatatatctcgatatatacatatataatgtatattatagacttatgtatgttttcaatttttttttgttaaattgtgctaagctcattgcaagttttaaaatatatttttgtatgtgctagtatttaaaattgataaatattgagaaaagatggtttatctttcttcgtggccacatgctttgtcgatgttgacatttgtagcatggcaaaacatgacccataacagcaatggtagctataactaagataatagaccacaatgcgttggaggaatggaagaattaaaacatggatatcaataatatcgtgataacacaggctttttgtgtaatgggttaggcaaaaaaaagaaaacaagtgcatcaagagtttccttttgtaaacatattgttagatatgtatgaattggttgaattttagagaaagagaatatagcttagaattgatatcaacctaaacctaactaggctcaggattggtctgataacccgcaaagactcaataatacctgcactattatttcctccactctcaataaatactcctaagtaattacgagttgtatggttatatataagacgttacacatttcgatgatataacatacttgcaagtaatttcagtaaaacaagaccagcatccaaggtataaacttaaacatcgtcattatctacttcaataacggagggagcactactgccatgatcaagctaaaacgagtacaactaactaagtggtggtgattaggaaaagcactgcattgcgttggaattttttttttaaaaaaaatcactgtactgactgggtgatgaatcacgctgcatttccattttctccatttgggtggcagtgagcccatgaagtaaaaaaagtaaatatggttaattagaagaaaacagaggggcaaggtgaaaagcggcagcgcggcgcaccgtcgaccagtggatcgcgtcagcgggtagtggggccccacgtgagcagtgggggcgttgacgtcagcggtacgcgagtgaaggggaggggggggctcgcgttccgagggaatctgagcgctctgttgggcatctgacggctgtcagggggcggtgggtcccacggggggatcgtacccccggatgcgtccaactggagggctttggctttcagtttcagaggggtctgggcgaattgcgtgagtccaaacctctctctctctcttgtttttgtccttcaacatcaaccccaatttactcatagaatttctcgtttttttaatctatactatgtactgtactcctactaccgctatatgaagtggtatatatttattattttattttaatggtgacagagaggatacacgtggacacattactatacacgtaaaccacaaagatttaccatttccatcctataaaaaacctaatacttgtgtgtccaggttcaatgctagaaataatttttttaagggcagagaagtatgactatcgtctatcacaagtgcacgacctgtgtatagatgaagagtaggatcaaatcatgaaccttactaaagtataaaagtaaagcttccgttggctgcgtggttaggggtgtttgattatcggtcacaatttatcacgtttaaatttagatatgtttaatcaacttgacaactgttttgttgtagccacaaaccatataaattaagttccacacatcaaggataaaaaaaagtgtagcttgctaattaaggtatggccaaaaatttgattgtcttaacttagataaacatagcattatttatccgcaaatgatgataaagtatgggcaaaccacttcctctgagtctcatttgtacctttatcttattacttttccttttttattcatttcatttgtttgattattttctagtattctttttcgattatggaatatatggaaaacatatgtgcaccgtctgctagtatccatcaaaacactacccgtgttaccgtgtaatatctttttaacacgcttaaaaaagctatagaggatgaataagagggataaattcgtgaaactcactaagttctcgagtgaaagtaaatataccttatgtgtttggacctcatacaaagatcgtgttttttccacgtctaaaatactttt

SEQ ID NO: 64025 - DNA, 1107 bp, Oryza sativa
gattttgtatctcgacgacaaagtgaaggaccttgggtgtactttttccttatatttgctcgtgaattgggccacatgtgaaccgtccgatcaatctatcgttcatgtgccgcgggggattaggtgggccatcgaagcaaggccttagatgggccatcctaacctgtggcccagcaatcatcatccccttctccctctctctctctctctcaaaaaaaacaaaagaaaagaaaagaaaaacatccctttctccttcctccgatccttgtcccccaccactcttcccggcgagagctccggttaatgcggcggtttgcgtccgccgccgcttttcgcctccgtctacagatgggtaagctgtcgtttcctcctgacatatgcgagagtgcgtgaccaagcctcgccgtcgcccgtaccgccatggcgcatctgttagagcaggttagcaaactagtcagctataaacatattttaaaaagataaaaaaagagagaagagcagcgggcagcacaaacttcaagacgtaacgtgtgtatgacatgtgagaccagatattaatagtatagtaagtaactattgtatgaattggctattgtattggttatagatgatttaaagttagtagtgggctatactattaaacttgctcttattgctactgtgtcttcaatggtggcgctgacggtcggcaaagatccggtcgaatctaccaagcccgatgccacatgtatcgtcttctcaagttcctcacaccacctccgtctctcccacctccgtctctcacattattagtactggtactaagagcagtaagagcggatacaatagcagactataagccaactataaatatattttaaagagataaaaggaagagagaaaagagcagctgcagcacggactccgagacgtaatgtgtgtatgacagtcacggagctcgtggctcctcaccgggagaccgcgcagacccccctttgccagttcggccgggggcttagggtgagatctcaagctctctctgtatgtggaaagatcgcgtgcccggaagaaacgcgagacacagacgatgtatacaggttcgggccgctgggaagcgtaataccctac

SEQ ID NO: 64026 - DNA, 618 bp, Oryza sativa
gtgcctgcaggtcgactctagaggatccccaggcttcccagatagtatcaaggaagtgaaacttaccagatcatggcatctagagaatgggatgccagagtcctcacccatcatgactgcttaaataagcaccagctttctgttggtgaactcctcttccctacctctccctaattcctgtttccccgcacatggttacatttcttccctgctttagaaacccctaatggtagtcagttagggaagtgaatttgagactgatctcccatatcctcaacagcagcacctgattaaagccttcttccctggcaatacttgttgtctcagtgattggctttctgtggagtgaacagcaggacttagaccaaacctctggcattttggtaataaaatgatgctgtgcaactttcaaggatagatcacaaaaaatgatgcaacttctacgtggatccctgaaactctggactgcatgtgagaagccccactctcctgaggctgccctgctgtggaggaagccaggtcacacagagggggcacatggaggcaatccagcctacagacctgctcaggtcctagctgacagccaacatcaccctctaaccatgctgatgaacatgc

SEQ ID NO: 64027 - DNA, 705 bp, Oryza sativa
caacaaacattctagatatatacaggcaacaaagcgtcaaagcaaacggcttttgatctatgtactcgggcctcgtttcagaaatgcaggaagccatagctagctgaaaccatttctttctctcttctgttttttatccttgttctcgttgtgacagatggtaacctgacggctacattgcacgggacacccgccagcgccaatatttagttttgtcgttcgtgcagcacgtaggctgataaacctgtaaccgggattactctgggctaaaatatatagtgatatgatcaaaggacatgaagtagagcattagctgatcttttggagtaccactttaatctgaagtaaatttgtgcccatttcacggtagtacatcatctttctcaaagttacttgtactacaatgatgtgctttgtctacgaggcaaaaataagataaactaccaacgattaaaatgtaatgaagggaacaatatggtgccgtttgagtttgatgaagataaagattaagtaaaaatatgctaaacaaaaaaatcatcagcacctaattaataaagttttatttattataaacaataaaaatatatttaaattaatattttagaacggccattatataaaatatttttgaaaagagtatcgtctagcaggtaaaaaaagtggtaataaaaattgagatgtactccaatttgtatgttattaatc

SEQ ID NO: 64028 - DNA, 19369 bp, Oryza sativa
acattcttcctgaggggctgacaaaggaggccgagatggcgggcgtacgccggctgggatgcagatctgtggccgagcatgcaggctccgggtcattctgcagcagaccgactgaatgaaatgaagcctcatgttcttccgatggatcactgaagcgtgcgcccaagaggaaggcggagtggcgcgccttcagcaagaaactgttcaagtccggcgatggcgccctggatctaaaccagagggctgctgccatcgccggacccctcggtgccattgggactagtgacaccggtgcatcgtctgaagagacggtttcagacagttgagtgtatctctagtagtagtgatttagtccagaaaaccttgtgtcagtctgaagctgcctgtatgattccgctgctgaagctggtaaacagtagcagtatgatcaaaggtaaaatcgagttaaatttcagccaagtgattggattcagtttttgtaaacatgcatcgatctgaattctgattacatcctgtgtaatatattattggcttgtgtaatccaaaaagattgaaccatatatgctcgcatgctgaaaaggaattgcgagtttttgtgatttgccatgaaccaattggtgatcatccatcgatatgaagtttactgtagactgggcatctcgagtaacaagttttttttttcaatcacagtataatgttagctgatgctagtatgtcttgcacagcttagtacttttatcttatggcaggcttggcatcattggccataactgagtcgagagcatctggatgcatatactccctttgtcccatggtatagcatacagtatgttttagcccttaacatggctattaaggggagagagagatatatagagttttttattcttcttttttggtcttaggatgaatgaggtgtggtgttggtttggactagttggaatgataacaaaatgaggggttttttcaccaaatgatctaattggcccattgttaacgaaaaaaaatcgaacacaccggcctgggagatctgcttagctcctgtgcaggtccaaagattaatgagatgcgggcgtgccagtcagtttaatcctgcaattgacaagatttgcaaataatagatcaaacagccgatcggctgacaagccgatggagtagttccagccgatagccgataatagccgatgccgataccagccgatagcgatagggtttaagcaatcggctatatgtcaaatgtagatactgatataaaggccaatggctgatgatgatgtaatatagaaatataatcctgcataaaccaatcagctaacaatatgatatagtagaacaagtattgatccgaaggttaaagcacccatcggctggaggtccgatgtcatgaaatccacaagattaaattaaacaatgaaacctttgttgccatcggctaaatccaacttatatgtatatgcaatccttatgagccgatgcaacgtccagataactcaccagctgaaaccccgatgaaacccttattggcaatcaataagcaggctagagattatggttctaagcacgacttagtagatcaaacttaactgatgcagcactaagtataaaaagaaacacaatatctagacaatcaagccgttgactgattttcagggtggtagatgcctaggctaatctaatctagcaacgcgatttagccgataccggcagaaaccctaaagcgagagacagccgatagagctaaattgatatgctaagactagattaacatagacatgataaataggtaggcaaatatatcatccaaaccagagcaatccaagaggtcgaatgcactggtgcaaccttgaacgacgccgatgtagatgagacaattgcctggaccgacggaacattggacttatcccttcgccggagatcgaagacgatgcagccccgcgtcgggtgccaagttccgccggaacgtaaaaaacgaaagtagaagtaaaaagggtgccgatgcgccgaattgtattgatcgtagcgatatattacatagaccccgggtgtacatatttatacccatgggttgatacaagtccttgtcggacaagaaagaaactaacctaaagataaaaaggaaaatataaagtccttatcggacactaaacacactttcctaaagataaaaggaaactaacaaactattcctaattaatagataaattgtcatgccgcatcctctttaaactcggtaacttagggataagcttcctttagtagattgatttccttaaccgaatatagcaggaatccgactattgacgactttataactcctatcggctgattccgagatgctgcagctgataatgattataagccgatgacgtctttgccgattaccaaatttcactgttaacacccattagccctacccgagtttgttgggctgggctgggccgggccacgccaaaagcatttctccccgtggatcaagtccaagacaagagtaaacaaggcacagcaataatacaaataataagtacaatgataagtaaataaaatataggcaaatcggtttgatccatgccaacattcctactgtggtaccactgcatgcatgaattgttatgtagtacttctatatatggacaaggtagcatgcagcagtacaaaatgttccaaatttaaaagcaactaattaaactagtgcttagtaacaaattaagccctatagctatagctagctagctagaccacctgatcacctaggtacgtgtatgcctagtacgtagctcttagccatgcatatgcatactctctccctttaaaaaaactcaatctagaagagatagttcatattcattatactaggaggagccaaatctatttttagattaagttttttttaggacggaggagttatatcgatagagtgtgttctctgatcgatcagatgagcagatcgacgtacgcgtgtatagtgtaggtgtacgttcatgcatatatataggactaatatctgcctcggaccgtacgtgcatgattcatggatcgatcttaatctccatgtgtccaaagcaagtctcaaattaatatagttccaatgcagggtttactcgtttgtcaatgcacgcgttgatgatcaagtgggagatcgatcgatcgaaggagatgagctagtacgtaccctgcctgcgtcagggcacaagcctcattcatatatatgcatgtggtttacacttgattggacaaaccaaagtggatactgaagctatgccacttgtgcccagggtacttaccaacacagatagcttaacacttgcaggccaagtttgttaattaataatccatgtcccataataattgtatttataggatttgaatttatctcaaaataattgtcaaaatatagtactaattaatgatctcattaatcacttctcattcaaatttctccttattttactctcaactatcctgtacactcttacgtagtaccatttaataaggggcattatactctttcttctcaaatcttcgtatatgcgaaacaaactagaattataatcttaattagcaattgaatcgaacagaagcacacaaacatgcatgcatgcatcgatcgatcggtcccatatatatatcgcgcatcaggatcgggtagctaccaattgtatgtgtaaatgtgtgcgcgcgccttcccatatcgggaaacgatgctccatcgatctgcattttattgatgtgctccagcaaggcgagtcgtagttgggtaaattctaaaattaacgccagagtttgccacaagtaatttggccgtgtttgatcatgttaggatagtgtttgcttcatagacatatatatgccagtcatgcaaaacttcatttaaaggagacctgaaatacatgatgtaggaacactaattaattagatgtggcaatgttatagcttctgtttgagagagcttctaccagctacagctttttccacagaatctctaattaagcttctcaaacatttcagattctcaaccaaattctgatatagaatatagataataaattgcatttgaagtcaaaagctagaaacctatcttttgtctattctcactagttgattagtactagaaagcttctgcgctcagaaaatgtggcatcgatagtcactcggcctgccccttctgtgcttaggatctgaagacggcgaaccacatcctcctcaattgtgtgtttgctcggcaggtctggctccgcgtgcttttgcctcttggctgggctgccctctctcccccgtggcagctggttctaggactggtggccgagcaccagggcccgctttacctgagcatctcctcgccggcttcgactccctggtgcttttggtttcttggcagttgtggaaggaacagaacgctagggttttcgactctgcgctctcttctgtctcagtggttctggagtccatccactcggagggtcgtctgtggtctttggctggcattgccgcctttggggatttgttgggagtgtagcgtggctctgccccctcccgctgtttggagtcttgtttttagccgccgtagtttttctaagttttcagctttgattttgcctttttttccccttcgcctggcataagccggtctggctgagtgaagttgtgtagctattacttttttcttctaatatattgacgtgtaatcgttttacacgttcgagaaaaaaaaactagaaagctgcttctcggaatctcgagcttctcaaacaaagtcattgcctacaaacacaaacaagctaagttgtggcatcaaatttgatggccacaactttaacaattgggacacaaatgtttagatgttcttggtctatcaaacaaataacctctggtaataattcgcagccacatacatactggcaatcacgcttaatttggggtagaaacagaactagctagttagagatatactatccattctggaggggaacaaagtacatgtgccatgcagaaagtgagggagcttagcacaagaactatgcagaattaatccaaaataatagtaccaatatccttttgtggtcctgctaacccattggtgatggtgactaattaagtaccaattaagtagagtctaggtgtcaattaagtaaagcagccaagttacatgacaactgacaattgtcacaagggccaaggccatccccaaattctttttgccatggacaccagcaaaggacgtagtactagcttgaagggtcatcaagttcatccttggacttagccaattctttcctcttctcatgcacctgcgcgccgtttcatcttttccttgtttgattagacgttttcaaaaggattaataggggtccagttctagggaggagattatattacttgttgatttgatataacccctatttgcatgcacacaccacctgtactgtacacgtcttgaggttggggttgagagcttaggtacactcatatcaatgttttgacttgatgtgagtgtcgaattatataattactccagtaagcaaaattgtagtactccatatatatcttagtaccttcggtaggatttctgatttctaccaccacatttaattagtttcactgaaagtacattgctttcctactagttaatccggaaattaattttgttgtttttattaattagtgtgaatcatgactcgatgtgatcgtaacatacatgtggtgagtctcaaattttctgaagacgggataaaatgcgcaaagatgagtattatcagggtgtgtttagttcacgttaaaattggaagtttgattggaattgaaacgatgtgacggaaaaattagaagtttgtatgtgtgtaggaaaattttgatgtgatggaaaagttggaggtttgaagaaaaagttggaaactaaaccaggcctcagatgccaatttctaagcgggaatgctagggggcagttgcctgatcgcctacttccacaccatcctgccttctgactgcatccccgtccatccatctatccattgtgcaagatcaaatctggcgagatggtcagtggtggtgtggatgaagcgtatgtgacgaggatagagccaccaaggagcagctcatcacccccttggtctttcacattgttgggtgagcactcacttcgatctcccttttcatctctatcgtcttcttcgatggggaaagaaggaggaagtgacgaatggggaagtaggggagatgagatggtggcattggcgagcgtgatggaaggaagtcttatgctactcctctttgatgtgagctcgtcactaccacggttatcctctcatgaaatcgaataatcatactcaaccaaatgcatcaacattggtgaactgattggtagttataggtattaggcacgtaccactagtatcaggcctgatacaccacaagtatctagtatcaggccatgatacaccacaaatatctagtatcatgcctgatacacaagtatgaaggacgtcttatactgacgggtatcaattgatacctatgggtatcggtctggtaccgatggggtaccagatcgacagatctgatatctacatagtattatcatatttgaacgggatcgcgtatattatcatggttaattgagcaatccagatcccaacttgctagtagataatgagaacagatctagaagcataggccatccatctttttccttacaagttagctagctagctagcaatccttcattctaaagttttgccctccacagtcagccctcttgttcaagtaacacatgagagctaaacaatggtgcaaaaccctaacactggtcctccctttccacattagggctccccatatatcctgcctccacaattcccatcagatcaaagctactagctaatagccactgcacatgccatgctacccaaatcatcacctcccttgtacctttattatattattcctagctaatctccacttaattacagtagtgttcaatctcatataagcatatgcatctcctagctaccaagctctctcttcctctgatcaactccactataattagctatagcttagctagctgagtgatcagtgagcaggtcgatagcttaattagcttccaattaatttgattaagagcttaagatggtaggcaagccacatcaccatggctcctcctcgcttgtggcggaggagctcaacctcttgcacggcggcggcgatggcggccgcggcggcggcgggctggggcagtggaagtgccggctgctgggctcgctggccggcctcggccggccgcggcgggcgcggtgcgtcgtgtgcctccaggtgcagcacgtcaccggcctccccccggcggcggaagggcgcggcgtggtggtggggtggcgcaacaggggcggcgagggggagcacacgtcgccggtgcgcgcgtcgcgcggcgccgccgcgttcgacgaggtgttcctcaactatttcgtcgccggcggcgccacgctgcggagcttcgccgtgtgggcggcgctcgtggacgacctggcgtcgacggcgaggggcggcggcgacctcggctccttccccgtcgacctcaccgagatcgccaccgcggagagctccaacccgcggttcggcggcaaggccctcagcttcccgctcggcggcgcggccgccggcgccgtgctcaccgtcagcgtctactgcagagtgatggagcgtgaggaaaaccatggcggcgccaatggtaataaggaagaaacgaaaccctagctagcctagttaatcacttaattatggcgctaaataacagtgtagtggttaattaattgcgaattaagaagtaaatactaattaattactacgtgtatcgatcacgaacaggccatgcaagagcggagaggaagaacaaggggaagggatcctacgcgtcgtgcctgccggatctgagctgcctccggaaccggccgtctccggcggcggcggcggcgtcggggtcggctcggcgggcggcgtcgctccgatccgatcgaggcgggttcatcacgatcgagaactcggtggcggagatggagggcggcggcgcgttcgggcgcgtggaggacgtggacgaggagggcgcggggttcatcacgatggagaagggcaccatctcgtcttcgcggtcgcggtctcgccggccggcgggcgaggacgacgaggccggcgacatggaggacgagaagccgtgcctgctgatggagctggcgccggaggaggcggcggcggcgttcgaggtggagaaggtggaggaggagttcctggcgatgctggaggacaagtactgggcgaggagcaaggagatcgagaaggggttgggcgtgagcctggacatggggctcgatctggggctggacctcgactcgctcatcaaggacgcggagatggagctcgccaaggcggagcaggcgtggcggagcaaggtcggcgccgccatcgtcgaggaggaggagtacatggacctcgtccgccgctggagcgcccgcgacgccgccgccgcgtgctggccggccgccgccttcgccttcgggagccccatctaggctatcttaatttgttctgctcgatcgatcatcaccatggcctatggcatgtgctactgcttcactcgtgtaacatcatcagtgatttatgtctgttataagtgttaattaattgttgcaatatcatactccctccattttttaatagatgacgccattgactttttctcacatgtttgaccattcgtcttattcaaaaaatttacgtaattataatttattttgctatgagttgttttatcactcatagtactttaagtgtgatttatatcttatacattcgcataaaatttttgaataagacaaatggtcaaacatgtgagaaaaagtcaacgacgttatctattaaaaaacggaggtagtatcattgaagagacaaacaaattaatttgaaggattcatgaaactcctggatctcttgttagtaggttgtttgccataaaaaagggattcgctagaaaacttctgcaaacttttggctccaaaactttcagatttgtgaacatcggattgccttgagatttatccatgaaggaaaaaaaatactagaaagaaattttcacacatgtcacgtgtgagatctcaatgctaactaaccaaacgatagttgaatgcaagttttatataagttatatcgtagttacagtatagttaatgcagttacaatgtagttacaaacttacaatctaattacactttaattatactatagttacatctgaaagttttttaatcaaaaaaaattacgacagccatacacgtctctttaagggatgtttggtagagctctaaatctaacatttatctagagtcatggaatcagggaaggatagtcatactcgtatgtattctctgaagtatattcgcctgcacctctcataaaagattaaagttctagtagcgtttggtttggctctagctctacaagacgagaatccaagagctgagcctatctaccgtttgtgatcacttgtttagatcatcacaaacagtgtccctactacgttcctaatcctgatattttaggattttagttgaaaaaaatgctacgacaattctattttctttccctaacaatcggcattcccttcttcattctcgctctccacaagttaaaaatcattctcgctctcaattttcgtctcttgagcaagactgccgcatgacaaaagggacgagcgggagagtggccgtaaatgtatgatagcaagaccggatggcatgatctgataaggcctgggtggagaggcccacctttttatttttggaagttaattagtaaagggagatcgagaaagatggtggagaaggtggatggtggtgattggcaaagtggtgagagtgttgttcgagttgtaagaagatggcgagtgacaaagagatgcattgactggagagaagttagcaacttactatcttcgttaaaaaaatataaggaattatagctagaatcaatctcttatactccctccttccctaaatgtttgatgccgttgacttttttaaacaagtttgaccgttcgtcttattcaaaaacttttatgaaatatgtaaaactatatgtatgtatcaaagtatatttaacaatgaatcaaatgataggaaaagaattaataattactttaattttttggattaagatgaacggtcaaacatgtttaaaaaagtcaacggcgtcaaacattttgggatggagggagtattttgaaacaattttagaacagaggtagtagtttggatggcggcaagtaaaatactccaatgaaatgattgcgtgaaagatgaaattagtttaatacaaaggagatggtgcataaatttgttttatatggatagatttaaaaaaaaagaaggtatgcaagacaatggcgtcatggcgatgaaagatgtggggtggacatagcgaggatttatatgaagggagggagccaatttgatacttccaaaattttgaatgcttttcatgctaaataaacaggtcgataactgttcccttccacgactgcttgcttaacggtttcatgtccaatatctagctctcatactccctctgtcccatgaaaaataaatctagaatcggatgtgacatattctattaatttatatccattaatattcagtattagattagttttttttatagaacggaaggagtatatacttgtactgattacgatgtacgcatgcaagttggataggcgacagcacagtgagtgagccggcgtcaatcatgcataagagtcagtgtgcgtcagacatgcatgacacttgtattaaccacagaccgtaacagaagcgagtgatctacagtcgcctgtggatttgctgctttgatttggacaaaagcaaagtggatgcttcatggacgtacatccaaatttggccgccctggaggaatgtctcagataattgagcagatgagcatagatacatggggatccacgaacatggcaggtccccacaggccacatcgccaggacctgatttcatgctccttcatcagcagtaaattacttaagtacatcacaaatttcaaccaagcgagcctctcgagtccgcaggttccaacgtatatagcacatcaaaatcaaatcaaaccaaacaggatgacgagcaattatcatctgagcaaaagtgaaagcattcgggtgaattccacgtgtggttattttacacagaataccgcgaaacacttgggatgagatgtcgaatttatgtaattgcctagctaggattttacaggtattacacaatattaattcaagaccgagttactccccaaaaaaatgaagccaacttatagagatcccaatagcctctatgctaaagagccagctaaagaaatggtttgtgtacaggtacaacaaaaaacaagcattctcctccctagccctggatctttaaaacctgcagggctcgttgccattgtttccatgcatcaatataagttcattggatgtgattgatcagaaaccttccctggagctattttttaatgtcgatgtggttttctgcatcccataccacaatcttaccatccaatcctgcaataacggagtacagaatgttaacatagactgcctgaacataaagctggagaatttaggccgtcaacatagaaatgttttaaacctgacgtgctgaaccgtttgacaatactgtcgtttccttttctcaatggcacgatgcaactgtgaaatttacgaaattattagtctatatgcaactgataagagtccgcttttgaactgcaaaatggaagtagagggtagtacgttatgcaattctcatgaacaccaccacgaggctttgatggttcaacagtatcactgcttgccacttgctttgattggccatatagctttccgaaggcttcagatagctgatacataaattttattctgatgttagttcttgtggaatcgcaagttattcaaataaccatggaccacctgttctgattattgtattcacaactgaaggcaaagatcaataggatacttgtgttaatgctactgcctcagctaaaaagaactgagcagatactctatatagacttgaggttgcactgataataaagggtgaatagttcaggtttaaaatgctgaagacaagaatgtttttcttttccaaccaaggataattccatttcaattactgaaaccagagatgtaaatatctttttgtaaactgaaaatccacttttttttatataaccaatagactgtacttccaaccatgggctgcgctatatagtgttcgcctaaatacacatgacgatagaaccttgtgaacatagtaaatagtagatagcagctgcatataacagcacaacagcaaggaatgacacgatgaaatcctgcactaacatgaagtaatgagagggagggagaaaggaaacctgtgaagctcttgaagttgatgtagttacttttctttcatccaagtatctgacaaagctcctatgagagacaaacatatatattaacctaaaataatggtcatggaactcttaggaaacaagatgttttttaagaaaaaaaggttaaagtgccttaactattaaggtgaagctaggcagctagaaatcagatgtttttaacaggaagaagcaagtgctcataacaatgcattgtcggaataaaaaggaaaatgcaaccactttaacaagttgctaatttgctatctacatctttgcttaccaaagtccagtctcatctgcagaaaagatcataggattgcaatcaaatccaacaccaatcaccgtcctttcagaaagaaaaagaatctgaaattttgtggagttcacccaatattatgaaacatggaattatagcatgcaaataaatactagcagaagggaaaatgctgacccacatcacggagaggcagatcacgcagtgctaaattctgtgcagcaggagacgtttcaacatcatcaatgaaataaatcatggaattgtgccctagcaatcagacaataacaaacaagtcaatatatgtaaataattgaaaattatcttatctgtggatatatcagagggtatagtgtcccatctgtgggaaataaaaattgaagaaacaagtcataatctcaacggagctcaaaatactggagatgacaaaagatgaactacgcagaggccttggctagtgtttttattaattgaagttcaactagattatgtcagtcaaggtgccacagtatatcgacaatgaagagaacctttcacatgtaaaagtataagttggtaggaggctatgatgcatgcgagatgatgtggtaaacaaaagcaaaatagagagttaaacacacacttaggatgaagaaacaagtaggagggagaacctgcataggctagtgtctttccacttggcgaccaccttacaccaaatgcccacatagatgataggtcaagctgagcaatttgctgcaaccacatagcagaaaaaatgttacaaggatgatcagcactttgacaggaaacaaaaaatgctatagcagctaatataaggatagtatgccttgccaagggttgtgaatcataatgagttctcaagttcttagttaatggagtatttaataaaaaaaacactgatgctgatgctaaaatgtataattagcctaagaagttgtgtggtgacaaaatggagaggcatatttgaaaatcgcaaagggatatatcgtaagacattttcattccaacagaaggaacagtggaacactatgcattaatggtctaagaaatggcaaatacctctccaaatttccaatcagtagaagtgctcgcatgtgatcccctggtcaagaaaaagctatgagataaacaaaatatttagaagatcctgataggcataagaacagcaaggtccaccttgtatcgacacccttgatgaaagtggataacactctgcatttaccatcagttgatgttgttgcaagaagtatctgaagaaacgcgaaagcaagcaaaataaaatattgcctccaaagaaaaacaggtcccgcatatacatagatgttgcgtgtataaaccaagcagaattgcatagtggtgggattgggagatatgcatctcacaagtacaagaaaaaaaagcaaaacgaaagaaaaacacagctgtaatgaaagcacaatataaagagagacgcttacattgtttggatgccatgcaacactagtgacagaagattcatgcttcttcctaacaaccttgctaatccacctataggtgaaggatccaggcagttaagaaaaatacatatcaagagtggcacatcaacctacctacttgcatgaactatatcagtagaaaacatacaacccagttgtaatgtttgacgtagctaatgtaaaactaaggaaatccaaaagtagcagtcaactaatacaggtagcagacacaattaccagttgttgtcttgttcatagtagcaaatgcacacagacttagcaccacttcctacggcaaacttgttttctgcaaacaatataaaatgaacttcaaaaacttgttttcttcatgatactgcacttcaggttataagcatccgtttttcacacattttgttgccaacaaatatggcagcacggttgagacaatctgacaaactaatgcatctgaacatctcatctaaagcataattagggctaaggaacttacaagttatgacttgtgcagttgtaattattcatgagtagtgtagtggcagtttttaagtaagggtaaggaaagaagagagggaaagtgcttagaggttctaagatgactaatatttgggaaagagtttattaggcttgcacgatttatatttgtatctgagagagtaaagaactataaagcatatacactggttataaagagaatatattgattcagcaacgggagtagaaaaatccaatgcgccagtaagcatcaaggcaggttataaagagaaccttttgggctccactggacacataaagctgcacgatttagcttgagaataacaagggtaggaacccaatcatggccctcttgtgtccaaacatatctgcagttcatataaggaaaaaaggagaccaacatgtatttatacccttgtggaataggaaggtgattcataataagaaaattgagacttgatgtgtacttacgaatttctatcatgtgagaccgttacgatcttgttggaagatctactccaatctattccagatactatttgatcatgctgcaagatatagcaatagcgaaaataataagataatgaatcaactatcgattatacagtactgcattgtaaaaagatgatgagagagagagagagagaggtgctcaagatcatcgcacttgtaaaatataaataagaacatttacctttgaaagaacatgaagtttctcccacttgtcagtaaaaaacttatagatatgtacttcattgttgtttggacaaaaggcaatcactgaaagagagaaaaggttacatgtcaagttaaaaataagatggcatgggatgtgcatcataaaaaggggaaatggcatcattctagagggatgtaacagtgtctcatattacaaggcaagaaatgctgtattcttaaattacagtaggtgttttgccatataagcagataatatatcatctatggtcagtatgaacagaaatctaatgtattgctcacccctccaatgggactagcacacatcaagcgagcacgaaagagtatagccctctgttcaagtctacattatgcagagttcagtagtttcatctatccctctatcagcagcagacaagcaacctgggcttacactagaggagaactgaagaacattatatataattgcaggaagcctacttcattttccataacaatcatgtgggtgccatgtataatgtactggttgttaccatggatgagagcattcatttaccagtgcatgacagaacaagagctagcgctatgtagcaagaaattcccattcagatatggtgcagggaatggagtggcaggtaaaattcacaggaaacatggaattattcaggtcataattcaaagaaccaagtcagtaaatttcaaattacatatagcgccccacctacgaggggaaatccatgatgtaaacttgtgttacggacgcgatccatgtctcctagtatcaccctaataccgaaaccaccttagcaaggcatttgttctacagaaacccatacatcagcaggaaacgccaccgctggcaccaaaaccagcaacaccacggatcgaagatagagagggacatccctcatctccacgaaatgagcagcaacgacaaccgattcctaccggggggattcgaaacggagctcaatcacatttgcaggcggaaaccctagaaaaacgtggtcgcgaatcccacccgtaccgaccgcacgcactcgtagccagcgtcgtacgccatggccggcgatccagaatcgaatcaaacgggaacaccgcggagggcgcgagatctagagaagagaggggggaaggagaggaggagcaggaggaggggtgattactcgagtggtcggggctccacgcgtggcaggtgatgcactcggcgaactggtggatcgccgccgcggccatcgcgggcggcggcggaggggagcggcgcggcgcggctgtggcggaggcggaggtggagggtggtgatggtggtggaaatggttggaacttggaggcgaagcgaaatacactactactagtgcaccactcgtccgcactacggacggggccgttaggcacgcccactaccgcggcccacatcttcgccactacaactagtactttttttttccttcagttatgtatatataaaaaatgtacatttttcatcaaattttgaatgagcaaaatatattcttgccattgttaccctgtaaaatttggtaattgaagaggtttctctactttaagattctgccaaaatatgatagttaagactttaaactaggggtctatttggttctctaccctaccaattcaatggtaaattttggcactaccgtagagtaaagttcatataatatatgtgtttgtttgctatcatttgctattaatatgcttttatagtgaagaaaagttatagagtagtaccaaattagatatgggcattgccaatgctttgactctaatccaaaccaatcaaactattatttaaattgctaaacaattggtagggcatattttagcatcaatccaaaatggccccaaatgcaaccaacgctaccaaaatttagtaacatcaaactacatggaaattgagtattattgatttgttgtaaggttaataataataataaattgaacaagcacttaaaaatcattgttttggattactttaataaatatacgtcatgtttttattttttcttttggtgaaagggaaggaatgagaataagaatctcatcatttcgtatggtgatctccgccaatcaatgtgctcgagaatatgttggctgcagtcattttctactgcacactgattatagtagccccttcctgcgttaatgatcatcacgtctatcattattccccgcacgctgttgtaccaaccaaagatggccagagaaaaaggaaaggcagaagaaaaaagggagaagaagatgtgagacaaattaagattggcccgtttggggcccatctatgaggcccacgcccttcaaagcctggtccaactcaactcaatgccctcgcaaacactgttcctttcaactttcaactttcaagcgtgaagtgcttttatttattttttttagataatgaaatataatatcccggcatttactcaaaagagctacagccaattattacatagtagttttcatgaacatagtgtaaatctaaatgaatagaaacataccgaagatcactattattgaaaccagcctaatgtaaggagatcacaattattgaagtctatttgtaaatctccaaccataattggcaaatagttgcataaccgtggtctccaactttcggcatgcaactttcagaaactcttcatcttcatcacacctttgtagttgtgcccaaaaccggagccaatgagttgccctgaaaataacctgcatataggaaaatgatggtgatttgtcaaaaaccatatcgttcctactcagccatattgcccaacaaatggcagaagctccaacaagtatcagtttactcattttcttatcaactcccaaaagccacccattaaaaatatgagatatgctaactggaagattaaaaccaaaagagaactgaactgctctccatagaaatttcgcaaaatgacaatccataaagagatgttgaatagactcattcttcaaacaaaaagaacacctcaagctgccattccagttacgccttgccaaattatccttagttaacacaacccctttaagcaggtaccacatgaaaattttaatcttaagtggcaacttaagcttccaaatacacttgtttctctcgatatagccattattaattaaagctaggtacatagacctcaccgagaacaagccattctgatggaaattccatctaaaactatcagacaaatcattcaactgaatatgtactatagaggtacacaactgatgccaacaaacaagattctgaccaattaaagctctcctgaaagaaacattaagcggaacatatcccataacagtggcaatagaagatgttttcctccgaacaattgcgtacaaagatggatatttatccttaaaagccaagttaccaatccatctatcttcccaaaatctgatttgttccccattattgacaatccaagaacccatatttaagaaagtacttttgacattcataagaccagaccaaaaatgggaatcaccttgtttcctgtcaacttgggttatagatttattataaagatatttcctcttcaataaatcatgccaaaccccatcctcattaattaacttaaacaaccatttacttaaaagatatttattttgtatctccaaattatgaatcccaagacccccctggtccttgggttgacaaacaacatcccacctagtgagcctgtattttttcttatggtcatccccttgccaaaaaaaccgcgatctataataatcaattttacgaagaacccctttcggcacctaaaaaaagatatcataaatagggctaaacttgaaagaacagaattaatcaacaccagtctaccaccaacagataaatgcttgtctttccaactactaagctttttctcaattctctcttcaataagtttccaatctttattagaaagcttcctaaaatgcatcggaattccaaggt

SEQ ID NO: 64029 - DNA, 2393 bp, Oryza sativa
  unsure (1)..(2393): unsure at all n locations
cagcgtgtgaaatacagttcgctccagaaaatagcacggggcatattgggaatgcttgcgccggttatatgctcgttgaagtacctgcagatcacaccattttacaggatgggttaagcgaaggaaacgcgtctttctccatagacactacagaatttatgagggaaacaaaaaaaacagctcacacgagggtcgagagtattcatgccatacgtatttgagagcagactgaccttactgaattgttgaggcattccttggtgctgatatgatgattgaggtggtgtttggatccagggacttaactttagtccctgtttttagacactaatttagagtattaaatatagactacttacaaaactaattatataaatgaaagctaattcacgagacaaattttttaagcctaattaatccacaattagagaatgtttactgtagcatcacataggctaatcatggattagttaggctcaatagattcgtctcgcgaattagtccaagattatggatgagttttattaatagtctacgtttaatatttataattaatattcaaacatccgatgtgatagagacttaaaagttttagtcccatctaaacagggcctgagggaactatgatccattgggaatcgaacacgaaaccccttccctatgaatccaatgatatcagtataacttgcattttgtagctgtgagactgatatatgttgagtatcaaagggaatcatggacaagtatcgacaagaaggttgaagctctccaattgtacagccataaaactcgttgagataaacaaaagaattgttggtaggcaggcaagagacgggcctgtaccatggactagtagtatcttgtattggtctggaacaattcacaaagcatgcccaagcactgtctgaagaagtagccaaatcgagaaagccataagaatcagttgtagtacggtccaacagatcgtcagtactgtaaggagggtgatcggatggaggaagagggcagctgctatcatcatcctgcatggtggcgtcggtgaccaagaaggacagatcggtgtagttgatgctactcacgtagtatgttcttgtgttgatctgaatggtggccttgccagtgttgctgcaggacaggtcataccatggacggggagcagcaacgcaatcgcgcgaatcgccttgaagacggaaagggtaggatatgttgtgaagatcaccacaggaggaaggaggacagtagtggttgttgctttgccctcctccaacatctgctgcaacaagcaaagaagaagagatcactagagctgtctgcaaggtgtaggtaatactactgctactaatggagctcgccatggctgcaggggcctgcaggctgcagcttcaagacctggatgaatgacttatgacttatgaccgcgagtggacgaactgcagcagtagtactagtcaaagttggacggccacaccagtcgtccaggcacagatgagacacgctcctacacgaattattgggatattatatttgcgttaatggctcttcttcgcctccatgggtcagacagacagaaacgaatagtccagtcaagatgagctctgagcttgctcttgttgcaggaccctgcttgctgctgctgtcgtctctgcttctgcagctgcaggccacggcatgggaagacaaggatttctcagctactgcccgccgtcgcggtgcagcgagcatggccccgagatcaggttccctttccaacttgaatccaacaatactacaccatcctcatgtagcgtaccatgcatgaagctagcatgctccggccaagacaccatcttagatagcagatactcgtaccttggaagcccatacaaggtgaccgccatagattacaagcatactaccctcaccatcatccctatcggagacttggattcatgtccgcttctaaattctgtaccacttccttctcagccactccattatcattatcacggtgcaaactggagctcttgcgacatatacaattggggttctgcagccctagtaagctgttctcaagagttgacacaaactgatatcccttccactcatattgctggcccaatctcttgcctgtccaccaactcaactcacttctcctatttggtggcttatgatgtgcctacgtgtcttattccaatccagtgcgaggtcatctcagatggccccattccgataccatattttactctggccatgcctcgctcaccttcaggcaaagtgtcagaaagaatcccctcaatttntgctgacacgacggtctattggagatccttcgcaaacccagccgcttacaattgctcacagtgtgaacaacaaggccgacgctgcgcatacagctcacaaagaaatcaaacatt

SEQ ID NO: 64030 - DNA, 43111 bp, Oryza sativa
attcctgcagcccatatatatatatatatatatatatatatatatatatatatatatatatatatatatatatatatatgtatatatatatatgtgtggactctagactcgtcttttaatatttcttttcttttaatttcgaattttctgtaaattgtatttctatatagactttatgctcttcttccaatattatttatttttatttctaaatttttattatttctaattgtatttctatgtggactctaaactcatctttcaatattctttaattattaatttcgaatttctgttacttctaaattgtattcctatattgactttaaacttttcttcccatgttttttttaaaattttaaattttagttatttgtaaattgtattctatatggactctaaactctacttttaattttattatatttattttaaattttagttagttttaaattcctatatggactctatactctacttctaatattccttattttttaattccgaatttctattattttcttaattgtatttttatatgaactctatactctacttctaatattccttatttttaattccgaatttcagttatttcctacttgtatttctatatggactctatactctacttctatattccttatttttaattccaaatttcagttatttcctaattgtatttctatatggactctgccttttctttttcttcgattaatgtgaaaatttctaaaccatgagagtgaacgtggaggctcatttttctatttctttaataatataatagattttataaattaatcctttaacttctcaatattaaaaacaagcaaatgtaaatggataagcacatataaaattgaattggggttgatattctctatagcaaaagagaatgggtaacacattttgtgaaaaatatatttttatttatttcagatagtataatttctttcatccttagcaaagtacaggaattcagctagtcataaaaaaagactcaaaatttatacaaacaaattactgttatatacttgttgttgacggatcgttcggaaagggcccacctatcccgtaccgaataagaagagaagagataaaatttgctcgtgtgacacaaacaatttttttctttttaccaaatcaccgagggatagagttttcccacctgaattcattccaaacgcgagaccaagagttacgaaggtttacatagggattacatcataattaagagtggaggggggtaggagaaaatggcgttgatggtgtcgttcaatgccacaaacagattttgattttaaatatgagataaacccttgagtcctacttgaataaaagggataaatcacagaggagagaggacatttgcgataaaacccaaaatctaatcactcgatcaattaatgtctagccagtgttgatagcgctacgagggacttaatatctccagccagtgtcgatggcggacttcgctaccctaacagaaacggtaaatctaattgaagaggcctctccaattagtcttaaccagagacacccacgtgttaatactttatgagttttggttattattaatccattaagcaagtaggggaaatattcctatcatctatgcttcaaataaaattttctcttaaattaatcatccgatttacaatccgattacatcattgtgttcgtaataattaaatctttacaataaaatctcacatgattatactttgatgaaaaatcataaattacttttatgatatgtctaacttacttttagatttcagtaagttacttcttagacatataaaagtaaatttagtaaagcctaaaagtaatttacctaaattatagaagtaacttataacagaaagaaagtaactttaattaatgcctttttttcattgaacaaattatcatatatatatatatatatatatatatatatatatatatatatatgttacttttagatttgattaaaatacttcctatacattcataatgctctgaggtgattacttttattattattttagttaattccataatttgtgctgattaatttattttctagatagagtcatgtttttatctctacaacggatttacttcaaatgacatgctaaagttacctttattttgttctaagttacttttataatatatgtaaattaattttaggttttactgaatttacttttatatatctaagaagtaacttagtgaaatctaaaagtaatttagacatatcataaaagtaatttgttatttttcatcaaaatataatcatgtgagatcttgttgtaaagatttaattgttacgaacacaacggtataatcggatcgtagatcggatgagtagtttaagagaaaattatatttgaagtataggtggatggtgcctctatatagagtggtagctggtttagacaaatcagctgcgaccagcgcgcgacctcaagtcgatcaatgtgcgacctcaagtcgatcaagctggtagcctagctggtacccccgtttttcctatacggtgtaactaatggaagaataaagatcgcggcttcagtagcttcacaagaaaactagttagatcaatttcgttttagcagagatgatcgtgtaagactaaggctaaatcaaagtgaattggactcttaacacttccatccgagcgtgcaaacggcaaacatcagcagattggagggccaccagaaaggcacatttaaccccatccctttctccccttctttgttccttgcttgccgaccgagaactctgatcgtgacggggccagaacaaaccggcacgtacgtacactgaccggccgcttggactcggatgagctaattaatcaatcaatcagtccgatcgagagtttttattttcaattaattcctatcttccgttggactttgacgctttgattagaaattaatcgagtttgttaatttgccacgatcggatccgcggttgctttcagtgtggaacacacggcgctaattaagacttaaaaccagtagtagatattaattagaaggtgctttaattagcttagccactccagctccaatgcctagcttaaccacaattgttctgatcacgtcattgctgcagctagctagtactacgcctgatgcctcccaggctcccacccctctactgtgttctgccaccgttgacacgggacatagcccaataaaccaacgaccagatacatagttaattagaagttaatttttttttaagacagagacaaagtatgtatctatcttgacgaaacatgtgccacttaatccttgattggagaacacatcaaaatgggcaaaataaacgtacatgcgtacgtacgttgagatagctagtgtcggtgacatggggccgggggtatcgtgactagaggcttgggtagccgcggtcacccacgtggcctgaccccctcgggggggggggggggggggtcgggtccgagggtgacgtggccacccctccctctgtctccccgaggggtcgggccgctcccgtttcggccccgagggctggggcgccccgacccactgtggttttggcgccacgtgtgtgggttaggtgagcacagggggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtgccaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcccttcttaggcagcaggaggcccatgtggtgaccccggaccagataaaaaggaggcccaggcctaaaaagagagagaaaagaagaagaagggaagggggttgggactctggcgaaggggttctagagcctgaactctctctcgctctccggctctctgtattcattcacgcacagatccaccagaacacaggagtagggtgttacgcttctcagcggcccgaacctgtctacgtcgcccgtgtcttgtgcacttcctctctcgctgacgtttcttagatcgagggcgaagaacctcacttagcgtccccggccgaatcggcaaaggggggcctgcgcggtctcccggtgaggagccccacgctccgtcatctggcgcgccaggtgaggggcgcgcgtgtctttctaagccctcgtcctctttcgtgtgcgccaagcttctcccgctcagcccaatggccgaacgggcagtggcgcacagcctctctccgaacgctagcggcgacgacggggagcagaacccgcgccgtcgggctcgcaccccaccgtccccctctcgccgaaatcttgggcggggggaggcgctcggggaggtcgaaggatccgcgaattcgccgcccgcgggcgacgggggaggacggcgagacggggcgcgtcgccgcctcgtctacggcgatggcggcacgccccagggcgcgctccaggctacgggcgcgctcctgcgtcacccgcccgtcgtccccgatccagagactccagcccgacgttggctggatgacgtggccgacttggtcatgacggcgcagcagcgcctaggcgccagcgggcggtcctccgccaccgaggcctctggcgctgccgccgccggctccatgtcgtcaaggcggagggcgcggcgagcggcggccgttacccgccgttcgtccgccattccctcgtcaacgcctccaacccaagaagatgtgcgtggggggctggatgcccgcctcgatatcgagcgccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaatcgtcaaccccgccgagtttctccagatctacacgaccgggatcgaggccaccgggggtgacgacagggtcatggcgaatttcttccccatggccctgaagggtcaggcgcggggttggctaatgaacttaccacccgcgtcggtccactcttgggaggatttgtgccagcagttcaccacgaacttccagggcatatatccgcgcccaggcgaagaagcggacttgtatgcggtacaacgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtactgtgcacaacacctccctccacgacctcgcggactctgccgcgcggtcaaaagtttggctgagcggacgaggaagtgggaggaggagaagaggcaggagcgccgtgagggcaagaccccggcggacatgcccggggtccccagggaggtgattgagcaccgtcttgccgtgcggccgggcgcaaggccggtccgacagaaagtgcggcggcaggccccggaacgtcaagccttcatccgcaaggaggtggcgcgacttctggaggccggattcatccgtgagatcatccatccggagtggctggcgaacccggtcgtcgttcccaaggcgaacgacaagcttcggatgtgcatcgactacaccgaccttaacaaggcatgtcctaaggacccttaccccctgccacgcatagattagattgtcgactccaccgcggggtgcgaccttttgtgttttctagatgcatactctggttgtcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaggcgtacctcagttctcccccagtcctggtcaccccggagccagatgagccgttgctactctacctggcggcaaccccgcaggtggtcagcgcggcattggtcgtggagcgcgacgaggacaaccctcactccgcgtatccccaccctgtgtcgactcgacccgggagagagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtacgccccgcgtggcctctcggacgaagagcgccctagagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtagttacgtcttaccccctcggccaaattttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgagtgatgcagttcgacggctccctgtctcttcagggcgccggtgcgggggtcacgttgacctcgccgagcggagacgccctcagatacctggtccgcctcgactttcgggcgaccaacaatatggcggagtacgagggactccttgcaggactcagagtggcagctggactggggatccgccgcctcctggtgttaggcgactcccagttggtcgttaaccaggtctgtaaggagtaccagtgctctgacccgcagatgaacgcttacgtgcgccaggtgcggcgtatggaacgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagtgctacgtgctggtggaagggaccctctatcggcgcacggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcaataagcactctgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggagaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccacgcgctaccagcagagcctgcggcgctaccatcagcgccacgtccgggcccgatcactctacgtcgacgacctcgtcctacgccgcgtccaaacgcgtgctggactgagcaagctctcaccaatgtgggagggtccgtatcgagtgatcggcatcccccggccgggctccgttcggctggccacgggcgacggcacagagctgcctaacccgtggaacatcgaacaccttcgccgcttctacccctagtgggggtcgggtgtcatgtctcgggctcgggccaaccctgcaccccccctcccgggcgtgcagggttggccgggggctaccacatgcatatacttaccttttttctcttccgtatttcaataaaagcattttcgatttcctgaggactgtgtctgtgccatcatttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgtgctcccggcctggccagtctcgacacgaggatctccccaggcactagccccgacccgcgccgtttgaggctgggacctgggcacgagcccttgttcaagccaagacacagaaggaccgcggcacagaccatcctcgtctcatacacacaacaaacagaactgacgcagaaatttcctctttacttgattgcagattaaatcagtctatacaagaagggggcccgaaagcctcggaagaagaaggaaaagttattaagattggcgggggcctgggggctcactccgacgcgcccgggtcgtcggcctcgtcgtcgctgtcgtccgcaccgtcatcaccgccctcctcgtcggagtcgagcgcgaacgcgagccgaggggccgtaccctcgaagctgtggacgatgtggtcggcggcgtcccggacctgcgcgcgcgccgtcctcggttccgggagggaactcttccagcgctgcccacggggagaagtcagggtccctggcctggtagcttgccagtacgagctccaccgccccccgggtgaggtccctcgaggatgacttgatcgtctcctcgagctcctcggggagccgctcgagggccccggccatctctgagaggcgctgggcgaggcccccctggttggcggcgtacttcgcgtaccgcccgccccagaggcccgcctgccgcccggcgcggtctagacgggacacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgtggcctcggcctcctcgagagctcgcccccgctcggtgagcgcgtcctcgcggaggcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttctcgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacgcgcgcccacgccgcgtcgagctccgcccgctccgcctgcagggcctccatctgggcacttaacccgtccagcaccgtactgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggtgcgcccgcggcctcgtcgtgggtggcctcggaagtcatcgtcgcctcgggcggagtcgggtcgggggtttggcaggccgcctggtgtgcgcgcgccgcctctgcctcccggacggactcccaggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccgaccggacttggaatggcgggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatcccccccatcttgcggggccgtttcttctttcgctccccctcgggctgcggcgtcggcaaggcaccctccgggcgcctgctgctggcacgcaccgcccctccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccgcgccatcgtggccccggggggcccgctcccccgacgccccgaccacctgcatgatggccaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggtgacaccggctgtacggtgaagaaccaccggaatagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctaccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatcccttccttggcgtctttacacccttgccaacgctatgcccggctcctcgcttcccgcgcccactacctcgccccctcgtttctcgcgcccacgcctccactaaccccactcgcccgtttgcggcgcacgcggaagatgtgcggccgtggcggttgagatggggcagatcgtgcgcgcattaactacgcccgccaaccgtgaaaagcgtcatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgccgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgagggtgacgtggccacctctccctctgtctccccgaggggtcgggccgctcccgtttcggccccgagggctggggcgccccgacccctgtggttttggcgccacgtgtgtaggttaggtgagcccagcgggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtgccaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagatgtcacttccggctgtaaactagccctcattgtaaaaagcatgtttcccttcttaggcagcaggaggcccatgtggtgaccccggaccagataaaaaggaggcccaggcctaaaaagagagagaaaagaagaagaagggaagggggttgggactctggcgaaggggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcagctagctaggcagctagcaacctactccctccgtcccaaaaaaaaaacaaacccttatttccgtgcccaacgtttgactatccgtcttatttaaaaaaattatgaaaaaaattaaaaagacaagtcacgcataaaatattaatcatgttttatcatctaacaataatgaaaatacgaattataaaaaaaatttatataagacggacggttaaagttggacacgaaaacccaggatttgtattttttttttttggacggagggagtagctacatctatgttccgtaacatggtaacgattgattaatagacaagggaatcgctcgctgctccggtcccatccggctaaccattggtttcgccggcttaaaaaaaaatctcctgattatagcgtagttaacttgtttaggaggttggggattcccccctatctaactcgaggctaactaagcagagcttagcttaaattagctcgtattacttctagttgcaagttgcacatacgtactccttgcttatgcagcagagagaacaggcaaccggcagcctcgcgtagctcgtcgtcctctgccaatcgcccacacgcattgtgtttaggcagacagagcatctttgtctcagatctccccccgagtaaactaattgccactgggattactgggagaagccaccacctacctgttcagacttcagcgtcacctgtgtgtcatggatgatgcattcatgcttgcatatgtatatgctctgtaccctgaatcgtgagacatacgtggtgcacaaaatgcaacatggatggatcatggatggatacatggttggatgcatgcatgtcgtactggcttggatttgcatgtgtgcgtccaggtgctggcatatacttccagcagcagctagctacgtgtatagaattgaataatgtttgtagattttgacttggtgtagagaagacggacgagagccagctagctgcaaattccaacagacaccaggtgcagtgggaaaatactagtgtttggttcaggcagagcgatcgatcgatcgatcatgacgccgttcctgctagataggtatcgtcctcttgtctctttccagataattaaactagcctagttgacgagtcttttagtttttttttattaatgctgggttgctcgatctggattttagtttatctcggagaggggaatggaataggtgtcatattatatgtgtactgttcaccaatctgcagatataatagtagaatacaaccgttgcttgatttctagatgaaacgagaatgacaggcaagctcttgtgtgctggctaccacagttttgagagaagaacctaacttggtttctgataaaagcattaaaaacaagccatctgaactctaagaaatgtacaaacataaaaaataggtcatgtcgttttcgctttttttatcatatcatttacagagtagttcttaattaactgtagaccagagcattcctcattgagaataactctcaatatatgtatgtacaggatatacggagtatttttttttcctttttgaattaatatgttgctcccgtcatctcagtatcaatccagtatacttttttttttctgtagtcttcccctgttccacatcaaagaccatgccgtattccgttgcaaagacagcaatagcatggcttgataaagaaacatattcaccaatcaccagtactgcccgtctctgaatttcagagtcgaaagccaaaaggtaagctactcgattgactgtatccacagttccacaccctgctgttccccgcgagaacaagtagtacagtattgcccatgcattcgcggtgcgggagttccgtgcgcgcgcgcgctccgtgtacgcgcgcaaaaagaacggcggctctcgaggcttggcacgttggcacgcacgcgcgcgccatatgggcttgctcgatcgcgcggccccgatcacgtacgtgcgactgtgcgagcgaccgagcgagaaccacgcgtgccccggccgcccaccccgcgagtccacggcacactcgcctgagaaaaaagtgccaatatcgctgatccatccgtgggtctgcgccggctaaggttatggttgggtcaattcgtaaacatacttatacggttttttaataataaacatacttatacgataaatttacagatacaagattctttgcaatattactcatacaatagcagtgaataacatgtgagtccgagtctaaatatcagtgtctgctactttatcaacagtactgtagacatttccactagcaaatttaccatttatttttagtagtagtacaaggctgcacgatattgctgatactatagcagctatcgtgtaatgacagtacccaacacgtagtatagtagtgttgttaattgttttatatcctaaaatataataatttagtgtgggatgtaacataaagtattttagtaattacgaatgaatatttatattttatattagattgttatattttaggacatgacttatggagagttcgcgtatttgggatatacaacgacgtagatcgatcggtctgtgaagtgaacgtacgactcgtcggtctctatcgatctcggggtcaagactgacgttctgacaagggaaacctgaatgacctgttaaattggacgtggtgtactgtacacttggccagaaggggttgcgtacttgtgtacgtatttcagtatttctgctctcgatctctctctctctctctttcgctagttagctttgtcctttatattataggttgatgtgttgttccattccctgtacggctgagggtgcaaacgcccgctcttgttcctgtcaccatgtcccattcgatcgttttcctcctagtacagtggacacgcagatttactgtagatcctcgaaatggaccggcgcggtaacaccgatcgtaaatttctcagtgaaaaaaaaatgcaatgtaaaatcagttaaaacatgtggccaaaagatcagactctgctaattacagccttacaggggggctcagaaccaaacaaaaccatctctagccaccaaaattgactcacgagaggttaaaacttgattgaaaggaacaactcgatcgacagatcgatccgattgatcgatcgtatcctagctattagctagctagctactacttcatgagacgcgttaattgaaccgatgttaacgaaaataattgggtgtactagctagcacaagtcaagacacgggaaatagtgatcgtttctacgcctcgacccgatcgatggatgattcgatggacgacacgtaaaacacgtttggctcttcgcgatcacagaaaggggatagataggccgacacgcgcggtacaagctggattagtacattattgtctccacatgtatatatgataatatgattattgctgtagcccgtaggtctatccagccgtacaagtaccactatgtatatatacgtacgtaccctgtggatcaaccacaaattatttttgtgacgtgctaattttataaagaggttttggaaggatttgctaattatattctaacgagcttatatggaagatgagtcgacaaatgcagccaacacgttcacatgattaattacgtccagcccggcagtctatatttcgacgtgaagttaattagctagcagaagatcctatttgtgggtcgtgtgtgattagtaaactgtctgtgtgtgtgtgtgtgtgtgtgtgtgtgtgtgtgtatgtatgtatatgtatatgtaatactgaacacattttaaatggatttttagttagagccgtgttagattttaaatggatattttggaacactagcccgtcgtcagtcatcactttactaatttgaactgatgtcgatcgtgaaaaattttaaaccgatgaaagggtagaattcctagcataaagaaacttttcaaacttacattacattactttaacttgcaaataaaaaattctacaatgctaaaatgtcaaatattcttgtggaaattctcttgtccgtcaatgccccgcttgttccatgcatgcatctccagctgccggctcacttgtattaaggaagaaaaatcccatttctcctttcagtccctgtccacttaccatttccttaataccctcacactagcacataattctctctgatgatctggtcaggtgtggcgctgcacactactgtgtcgacacatacccaagcagcaacaaaacaccccctctcctggatttccattttcttttcgtccaaccttgataatacatttttataaacctattcatgtcgtatattacttattaatttctccatcagatgagaaattgccgttgattaatccggagacgaacaactacacaacccgaccggtcgggtaattaaaaccaatttagctctcgttcgtcagcgccgatggctaagctcgctgccggggcgcgccggccgcgcgtcccgtcgcggggcccgggcgtccgacgtggccgaccaggcgggcccacgtgccccctcctcgctcgggcagtgacgcccgtgtgggccacgccctgcctccccagtccccaccctcaccggcccgcctcgctcgcccgcgcgcgcgcgcgcgacgtgcatggcgcgcggcctcctccccccctcccgccgctatatatacccctcccttgcaaccgcctcctctcatcgcacactccaagctaagcctaagcgagcgagaaaaaatagcaaaagctagccggcaagcaacgccaactaattaggggagagagatattcatggctccggcggcggtggctgcggcggaggcggggtcgaaggcggcggcggtggcggggaaggccgtggcggcgtgcgagcgcgacgcggagaagctggagttcatcgaggagatgacgagggggttcgacgcggtgcaggagcgggtgctggcggcgatcctggcgcggaacaacggcgccgagtacctccgccgccacggcatggaagggcgcaccgaccgggaggcgttcaaggcgcgcgtccccgtcgtcacctacgaggacctccgcccggagatcgagcgcatcgccaacggcgaccgctccaacatcatctcctcccaccccatcaccgagttcctcaccaggtgtgtatagtagtgctagctaacccaaacaatttcttttttcaattaatccggcctttcatttgccggctcggctccgccattgactccaactaattgtttgattagtttttggtcgttgcttggttgatcgttcttgcttactaattggcgtgcgtgtgcatccagctcggggacttcggcgggggagaggaagctaatgccgacgatagaagatgagctggacaggaggcagatgctctacagcctcctcatgcccgtcatgaacttgtgggtgatccatctctgaatctctggccattatcctactttagccatctaactgttttctttttctcaccatgcctttgattgggacgttttcttgactcccggcaacagttgaagctacctagctaagatacaagtagccgtattaatttctagcatgcaatttttaatcttcttttaataaaaaagaaagaaatgatttcttaatctagtgtcattgatcgatgcattagtttaaggcctaattaatctaatctacagagacaaacctaaacctaaccgttttccgtttaaactttaccatcgaccgatcaagaaacagtacgtttaatttttcatatgctaaatataatacttgggaaatgtaatgaccggggcgagcgagtcatgcgtttgtagccttggtgacctcacaagggtttggctaagaaacaccgcaacttgcgagaggtgtggctaattaatcattcacgttgagcctaaaatataatgtgtttgtgtcttagacgctagaggtgctgctgccttgggtgtctctctactttttaggcaccgagattccttttctaatttgtaagacatctaacgatagctagctagcttcctaaaataagattatgtagcagctcaaagtcgctcgcatacgtaaccaggaagttggagtgtaaccttacaaacaaagcgacaaatcggctaccggccttgttgcgctaaaataagctaagagaaagggagttttcagaaccattcaattagcttgaagcttgaataaacacacacgtaaattaatggtactaacgctcatgctcataaaattttatcagcattattacgtgccctgtgtcaatcccacattaatgtatcccagctgaaaggaatggtgcaaccaccggtgtatctctgttaattagccatcacaatgctaaatctttcgtacatctgatatcttatcataggttatgtcaacatcggcctgaatctttaattaatccggcatgcagaactcagcatcagtgggccatcaattacactgcatgatcattgttgatcccttcctgcttaacgattcaacgacataaccaaccagctgctagctgactgaatgactgtagtagtaaactagtattatagctagatagtactgtactagtgattaatatgtttatctcagattaaattaactaaaggtaattaaataaaaaaatgacaggtacgtgccagggctggacaagggcaaggggctctacttcctgttcatcaagtcggagacgaagacgcccggcgggctgccggcgaggccggtgctgaccagctactacaagagcgatcacttcaagcaccgccccttcgacccctacaacgtgtacacgagcccgacggcggccatcctgtgcaccgacgcgttccagtccatgtacgcgcagatgctgtgcggcctcgtggcgcgcgccgaggtgctccgcgtcggcgccgtcttcgcctcgggcctcctccgcgccatccgcttcctccagctccactggagggagctcgcccacgacatcaggaccgggacgctgagcgccaaggtgacggagccgtccatccgcgacgccgtggcggaggtgctcgcggcgcccgacgccgagctcgccgcgttcgtggaggccgagtgcgggaaggacaagtgggaggggatcatcaccaggatgtggcccaacaccaagtacctcgacgtgatcgtcacgggcgccatggcgcagtacatccccacgctcaagttctacagcggtgggctccccatggcgtgcaccatgtacgcgtcgtccgagtgctacttcggcctcaacctgcgccccatgtgcgacccgtcggaggtgtcgtacaccatcatgcccaacatgggctacttcgagcttatgccgcacgacccggacgcgccgccgctgccccgcgacgcgccgccgccgcggctcgtcgacctggccgacgccgaggtcgggagggagtacgagctggtgatcaccacctacgcggggctctgccgctaccgcgtgggcgacatcctgcaggtgaccgggttccacaacgcggcgccgcagttccggttcgtccgccgcaagaacgtgctcctcagcatcgactccgacaagacggacgaggcggagctgcaggccgcggtggagcgcgcgtccgcgctgctgtccccctacggcgccagcatcgtggagtacacgagccaggcggacgcgaccaccatcccggggcactacgtggtgtactgggagctgatggtgcgggagggcggcgcgtggccgccgccggcggaggaggagggccgcggcgtgttcgaacggtgctgcctcgagatggaggaggcgctcaacgccgtgtacaggcagggacgcaacggcgaggccatcgggccgctcgagatccgggtggtgcgcgccggcacgttcgaggaggtgatggactacgccatctcccgcggcgcctccatcaaccagtacaaggcgccgcgctgcgtctccttcggccccatcatcgagctgctcaactcgcgcgtcatctccaagcacttcagcccggcttgccccaaatacagcccgcacaagaagtgatcactcactacactacacggtccagttgagctagacgacacaacgatatatagccttctactacaactactactaccagcactcagtcccagtgcttatacagtcggtgtcagtgtcagtgcgtgtgtaatttctcgtgtttaaggcagagggcatcagggccatactcctggatgcctgcttctttgatcttagatcatgctgtccagtggtagttaccatgtaatcatgtgtgagatgttatttctgaagtggaaatggcgagtgtttgtgatggggtaagctggtaacgtcattcttggccgaataacataataggccttgttggagtatctaccaactacttctgttgacccatatgtacttttttctgcttgtgcaaaaatgggagtgaactagtgacactgacaccccaggaattcaaccccactcatgttcctccatgagagtatgtctgttggtacagcgtcacccatgtctgctaggatacactacttatagtggagtatatgtttaaatcgctcttattattctattactacagcatgatcctttctgctaaagttttcaacacagacgtagctccctattttgtaatgcatgactctaaaataaacagtgtttttgggagggaaaaagttctgtaacttgctacactagtacactgcttacagcctagcccgggtttggtacaacatataattcccaacagacaaaagtatcaccttatgtttagatttgaacttttgatatagagaaatacgcaacacttcctgcataaattgaatcctacctgaactcatccaacttgcaacctctcacagaacattaatttaccagtttcaatcgttaaattattcatgaatattgtagtaggtacaagtgattctaattatggggctaaaactgctatagcttgcacataaaaggaaacatggcattgccactgccaatgacttgtgcaaaaacctatcgattccaatctaccacagctccactctcccatgtctgcttgtcacagaattcagtactaattaacagtcaaataagatatttttcttttttaaaaaaaaaactaaaagacgagctgcttgcactcatggcccgtttggttagggggagtttttaggagggattggaagtttagagggatgaggctattaaatgttttgtttggttaggagacatggaaattttggtgggatggggatggggaattgaggaatgaactccctccttttcaatacctgggtagggggtcctttacttcgcctaaacaaatctcagccatccgttttcattaatgacctaatctccaactaaactccctatcaatttctaccacctctaccaaacaagagactaggatgaaaaatcaaatttccatcttaatctcaccatcaattccctcgtgtaaactcccaatcctcttccctcaagttgccaaacaagccgtgatatttgggacaataaggaaatttagttgcttgcacaactcagataacacgagttggtgcttggtagcaatacagaaaatacggcacgtacaatacagaaaatacaacatgtgacccacattatggattacactagatagatgttggaataataaatatgattatttagatttataattactaatcatatagtggattgtgaatatgaccacgcattttgcagtagttaaggtgcctttgtaccgcttgggtcctgtgtaacaggaaggtgtccatcggacgagcatctcaaaacatctggaagccttctcaactttggtccttgtttcccactcaggcgttttggttttacatcctagccaaccattcaaatgtcacatactgaagttctaaaataaaattatcctacttaaaaagatctttatgaaggaaatattgtagactctagtgacttgcccaaaaaaaaaaaacctccattatttttagatcagaatgaatagcagctggattattgctagttcttactgcaatatgttaataaggttaaccaaagcataactacaaatgatatgttttttatctgtgtgccttgtgtatcctagttcttgtgatttgacctcagtagtaagtcagaaatcatcaggggagttctattttacgctgttttgagtctcttctatcactgagtcacgggtaatttgattattcaagcccatcacgaagtgtaaccaaccttaatcagaaagattactctataattgaatagagagcattatgggtagattataaatctaatcttcctaggccatcagccttaaatgccttgatggttacacaggagtttcaagtgtctaccaggaatgatatcgatttgttctgaacttgtaatacatggagagtactcattcacaattaattgttagcctatcttacatagttagatctaagatcagaccaaaggaacaagttataattgtgtcagtctagttctattactccctggttccctctagtaaaaaaaatttgacgttccaacatcaattaattttgactggagggagtatgatatattttgtaactaaataattacagattggtaacagatattctgagtaagggaaattgtgttcggttgttggcaccaaacctggtcaaatattgctgtagggatggcaagagttgccactgcattaggggagtctactattccagatatcctaccctcacatgggcagcatgatagcaaaaggtatacctgtatataatccgttaatatctgattttaggataatgttcagatcacataatattagcaggataaccaaaaatcctgtgtctacctgctccttggagtacccaaatctggaaaggtactcaatggcattgaggacagcacgcttgtaggcaactgatgcatcaagaaaatgctgcttcccagactcgtctacactgatgccctcaaagactaaccagtctgagaaacgtggttccactggacctatatcaaagataggattcacatgaagtggtgttggacctattggagtcaagtattccttcatcccacctcttatgatctcacacctacacaaaatgtaagaatgaaatcagttggttttcacaagaacacgagaagcaaatcttcatgatcagattattcacaagcactcagcatctcttgcacagtcaagtggaaatgtagtttctcaagtacgatataactatgatgcatgatttaggaataactggtgctatatgcattagtggagcgattctgatttccacaaccaaaagtgatgcaaaccaacacaatgtctcaattagaaatcattagagcattttaacttacattgatgacagaaaagaagcataaactactgcagtgccatggagatggaatattacagaccatcacaattgacttggtgagtggtgacagcagtgctccttgatccttaaattaacattcttgatgtgcccattcagatgaaaagtctcaagcaagcagctatgtctatgtggatgatctatgcaggtgttcaagtctagtatatttataggaattgtgaaaaacctaacaatacaaggattagttacattagtgttagtggattttgttcacctttaagtagttgtttgggtgcatcttaacaagtactcagaattatagacaagaaaaaatgtaattacttgagctcaagaaatccactcatttctattgctccacagaatgagacttcgccgtcaccctgggaaaaatgcatgtcaccagtactcagatttgctccatcaacaaataccgggagataaaccttggaacctctacttagattcttgatgtcacaattccctccattctcccttccaggaatagttcttgctgcttcatttgcgattttctgccaatcagcagtcccttcttgaatctgaatcatgcaacaagcattatagacatggtttgttcctttaaaaaaaatacaaacagggctctttaaccaataaccatgtcttagattgatatctatatgtaaaattgctgcactgacagtctggaccagatgaaaataataattgtaggtactgcaacaaacaatgtttcatttaatccttgcactgaagtaaaaccactaatctggcagaaggtcatacctttccaagtaaacagttctcaggggttggtaagttggcaagaggcctctgatgtagaacttcacagattttgattgactcatgatttgtctcagccaatattttttccctctcattccatatattgagaagctcagcagatggtgcagtccccactataccaggatgagttaatcctggaaatcggacacctgatatacacacaatggaactattgaggtatcctaaattgaaaagcttcatttagaacaacaccaaaaaaaaaattctacctggtatttgaggggagtatgcataaattccttcaaaataccaaatcgcctttcttgcactagggaagtggtcggttaagaatccaccaccattctccctttcaaatatggcagtatatccccattcgtcaccgggaagtggaccaaggttgcagatctctacagcaagaagatcaccaggtgcagctggaaccccttcagcatcaactattcttaagggcccactaagataatgagtctgtgggaatcaatagtcagtttcgctgatatcttgttttgtaataagcgctgtgataaaaaaaattaaacggcatctcttgcaggagcgatatatatacttacaattgtgagatccaggaatttgatgtcatctgcggagttatcatcactgactcttcctccagtccaatcgaccatctcaacacggaacaattccccttcagttacatctgcaacaggagggatatctggatgccagcggttatggagagggactttttgctcccatggcttcttgctcacatctataggaactaccaatcttggtgttggaagagccatgttctgttgcagggagggaagggatcagaggttcatccttccggaagctcatgcttctatataatgatagcatatccatagcaatgagtcaggcaaaaaacgacaaaatgagcaaagacaaaggaatcccaggaaggaatggtttcaaatatacactccatctcgaaagtgcactgaaaaataagtgataaatcctcttattaaaatatttccaagaaactaagcaaatcttaacctagcaattattttatatgtttggaagtacttaagatagtggtcacaatcaagtaagaattgtcctgctggtccctcatatctctataggccactcagagcttagatgatgagatattttctagttcagaaatcagaagtggtaccaaccaacttgggccgtcatattcatcggtgttttccacaggcacttcatgcatcacttatgctaccaaacatgcacatagttaggtttttgtgataaatattcaaatataatctgaaggagcccatgtccccaataggctccaattcaggctaacttgtccatgtccccaataccaggaacagtctaactttatcttcttttgcatcacatttacaactagacagctggatatttattcttcaaggcaatgtctaactaacaggggcattgagttctattggttctattttcatttaacagtattaaacaaccttgcaaaaccttcctgttacaagctaaaatattactccctccgtttcatattatatgtcgtttttacttttttccaggtcaaacttttaaagtttgaccaaattcaacacaaaacaaacatattatcaaaatatattcaacattacatttaatgaaactaattcagtgtcgtagatgttgctaattttttttctataaacttgatcaaaccagaagaagtttgactagaaaaaagtcaaagcgacttttgactagaaaaaagtcaaaacgacttataatatgaaacggagggagtataatggaaacactagtacaaatagaaactatacacaagggtaagaaagtcattcctgaagtagtactacagaaggcaagaaaagtcattgttgaagaatatcgcttagtcaaaatttccattaacattttgcctaaggaccataacctgtacaattagtcaattacctccaacaaaaaatggaaatagattgtatgaaatgggagttgcggaattgtctgatttccaccaaaattaaccactctttgttaatgatggcattgaattaatagagcattatcaattttgcttcccaagtatagaccccacatctcatgaagtgcatgtgccaaaagcactcatcaatctatctgtgaccaataaaaccgttatcttagtaaagaagcacctttctacaattcctgctcccgaatcaacttacatgatcacatccaaactcagaaggaaagcaaaggcatgattctctacatggtatatattgaattaccttccaatgttgttcctcactcaacatactccaacaaacatccatcagtagtatacttctttgacttgtcctctaacattcgaaggctccagcctgcatctttcctcagtcccttcttcttcatccaatgcaagatcccctgagcttcctgccacctccctgtctcagcatacaaatttgataacagaacataatgcgatgcattctcaggttccaactccaccagcctcattgtcacatgctcactcaaccatgagtcgccacgggccctgcagcctcttaatagcaagccccatatcactgcatttggctgtgatggcattgtctcaacaaccctaaaggcatcatcgaggtgtccagagcgactaagaaggtcaaccatgcacccaaagtgcttgatcccaggttgaaacccatactcaccttgtatggccaggttaaatattttcctcccaatgtcaacaaacccggcatgtgcacaggcacaaagaacacaaataagtgtgacttcatctggctggacaccatcattctgcatccgagagaaccactgcaatgccgtcttgccatcctgtgcaagagcaagtgctccaatgatagagttccaagtatagacattcctcttggccatctttgagaacacatgcattccatctgagacttttccacacttcccatacatgtctaccagcgctgtgcccagtacaacatccatctcccatccctgcttctgcacgtactcgtgaatccagatgccagtgtcgaccgcacaatgggccgcgcaagcgccaagagcagcaaccatggtaacgcggttgggtgcaacatgagcagcaagcatccgccggaaggtcgccagagcgtgaaaggtgcggcctcggttcctgtatgaggtgatcatagtggtccacgcgacaacctccggtcggggcatttcgtcgaacatctgctcggcgtgcgccaggtcagggtcgcagtccgcgtagcgcgcgaggagggcgttgcggacgtggaggtcgggcccgaacccggacttgaccacctggcaatgcacggccctcaggtcggcgagggaggacagggaggtgagcaggagagggaaggtgaagcggttggggcggacgccgcggcatcggaggaagtggcggaagagcgggagcggggagcgggcgggggcgcggccgagggagcggaggagcgagttgaagacgaacacgtgggggcgcgggtggcaggcgaagagggagagcgccgggtcgaggtggcggagacggccgcaggcgaggaagaaggcggagacgacggcggtggagcggaggagcgcgcggtccccgaggatggcgccgcggatgggcgcgagcgcggcggcggtggtgcaggtgttgatcgcgtgcagcgcgcgcgtgacggagggcggcggcggcgcggtggacgggcggagaggcggcgggaggccgccggtcatcacggctggcggtgcgtggggcgtggaagcgcggccgccttgaacaaccctggatgtcctgggttgatgggttcgtcctccgcggccgatttgtccgttaacggcccagaaggcccgttgcgcaagcaagagttgcccgtaaatggagtatatttgtcaccgttgtaaggcaccgttgcaactttgatcacggaaaataatttttagatgattagattatgatgataaataaaactttaaaacttatgtttaagtatgtaatacactttgataatttgacatctatttaaatatttagattatttttataaaatagacgaatggtcaatgtttaaatatagattgtgcttagcaacaaatataaaggaactgagagagtacataaattgttccagaatccagacacgattttaagcaacacataatttgtttgaacttaaatcaataggtcaaacaaattgtaatgttgttggaagaagtatatatatacgctgtgtttagatctaaagtttgaatccaaacttcagtccttttctatcacatcaacctgtcatatacacaacttttcagtcacatcatcttcaatttcaaccaaaatctaaattttgcgctgaactaaacacagccataatttgttttgatgatctagtagtctcacggattacaagtttacaacaagacggtcaacagcaccccggaggatatggcaatcgatgacgttgaatgactgacaagcatttgttctttgatgccatgatcaacagaaatcttacacataaccgcacagtaaaggtatatgtagataaggagacaacaaacaaagataagatcagctaaatatacttgctgcgttcattgaaggctcaccgtttcgaggctcctgaaacttgattggtatttgtgacatctgtggttggtgtttcctaacctgccatgaagcataagaacgtatgtaactcattccaacacagtataaccatattcatataggtcaatcctacaaacctttacaccagccattgataacaacttgtgcgaggctacgtaaacataatcagagttgtcaatccttttctctacaaaatatatgacttcagatacacctgactgcaagaaagataagtattatagttagtgttgaaccaatttcttcaagtgaaaaggcgcggtttactagtaaattattaataaaatgcaatgtgtttgtatacattaactaaagtttaaccggcaaagcatgcagtaaatatgaaacttttaagctaaaatgtgccgttaggttttatgaagtgtatgattgagatatatggtgttataatgcatttcctcaaagtgagagtaatttaaataggtgatgacaaaaatacattttaactttaagatactgattctatccagaaacaaacctggataataatcttagcacactcattgcaggggaacatggtaacatataatttctgcaaagagaagataacacaagattattcttagcttataaaggcaaattaatgagatgctttaagtttgtaggagattagaagtccaaacctgtccagccgctgaagcatggtttgtatttaaaatagcattaacctcagcatgaacaacatagctgtcagggtgaaagatgacggtcacaattagggacttagaattcaacatctaagccttgctataggagactatttttgtattcaaggaatgcatatgtagtgtagcacagtgtaaagcttagaggaattaacaccagggcttctcacacaaattttacgcaactggattgggtacaagctaactaaagtctaagagcatctttcccatccttgaggaggtactacgaggtaccatgagatacgaggtactatgaggtacgaggtaccatgaggtaccaatttaatctaaccgttgatttaggaggggtatgatcgggctaaacaaatttagggtggcgctaatccctcaccctcttgatggcgttttgcttgcttgctcgtggtggctcaaagggacccaaccatgtccgccgccgccggcggcaagagctgcacgggaggaggcgaggaggcgattgccgggctcctcgacagcggcagcggcgtccggcgagtacacgctcgtgacgacgagggcgacaagatactcgtcggcgacgtgccatgaatgaatgaatctctcgtattctccaaagctttgccacatctccgtgccagcgagtccgccgctgccgccgtcgcgtcgcatcgagtccgccgctgccgccgtcacgtcgcatcgagtccgccgcggccaccgtcgcgtcgcatcgagtccgctgctgccgccgttgcatcgcatcgagtccgccgcggccgccgccgcgtcgcatcgagtccgctgcggcagccatcgcgtcgagcttccgacgaatcgccgccgtaaccatcgtcaagctcccgatgaatggccgttgcaaccatcgccggccttaccctcttcccctctcttctctttgccgcatccccgtgccggcgtcgcatcaagttcgccgcggccaccgtcacatcgagcttccgacaaatcaccgccgcaaccatcgccgcggccgtcgtcgccgatgaatcgtcgccgcaaccatcatcaagctcccgacgcagcttgcagctatcccggtcctcccgccacccatcgccgatctgggccgctgtcgggtttccgatctagggttcgggacctatatgcccctgctcccgccgccatctctcgccgccggttagttcaacgctgctcctgccctgtgagatgcagagacggaggaggaagagatgccgcgtgcgtgcgtgacgcggaataaagacgaaagtacaaaactgccctcccatccacagtaccgcttcaatgggaaggtgcggtaccatgaggtaccgacgatttttgaccgtagggtgttgccagatcaacggccgtactgcataacctcaaggatagtaaaaaatcttaaagtctagaacaacaaggatcagtagatatgagcctgacacaggagcatagaagtaaatttttaagggccatatatagagttgtagactaatccctttagataatttttaagggtcacatatagagttgtagactaatccctttagattttttgtgcctcacaggtcacaagatagctgaaaataaaaaaaaatcgccatgtgcatgtctctgggaacttttttccccgagttattaacagtcaacacacaggatcccatccacgccgcccttccttttttgcattcagttatgctcttcattctttgaacatatcatcactcttactctatatggtttgtgaagtcagctggtgtatgcgagacttttgggctgggacgcaaatcatcagctcagcacatacaccacccaacagtttaaggttttctcctctctagattatgaaatcaaatactccctccgtcccataatataagggattttgagtttttgcttgcaacgtttgaccattcgtcttattcaatttttttttgcaaatataaaaaacaaaaagttgtgcttaaagtactatagataataaagtaagtcacaaataaaataaataataattttaaaaaaaaattgaataagacgagtggtcaaacattacaagcaaaaactcaaaatcccttatattatgggacggagggagtaggaaataaaaggcatttgcattaactgtttattttgaagaaagatccttgtcaatgatctaccacatagtttaagcttctgcattccaaataggtggcaccaagtgattatgtacatttagaactagagctcatggttatatctaggatatccatatttacaaaacaattatctcatcactgctaaagtaaattgcccgtactgatcccaaaaagcctatagagctacagtgtatcaataaaagatactgtcaatgtctctccactgatgtttccaaccagttgctctttcatgcttcccaggtggtgcttatcgtgttaatagtctataggcatttcctccttgttttttagataatggattattaacccggcctctacaccttagaaaggtgtacacagcccaaggcatttcctccttgttgctagaatattgacgttttgttgtatttgctcatgtttcctttaatatatttggcccacaatccttttgcatgttcacaaagaaaagggatagtgctaatcaaactagtgtagaaaataaattcatgacttacgggtattttgtctccaatggatctcccttggcagatttctgaaatgacaagcaattaggaaaatactagagaagtgatagatgttaagctatgggactcttttgcatgtggcagcttgtatgtgctaaataattacaaaatgagcaccttacatgaattttgactttgcactaacagtacaataattaatttagtagtccttgttacatacgaaaaaagagcttcagaaaaaatatacctttgcccagggtagcttattgtcagaacaacctctaggaaatccattataccctattcctgattgcattaagattgggttacactatcagaacaacatgatatacatattattaatggtgcattgcctgccaaaacaacatacatttcacagcaatgctgcagtctgaagccaccaaataaaagggtgcattattatatgtttcaaaaaaaaaagtagcatgtgttgaaaaaccaatatagctggatcaatgttaccaaaaaaaaaaactgaaatgtagcagcgagtccaaaagcaaacatgtaattaaaaagaggactgccatgctggttgtgatttgctgtgaagagccaaaaatgtaagactgaaatgtcatgccattatgccacaactggatagggatatcaatagtgtatctaaccagtaacaaatgcccctcaataaagcagtaacaaaatggaatttatacaaaataatatatcgacactggggtaggcaggtaacacgagaagaagtccgttgcacacactagcacagcactatctcagtacacaaaacagtactgcactggccaatcatgtggtctaatggagagaacaacaaacaagaaaaggatataataaggcagttcagtgcacttcctaagagtgaaaagcatatcaaatttgatttgtgaccataatgcttctagtttatgaaaaatcagtttcagatatagcataaaaatgtgtacagtgtccaatggttacatggattaaccttgtgtgtttttgtttttaaataagcagctaacctactaaaatgcaaaaaggctataaaatttcaaccctgaacaaggtattctttgagtttcaactttacctaggattatcccctcttggctaaccaagcatgctccaacctgcatacaacatactgatgaattgattaaatcattaatgaaataggtgaaataatgaactaatcaagcatgcacgagctgcttaattgagttaaagtttgctttatgacaacaacaaacaaatacattcaaaacaaatgttatccttcctcttccattacatgacatttgcaaaacgagcaagaaagatatacgtgaacaaacttgagatgaaatgaagcattactacttgacattttggtatagttgtattgccaaatgatcctacccaggggtaaaatttgccactctggtatgtatggttggcaaaaggttgaaagaaagtcatgccttattgtctaaaaaagattgaaagaaagtcaagtccaaataggtaggtgaattcttctaaagtaggataataaagggtagcatcatcccgaaaaaaatcatcaaccacaacagtccactgctctccgacaattttaatgattctccacagtatagtatcattgaggcatttctacaaacagtatgactgcatgagctcaaacacgttaaacgtcgacaatcgttcgttggaatccttacacgggcagtttagcaagcaacgaagatgcactttacctgccgattaggatccttggaccgcttggccgaaaggaacgcgatcgccatgaagtagtcgtcccaggagatatacctgcagaaacgaacgcaacaaatcctcacaagatgccaaaaacgagctttaactcggctacacctaatcaaagagggtgagccggtggggcgactaggactaacccttccctcttggcgggatcgaagggggactgcaccggcgggcgctcggcggcgcatccgttgaccgcgaggtgctcggcgcacggcgtgggcgggctccgctgcttggcagagctggccccgtaggatgacaggaagcgcagcgcggccgcggcggctgcggcgcccacggcggcggagatggacgctacggcgaggtccctcgccgaggccatcgcgctcgctcgagcggggcttgggtccggagggagactgcaagctgcggccggctgaacgcgggagattttggggatttttttcccttttcccgcgcgcgagataatccccttgtgtagtactatggtgctcgttgggctgggctgactagcaagtcggcccaaaacatccttcgcgtcggccgttgggctaaggatagcaaagttgcttcgagaaccctgctttggtgaaaaattctgataccttccatttgcaaaggaaattcgatatctaagcctctaaggggaaaaaaacgacactgtccatattcaaaatgcgtgtagagcctataaaaaaacttgcgtatggagtatttaacatgtctcatagcctctggctttaatgcacttttgaaataggaatgggaacgagtggaaaggattacagcacaataacaatatcccataaggtagtatgaaatattgcaaaaggattttgagggggaaaattataattgttccttgtgtttttcttatgtcatgtcaaacaactattctaattattttccaaatgttttgttcatataaacttccgagggcgagtaagcacaaagctaatactagcgatgatagtactatattaatctgtaaggatatctaaccgctcttattataattataatatgtgtctatggtcgctctgtctaattatattctagttttagaatggagtttaattctttctctataaaagggtgaggtatatatatgattatccttctctagcaccggttagctatatctcccctcattatactcatactttcttccctaattatctctctcttcccatcccctctatacagtggcggatccaacgcgagtacttggggcctaagccccctatcccatggagtagaggaagatggaagaagaataagaggggagatggagggataaggcggcaacgagcccctcgccaacctctctctttgctggtgtaagaattattagtcgttgtttcttcatttatttagaactaggatctcgatctgccctgcctctcgaagagggaggatcatcctattttgctcgtgtaagaattattagttgttgttttttcattgatttagatctaagatctccttttctcatcatgtaagaattactggttgttgtttattcattgatttagatctaagatctcccttttccatcatgtaagtatcactggttgtagttttttcatcggtttagatctaagatatccattttccatcatgtaagaattactggttgttgctttttttattgatttagatctaagatctcccttttctatcatgtaagaaatattgtttgttgtttttttcatcgattttagatccagcgccaggcagccgcgggcggctggcggaatcgccacaacgcatggttgctgtccccgaggatctccaccgcgctccacgagaggttggccatgctcctccctgaaaggagcaactgccttggctccggccacggttgggtcattgtctatgacccgatcttctacaagccgtagttccgcctcgtcgatcccctcatcggcggcgagccccagctcggcctctgcggcgtgtagccgccgcccggtggcaccctccaccgccaacaccaccgcccgcaggtgccagcaccgcgcctcctccagcccattgcccatcaccacgccgccgcccacctccccgcccctgtgcgctgctcggtaagagagaagagagaggagagggaggaagaggagtatgataagtgggacccacattttttgtaataaataatttgctgactggattgccacgcgtacgccacgtaggacaaaaccgctccggattgggctgtgggggataatttgtccggtattttaagtttagggtgagtaatatctggtttttgggtttagggcggtaattcggttgaccgcgatagttcagggggtaattcgtactttttcctaagtattttttttacccaaactaacgtaagcgcaaattttatcttaccagttcaccataaatccattataatcatgtaccccgtcccataatataagggattttagaggtatgtaacatattctaagactatgaatctggtcgcatccctctagattctaaggtagtcctactttctctattttataatgtaagactttttagatttattacattatgaaatggatatggcgtggagtgtttcattgctagtaggagtaacagattcctagtatctgtccgtttgccattacaccacacaggcacacatgccacacaccaaaccacaggccacacacgcctgaactgacggggtgtcatcaaacggactacggagttgacactgtagactcctctcccccgcgtcgccccgatcatggcgtcgtcggcggagccgccgccgaagaagcggaggctcgtcgaggtccatgtcccgtccccggccccgagcccctcctcctcctccgctcccgcgccggcctcgccacggtccccggtcccgccccctccgggcgtgccgccgccgccgccgcctcccccacaaaccctagccgccgccgcctccccgcggccggaggaggccgtacgcaagcgccgcaacagggaggagctgcggggcctcttcgagtgctaccgccgcatccgcctctgcgtggagcgcaaggacgcgcgcctcctgcccgagctcgagcaggtgtacctctcgctcatcgccagctctcgaggtgcatggactctcccctcccactcacgcttcatcaagatagcgcaattggaaagtgccgaaattcgtatagcgagtcgatgtggcgttttctcgataccactctacgctcgaagctagtagaatttagttctgatccgtctctaatctcgattgatggttattacttattacttgagcacctcgttcctatttttcttgctccgttgtgtgtttgtgttaatcaggtgagggaaagcagaaggcttgcatgggtgttggattatatcattagaggaagtatacagtggttaatggtgactaaaaggatgctttactgccagcatattatagtgaaatagatttatggatccataatccatatgagctgccatgggaataaaatatccagcaacaaatttcacatgattaacctgttctgtactcctgccccgtgtgtagtttgaaactttaatctacttggttaggtcttaggtcaacaagctgtgtacgtatttgatccaggctcacaatagagaggtatgtgcttgggagatgtactgtagggcgtaggcactacttatttacctgttcggaagtagttcctgagaataattcttagtcacatgcttgtgaccaacagtatggaaattattgttggtgtatccacaactggttcatcaccacgactgatttaaaggagcacctgtttgtttatcgatccttagagcttttgttggccttactagtgatgaactcctatcaaaatcagtgtccaactgtatttattgattgtatgcttgtgtgaatcataagcatgcatcacaaaaggataacaaatatattaaatccaggtttccaagttaataaaaaaacagaagcaaaagttgatcaaataatactgcatcactgatgtaaaactgaagtaagttcgtggggtatcgacattttgatcatcacatgttaaccaacaacatagaaaaaaactgcttagggttaaatgctctttatatttggaaacttaatctcacatgtttgagcttatctagctatgctcgaattttcttttggcagcattcatgtttctgtactctttcagttatatttttaccaatttgattaacagagaatggaacttttggaggttgaatatctctaggagagttattgtagcaacctaatttgccaagttatcttaagacgatgatcatataaaacttgaattgtttttcatttatcacttagcttttatttgtagcatcggactgaaagactctgatgttgtgaagttccgtgtgtttaatagagacattaattaatgtaatcactggggcatgtaggtacttgattacatggataaaacttcatatattgaaagcaattactgttttaccatgcttaaaaaccatcctcatcattttcccttaccttcgatgcaggttgtacaagcgttcaacgtattttagctgacttgattcctcaatatgcctcatactgccctactgcacttgaggcagctaccaaagtttccatcaacatgtataaatggaacctggccattgtaacaagaggggaagatgtggatggtgtggcataccagactgctagggcttgtattcttggcttaactgacatatgctccacagcatcctgtgaagcacccaaatcatctgttttaacaggaatctgctctgcagtttatattactgtcctcacattcttcatttcaacatttgatgggaaggatatctatcacataggctcaagaaaacttctaaatcttcaggaccctgtggagctgttagacattctaaagcaggattcagggggtgacaaccaacaggcagacgactgtttagttgaactgagagcactttcattgctatgcatatttcttttatttccagagaacatactagatgcctgttttgcgctgattgcttctgcagaagatgtaaacggagaaggattgtactttctaaagcagctaacctgccatctgaacagtggtatcataactgatgctctcgatgttcagggggatggaatctcccagtgtacaggaatggacgtagatcatcctagcaccaaagaatctgttgattccaatctatcttctcatagtgttggtgtttcaggaagttctatgttgcagccaaatgagtgttacatgacaatggtatggaccactattgattgatgaagcattttaacctttcggtcaagtacttttgaatttttcccattagaaatgatgatgggttctagcatataaagtcaattactaagcaccaatttgatagtggttatattagttgcccatttatttcgcatttcaccaataggatggttgggttatggacagtcaaatgagtaccgatgttcatttccttatccatgataaggatctgcacacacttaggctaaaagtaagccagaaggtttcaaagttataagctagatttgctataacaaagatatatatattatcagtgtgtttcaaagtgcctattttatgtgcaacttgttaatcactttcctaactgtgctgcctttctgacccttcattactgttgggtgttgcacgaggccttttggttagctcattcttctgtgtggaaattcatttcagtgaaagttggcaatggattcatttgagtgaaatgcatttgcatttttgctagccattattcattactctttgactctgtgacataaatattgatcaaatggtttgttttgtcattaattcaacaaattatgggggcaaggaaattttatgcgcccaggatgagtattatgagcgtatattaatatatgatatacagattgccaggcaataaacaattattttataaatgtgttatccttaaggggtctttttttttgcaatttttcacttaattatatgtggtaaaagactgttatgtagtttcactcattagtgttctttatgtttatttatctaatgttattactaggtttcacttgcaggccatctctaggcatccatctttgaaaggctggatattattgaggtacaaaaagctgtgtgattcctgtagaactgatgtggtttcagaggtatcatcgtgtttaaatgttttgggctctttaacacaacttgaagacaataaaagtcacatgggcagtgaatcatcagtgctggacaagattgatgaaaattcaggggggtat

SEQ ID NO: 64031 - DNA, 44876 bp, Oryza sativa
ccccctttgaccaattgctcctataattggaaaatcattattattttttttgcaacttgcattattagaatcacacacttaatttgcttggcctcggtttgcgtgccaaaccgacgaacctacccagtagtcgcactaattcctgtaggttgtactaccctgattccttgtcggtccacccttgtggtacttcggtatccgtgctctctgagcgcgtgtaccaaatatcccacatacaccgttgattgtcgaaaacttgggaaatgggtttgtgaagccttcaaaacctgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggtggggtcggttggagccaaaccgggttcctggtaaggcaagaacgagaagcttgctaacttaccgatcgagatggttggagataatttgtgactgtctaaaatggcctatgtttatgtgaggatttgatccttctatgtggcatgaggtatccctgggtcggcttgggaaaggctttatcgcgaatctctaacaccggccagtgtctggagtaagttcgtgtcttgtgggtaaagtgtacccctctacagaggttaactaactgttcgaacagccgtgcccacggtcatgggcggatgtgaggtggttcccgttgcgtagatttgtttgcatgtgctttgtgaaaagttgttgtggattgggaatcgtaacaagaatcagcctatgtggcagatggatgacctgagtggtcagaaacgaatctgtgtgattcgggatgtctacgggcatcatagactagtcttcccgagtggaagcggattgttgtgctgctgggcagctagactctaggagtacgagaaattgaaaaaggctctgggagccagttaatcaagtgaaatggctctgggagccgataagtaatgatctgacccgggaggtcggtacataaccatttgagttgttgaaaatcatctcttaagtcgaatcgagacgcaagtctcctttcgacccaaaattaaaaagaaataaatcacttagtgatttcaaaaatgatttcaaacaaaggatttgcaaaacaaccttgcctctcttccaagcttgcattaaacacctaaattcccgtgacttgctgagtacgaaagtactcacccttgctctatataaatatatatagttcctccgccctgaagagaagataaagtgaagtgaagatttttcgcctggtccccagccgtcgcctgtggtgttgggtgttagaccgttggttccgctgctgctgctgttgttggtgtttccccgtccgcgtcgtcggttgcattctcgggctgttctgagctgcaacctaagttaaggtaaataagtactctatttattttagtccatatttgtcaccgtgggtaccagcactatgtcctaggactggttccgagatcgcggtttcgtcggaagcggttcgcgccgttttttctacgacacgcttctatcaggtgccgttgtacggtggtgccggattgggatgtgacacggcccctccttacctcacacatgtcaggggacttggagaagctagacggtgtggcatagaggagcgtgacgacgttgaggggttgccggcaataaatctgcttgggtcgttgtttgataaaccatcgtatgttactccagttccctcctttatctcttgagacacacgcgtggcatcacgcttgcccaatgtcgttccttgcctatggtttcgtgcgcagatcgcctgcttacgcccaacgtataacgtggagaggcaagaccacttagagcaagtttaatagtatagtctattgattactccaatttattccacgtcatttttatcaaactcaagagacagatgatacagtaagtgggctataatctgacgcatcacacatttattttattccacatgggcccacatatctctctctgttcttcttctccaccagcccgtccaagacaacacaagaaatcagatcaatctaagatcaaaagatcaaaacttgatgtctaaaaaatcaaatcgaagcaagcaagaccacgaatgagttgtgtgatgaataaaatcacgcatcgttgccacgggaaggagctgccgttcaacatgagaacaagccgacctcggctggtagcgccggcgagaaggcctttcaccattgctggccgtggaccatggtcatgccctctcaaaccttgcttccatcgccatggcatgagcccgtgcataccactgctagatactagctggattcaagaggtgcttaccagatctaagtgaggaaccaacctcgagcgcggtggccacaagcgtcgccgaccgcggtgaaccatcggcaacccagctccacacagttgatgacggcgaccccagctcgacaacatcaatcaccatcggacgagctccccggcggccggcgggtgactcgtggactcatggttgcaaactcgcgacactgcatcaaccgacttatctcgcagctcgtgtatgctacctgctgggcccacaatttcttggagcgcacgtgccgctcagcgactaattagtcgcccgcaaacgcgctctctctcctccaacgcatcatcaaacctacgtggaatcgctatcgctagcaatcggacgcctattgtacctgctcttactagctcatcgcgatgggctcgtaaaagcatatgatgcattgttttccatgctatcactatatctggatcaaaggttaactctggtctctttgagttctttagttgaagtttccaactcatctttctcgttttccacacgcatgtttttcgaactgttaaacggtacatatttttttagaagttttatgtatagaaattgctttaaaaatatattgatcaatttactaaaactaattaattatacgctaatgattcgttccgtcttaggtgcgcgatgattagttaccaataacaagtgactaacacagcctaaggcatgaactgtcctggtgttttttttttttgaaaaagtactgtagaaaagtttcctagagatgaattgccctagtacgtcgcagtttgttcctttgtcttcattttcattttgctctgccttgttatttttcctggtttttttcttcaacaagcttggaatctctattatggctttcttaattagacaaataaatttatcctctaatctgattaaacaaatgtcgctcttatttgacaaatgacaagttaactacctgtaatatgaaaaagaatgcatgtacaacttttaggtgaaacatcagatgggaaaacgttcaatataccaagaaaactatccggtcgttcagcttggacggttctgaaccgttcaacgacgtcgagtcgtcgacgcaagcgatcgatgtatgtcagcagtgaccgaagatgcacgagctatcatggctgatgtacattccaattaaccagcacctaatctagcaattaattattcatccacatgttaaatcttctgaaaaacggttttctgtaatactactccgtaactaatagttgagctaagacaattcactattaatcggggaccccagcaacgtctataatctggaaaaaagatgttcttgtttgtagataatggatgagggaataatcgatgattcgtgctagcaaatgcgtactacactgatcaacatgttcctttgcatgatagcatagcaatgatcactacgcgtgacggcgtgagctttctaaaattaacatttcgcgagaaggaaaatagaatgtgtgtggtggctacaaaggcaacctgaaagtgaaaaagggtagagctaagcttgaagcataagcaggattggctacctgacgagcaaccaatccaatttttgcaggttatctactaagggcctagctaacacaaggaatcttttttattattttgcatattgtaggcaagtgttgtaaccatctacagtgccattgttggtttcaaaactttgagacagcaaaacctccataaacaaagaaactaatagctggaaactaagagtgagcaatcagtttcagacagtcggccatggccctaattggctaattatataccgtatggtccgtatttcaatgaagtgttctttggtgcgacttgtaacttgtaagtagtagttagtctcactaattagactgccctctgagttttggacattttttattggtgtctagatggaccttaatcatcaaaataattaagttggtgatactacattttggctagacaaataaatgtgaattatgttgattttgtgaccttatcaaactgtgctgtgcttctaaggtgaaaaaaaaatatatatccaaaattaacgaatctctgtacagctgtgccacttgaagttagtatggccgagtttagttacaaactttttcttcaaacttttaactttttcatcacgtcaaaatttttctacacataaacttctaacatttccgtcacatcgtttcaatttcaatcaaacttttaattttgacgtgaactaaacacaccctatgttccacttggtcccatgaaattttgacagttttggtaacgagacgaatattgtcaccaactctttcaagctctagcagactggttccacaaatcattgcacttgctggtcgccgtcgaaccgtcgatgtcccatgaatgacataccgacgaacgtcacaaaccaacacatgtgttgggatctgctgcgcctgtgatcggttggatgatagtaacaggcatccttaattgttcaatgtcactggagcaataggagcaagtttaatacttcatccatctacttttgatagtcatatttcatcttggcacaataaccaaggataaataattctacttatcatccatttaaacatgctactaattattcctcgtaaacaaacgatttattaatatttacatttctcgatgcccatgtaactaatcttgtatggaagaatagagagtcacgcattaaatccgagaaagttataagaggataggtggttggattgaaatatgcctatcaaaagtaaaatttttcatatttgaaaatatacctatcaaaagtagatggagggagtagtatagctaactactagctccaaatcatatatagttaatttaatatcttatttatataatagttacctataaatatatactacaccattaatacatgatcgcacatcttaaatacataatattttaaagttcgtgctgcagctgactataaatctgtagcccgctttccttctctctcttctcttatctcatccacatatgcttatagctgatttgtagcctgctattgtactcgctctaagatgggatccactttcttatattcttttgtatataacacatactatatgtatattacatataatcttttcttgatcttaagctaggacctaaaaaaattctactcaacatgaatgaaaaagcaccatgcatgttgcaaaaaacatgaactaattttttatttcttatgatgtagagttaattttaggtttggccatagcaatattctttgttttctcctgtcccaatgcataaaggtagaaaaaaatattgctttattccttaagactattttgcatataatattgtggatgtcctaagactgcagcggatacagacggatagtgataatatcatattcattttcatatagctagatataaaaataaatacgaataactcggatacgaaattaaatacaagttatcttgaatataaataattagaattgaatatgattggatacaaatatggaaacaatatttctcggaacataaaaaccatcaatacttctaatagaaacaaataccatgttttatctcctttcatatacaaagtttcatcgtggagtaaataatgttcattaagtccaacacatgcaacattatcagcacaaatatgtgcctaactgatattagaacaaataacatattataatttgtaaaagtttttagaagttcaaataatattaattgtgtaaaatagggttagtgtgatgtgctgctattaaaattttaaagaggtagactgatagtccagagttagaaagtgcttatcgccttatccaattagacaacttttatagtgaccatcgacagtgtcacgtatttgtggtgtcttatagtgaattacactatttttggatgttctatagtaaattttgtgttaccgaaatgaatcatgatcacataacacaagaggaaggaatttattttcaagttagaaaaaaaataagttgaaagaaaataaattaatgaagagaaaagcttccctgggatgctcttttaacggtgaccgctcagtttgttactcgtattcgtataagagaagttacttctgctaggagctcttccttagatgctccttgactcttcaagcctcatcggttggcctaataagtaaaagtataaatcaaaatttaaattttttaacttaaaattaaaatatttttaaagtaatttctttttaacattggcttttaagtcgctacgaacaaatatataaaagttttacatgttaatttttatatttactaataagtcattttagcttattagagaatatggataaccgatgagactcttggtacactacacagcaccaagtaatttgaataacgatatttctaccgatgtgatgtaatgtaaggcatgagcttcgttgcggttgactccacaaaatagtctaaagtcaacgatcaacgcccagcactgcacttctgcgaaatactccctccgtcccaaaatataaatatttttagcatagtgccaagtcaaacctttttaaatttaactattaacaaaaaaaataaaaaatcaattatataaaattgatgttagtagatttatcattaaacaaactgccattatatgtaactcttttttatttaaaacatcttatttttatagacattgtttgtcaaaataacatttcgaagactgtgtcaaagtaaaaaaaagcttatattttaagacggagggagcagtatatattattacagtatcaatttctctcttcagcaatgttcctgaatacatatacataaaaacatcagcccatcgcccatcaataattaacacttactctctctctctcacacacacacacaaaaagaagggcaggggcatatggcctgtacaaacccatctaagcttcaaatcgacaaaacattgtattttggaataagtgtgttttataactctcatctctttctttctcttgattgaatcactctcttaaccataaaatcgagtataacggctccatcatgttcaaaaaccggtgtaaatctactcctgcaatgttttagaaaatgatttttgttgatgtaacagtatgatcacgactgacttattcagttagcagatataacccacatgtcaacaacattttcatcatctcatctttttcctcacctctccctctccctccctcccacttttttgtaggcgtccaaagtcacgcgactaactggctattggctagtattcctgcatacttgtacttctcaaacattagccactacaattcaacactttttttataggagcaattcaaaccctcacacacatgcaaataataactagatgatgtcccgtgcttttgctacggatatatgttacatattggagaaatgataacatgatttagattgaaatattataacaatgatttgataatgatgatttagcatgtgtttgtttagttttagaataaaataatttataggcataattactatatgtttaaatgttgagctttatatgttcgatgggttgatgtggtatgcttacatggagatactagtagtgctagtaagtaaatattatgcttgtatttaagctttagatgtttagtggagagattcagcccttctacatcctacaataaggctgcaagccatgggccatggcccgtacacgcccaactttaggcccgaattcgcattcgatccgctaataacaatccagtagcaccgcgaactgtcatccgttagcaaacttcccttgatcccaacaaatttcgctcgaaaacactactctcttgtacactgcaggttgttcgcttcagagtttcagagcgtgtcgcgtgcaaccgtgcagtgaagctctccgtccccgaccgtctccgattttccagccgctttcgcgatctcctctcatccccctgttataaagccccactaccctccagacacgcctagcctctcatcgtctcgatcgatctctcacacgcgcgcgcctccattgttctcggatcaacaagctctccaagaacagcagcaaagatgaagccttcgtcttcctccgtcggcgtctgtaccctgctggtggcggtggcctccctgcagctcctcctcgtcgtcgccgtcgccgcctcggcgaagactgcaccggcgatgccagacgaggagttcttgggccgtctctgcgaccagcagcagggggccacgcggcggcggctcccgtggtgccagcagctgcacgcgaggcggcgccacggcggtggcggcggcggcgtcggcgtcggcaagcggcggcgggtgccgatgccgccgcccagccgcgccggcgaggagatcgacgcgcgctacgacgtgtccaagcgggtcgtgccgagcggaccgaacccgctgcacaactagactgatcgatcgatcgtgtatctgccgcttgcattgcatgcgggcgtgcgtcctcattgatctttcttcccgttgcgcgggggcggctgatcggcggctgggcgcgcgcccgcggtcagtccgcccctatagtactactgtactactactatactagcactactatactactatacctactactattcctacatacaataaatgaatgtatacacatacgaataaacataaaaatttattcatatgcatacattttttacctatataaaaactacatacatgtatatgttgtatacgtatatacaatttaactttgtatacgtgtatacaaactttatatacgcatacgtatacaaagtttgtttttttttttgacaaattgatccttgtagaaaacttatttcgaaattagtctttgccaaaaactatatccagatataggctgttggctcagcgccaaagttgttagcgctgaggttgttcctgtcagcgtcaacaggactggcgctggtattgcgccagcgtggcgggcgaggagcgacgtggcatggcaccaacgcaaatgtatttggcgctgaccccttatacatggtaaacagactgatgtcttgtaatgaattagttatgtactgctgcaatggtaagttcctttgcctggtgtaccttaggactagggttcgaatcccaggtcagccattttcgttttttttccttgttttttttcttcaaatcttcaatctccgtgcgtacatataaatgattaatgatgatttctgtttttgaaaaaaatatatacggtactaatcaccctattacccaccaaactgaaagaaaacatcggccaacgaacaaaattaatggaaaaaatgttgatatgtcaaggatttgaacccataatgtacggcatacaagtcaaaacattaaaagaaataacacattttttgtttaaattaatttttattaaaaagaaatatcacattcagtacagatttaaaaagtagaagaatggattaaaaaagtttagagtcaaattttaaaagaaatatcattttttataaaaaagaaattagaagaatggaaaaatctcacctttctagagcaatattgctagaggtgctaggaagtcgacgaaagccgctggaggcgatcccgcgtcgctcgtgatagcaattgcaacatgcctgcatcgggagcatcgcgtgcagcagctcgctataggcccgcggtgggagcagcagcaagctagcaagttggtagggttgtagcaagagcagcaacaatggtggacggaggaggtaccaccaattagggttggggggaaggggtcagcaatttctgaatcaccatgtaggatggcctattctaccaatttttggaaaaatccatcttctaatcgtgttattcctggccttgaatccaatggcaagtattatggatttacgggtgccaacagttttgatggtaagcatgtaattacgttttttaagttgtaaatttaataaaataccggttcaaaacagttacaaatagagattacctatacatttttcgaaagatttttatgatcgtatcacatagatttttaatctttgaattaaaatccaatagatataataaaaagcaaaaagcaattaagaaacactataatggacactaaattaccatatcctcaagcaaaagaccaaatccaatacaaaatttaaaatttacatgcgaagatttaaaaattacagtgtaacttacaaaagttacagtgtaactttcataaattacactgtaacttacaagaaaatgcaccgtaaatttgagtgagaaaatcgagtaagagataagaaaaaaatctttcgagtgagatatagcaaaatcgttacaaatatgcagttggcctttttttggaagagaaatgtcatcgagcccaatgggccatctatcaatggaggctaagtacgtactcaggcccaccgagaagaggagtactggcccatttcttgcggcgcaggcctccgtgttgcagtttatgggcccacccaccacgttcctcccttcttcctctccaagtccaagacgagactggaagccgcagaggagggagggagagagcccttggcggctcgcggcgccgcaccacaccaccaccaaaacacgcacgcaccgaacgcttcgatggggcggctgcgcgcgtgcacccgcctccgtcgcctcctcgcgacgaggcctcctcatccggctccgccgccgccgccgccgaggacgacgacgacgggccagactctcccgtgcttctccgctagggccttctcgtcggcctcggcggtcgccgtcgcggtgccgcacgaggcgcgcgactccggcctcgggagctcggcctactgggcctggatccgggcggcggccgagtcggccccggccccgcctccgcagcaagaggaggaggatgagggcctcgcgcgctgcatccccgtcaaggcgtacttcctctccaccaggtacgttggaagcatatgcgcgtgcttgcacgacaggtgtttgttgattttttttttcaaaggtgtatgttgctatcatattgtgctaattcaatcttccttatgccattttgatggatgggcacgactaatagatgcagaggactaaaatgatgttttgtttgtctgatttttctttccccctgtggcagcattgatttgaagagtttgcaggcggaccatgggagcgacgtggtacctccgtcgacccgatcattgaactacattgcactccgatactcagaattccctcaagaaatcatggttagtgattccaatttaccatcacatagttcctggtccaaatgcttttgaatcaacaaatttaagttattaactccaccttggtaatttgttgaacgcaattttgtgaaatctctctttttctgcactgcaaaatttaacttctctgcaatgattggctaacatttctgtaggacattggagttaaggacaacagattttgctatcgctatgtggttgtgttccaatatggttcggctgtgcttttcaacattgctgaccatgaggctgagcactatcttgatatcatcaggaaacatgcttcaggatggcttccggagatgagaaaagatggtattacacatgctattcactatcttgcttgtcatattttaccttgtgaacaaagacattttactcggtacttctagttttcttcacactgttccattatattgtgtgtacgactagcatataattcaattgccttctatgttagtgaaaattacattttgataaaatcccatagaactacaagagagtccatatgcatctgattgatattggacgtgatgcattcataggctggtaatatgtgaagtcatttagagttgagtagctccccttctaccccctaaacagttgcaaaagcttttctttcactgggacaaaactggctcatttgcaaagtagtgaagtagcgtgtaaggttaagaatttaagattgtattacatcctcacatgatatcaattctacaatgaccagattatgcagtagttgagaagccctccctgacaacatggatgaaaggaggtcttgactatatagttcttaaaagcctagatacagatggaattcgcatcattgcaagtgttcttggccaaagtattgctcttgatcattacatacggcaggtactgaaaaggggcaacttcgacaagctttttccatgtggtggtagccttgaaattttgttcttaaggttctaaaaaacactaattttggtaggtcgatgacatggttgaggaatttactgaaattaatcgtgtcatggagaagactgggaactttaccatgcaaagaaagaagctgttccaacttgttggcaaggctaattctaaccttgctgatgttatcatcagacttggcctttttgacaggtatctcttctacaatctaagtaccacattccctttttagatggttcatgtcttccgttgcaattgcataatttcctctcttttttatcatgtatggaagtaatctcattgtataccaatcctacgtgcattgtgacaagctatgctgtgggggaaggaggcatgtagtttgatattcttttctggtgtgtttaaaaggttaatgcattttagctctgaactgtaaaattggagtttacatgccacagttctgtgttataaaagcactttgttcattatacaaatgttatgttattgttttccctgatgctttgcattaaccctagctctgcaaatgccattttacttaaggaagcatactcatttgccatttaagtaagggaataattgaaggaaaggaagaattatatggcttctataacataaattatttatattccgagtgaaggtggcattttttgtcggaagtctcattagttaatgctgatttgccataatactccaccttttaataaaattcctctttccatatcatgcttagcttatgaaaattgcaaaacattttggtgtcctcaactggctgtttccagttgtaaggcttggaatttgccaactatccacatggtttgataagaacccaagactaccatgacaaaaaaatatggataaaagctgatctaaagggaattttacgacatcgtggatacggtctccttgcgtatcttatggcagccccttaaaagaatgactttttcttcaggtctgaaatcgcttggaaaaattcaaattatgctcaaatacttgagtatcttcgggaagaatatgagctgaaccaacgttttggaagcctcgacttcaaattgaaatttgtggaggtaagttcttcgatttgtgttcattttcagtgtattagctgatttttttaaaaaattttgagttcccattcgtgcttacactttattattgcaacagcacaacattcattttcttcaagaagttctccagaatagaagatcagatttgctggagtggggtgtcattatactgctgattatcgagattgtcatctcattatacgaaattatcaaggattccagcatgatgtcctgagagcacactatccaacatctttgacagccatccacccacatcaccctactgttatgctaacccacactctacttcccacaattgatgctaaccttagttgaaaggaagtaaaagctccctttcatagctttacttttgtgttatactgcctgggatgcatttttgttagtttatttattctgctggttccaagtatacctcacagctaacaagagcagttaattctttctccaaatcccaggaattcagttccccaggtttctacgggaagagttttggttttcctctttatgcatttcaacagatgttcttggtacatgccccatttgctgataccactgctgtcagggtttacttactcctgtaggacctatgttggtcccaaactcccaattttgtggtaagacatgagaccagcaggctgccggctattagaagggatgtaaaaatgatgcgaaaacgtcaaatatttaatggcatatcctctgtactataagcgtccctactactatatttgtctttgtattgatatttagcgagatgctatgatctctggttaaaccactcttcttaaattacctgtgctcaaggatctttgtagtttgtacaacccaggcgatacacagaagtgcttcagttctctcccactaaagactgcatgaatcctaaatcactactccctctgttgaacataacctactactattattatatgaaattctatgaatttggagactcccaaatatggcaacttatcgtatcctagttgtagaatatgttcaattcaggattaggttgctatagttttggatgaaggaataatagttttcaagttcaacatgctggagccctaccaattttcaggagtgcgcacggcctgaagtttaggaaacctgcgatgaatttctgccacattacggagatgcgcatgtccagatcatcgcaaccgatggctgcgaccgatcattacataaacaattccagtacacaaaaacgatgcaaaaaagatggtataaatctattatattatatgcaacatctccatatcatttcatgtgatatcctgcttctgcttgttcttgccacaaaatatagtgtaaacccgaataaaatattttctttcagttgtcccaaaatggatacctatggttgtctttcccctaatttattctttgatgccaggaaaccgaagctggcagtttacaatcgtaaacaatcaatccaatctcctcagcaagtaggctacttgaacctccttggttagcggcatgatcctgtagctgtacagttcagccaccaaactgggccttatcttgtacattggtggagcgccgttgtcttcagcgcctaaatccacctcctgtccaaagatcttagccttagcttccaccctatgttcaatagcacgctccaccgtttcataggtgaggaggtgcattagttgatcgcagtcctgaaattcccagataaaaataattagccgcttgcataatagactcaactttgatatgtacctaaagtaatgtacaagaaaacacatggaatttatttgcttcccatgataaagacagattatacagcaaaacagaacacaaacctgtgctattatcgcaggcatgtaagcttcaggagactcttgaaacttagcctctgccacaaacttaccatagtgaattcttttggagagcgcctggatgatagaacaggaaaacaagaacaggtgagcataatttcccaatataaaaatgcctaattgcacgagtcaccagtgaacaacagtatagtactaatactatgaaaatgacatctggtgaaaattctggcagcagaacatcttgaagcaatactacaacaagaaatggttttacaagaattattttgctaatgctaaattattttgagcaaatgaaagctacagcacagtagccagaagcagtacgaggccagattattagaacatttggtatactaactgtagtacctgcaagcagatcgtgtcacaaagagcactggatccataattaccatcacttccttctttcactaatcttggaagaagctcatcaaaatacattttccaaatctccttgttgatattaatagaatcagcaataggatgcaaaacctagaaaagacaagaacaaaaatatgaattttatccaaatttacttataacaatacaacagcacagtaatcaattagcaatgtgagtctcaatagatggtactccacttcgtatcaaaagttgtattatgttgcaggtggacagtaagcacgatatcccaccacagaaccgatatactagtggtcagtcaacaaaggtacatgcttgccttcactgacaaaagaagctacgcaagcccacacagaagaattcaacatctacgaatacataagatgcataaccaattcatctactgtcagttcagagagagagatagggagagagaggcaagcataaacccaaataataaaacctgatatattagtgattagtcaatgaaggactatgtttgcctatactaacaaaaggaatgctgaaagcctacagagaagaactagatgtctaagaacacgagtttatgcattacctttggatactggagaggtggcaacagtggttcaggcagatcctccggaaagaatgggtgctcatcagggctcttgtatctcccaacctacacaagatggccagaaccatcaacattttgcaatttttggcatacaatgaacaattatattgctagttacaaccctgctctacctgttgatgtagtttttcggtttctctaaccatgaattcaaccaaagagccatcaaatccatccacatggaaagcatttttatcatatatatcagcattgtagcaaaactgtgctctctctaagaggctgaatatgatgctgtcttcttgcctaaccaaggaggttctaatgttgtccaaggtcagtatttcactttgatctatcctctgtttctcctccctgcaaaaagtacaagagaaaagtattaatttctttgatgtaacacaaaaaggttttgtaggagtgccataatgacttaaccaggttatcaatatgttatttgtcccttgcaaagaaaaaaaaagttctttggtttccaagtcaattcccttttaaaaggtgcacatgtttatctagaaagttttgctgcgattcagggattgatactacagcagtcgtacaagaaaaataattcaccctttgttgagttttctacacaaagactttggtcaagtcaccagctgcccacgatttttggtcgaaatggcaaaataccttgcatgaaatttacatgtttaagcatccttggcatcacacaatgattaaaaccataatatggattcaactaatcaaaactcaaaactacagtatggctttaagtcaaagctggcaagcacaatcattagcacaatcaactccatgttgttaagaaatcatttgagagaaaatatttcccaactaggagaccaattctcaaccatcaactcgacatcaaaccattcctcatttttcttccgaaccagagaccacctcgaatcggatagtatacgattcatgaatccatcaattaaagcataacgctaacccggtctcgattcgcaaagcactaatgcacaaatcgcacagacgaagatgctatatgctactacaccaccaacgccaaacagagaatcacgcatccgattcattccaagaccgggcaggcataaggagacctcgcgagcagggggggggggggggactagagaagagtttcatacttggtcacgggggtgacggagttgttggtggccgcgagccgcgcccgccgcgacgacgggacgaactccacgcggctggccggccctcctcccccgcgggccatccccacgggcgcgggcgaggcggccctgtagctggagaccaccttgttgaactccatagctcgcacgctcgcgcgcaatggaatccggggttggtagggtggacgtcgtcgggagggagggaggggtgggtaggcgtgggggaaatgaaatgcggggcgtcgtcgtccgcgatttttgtaggcggcgggagagcgaataggagacgacgacgggaggtgaggtgacggcgcggaagggaggggtggggggatggttggcggaggcggaggacgggaggaggaggaggtaggaggaggtaggtgggtgtggggttggggttcgtgggaggtggtgtttggatttcgttacttaacttttatttcatggagttagacactaatttagaggattaaatatggactacttacgaaactaattatataaatgaaagctaattcgcgagataaactttttaaacctaattaatttataattagagaatgtttactgagcatcacatagactaattatgaattaattaggctcaataaattcgtctcgcgaattagttcaatattatgtctaagattatggatgagttttattaaaagtctatatttaatatttataattagtacctaaatatttaatatgatagggacttaaaacgtcccgacgtctcgtctcgtccggtagagaggccggcgtgagaaaactgcgaaaattgggggcggtagccggtaccaggaggacgttaggtgtgtcggggtttttcacttttttgctcccgtgttctcggcggaggtgaggtggcgcgggcgcacggcgtaccacggggttacggggttggtattgtggggtacggtgcggcgcgtggtgtgtggcgcgaggagggccgggagagcgtgaggctcgtcaccacggcacgcgtcagcttcggcctcgggtttgaggcgaggcggaaacgaatggccaggtccaggtctgaatagtttctgctaccgtcaactgagacaaaacacaagaggcaccaaaaacatgaaaagtgttttaaactcctgatgtctccgtttatttttttaaaattcttcgagtggatgccctctaatttattaaaacactatctaacatttatgatatagacataaactacttttaaaaaaatcaagtcaaaactcaacccacacgttaagatattatcaaatgtgtagattgaatttgaatatgatttttggtgtagtggtggactttaatatactcgttcttaaattatttaaaattatacttgagaaaaaaaattatatgagagcatattcccttgagagtgagagattagaatcatcccccctcaaataaaaaagtgctcctaccatgtgaacgacactagttttgctggtcgtgtaagggtattagttactccatccgtcccaaaataagtgcagttttacactatttatctccaacgtttgactgttcgtcttatttgaaatttttttatgattattatttttattgttattagatgataaaacatgaatagtactttatgtgtgactaatttttttaaaaaaatttaaatcaaatagacggtcaaacgttggacacggatttctactgctgcacttattttaggacggaggtagtactagtccacgaaacttaatttaagttaaaataaactatgaacctgttctattttgacttataaattagttcataggttagccgctacacccctacaactgtgtaccactccatgtttgtcgttaggattggcttttttagacataggggtacggattaagaagcaactagtctaacacaacggaatctatactactagtagtgctagtaggccattagctgtgcaaacactatgtttagtttatgtgctaatttttttaagtatatagacacacatttaaagtactaaacatagactaatgacaaaacaaattacagattccgtctgtaaactgcgagacgaatatattaagcctaattaattcgttattaacaaatgtttactatagcaccacattgttaaatcatggcgtaattatgctcaaaagattcgtctcgcgatttacatgcaaactgtgcaattagttttttttctgtccatatttaatgttctatgtatgtgtccaagcattcgatgtgatggaaaagttgaaagcttgaagataaaagtttgaatctaagggtgtgtttagttcatgctaaaattgaaagtttggttgaaattggaatgatgtgacggaaatattggaaatttatgtgtgcaggaaagttttgataggttgaaaaagttataagtttgaagaaatggttaaaagttaaaagttaaactcggcctaaacacggccaatatgtaaaagcatggcatcctgacgatatccgccgcttcaaacgtgggaaggttgtccctgtcacgacgacttggcagccggtcgtgcaagtggggattctacgacgtttttgcactcccttcttctcaggcacggcagagtttatctagttctagaaagcggcatttcaacatcagcaacaccaacactgccggagcatttcttttttttttttggggtcttcccttcttattttccctgagcgtagaaaattctgtggtttccagttttccacggaagtaaattccaattttccaatagatgtacgtcaaccctttgcttcctctccagctgcagagttgcaggtttgacgaatgcagcttatctacaaaattcccatcagagggaacacagttacagaagaactaggggaagtacagattgcaaatccataaggatcttctttagaaccgtatacgtaaagggcttcatggattggccactatatatgggtgtcaccctcaatcgtgaatctgcaaggtcagatatcagtatatcaaatgcagattgcctcattgcagattgctgtggattgttcaggttccgggttagcccagtcaccagtcttcactgacattagcccgctgtggttacatcagatagtaacaagctccttcatcatttcggaattcagtcggtggtaaggcatcggaaatggcatcaaaacaactcttgctgcctacctgaatgtatcacgcagggacagattatattaagtttgtggtccacttgccaattaaacgaacgcctcattataagtgaaaagctcacctttcagctatccgtgctgccatcatcgtcatcttcatccccagaagcttcataacgtggctgatcatacttctcacgaagctgcttgataggaatgaagtccccagcagtgtcctcgccaaaaaacagaaattcaatataggggtgatcaaatcttccctatttataaacggggacagcattagttcaatttgaccaaaaatgaaaaccaccaagcaaatgaagaactcaaactcactttctctgatatttcagcttctgcaagattttcttctgcaactgaaattacacagacataacatgtctcaaaatggcgcagcataggcataaaacagtaagtgaagatggatttgatcaattgactactgcatagcctactatcttgccttcttctgccattttacacaaaacaagattgctcattaaaagttacagatctcaagatagaatttccaccagtggtcatgtctatcaaaatagtggaaaagaaaaatcaataccatatgcaacaaggagttctggatcagcatatacatcaacaaggacctgcaagatttcagcaatgaatcacagaggatcactaagcatctcaattctcaaaagactaaattatgcaaacacatcagtaattcagtatgcatgggcactatcgtccaaaagaaagcattaattgcatagagaaacagtcaattgcaggctaataaaattgcatcatgaacggcctgattatacccaaaaaatccaaaagggaggagaaaaaggcaatgatgaatatcaccatctcaactccataagtgagtttgcaaattaagaacaagaacaggtaggtattattacacataatcgccatccatgatagataagtcacaactgatgctacatgaaggaaatgatatttctatgaactatgggcattgaggaactactaaatcggaataagtcaagcagcatttacttgataaaaaggttgattcggtcctttggacaagttttccacatttgctgtctccatccatgacttggattcacagcacacaggatccatgccacaaatcacagctctatatccttcagcaggtgatgttatcatgtaaaattaagaagagaaactaaagtgtgttcactgaagttaatatttgatataaagtgtgcttcaacacatgcaaatgttccatttaaggataatggcaattatgaaaaattaacttttcatataaagtttgaaaagaaattgtagtagttatccattttctgaacagcttcagaaataatgtgtgaacaacaatacgaagtaggtagtatagcagtactcaccgtgtaccttatgacgtactttctgccctagtcgaaatgcatattccacattttgatatgcaagggccttagcggagactgccagagactctgtctacatgatgtttgaagttaatatgttattaacacattaccatcacatggtcggtgcactacagttttgttgtacctcaagtttagcaatttcatcacgcagtgcagctgccaaagcataattttcactgtcaacagccttttgcaaatccgcactgaaacaaatggataaagctaagtgatctactgatctctcaaatgaaccaatgctacataacactggaacatcatggagaaatggaaactattaacataccgcacgcgtaaaaggtttatagctttgtcctgagcttcagtctttgatgagcctcttttagcttcacgttgcctaattatctctgtttcaatctagacgaggatattttctttagcaagcctcatacaatgaattcatttatcttcaagtgaaatcatttggtacctctgtgagtttttccctcaattgttttgccacatcaaattgctctatattcaatgcatactggtaagaaccaagaaattaatagttaggctggacgtgcatagataagtatcaaacatttgcatggaccagtagccagcaactaagaatgatgcaattatcatgatggtagatttcattagccgattgctactagtctatggaattgatccgtgaaaaaagaatcgttgccggctggattggtaactttatttgctttagaaaatgatggtaaggaagcaacaactcacctgtattcgggtttgtaggtccaattggaagtagaagattaagatgtcttcgttagcagactcactgcgttccagccttgcattactactgctacggtcatctcctccaaatagccatttagcgttagttctcactgtagtacccatttgccttctattggtcctcatatgtagttttttcacacaccaacgccatgagtacgctccacatgttattgaatttattttgtaaaacaacctcagatcatccactgcaagacaagctggtctaaaacatgatccatggggcgaggaaattgaaccacatgcaaaaatgccttgcattgtattggtatgagatttgaccagttcaattcccacaactgatgtagtccaatcaccacactgacagttgcaatcagcaagccagtggcatctccagctgcgcagagaacaaaaacattttgcttaaaactagtacaaaatgcactaggtaactaagaaaggctttgaattgtggcatctaaataattacaaactactattaactaacaaactaacaagtagtgcctggaaccctaccatatcgtaaatgtgcaataaacattttactatcttcttttttttttgtccgtagatactgatcaatctattctgaattattgaaggtaaatcgcacctaacgtggtccaggcgagtaagcaaagaaaccctcaaactctttggaaataataaagtgctagaacctaccagtacgctttgtttcgagtaatatctatcagtgctctctactatcacgcaaaaaaacaaaatcctcaaaaactaatgggttatacgggagaggtaaggggttgcccgcagcaagataaaacgccagaaaaaaaaaaaagctacgaaaccaatcaaagaagccacagttcatcaccaaccgaagaaacgaaaccaatccaacccttttcagaaggaagaaatcctaatgggactccggtctacgccgccggccatgtagcgagcgtggagagaaggatagataccttttctggccgaggcggcgcgcgcttcggtgggaggaggaggcggggaagcgtcgacgagtctcggcgaacggggaagaaagggggagggccgcgcgcttctcggccgtaactaccactggctcaaagtgtggcggtcgtcgacgggataccggatagaatgtgtgacctggatcaggagtgcatcgactgcaggttaagcacttgggtgaaactgaccgtccaagaaccagcgaacgtttaggattctctgacctcgccttctccttcccttcccttcatcaagatttggttacaattttggggcaattgcatctacgcccccactttcaaacccaattgctgttttatcttcactttttagggacatgtataccctctgcatccagcaatatcgtgcaggggaggacctggaacaagggacggggaggagggcgccgtaggcgccgacgtcgacgtcgagcaggatggggtcgtcgccggccacgggagcagtagcagcaaaagcgatggtgggggcaggcggaggcgggggctgacgacgatgcctcggcgtggaagccagcggccacgggagcagcagcagcagccgccgccgtcgcccgcacgccgttgccgcgcgcacgccctcgccgccgcccgccctcgccgcggctgccgcccccgagcgcacgcccttgccgccgcccgccctcgccgcagccgccgccgcgccgcgtgcaagctctcgccgcccgcccgccctcgccacggcggccgccctcgccgtcgccatcaccgcgccttccgccggagccgccgccggagccgcgcacgccgctgccggaacggtcgccgtcgctgcacggtgcttgacctgagcagagctgtgcttgcctgcttggatccttatgagaaagactacacaacggtatataccacttatccctcatgccgcgaccccacgtgccggcttctcccgagtatgtcgcatgctgctaggattattatcacacaggtttgctgtgtgtatcagtgtatagtcttgttcctgacagctagctagtacctagcatgcctaagtcatgcctttgatactagcctagctggttgttgtgcatgccaaatccctgtaatagctactagtagacctgtaccctagctatgtagggtacttattatggaggagcctagtagcctagctatgtgtctaagatgggttgcatctatttgttgtatcctataccatgcacggattagaccggacaaataattacctagattatacatggatacaatggattattctaattagatatgtcatgttgggctcttggttataccacatcttagaaactctagtatgtgatacatagatgctagattatcatatatgatatccaggtattgggtcgaatacctaggtaccaagtatgaaacctataaatacaagatctgatgctgagttatttggcatgatacctataagtaccggatctgataactaggtatggtgtctgatacctatgagtaccagattggatacccgggtatcgggtatctgatctcatacctatgagtatttgttccaatacctatatgtaacgggtcggatacccaggtaccgagtatgatacttatgaataccaagtctgatacctaagtatcgggtctgatacctatgagtaccggattcaatacctaggtcaggtttgatacttatgagtatcggatccggtatcgcgcatgatacctatgagtattagatcggatacccgggtatcgggtatctgatcttatacctatgagtactggatccaatacctagataccgggttgatacatattagtagaggatctgataccaaatatagggtgtgatgatacgagacttcagatgtgataccactaattctaatatttatgggttatatacttctattcaacagtcaaataaaaagatggaccatgcatagctaggccagaaagtacagccaaacttgctcacgtgctgctgacatgctttgtttaggctaatgctactagctctagtgcttaattctaactttactagttgaagcaggtgttagacccatatggacctaaagaggtgtagaagtagtgctgtattagagtatttcatagctattttgtattgtaggagaaaagagacctctcgtcagtcatcactagtcggtagcctccatgtgaaaggacagcacacgacacgctttcagagagaaaaagaatcggtgagtgattagtaagtataaattataaactataccgttgagacggtacaccatcccatagtttttctcgatccttatccattcattgaagggtacaacagtaaattaatatttcataaaaagaaatttctatttctctttgtgggacccagtgccaccgaacaggcccatttttaacccaaaactgtgggacccatctaacggggctaaaagtgagggcaaacggtgggttcatgttcaaaaagatgaggcaaaattgcaaactctaaaaagtaggagtaaaacagcagttgaggttcaaagtgagggcatggatgcaattatccctacaatttttggcccaaaaggaggaacgcggttccccgctcatctcgtcgcctgttcttcacactcgtcgggcactcgagcacaggcgcacggctgtcagatatggcaacggaccaccgatttggcattagggacacgggcacacgggcccgacgttagtgtctagcactccagcgtagatgtgcaccgagtgaccgaggccacagagatgcgctgactgcgttgtgctggtgcgcctggtgcctcgtacatacaatacaatagttttgagaccctcatacaatacattactccctccgttccaaaaaaaaacccattcgttgctttaggaagggtcacgttcccttctagattaagtttttttttttttaagaatagagtgtggttgttatgtcttttttttttcttattcgtgtgcagtactgtaatgcattagtactgtaatgcattaggtacaaaatgtctgatgttgttcgagggatgagttcatgagtacaaagaaggtggatccttcttttgcgacaagtagggcgacatcgtttggctgattataagcataagcaaatgacatattagcaaataaaaataatttgtgaatataacgtttatatacgtattcttaacgatttaaaaagcaaagcctacaaaataaactacgatgaaaaaaatcccaaaataaacttcatatttaaggttgaaatgcatattttggctgataaatataagcataagctaaaagataaggccggtagtatctatttgaactttgtgaacatctatttcatttgctacggcacaaagtgtatgtgctagaacatatttttctttatttcttcattaatttcttatggcacagtggcatgatagatatctttgagccctcgttcttgacagtactcaaaaccatatagtttttcctctctttctgcttgaaaatgccatcgatcgatctattgtagccgtttgttctcaccagcccttcgaacggcaatttgaagccttggttcaagatttttcaatagttcttcctgtttaaagttgaattcgaaaacatggaatgagcgtttgacatgtttcataatattagtttggagataagaacataacaaagaaaaggaatagcattttttcagtttataagtataccaattcatattctaaatattataaatagtgatttgatcttttttgtgtgtactacatctcatcttaactcagttcatctaaaaaatatatatattgttctattgctaacctctaaacatcataattttcccattcgttttttttatagcgtgtacatcttttcaaattcattgatgtgtacacaaccatcccgtagcaatgcaagggtatcagttagtttttattgtttctagcaggttttatccaatatcacatgtatatattacaattaagagtagtttaatttacacacacaagaatatatgtaagctataggggtaaacttaccatcaagagggacctatctttcaccacactcaaaatatatacagacaaccaacaaaaatctccaacttgcatgcatttgtattcaaccaacctcgggccatcctggcttaactaattcagacaagcaaacagtgcctgttggatgtggctagccaggctaagctcattcaggataaggcatacagcctaggctgggtcattcggtagcagaacaagcttccggcagcaattttttttttcggaaaaaaaaagattcttttttatgccatgaacgtagagaactttttccaccaacataatgtaacgggataaatggcgaatcattcttgtgtttctgaggtcaaatggtcaagtgaacttccagcaaacaaaataaggttacttattataatgtcgtaggactgttacttgtagcataacaccgagctctgcctcattgtctgctatgagattcagcaataataaccccatgaatcatttgacaggtgatcagctcatagcttcacaatcgtcctacaataatggtgataaaatatttgccaatggatgcttactcccgaaaatgataggccaagaattctatctggaagatcgtatgacggttccaagccaatcttctgagctcgtgtccccttttaaggctctcagtgaatgttctgtaccaacctgcatcagaagtcacacggaaaaaggaaaaaaaagggtcattgaaaattttatatacacaaagtcatgaggggaggaaaaagttaccagacctttgtaatatacacatcaactccaagcctagctatcgcagcagcttccaatattttggtctccattccgccagtggtgtcatgtgcagctacagatatctccactgcaatgcatatcagattatctttgttaggattacacaagctacaacatacagtttatctttattatgctggtcaaaagaacagtgtgtctttatcatgaatttcattagcccctggcttaaaagattatagctttgatcccaatactcatatttcaaactgtcactcctccataagtatagtatttgatccaaatcattgagacttccaattttctctgcataatgcgtaagaacaaatgatgtatttgttcattagaagttattaattgaaaaatcgtcaccggtagctacttaatcatgtgcctgttacgatctgataattttttatgtacttgaacttgttacaacgaaaatagttgcatcagttactcagtacaactgctatgagtaactcaaccaccagcgtacacatggaaggaagacataaattatacctcctttcttgttgcctttcaatgctggttttacaatcgaccagctgccattttcatccaccgctgtttaaacaggcaaacaacacaggtcagcctaagacagaaagcaaatggtaattgcatatcttttacttttcgtgtgctccctacaatttctgatgcatatcaaacaggaattccagtaggtgagtactgaatgctaacctatctctctgagaagtactgcattcgggtctgatggaggacgatcaaatactccatggacatctgtctacatctcaattttcagagtgctatgcaaaagcaactataatgaaggatgggcaacatatgcaaagagtggtgcacagaaatgtgatagaacaaggcctgtctgataagtgataacagcaatacgaacttcaagtattagaataaagacatttcatccatgtaaataatttgatgcacgcaccatctcacatacataatataaattgtcaagtcatggcaaaggtgagaaggcagcaataccagaaatacaacatattttggactcagaagctgtgcaagatggcgtataatgacatccccactcaaaatggtgcagtcctggtcatttaattataccacataagtcttgagaagtacacaaaatgtgtcatagtccagagagacctctatgtaagtgtaaattaggacatgggcgtgattcaatccaaaagctcaccagcaattcatcaagaacagcatctccatgcaaaacctggaagaaattttttatgttctttttaatgtagatgaagaaaacataagtagagctgtggaagtatgcaatgctttccctattcttgaaacatttcctgaacaaaagtttactcatagtatgttcaaatatctgaactaattcattatttaccagtacaaaatctcagctaagttggtatagaaaatgtattgcaaaataggatgcaacttagaagaattaccagtgcacataacatgtgtaatgaatatgttacatactacataaatattccagaaacgccatatttttcttacaatatggatacataagaagtgacccatataactacattacttaatataaaactttagtcgttgtaaattctagagaaataattattcaagattatgaagtacaataacttacagggacaaagccaacatggagtgatagcatgatttgagaagcatccactgattcaagctgtaagtgcaaaactggaaggtaaaaaatcaaagggcatctctgttgataggattagacatagatcttcaagaactttgcaatgtcaagtccatgtccaaagaaacagaagaaatttagttaattgtttgctttctcacatttctttgcttagtagaccatccacaagcaaacggtgacatcccaacagacggtattccttctacagaatcatacacagttcaaaaaagacatttacttaattattagctactgatgataaaccgacagcaatagactgaagcaatgcatcaagatcatataaaagatggatacatatagtggttagttcaggattaagattacataggaaaattgttcataacaaatgacaatggatccttggatggcacaacgggttaagtgaagaccgcacagtaaaattccagacaaaacacatatattctctagattataatggagcatgagtttatgacaaagtaacaaaaatgaccacatagatatcctgatagcacgaaagaaacatgattgtgattcaaatatgaagagtggtccttcatctcaatgttgtgtacctcttgcaagagctctaacaatctcctggttgagagaagtgacctgaattgtaatatgcagatcataagaattatttttcaagcatgcgcatcaaagaagcactacatatgttgacgatatactgggcaacaaagatatatctctgaaagtaagatggagaaaaaaaatatagattataatatgaacgtgaaaggagaacttcaaaaactagccttactgaaattcttgtagccacaaagccagccttcacaagtgttgaatgaagaccccctttatggactccagatctacttgcttggaagtgaccaaaagaccctgaggtagcagatgtaggtagtcagctattacaccaccaaaatcgtgggctgtatcctttaaactacaacaggccaattatagtcggccagtattacaggcatcatgaagtgtgagctattttctttattctcccctggttgcctaggactacattttcaaatcaaatctttattgatgcagtggaaagtcctaagcaggaaggatgctgagaagctggaggccatggctagcaaacttatggaagcagtctcctcccttggtcctcccagagctggagtagggtaagcactgatgctttttctgtggtgctgttggttagctgttatctgttgagttgtttagaggtgcctgagttgtcttttgcttttggtcgcttagcttcaacccctttgtatcccttggcatggtttggtttctgccctgtttctgtgtttttgtgctgaactcttgtaagtgggtctcccccaccactgtgccgcttctggctttctataaaagccgggcccgatggtctatgatctaaaactatattttcagggtgtctaccaatcaaaacagatttattcaaatatattccacgaaggtcagctacgttccgaatatagaccggttaagcaggtcgtgaacaatgtttacaattgcttgtcattgatacacattgagaatggtacttggttcacagtttcgcaccaaattttcacttagccgtagtagtattctgaaaccaaaatacagcaatcaagctgatcctatcgtctccagatcccaaccgaccaccgatcccccagttctgctcatgaactcatcagcaatacaaaatgacagataggcacagttgttagttcagatgaggagccatgcataccggcaccatggacgacgacgaagttggagtcgagccccaagcctcccatctccgacaagccctccacatccacgaccgggccggtcggatcgccgggccgtctgctccagtccatccccacaaccttccccgccgcgccgccgtgggacatggcctgccgcagctgcgcgcacgccgaccgcaagctcgccgcgtcgatgctctccagctctcccttgttcgtgatggccgctccacctgcgccatcgaagctgctaaagaggagcagagaggaaacaagggagcgacggagcgcgcgcgagtaccgagtttgacgatgcagcggacggggcgggaggcggcggggtccgtctgctgctcctgcgccgcctcctccgccatgggagcttcctctcctcgacctcgcgccggccaaggcctcgggagggagaggcgaatctggtgctgttcagtggcaaccggcacttctggattgcccagaaatgctgggccggtgcttcgcctgccgctccggcccatcaaagcttttccatccgctcgcggaaattctcggcccaaacctgctcggcccgatccgtcgccaacaagagcaaggcacgaaaccgcaacccttccgacctcaccgtctcaccgccgcatcccgctcgccggtcaccggctagacgccgccgtcgcgcgggctcctgggttgccgtgtctccatcgcttccttgttggcctgttcctgcgagcttcgccctctggcttcctccctgttcgggatccgggatcgtgtgtctgcctctcggctcgctgcgccgccgccgccgccggctcgtcccgtctgtgtgtgtgtttgtgcaggtcagtgttattttgtaattttactacgagctcagattcgtatacgttttaattttgtgtgtatgtgctactattcaacttgcatctgttcaagcgggtgacagtgttatgctgttgtacattagcattgtgcatttatgcatgcattttgtttgagcattaatttgtgcccgattcagtactagttttcctgttagtatttaccttttgtctctgactgttctaggattctggcttaaaagggataatctatgccgtcgaaatcgtggcatcagttgtcattcaattcaatccccttgttgattcatgtgcttgcagttgaaattggagtaaatatacaatgaggctgttgaaagcggatcagttgttcaggaaagtcattgacggcgggtggagaaagcaatctcgactgcttgggcttgacgttggtagtaagtatgttgggctggctgtttccgacgacaaaaataggatcgcattgcctctaaggtatgcacttcaaactattgtagctgaatattgtgttccttgatccaaaggtttcactgagatagtgagatgtttccagaacatatttagcacaagtgattccagtgtgtccataaaaattagaacatcactttctatgtgatgatttaaatgcaggcggttctatattccattcctctcatggattagtaggaatgttgagtttccaactcatttcaatggatcggcattttttgttgtacttcattcaaatcattatcatgttggattggaatcttccaactatcagaatttgtttcagtttgtatggtctctggcttttgtaagacagtctattattgtgctgtgtctgttgtattaggtccttctctttgattaattcgactatactaaacttcggtttgttagaaaataactgtagttgccttcaaactttaaggaaaattatttgcaatttacaatatatcgatacacaagatcttatccctactatcatagtgtacctttattatttttaaaaatattagtctttaacatatttaagccttataaggcttttcttcacgagaaattcttcacttaccattgttaagatggacggactgcacttggctaaagctgatatccttttacctacctaagcactcagacagagtggatctagatttgctgaagtatgcgtttatctagaattttgtggtcattgtctgcactgctagcataaggttatctcaggataacacccctgttttatcagatattgactctcttgaatttgcaacaatccacctgcctacctggttttttgtggccaatactatgatagtttagtgatgggatatatgatctgcatgcattcccttaaagaaatggattttcctattgggattaacaattgcattgtctcctacagtgtattgagcaggacaaagacaaacatcagcttgatggcggatgatttcgtaactttggtatgctgaatatgtttactgacatttaaattctggagtaatcagattgtagaatcacttaccaaaagatcgagttcttaatatgccatgtaacatcatcctacatcagatcgagtgcttaatgtgccatgtcacatcatcctgcatggctgcatcgcatgcctgcatactgcacaagcaattttgtagcatgtgtgttgaggttacgatgcatttatggaagccagggttacaggccttctctaatatgctgttctttactgctcaatttactcatgtcatttacatttccaaaatactcgagggtgacattgtccacaaagaaatcataaatgatttagcaatagaagttacagacagctcatgatgcatatattctttcattttagattctggtgaacatttaaaagcactcatgttttgctatttttcatacatggaagccaattccttttctttgtttttgtgaataggtctcaaaatactcccttgcaggctttgttgtcggctatccgttcaacttgcagggtcaatctagtccaaatgtaaagtgctcttgtgctgggagcctgggatagtgcacctcattttctcactatatgtttggtgatgtttcctttttctattaagcaggcattacaagtaaggcttcttgttggagagctctgtaaaactgggaaacttgatgatatgagttacacctattgggatgaaaattttacctcgaaggtgatggtacttttttgcccattatctctcaaacatgaaactacatattagcatggggtgcattactcatgtgaccattttatcctacttttcaagtacttttttatggtgaagtgttttgattgatctgtttatgtctccagtgtgtagaagcccttttacatcctctgaaactacatgacccagttgaaaccaaaacaatgacagataaatttgctgcggtttgcatactccaggtacatacaacaaataccaaatgacgtcattgtagacttcgttgtttcgattatgtaattattattgaaaaccagtactcatagttcatttagctgaacatctgcttagtgacattgactatcatactttgttttcctaaaaagatttttactttctgtgcagcgctacctagataatatgaacagagaattgagatctgcagataattctggaaaacagggtgacacctgagttccacaatgcatatattattctgttcggtgcacactaaaccaaagacaacggaatcagcatctgttcggtgtactgctgccttagtgtactgctgccttatgaaaaaggctgtgcagttcattgagacatgtacaaaactctgagtttatgctctcgtatacgcctgataagttttgtagatgcagacttgcagagctgacaattcgtcagctagcaagggcagcttccctgcctgcctgctagaggcaatttgttgtaggtgatgcacaagtactaggaatcttttcccccttcctttattttcttgcttatgaggccattggcaccgaaatgcctgcttatgcgcagcttgaacaatctcttccaatatgattgccgagcatgcgcgtgtgtatatgagcctctattgtgtttcgggaaaaaaaatgattgccgagccaagaagatgcaatcaggctgtcgagtcaaatcaggttgataatggcgtgctgcagccagattccatttcctatgtctgcatgcgcatgcttagacaaaattcaccgtgatgttaacaactcatgtcattcgacgacgggcagcttttgatcattgtcacatccctgatacttgtaaatcctcaataatgtttcctcagttgtgcatatccgtggcctgcaatgctccgtgcaattgttgaatctgtttccagaactgatagcgtaaggaattgtatgaccatgatccttgctgtctggttgcaaaagattgaaaattctactctacaaagcaagttaggctgacagagaatcttgtggatgggatgaggtaagttcacttatccaattagtttactactctataggagacaataggtgaagaaataggcacaagagctaatgtgcagacttgtgctgctgagatcgtttcagacttggacaaacaatgctatgtggtttacatggactgcgagtctgcaacagataaaatcaccaatctacagctgtaatctgcattgtccgtttcctagggttagcgtaaggaattttccgatgtttctcccaggatctcagtctcagtggctgagatcgctgctactacctacacatgcaaaagatcataaaattcgattctatcaagtaagttaggctcatgaggaagtttcagaatacaggtaactacacaaaggagttaaacacatcacacagcacaaaagaggagaaaaaagagagaaaattctgaggtggtaggcacatcacagcacagcaattaagcatgaaacataaggggagcaagcaggtcggcgcagccacttgtcaagttaacatagctctcacgtatgcctgcctgcttccatgccaaaagtctactacactacagctcaagctactatgtatctgcctatctcaagagcaggagacagtggtgagcacagcacgaaaccaaggtagccgaaccatgcaaagtcaacacagttgacaaccagcaatagctttgtgcaaaagagatttggcagccaaggaaagacaggtcaggagctcacatcaccattggaagtcagccactgatcgtaccgttgttatttttagggagccgtactgtctaatcagggggagaagagctgatgaaggtgtatactggcacgttggagatggcttgaaggtaaagaagacggctggttcacggtaggtgattcggtcgagcagccaacggttttggaccggaatgcacgagctagctcgatcggcattctcccttttattgtttatatattttcccggttgtttgtttgtttgttattccggcgatttcttgaccagagataagcagtcgtttatttcaaggtctgagtctttgacaatttgtttgtgtgttgattttgttttggaaattgtagactttgactgaaaagaacgaggttaattaatctcgtaatccagtcagagatgagtaattggcatagcgacggcttgcatgaaattagaagttttgttaatttcatattagcaactaatacgatctcctgcctgtttgcactttgcaggaggaaaattcagcaagagtaggaattggaggcagaagttaagcacaatgtagcatatatggagttatggatcaggaacacgtactctccaaaatgatattcagccacatatgcatagtttgtcctatttaagcttccatgaatactaaatataatatattttttcggtgcctacgaaaataatcaaataacgacccctgttggagtattagacaaaactcatacgtggttagtccatactacgtgcgcattattggctgatggccatagcaatagcagaacatgtccatacactgtacatgaaaatcgtgatcgaactctgttccctttactgttgggcacctgcagctgcagtatctactataccaccaaacagtactacccgtctgcatccaacgtgcaaacttcggtttgtccaccaccgggacatgtacctcgtgtgacagcgacaccaccaagcgatcgatcgagagcacgcttgcggtgaggacgtgaggtcgctcgcccggatgagtacaggggctcgaggccaaggagggggggaaccaaacgtgtgacgggaacagcaacgtctcgtgggggcagccccggtcgagccgaggcgcgctggcgctagctagagtccgtagcgtttggtgatcgatccgacggcctgtctccccgcgcccacgtcgtcacgcggtgagacgcgggcgctcggtccacacacgcgcgcgcgtacgtgcgtgcgccatggccaccatcgatcgcggccaccggctgggtgatagccggtgcgaggggaaatatccggaaggaggctacttcctctgtttcataatgtaagtcattttagcatttttcatatttatattgatggtaatgaatctagatagatatatatgtctagattcattaccatcaatataaatgtgggaaatgctagaataacttacattgtgaaacggaggaagtactatattacgagatctcattcgagataatatcagatatattgatacgatgttaaatctagtatcccatactgaaccatacccgttaggtctcagttgataccttattagtaacagaccgacacctatcgatactaaactttttacccattggtataaaccaatacccattagctatcagatctagccgagagaaatgagagaagaaaggatggagatggtagaactatgatgctctccatcctccctcaacacgaaatgaatatgacaacgatgtttcccatcatctctctgcggagggcccgccatagacgaggccgacacggagcgacctcccgtccgattcacccaccatccctcatccccccccccaccctccccccatttcccctcccactcgaagagcaacgcgtatagcagagaaggtgttcggtgcaacgtaaaaattgggtggcgaccaaggcgagcacgtggcgtcatggagcgagggcatgaggaggatgagtggggtggagcgaatcgtcacgcgaaggataccttcctatttcctaatgcatgggtacataatcccaatatatagcttcatttgttttttttttctcccaaaacaaattgagtctggatttgaaattttgtcttagcaacttaggaagaaggaacttgaggtttttcaattcttctctcgcatgtccatgcagtattcgaatcgatcaagcttaaaggtcggttgtggtcaagcgtaggcgtcgctcatctaggagtcttgttgggaggatcgtagtactcttttgatactttgccagtttcggtcaatggtttcggagtctttactccctttagagttttcttcttccctagtcgtttccttgtgttcccttaacaattgtctctggctgttgtattgtgtaactgaatttcggctttattctaatatattgacgtgtatttttttcgcgtttgcgaaagaaacgacttgaaattttgtggatgttattttaataggaactttttaaaattttagagagcttttataacatggtccacggagtttttcatttattcgatactccgtattattttttaccggatattttcccgggaggagaccctcgcgggcttttgtcatgccgctgtcccttggtcccgaggccgcagagccgtgctgtcccctccctccgatccctctaagatcgatcggtcgctcgaggccggctacgttagtctcgcctcgatcgatcggtacgggtacactcactggctcaccccactgcaaaaaagtcaggattcgacgcttcggccgattatcaccttgcgatcgatcgacaactcgggggttgtttcacgtgtacgtgttgagtccccgttcacgcgtggactagtcaggaacaggatacactacgtactacgtacactcagtggccttgacaatcagagacaatgtactaagccattcgatcacacctgcatgctgatcagcgagtcgatctacgactctctcgcccgttcgtcgtcgtgaccatggtggattaattagacgtgcaaattaataaggcgtcgctgtccagggtgccgggtgtcgacggcgacccgtggggacgagcggtcgtaccggagagagaccgtgccgcgcgctccgctccgcgcggagcgtggcgtggcgtgctgccgtccatgcacacggcgacgacgacgataggtgcatgcacgcacgcacgcacgcgagaggcgctaagctatagcccgctgctgcgaacatcgcgcgcgctcccgcggcggcggcgcggtggtattcggtcttcacgtcatggtcgatcgcgcgcccgacaccgccacgtgaacgatacgtcctgccgcgttccgtgtgtccatctctcgtacgtagcgccagcgtgcgcgtgcgtagcataggcggcggtagacggcgtacgtcgccgtatagcagcgcgcccgctcgcgcgtctcgcgtacgtcgcctcatcgcgtgcgtgtgtggatttagctagtctcggtagctcgatcggtctcgcgccgaatcaatcggagtcgtagcgtggcgcgtcacgcacgtagcggtagccgtgtgtctgggtccatcggacacgatcgatcacacgatatatgctactatagagaagctagatgcggacggtcgggctcggccatctttcgttttcacggggcgtcgttttgatcaggattcggttcggacctgacgacatgggctagctactacacagtagccgctaggcgtggatcgaaggatatctttgatggatgctataccgtgctacgagctagcgataggattgggggagttgtgatgggcaggaatgaaaagggcgtcttctttgagcgtagaggaatcaggcgtgtctgccgacagggtccaagcttgatctttgttaatgcgacctcaaattgtagcctgtagaggctggttcgtcttgctaatgttaactgagacatgcaggacgcgatagcatttgccgatttgcgtgcatcggtgcatgacaatacctctctctggtctggcttcgctggcaatgcttggctattgacgttaccaacgccctaacgataaggatgctctcttaattctttacactttgagatagagtacaatttttttttagaacatgagatagagtacatgacttctcaatgtaagactctgttcaagataagttcatctgacattagacggatgatgggtagagcgtcacctcaacttacaaccagggttttaaatctctcgttatagctgtcgctatctcccgctatagctgtttgagaagggttctagctatttactctcatgtacaatttagccgctatatctttatttagcccgctatagctgccgctatagctatttgagaagctaatcactaaatgccttagcctgctatttaaaacattgcttacaacacgttctttgaggactcgatgtcttccccctgcgtctacaacccggagctttttccttgcgctttagcggcggccaaccaaaaatgtgcaaccgtgaaataggcagttacaccgtactatgtgttatgtctacagagagattgaaaacaaatcaccatatcttgtcggagtacaagataggactggcctccctctcaccctgtcagaagcttcgtttcaagtatggtgagagtcctctcgcggcggttacagttaagatcaaaattggaaagggttcaaccccttcgttctggtggtactggcaccaattgttggaaataaacactggcgtatttgaggggatgtttttcacggtgaacactatggtcaatcacatcgtgcaagaagggaagctttggttgtagcgaaacctagtcccttatgaattccttttggcagttagaattccttatgaattctctttttccttgttgctttaagctgatcggttgcctttctttcttagttagcctagtgtgctcttcccctctcccggtaaggcggtaacccctaggacttgacttagtgggtggcagttataaaaactgttttttcttgctaatatatcgttgtgcaagccttgtacgggtttaaagaaatactccctccatttattttttatagtcatatttcgaaatctgaaaattttatttttgattggcatatttcaatccaacaacctatcctcttaatgattttgtcaaatttaatgcgtgactctccattcttccacacatgattggctatatgagcattgagaaatgtaaatattaattaatcgcttgtttacgaggaatgactagtagcatgtttaaatggatgataagtagaattacttattcttggtctatgtgtcaagatgaaatatgactatcaaaagtagatggagggagtatcactttgaataaaatttagtccaacttagagatcccaccaattaatttttttaatgcttcgcctaaaaatatagaaaatcgacaccaatatatttgtctcaaaaattaccgtcgtaatattaataaggttttataatatattttattataaaactgattttcaaataatatgaagtttaattaaatcttatttaaaaattaaatatttatggaaggggagtactactacacattatatacaacctatatatatcatcttcaattcacagagaagttacatcgtctcacttgttaattactactccctccatctacgtttgatagtcatatttcatcttgacacacagaccaaggataaataattctacttatcatccatttaaatatgctaatagtcattcctcgtaaacaaacgattcattaatatttacatttctcaatgcccatatagcaaatcatatgtggaagaatggagagtcatgtattaaatccgagaaagtcattaagatgatatgttgttggattgaaatatgcctatcaaaaataaatttttcagatttagaaatataactattaaaattagatggagggagtactaattaccactcgacacatgtccagacaccagaatataggccaagaaaattcacgcacgggatggactagcagcgccgtcgtcttgctcaaccaccgccagttgcagcttgcagcactacgaatgaaatcaactcatcagtgacgacgccgtcgctgaaaaggctaggcatgatgagagaccagccgatttttttactgtaactacccttctttatcgtaccggtccacttcagggaacctccaattatgcccaggaaagcagagacagtgctgccacaaagtcaatctagcgacatacgcgaatgacttctaccgggctaatcaaccactagctttttcatctaccgtttcgaactaattgaacaccccttagggcacctgcaatggttatctataggctctctacaagagatccatatcagcatattttcctacttggaagagattaaatgaagagagagagcaaagctatctactaacctagagatagtctatagagaaaaacgagacaatgcattagagagctatagatacccatgtagacataccattgaggtggtttactattaatctagtctattgctgagatgcacatgttttatagagaacaccttactttaccattgcgggtgctcttagctagctactcctacctcattcgttcgatcattaattagctaatggataagtcgcgctcatgaacacacggctgcagccaatcacggtgctcacgtacctgtccatgttgacacatgcatactgaacactatacataatgaggttaataattatggttacgccttaatcttgacttgtgtacatctcagtgcgtgattaacactgattaaatatggtgggttgatgggatacatcatacttacatcaatactgtagtgtgattgcgaagtcatgcgtgcatatatgactccacctccagagtttaaatcttgatgccacaagtagtatgtatacatgcatgggttggtaataagagtatatttaatgtgtttcttgaaagaattttagtagaatatgcatctttaatcgtgtgtgttaagagatgtgtttgtgtagtggcggatttacaagtttccttgagcacgagcaagcttaacagctgctgatgtaacctccactaaaagaagcaaattaggcactgttattaagtgataatccactggctaatgcgggggagcccaggcacatgcccatggtgaccgggccttcactccaccactgtatttgtgaatgtaggagtacgatgttacatgtgtagtgtgtaatttatactaaaagaatgtagtgataacaccgtatctactttcattgtaaactagcacggttgcatttgcagattgcgcggctagtatcattatattttctctcatataatagcatatatattttttcattatattattcaaatatattaaaatgacaacataattttaaattttgcaataactttacaaaactactaatgtgtactattcatattgtattttatatacgtgttagttattaattatttttaatatcaaatttttgttatttgtaaatatatatatatatatatatatatatatatatatatat

SEQ ID NO: 64032 - DNA, 19027 bp, Oryza sativa
ccccccctccgatctcgcggttccgcgtcggcgattcggcccccccgccggtgattggatctcgccggcggccgagtcgtcgcggctaaccccgcccgtcgtcctcgaggtctcgcgcggcggacgacatcttgacgtcgtcgtcgtcgtcgtgttcatcattccctcgggctaagtctggaggagtagcgtggagcggagatccgcccggacctggattgatttccttcgatggtaaggaagccctagctttgctgttccgttgctctagagtctagactagacgcgggtgatattaccctactgggtactgacgctgatagcacctttttgatttcccacactattttttgagttctaactatgccccacgttaggtccgcgcccttggatagttaggctgtttcagatgggaaatgaggacgatgttctttttgtcccgataaattattattgtgatattattccttttgatgaaaaaaattattgtgctatggacgttgacctgtgtgttgctacccttaagatcaagtgaccaatatgccacgctcttgttcgcgccagaaaacggtttgctatacaactgctgtaatgaatgtgggatgcatgggtttcgttgacattttaggtataacgctatttttcccgcgtcgagcaatatgcagctagcgtttgatggcataaatttattcctgcaggcggctcaagctaccattgtggtgggatcccaggtttgggttgaggatcctggtgttgcctggatcgatggggaggttataaaagtccatggtgacacggttattgtcaagtgttccaatgaaaagacggtaagttgttcataagtaattaggttttgctatagtatgaccagctggctactatattattgctagatttgtaacagctaggcagctaggagagaccatgtaaagatgagctgaactgaccttccataatagcggtatttacacttaagttcaaatttggtcgttttgttcaggttactgttaaaggttccaatgtccacgcaaaggatccagaggaatcaccatgtggagttgatgacatgacgaagcttgcttatcttcatgaacctggggttcttcagaatttgaaatctagatatgacatgaatgaaatatatgtaagtcttttacactgacataatgtgactacgcttctctatatgtttttaccaatgctaccattttaagtgcagccatcattcttctctaacgcatgttttcaacttatttgtgttgaaaccagacatatactggaaatatcttgattgctgtaaatccttttcgaagactgcctcacctgtatgatactcagatgatggaacaatataaaggggcagattttggtgaattaagtccccatccttttgctgttgcagatgttgcatacaggtaggctcattatgatatatatgttgataactacaaggtggtctacgatttaaatgggttagcttccataaagaacttcttttctcctttgagctctactgtgagaagaatgtctttgattactggtgtagattgatgcttaatgaaggaataagccagtcaattcttgttagtggagaaagtggtgctggcaaaacagaaagcactaaaatgataatgcgttatcttgcgtacatgggtgggaaggctgccgctgaagggcgaactgttgagaagcaagttcttcaggtgataatttctgagagccacctaattccagaaagctatttccataaccatctgttgttcctcttcaactgattacttcatattcatattcctctcagtctaatcctgtccttgaagcatttggaaatgcaaagactgtcagaaacaataattcaaggtaggaagcattcttcatacgatcattatgattcaatatctgtcactcaaccaaatcttcttttctctgcttttattgcagtcgttttggtaagtttgttgagatccagtttgatcagaatgggagaatatcaggagctgctgtcagaacttatctcctcgagagatctcgtgtctgccaaatatctgatccagagagaaattatcattgtttctacatgctttgtgctgccccacccgaggtgctgccccttgattattcatgtccttctttgattagacaaatttatgtaaatagcatcactatttttacatgctgcttacactatatgagctgttatatatagtccatttttcagtttgacatgacaatagcaccatcctaaatgttaccacccaagataacctatctagaggcttatctgtattatttgggaccaatagattgacagtttgatatactctttaaatcgattgattcccaattataccacaacttacatgtcggtcagcatgaaggaataccgtttcatatggcacacactgtggtgtgaataaaatgctttattaagcttaaaatttccagtttcccttgctgaagttctctcttcacgttgtatcctgttctctgttagattgataacagttatgaatctaattttggttcatgaaaaccttccgtcgacatgttcctctagaggttcttctccactttgtagcttcacaaaatactaaatgctgtaagcctgtagcagcttctgcagcctaaaatactgtgtttcatatactagtgctgaatgattcagtgttccatctacaggagcttaagagatacaaactgggagatcccagaacatttcactatcttaatcagtccaactgctacaagcttgaaggtctagatgaatctaaagagtaccttgaaactagaaaggctatggatattattggaatcagttctgaagagcaggtatgcacttggttctataattattaacacataccattttttaattacttgaagcttatttacccttctcaaactttacctcatgtttttcatgatgcttcaggaagcaattttccgggttgttgctgccatcctccacttgggaaatgttgagtttgctgaaggggatgatggagagtcatcaaaacctaaggatgaaaaatcactgtttcatttaaagactgccgctgagctcttcatgtatgcggtctttggattccttttagaaactcttgaatgcatacacttatctcacaagagcctcaaatttggtcttgtaggtgtgacgagaaagcacttgaagattcattgtgcaaacgtattattgtgactcgtgatgagaacatagtaaaaactttggatcctgaggctgctaaggggagtagagatgcacttgctaagactgtgtactcacggttgtttgattggtgagtcagttttgaagttttgcactggctgctaatggttgtttccacacatattttcaccttatgctcatgtgtcaaatgacctttaatcttaggcttgtggataagataaacaaatctattggccaagatccaaattcaaaatgcttaattggagtgctggatatctacggttttgaaagcttcaagacaaacaggtgcttcactggtacgcttttgatgattgattgcatgttagttgtaatcttgtcaacttattggccagcgagaggaaagctgttgggttagccccaatttagttcttggtaataaatggtgggaatttggcttcacgccttactatgtgctgttcagggcatggcttctagaaacttttcgtcaccgaaacacttggtcccagttgtactagaactaaagctatggacgcatggaagatgctacactcctgggcttttcctttgatataggattacatgttaaagattcaggatggctgtattttatggaaaatcttaaatattgcctgcaatatttgccttgaatgcagcactttctctgaaacatttcctgaagaagtgcaaaatgttggatccagagtattgctttttcatgtttagtgtgatcttactgtttcaaaaagttaagataggtagtagtgaagtagattctcagaactattgttattttaggttttatacactatgttcttctacaatccaagatattaccacattttatcgtgatgcatgggattttttgttgcttgttactccctccattccaaaatataaggcacaaccacccttaatccaaagaccaagaaataattattatcatcttgtagtttggatcatgctaataaatacaatgcatgcatccaatagaattagaggatgtgagagtgaaggatttaaagaattaataatttaatggagaagatgtcatagttaattgcatgcatgcttgcatgtatgccttatattatggaacatataaaaaaagtggttgtgtcttatattatggaatggagggagtaattgtttcttgatttttatttatctgttttttctattatttctctctaattttatgaatttattgtagttctcatatctaatgcatatttctcttgatattgatagtttcgaacagttttgtatcaacttgacaaatgaaaaactgcaacagcacttcaaccaggcaagttttctgttttttgttgttatcacctacgcgttcatttctgctgacttatattttttttaaaaagatatttccaactttgaatttcttcttttctgcagcatgtctttaagatggagcaggaagagtacactaaagaagaaattaattggagttacattgagttcatcgacaatcaggatgttctcgatctcattgagaaggttgctttcttggccttgaatatatatatttctcgaaccttgtgatatggttacgctaagacaaacctcgatgaaaacaagattgctctctctctctctctctctctctctgatgaatttatgtggtctcgttcaaaatcttccttgcataattttaccaaatataatcgtagatgcaacagaccttgcaagtagcaagcaaatgtaagtgctgttgctactataccttagctccaattcttggatatgcaggctgctactcgtatgtttttttttttcgtgttactgaaactcgctggtgatgtcatgcttttatattctgcttttttttttccactcccgtctaagtatttgattattcgttcacagaaacccggtggaattattgcccttctagatgaggcctggtatgtataactgataataaatcattttgttgtttatgctggtcttcaagcatacagcatttcagctttacaagaaattgatctataaacatgtgattttgtgttacagtatgctgccaagatcaacacacgagacatttgctcagaaattgtaccaaactttcaaaaataataagcgctttactaagccaaaattatcgcgatcagacttcaccatatgccattatgctggagatgtaagtatgaatacctttactttctttagttttcatagttcttttgatcaaatctaagttggccaccttttaatttgtaggtcacctaccaaacagaattatttttggacaagaacaaagattatgtagttgctgaacatcaggcccttttgagtgcttcacaatgttcatttgtctcgggccttttccctctcctctctgaggattcctcaaaatcgtccaagttttcatccatcggttccaggttcaaggtgcataacaagtcacataaaattcttcatttggatgtctattgcttacgattgttcatacttttaatacatatataatgcaatacagcaacaactgcaatctctcttagagacattgagtgcaactgagccccactatatccgctgtgtaaagccgaataatatactcaagccatcaatattcgagaaccagaatgttcttcagcagctaagatgcggagtaagatttcctgtttcacatatttttttgcttccaagttccaacttcaatatttacattattggcttgtcctcagggagtaatggaagcaatcaggataagctgtgctgggtatccaactagaagaactttctatgagttcatagatcgctttggtattcttgcgcctgatgttttgagtggaaggtattaccagtgttaacctgtttctttgttcagtttgttgagcctacttaccgatgtgagtttgtgttcattttactagctctgatgagattgctgctgtaaggaggctgttagagaaggtagatctgcaaggttatcaggtaatggatgttacacagaaagtagcttttgcattgggtgttattgatctgtgataattgatgctcagtaagtagtatgctctgttgccatattgttgattactccttccatccacaaatgcatagctttttggacaaacaattacttaaggcatcctcattctggtacacttatataataaactctaactgctgttgttgaaacagcagtgtctagcatctcagaagcgttggtccattgtggttgaggtgctaaacaaactgtactgaaccagaactactgtctgagtgtctgtattaagtatttggagccacatagtgtcgtgttagttataagacattaccacccgttgatcattataattcttaacattttttataaaaataatgcctcgaagtgcaagaattgttctctcctatagaaatatctacttgtgtagagcataggctgcagcagagctgaattgtttagaacaggatgtaacatatgcattgtaagtgaatatttggaggtctatctttaccagtattgatatgtggactaaactgcatgccttttttcaaatggattatgtagattggcaagacaaaagtatttcttcgtgctggtcaaatggctgagcttgatgcacgtagaaacgaagtgttaggacgttccgccaacatgattcaaaggaaagtccgctcatttctggcacagaaaaatttcattaaactgcagagatcagctgtacaactgcagacgatttgtcgcggtgagattttcatttgttattccaaattgaagcctctatgtccccagttaatttaaattttgttcatgtcataaaaatttctgacatggcttccctttcatatttaaaggggaacttgcaagaaaaatttaccagaatctccgcagagaagctgcttctctcaggatacagacttgctatcgcatgcatgctgccagaaaagcatacaatgaactttctgcttcggctgttactatccaatcagctttacgcgggatggttgcacgtaaagagctccatttcagacaacaaacaaaagcagctattgttatccaggtaaaactgagaaataaataagcttgtttcatgtgtgtgtgagcacatgcaaatcgatagtagcatggaatagtaatcaatataagtattatgattttctctccttatatttaaggttgatatttgattgacagtcatcgatagctctgaaactgcagggaacatgcttaggttgcatagattttttcttctagtcttagacttaagttgtaatgctattactgcctggacaacttcctcagataggggctagataaactgataaaaaaatatgaaatctaagtttcattgggaggtatagtttatgaaatctgtggtttagtaaatagtaattaagactagaacatacttccattcacctttgttagtttcatccttgaattcaatagctgaaagcctgtttgctatgcagagtttgccttttagactacaaacagtactccccgttgaatctttctccaaaatatgactaactgtacatatagtgcacatatagtccacaatactaacatgcagacaatctgcaataatccttatcagatcctatcgacgcttttttcttaaactttgtacttgttcaaatttctatttcagagtcgctgccgtcagttcttggcaaggttgtattattcaagaacgaagaaagctgccattactacacaatgtgcctggagaggaaaggttgctaggaaggagcttcgaaagctcaaaatggtaaactcaagcacaccagtcatttgttatgttctatctatgctatttcgatgaaaccatgttaaggtgtcccttagaaattttggtcaagaaaaagtttcaactggcccatttttttgcaacttctggaacctttatattgtatgtaggatagtgtacaatattgcacttgcagttacagatgttttgctatactgctgtgtacatttctcagtacatggtatgtttttataggccttagtactttgcctattacagttctctattgctactagtgcgaaagccccctagtgatagtgggatatatcaaggaccagcttttcttatccattttcattgcttatcaggctgcacgggaaactggtgctttgcaagctgccaaaaataaattggaaaagcaagttgaagagcttacatggcgactgcaattggagaaacgcatgcgagtgagtttatttctataaattctcttgttaatgtaacttgaagaatactggatggcattgttacattgttttctggggttgaaacaccaatctgtactctacgtgctatttaacatacacaattacacaaatatgatctcatggttcatggttgaactggctgtttggttaccttctacaaaaggactcagcccataactaattcactatattggtttaagcactcaagcacacagctgactgtccatgaatatcaatatatatatctttctgtccatgatatgagtgacctatgcggtatattcaccatatgacctaatagacatctgggaaatggcaagggagatcttgttcttccctggtagtaaaatgaaaaaaaaaatgtatagttaacttgtgataccttattattacttatgcatgggtctttgttgtaggctgatcttgaggaagctaaatcacaagagaatgcaaagttgcaagctaccttgcaagaggtgcaacaacaatacaaagaaacacaggaaatgctagtcaaggagagagaggctgccaagaaggctgcagaggtggcaccagttgttaaagaggttcctgtcatagatactgaactgatgaataagcttagagatgaaaacgacaaacttaaggtgagacctgatcatattctagattctcttttttgtctgccccattgacaaggaaatgcattttcttatttcttaggacttatactataaaataaatctaatcattcttaaagagatttgtttcctgctgccattctagctccatgcgatactacctctgctatggatataacacttgacattccattactgcagactctggtcagttctcttgaaaagaaaattgatgatactgagaagaaatatgaagaaacaaacaaaatcagcgaagagaggctacaaaaggcaatggacgctgagacaaaaattgtcgatttgaacatggcgatgctaaggttgttccattttctgaactcaactttattgtagaagtacagtggttgacatttctttttgttattctgcttcaggcttcaagagaaattatccaacatggaatctgaggagaaggtgcagagacaagcactgttgagctcgccagtcaagagcatgtctgaacatctgtcaattccaattgttccaaaggtacatgtaatggcttgcacattggttaacttttgttccctctggctgaaatgagaatgttcctttactcacatctcccgctttcttttctattaatcagaacttggaaaatggcttccatgaggttgaagatccaaaggtttgaagttttccaccttaaatattccttttgttttgaaacttaaattttctgtctatggtctcacaagtcacaacaatctgtcattttcaggaaccccaaagtgcacctcctgctattaaagattatgggaatggtgatccaaagttgaggaaatcttgtgtcgacaggcaacttgtaggtcaacatatttattgtttaaattgctcatacaaaaatggttacttgactcttatctttctgtaggaaaatgtcgatgcacttattgactgtgtgtcaaaaaaccttggctattgtggggggaaaccagttgctgcttttaccatatataaatgtcttcttcactggaaatcttttgaggcagagaagacaagtgtttttgaccgccttattcagttaataggatctgcaatagaggtaatctggaacctgtattgtggtctttcagcgttacttgagccagaagtacaattagacttcttttatatatatatatatatataaatataataagtggttattatttgaaaatttaatctgagatcctaccagcatcaaaacatctctaggctttatctttatgttatataaaagtagagctgctctcttaacaagtttccaatttcttttacaccctacattttccactctactactctagttgtctagaagttattctgcgcttgctccattttcctcaaggtattggagcatcagctgaagtagcaatatgccacttctacccttgaatgaaggcaaagccatttttgctaataaatcaaacaaaaaactcaacctgtagatgcgtgaaaactggcatggttttggaaatattacaagcatggagatctaggccacttcttagtacatggaagaacatgctacttatttggtccaacattttcgttttttccaataaagtagaagaaaaactaaaaccctttcagattcttgaaaactgggatggtacaggaaagacttgaaaacatggagagagaatcaacttcttattacaccaatctaattggtttttgttttctaaatttgtattcctcagaaatcaataatgacgtcactctgttctctggcatttcatttattccaatccacagtttatttcagtgatactgttttgaccttaaattgtaatctgattgaattttggaagttggcaagtttctttggcccccagtcagcttacgttgtgaagcccttgatgcagaatgaagaagataacgataatcttgcttactggctctcaaatacatctagcttgctgttcctacttcagagaagtctcaaagctgctggtgcacctgggagtgtttcacgaaagaaacctcctcagccaacatcattgtttggcagaatggctcaagtatgttactttcttttccatgcatgaaaagtggaaggaaataaaatggaaaatgtggtacgggctctgataatgtaaattcacttgtctagggcttgcgatctgcatcttttgtcaacatgcatgttgaggcaactgatgtcgtccgtcaagttgaggccaagtatcctgccttgcttttcaagcagcagttaactgcttatgtggagaagatttacggtatcatccgtgacaatattaaaaaggaattatcatctttgatttctctgtgtatccaggtatattttccttttggatctttgctgtttgttgataactggctgtaaatggattcattgtttaccattcattttgatctttgttaaccactaggctccgagaacaatgaaagctagcatgctgcgaatgtctggacggttatctggtcaagctcagagcaaccattgcagagaatcatcgagagcttggatatccttttgaagaaactgcaagataaccatgtatgtgtatttctttgtttctatgcgattcacttctgttggatgtatgcgctaactgctgctttgtttatcctcaggtacccccagttttagctcagaaagtttttacccagatattctcatacattaatgtacaactgttcaacaggtgaacctatatttcaagttttgtttcttgtatgccgggaaacttgcgcagtacatgagtacatgaatgttttttgttctgcagtttactccttcgtcgtgaatgttgctccttcagcaatggagagtatgtcaaagctggtctagccgagttggaattatggtgtgcaaaggcaacaactgaggtgatctgtctgtgtttgaacgctagctttccctcctacatgattcagtttactgaagctccttcatttttttttcatacagtatgctgcagcatcctgggatgagctcaagcatatcaggcaggctgttggctttctggtatgatgtccattctgcttgtgtatatttgtgttgaggtttggcaccaataaaatgttgtagttttgagaatgttatctgattgtccgattaatcacgattaatcgtcctgatcgctcccctacctccgatcaggcacaggtaagtcgatcagccgatcagaaagctgatcatccgattaatcgatgattagtcgcaattaatcgtccgatcagggtggaaaacgatcagttcatgggctacctccctgagaaaatataattttgggcctgccagcccagcccatgttccattttgggcagatgacgggcagcaaatgatgctgcttcttcttctttgaccaaatgatccttgctttttaccatatactacagactatagagtatttagtatataatatatagcatatttggcctgctggacactcttgctatactaaccgatcagcctcgattaatcgccctgatcgtcctggtcggtgcctaggcgatcagggctgatcgcccgatcagataacactggtacttttgacatcctatgtgcatgagtggcatcctagaaccttgctttatttatctttggctttaataagcttcatagctttccatgaataaagcaaatgataattagtgttaatccagactgatgttgccctgtgctgtgtgtaattggcaactattaatacattttcaatactcttttcaggtcatattccaaaaattcagaatatcttatgatgagattgtcaatgacctatgtccggtaaaatcacattaaccgcacttttcaattttgtcgagcatcttttctgtttttgttccttaagcaaattggtgctaattcatgctttattgttgatatctgtagatcttgagcgttcagcagctgtacagaatctgtacacagtactgggatgacaagtacaatacccagagcgtatcatcagatgtgagttccattcgttaaaaaaaatcaatatacaattatgcatgtggcaatgaaaatctttccatttgttgactgctaaagtacattttcttttcccccttttaaaagaatgttgtatatggaattgaaataacgtacatacacattactgcttaattttaattcctggtcaatgtagtatactgtgcaggatatcaaaagtgaaaagaaaacttaaggtcatctaatgtttcaggttcttagtaacatgcgggtgctgatgacagaggactctaataacgctgaaagcagttcatttctgttggatgataattcaaggtaacataagtaccatttgatttaattgtgtggatgtatctactgtttatattagtccctggacaaacattaacacacccctcaatttattgttgtgtttgcaatgcagcatcccgttctcagtcgatgacatcaccaactcaattcaggagaaggacttcaccgatgtcaaaccagctgaggagctactcgagaatcccgccttccagtttttacaggattagggctgtgaaatctcagagctttataccgttagataccttgtcagaatattccttgatttgttgtaaatttttttcaatcctttacgctggatggtgtaccctttcttttgttatatttccttttcttttccagctagttttttgtaaaatccttataggtagtcaatagggttgggatgggattcctcccttacatctaggaaaagcaatatcttttaaagcaaggcaggcaaatcattcttttgtagggcaaattcaaatcagtcttataatatccatgggttgtaggaagaggcaatgtcttggtggcctctcccagttatagattgtacaaagttacaatgtatatcaacagtgcaagaaaaggaaattcatataccaaatggcattatgctcatacatcatatcttggaggtgttgtcttgtttaccagatgcgctgcaatctgcagtgactttttgttactctttttgagagaactaaactgcaaatacagaggatgtttcgtaatttcttctgcgtctttttctggcttgtggtgtctaaggtgccatcgcatggaaggaagttgtgtagtttctctatgggtaacttcggtttgaaagtagtctgagcaatttgaatgtagccttgtgtaaactttgagtcgattctcatcctccatgctcgagcaggtacgtccgtcttctttcgatccgccgtgccttttccttccattcgttttgaatttttctggaagagttcttcatttggatttgaaggaaagttacttcaactggaggggagcacgggaaacccgcgaactttgctgcacagtcccaaatgcccacctgacacccctggcccacagctctaaagcgtccaacatcactagccaattccctaaactaccctccctcagaaattcctccatgcatggtttctcgggggtatttccgtccatccacacactgaacgagagagaagaagcaacaacaataaaccgatggcaggtaggcacaccgcactcccccattcccttccaccctctcccaccctttaaaaaaataatacaaaaataagaaaaagaaggagaagaagggagattctctctctctctcctcctcccgctcccgaattccttctagattatcccaaattcttcgctgccaagccgccatcccgcggaatcgaggtaatggttatcttccccccaagtttgttcgttcgttcgttctagctcgattccttgagcggattgtttcgtttgatttggtttggtttcttctagcgaggggaaagggtaggaggagcctgacttgctgtggaaggtggttagtttggggggggggggggagtggttgcatgtgtttcttttgcatggaaattttgctcatgcctggtgaaagctgtggcgctgatttggagctcggagtttgtatgtagaattgtgaggattgattatgcttcgtgggatggttgcaaggaggagatgttgtactatttttggagtagcaatgctctctagtgtatctaaacaagggaaagtgggatgggggaataccacgcatccggctcaaaatgtatgaggggttatctatttagggtaatgataatgcttgattgatgggtggggtactgggttaaattttcctaatgtagatatgtgcgtcactttctgaatggggttgtcttagctatctacttcttcacaaggtgttgatctgtatttgaatggaaaaagattgaggttcttgttcgatcactcaagtttaattcactgatagagataagcagctctacttttgtaattctagaaagttgaaagagaatgttttcaccaccatcttattccctgatgtaggctttcgcttaagtacacttgtcattgttgattattatcctgctcagggatctaaataatgaaatttcattcttgcataggtgctgttccccttgcctttgcttcacctcttttgtatcactaccggaactttactcacagctgctcagttgtttctttgctgtcagcatgggggaacataccttgtacattatatacagcttgatttttgttttatcacattggctctttcagggatgagcagcaagttcatgataacctacaagaggaagcgtgttacatcacatgtctatacagctgatggcaccaatctcaagtcttctggtgcttccagtagtgttcctgtcagcagtttatccccaaaatatggggttggtgccgataataacatgttagaggaagataattttgtgaggaaccttgacttgtcacccttactatctattttagcatttgatgttactctgttacattcctaaagagggtgtacaatacataactactactgatatgcaccacttccacaaggagcgcatgaaactgccatgtcaaacagtacaacatgatgtagatattcatatctagaaatgtcactagtcatgttttttcaggaatctaatctatcgtgctttataataaaaaatcgtttaatgaaaccatgatatatgtttatgttttaaaactgctgtgtgataaagttccatgccatactaaaagtttgttctgtatcactgtggtgtgttaatgttcaatgctggagtatatactaaaattttgtatttttgtattcataagttgatctaactttattcatatctgatacttattctcatctataaaattggcagtcgacctctacaaagcaacaggatgtatttgattcaagggagcaagtcatcaaggaagaatcacctaaacaaagtgcaaatgcaccaggcaaagaacgagcggaacttaagtcacgtgaatcattatctcaaaaggaacagcctgagatatgttctactcatactgcaataggagacgcatgtgagaataaattagaatgcatagatggcacacataatcaaagtcttgtttccagttgtgtgcatgctgacaggacaactaatcaggcagaagattctagtgcctctgtttctgtgggagtaaattctcatcagcagccgaataattctaccaggcctagccaatctaagagtagatttagtcctatgcttacatttcataggcgagttaaaaacaaaataggtttggaagagcctgcagcaggaagttgttcaagagataatgacaaacattgctcaaaactaagttgcaacccaccaagttcgccactggatgctatacccttgtgtagacaaactgctggcagttctttggatgttgaagataaggtatgtttctctctcatgacctcatcttcatgtactcgtacttgtacaataacagtactgctaacttgacaaaatttttgttaagcctatccatttgttttacttgttcattctatgcgactatgtgcaatactattgcaaggggacataccagtgtcaggaaataatgcatgttgtgactgcaatggctagaggcatccaacattgtccgtgtaacttcaactgaaagcttctatgtgattcacttatgcaccatattctagattcatgtcttttcttttataaattcttcaaataaaatccaatgtgtgtgtcattgcgactgcattctctctactgcttgcattgtctatacacaatgaggctacactcctgatagtttatgtgttcattgactatgtgcttttgcattttaccacgtagagcattcagaataactacagcttctatttaatactgaggaaaaggaatttatttacaggttactatagcgggaacaagcactggacaatctgtaattgttgaccacttgcttgaacaaaaaaggtaagacggtactatttgttttgttgatcagtacatgaacccggaactcattaatgctccttttctagttcacacattccgaaatcgtcggtacatcatatggttccctcgcagcctgctaaagatgcaaaccaaagttcaatcccagaagaaggtacaccagtatctgagttcactagggtgctagaaaccagtgagtcagatgcaagagtggaggactcaaacagaacaccagtagacgctattgaagtaccaaaagttattgaagtgaagagggatgaacatggtaatggacagactaattgtctacagtcaccaaggaaaaatataaatgttaatcttctgaaaccaacaaatagatctgaggcagctgatcttctggagtctcaagattcaacaaaaaatattccaattattgtcttggacgatgatagtgatgagaggggcaaagagcaggaaaaatcagaggtccttgatcaattaatccaggagaaaaataaaggtagattttctttggggcagatcaacctaaatctaaattgtgctgaattaccacaagagaggcttctcagtttggatgagacatcggtgtacaaactaaaagatcaggtcagaatgataatattagtctatatttcatgaagtattaccttacattttggctttagtccataatccacattcctcatcttatttaaagagagaacttctttctgcagtgaagtggtttgtacataatacattctgtaccgttcattttagtaggattgggtgttctgtttctttatacttgctctaggtgttcagtaaactgtatcctatgtgctctttatttgaaccactatctagtttacaagctattgttttgctgatacatgtgttataaaaaagtgcttacatatgctttattggataagtccttgatatttgtgctttgtattatctcaagcattttatttgcactatttacaggatcaatgtgttcatgaacgaaagcaaatgtcccatccagttgaaaggttgttttttacaaaggagaaggatgccatgcacggtaaaaaacatcatgaagaaacctcaaccatgcatagctcgtactcaaatttatttgatccagccccatcatcgtcgtggattactgggaatttcaaggaaccaagtgtcatgccatcagaactgaagttcagaatattggataaggctcctgaattcaatttagatctcaaattggatagtttcccagacagtagtgtattagcccttaggcacgataagttatttcgtggaggcacctccagtggatcccattttctgacagaaaggcttgggacatactcctacaaaaggcactcttccccgtggtcagaagaagaattggattttctttggattggagttaggaggtatgggacaaataactggaatgcaatgttgagggatagacggttacggttttctaactcaagaaatgccgaggatcttgctaagcaatgggacaaggaacaaagaaatcttctaggtgtggatttccttcaatcactcagatcctctgctcgaggtcctccaccgccttcacatataccagaagattacgttggaagcagttcttggactggatgctcaaaatctccatttctttttgctccaacagacctttcattgggtgacatgtacctttgaagcggccgtacttcagagagaaggcagcatccttta

SEQ ID NO: 64033 - DNA, 18000 bp, Oryza sativa
cttgttgtttatgaggtctgatatgagatgagagatgaaaccaccagcaacagacagcaattgcacgatccgtgtggcgacggccctcgggcgcttcccccagtatgcagaaatgatctcaggactgtacacgagaggcagcgcctcattgttgttcatggatgaaacctagagccaagaaaagggggaaatgaaaattttgttcttctattagaccttagttgaaataaactgttaattaacgtgatgattgaattgtgtggttggtggggcggacctcgacgaggcggaggcggacgttgtcgtcggcgaattgggagtcgcggaggttctggccgcggaggccgcgcatgagcgtggcgagctgctcgtcctcctccatctgcttccgcactcgctggatctccttggacacctccccgaaccgcttcaatcgcaaacacacaaaccacaccaacacaatctccacaatctcagcgagatgaaacaggtgtaagaacacggaagatctgactgattgagcagagaggcgatcggtcttacggtggaggagatgtcattaggggtcctcgtcctcgacctggagcgaggcgccggggcggaggcggagggcttgggctccgtggcgacggcgaggacgcggcgggatgggcgccggcgccgacggcccggcagcgacgccgcgagaccaggcagacggccgaagccaccgcagtgcagcaggtgcggcgccgccgacgccgccgccgccgcggcctccatgggcaagaagaagaaggaagaagcttagcttcttcggcgaagaccccgaggcggaggaggaggatgaatttgccgcgcaataatcttcccttgcagtgcagtgctctagttgtagcagtaaacgcgggaggcgccggagcccggagtggacctgaatgtggagtgagatggctggctggcccccggccacttggcgtcaccgcgggcacacaaggttcgtgtgcccgggaggcgcggacccatgggcggcgcgagagcggccacccccaccaaaaccggtgaggagaggacgaagcgcgatgtgtccgctttggattcgaccaccagattcccaccacctcaggtaaaatgccaatgcacccaataatgctagcacagctctagtgattagtgattcctatctccggcccattccataaaaaatgaatttagcatagaatattatcggagagtgaactcctccaccaagaaaccgtgaggcccccatttgtgagttcggtcaggggcagcgggtgagatttgagggcttggtgagcggaactttgtgatcttgagggtgttaggcccctccaagacgatgagacaaaagaggtttatacaggttcgggccgctgagaagcgtaataccctactcctatgcatgattgattgaatgtagaacacaagtgcttggagttgcgagacccaagcgccagttcgctcggaagtcccccccccccccaactaggcctggacctccttttatacctcaaggggttaccacatgggcccaacaacctaacctaactccggtggagaagtattataatctttgcattaaatgcatgtcttgtctcttgacttgggaagccaagcacacgtcgtcttgatgatggggcctgtcaaatcttgccgcctgacacgcaagcagcgcacaggcgcactacccagtcccatcggtcattcgaccggtcacagactggttgagtatactgcacgccgcatttggcgcgaccgctcgggtcgccataaatgcgggtaggtgggcacctgtaggcggacacctaacccaccgtatgcggtgacctagagagggggtcggggggagcccaacccctagtcacgggagggggtcgccgctgcccgaccttgggcccgatccccccttgggggagggccacgtggcgcttggggcagccttctccttctagtctcggccagggagtggccgccgccctacctcgggcccgacccccctcgggggagggccacgtggcattggagggcagcctcctccatttagtctctgggaaggagtggccaccgtcctacctcgggcctgactcccctcgggggagggccacgtggcatcggggggcagcctcctccgactagtctttggggaaggagtggccgccaccccacctcgggcctgactcccctcaggggagggccacgtggcatcggggggcagcctcctccgactagtctttggggaaggagtggccgccaccccacctcgggcctgactcccctcgggggagggccacgtggcatcggggggcagcctcctccgactagtctttagggaaggagtggccgccaccccacctcgggcctaactcccctcgggggagggccacgtggcatcgggggaggaggcctccctctaaacctgatacccccgggcccatatcatcgacaaatgtgatacattacagtattatgaatctagacagatatatatccgaattcataaactatgatatgtcatatcctgtagaaggttgattttctatgggacggagagagtagtgcgcaatgcaatcatcttttcacgcttatactgatggtaagatgtggagtaacggcttattactagcaacttaaaaatttgataatttacaaatataatttttatatgtgttcttaataataatgtaaattataataaaaaaaaccattaaaattaactctaaatttaagttttcatatttaaattttagcttttagcttataagcttgaggtaaacaatgggagtgcaattctttaccgcaaatggttcaacggacagatatcacaagtcacaatagtaagcacgaaaacaagaaagagtggtcgaaaaagatgagctttaatttttttttctacccagttggtcttttactagagaaacagaagaataaaaaatggatctagacaacaacaacaacacgatgtacaagaaattttacagacaccaggagaccaccccacgtacagcagcagctccaggacacccccaaaggtgatgtgcagcaatagctacctcccaattcatcgcgttttcgcagctgatgaggtcccgttcttttcaatcgcccgctgcctcgcacgctccatcttccgtttgcgccattcctcaagagctgcagatgtttacacaaaatggtaaaagaaaaaaattagcatcagcttctacatattaccgagggaggtagaagagcaaaacgctgctccagcaagcatgcaaaataaaccgttgtgtacagaccaaatcacactgctattgcataatggtatattaccaattgctagcatatgtatatatatgtacacctgatgacttcaggatatgatttgctatgatcattttgtgtctctgcatcaactggcaggatagaatggaatggtggtgaaatcacaatagcttggtattgcaagcagttgtttcattctttcagcttttcttttcagccctgtcctgaagctctctgatctatagcccatccaactgtattattgaactgttcggtttaactgtgcaactggtcttttttttctttccatgaaatatatactgtcaaatactcgcagcacaagccacaactaaagggccacatattgacagcaatatgatggtagtactacaaagatgtaactgtcacaagactcacaaccatgtttgcaagcatctaacttcattttgttcacatcatatgctcctcggatccgaacagacatagtacagaagataaactgaaagaacaatgcagccccaaaatatgaggagtggtaagaaaccaagaatgaatttacgaacctttttggctgctaccatcattccctgcccttaaatcttgcaacctttttgatgcatcaacagcagctgtctgcttggcatcttcttgtgtcatcatgccatgctcaccataagcttcttgttcgatttccttcacctatgtagcagaaatagcgaagttctaactttgattagcatcccaatgaattctctttcaaccaaatcacgagaaacacaatatacaatatacagtgacttactctcctgatcaaatccacaggctccatagcacgacgtaactcttccgactcccatataaaccgtagctgagctgcggaattgtagcacgggatctttcactgaattgagtatataacaggactgatctcacatgatataaaggaaaaactagaatttgtactaaacgaagaatggttgatcccattctataggttttgagcgcagcttatagtgctgttctctacatttggggtttccccatatgctcagagctcatgaggtatttcgattggaaaaaaaaagagtgatttttgtcagctgctcggattcgtaaagaaattccctgcatttcctgtggcgtggtgttagcagaagcccttgtccacatttaatcagaagaaaagacctgaactttgctagtcagtctagatccaattcactaaccagtttatcgtactatcatttgggtaccaaatcgaacaaatttctaggcccaaatcatctaacgagagatagattgttcaatgagagtgaaatgaacaagagtacaatgagttcgtaccagaatcgaactggtggtcgccggcgatgcgcggccaggacgagtagtagttgcggaagaggagagcgcacgcgaggaggttgattgcgcacaccgcgacggtggcgttcttgtacgatatcctggaggaagcagaagccccacccctccacgccccctgcccgtccatcccgtcgactgcggccatgcggcggcgcggcccgtcgagctcgccggagaagaagacgaggaagagaaaagcggacgcgtccaccaaccaacacaactcccttcctcacgtagaatggtaaatgggcctacggcccattaattagcccataaagaataggcccattaatgagcccataaagaattgggcccaactacctcgcgactaattgggcctccactaacacctagattccaaccctacctcgcttttcaccagtcaccaccacttggccttcctcgtctccggccttcctccaccgcgagctccgaccaccaccgacggcgacaatgcaggcggcggcggcgtggaggcgtcacctcctcgacggcaacatctcccccaccaccgcggcggcgatctccgccttcagatccgcctcccagccggcgctcgcaccccaaggtatggaggaggcgcccttccgggcgtccgggaccagccctgaacatcgcccgcgggtgccccccgagggtagatcttagaggtggtttgggttttcgatgcaggattgggtggagcggatggcgcgaggtacatgtccgcgagggcgccggcggtcaaggggacggggcatctcgtccgcaagggaaccggagggaggtcgtctgtgaggtgaggagctcaggctggttccgttcctccgattgattctatcgggcattcccgttgtcacgagtctgcgtctaggtttggccttcccaatgatttggtttaggttcattaggttgtgataatgttctgatccatccgtactgtcatagcagatatgtgttccttagaatggtcttcctgatgcttagatcgtcagatttgtgcagttcgtatggttgcatttgcgatggacctgttcttgtatacttgtgcatctcgtggaatttggagttacctgtaacacagctaggccttggaaattctgtgccctgaaaaaacagagagtcgattttagttattatgagctgaattggagctctggttgacagatatgtgatgttgttctaccaaatgtatttgatcctacttcccacatttttttgctaggtttgagaaaattcatttgccatttgcatagggtgttgagtgtacgaattgtggtactaatatttatcttaaagagtgttacttgcacatttgctggtgtttgttgcatcttgggagcaatgacgatcaaattaggttaatgatactcttaacctgcaaattttcctttgaatttataacaagaaatttcgtgacagtggaatcatagctacggtgtttggagctactggatttcttggccgctaccttgtccaacaacttggtgagatgataaggctttagacctatagtactacgttgtaatgaataatatcttactgagttatattaccataaaaacaaagtgaaatagtatggtaactcaattatttatttctattcagcaaagatggggtctcaagtgcttgtaccattcagaggttctgaggattgtcaccgacacctgaagttgatgggtgacctgggtcaggtactgtatttttgtagttcacaaattacaagtagtgaagtcattaactcatttttcctttttttttcccttttatgtattctacttttttctcttggcagattgttcctatgaaatacaatccaagagatgtggattcaattaaggctgtcatggccaaatccaatgtggtcattaacctaataggtatgtctaacttggtacagcatcgtattcagagtcaaatcccttcctgactatgtcaactcaatttcaacaggacgcgagtatgaaacaagaaactatggatttgacgaagtaaatcatcatatggctgaacaacttgcaatggtatgcattgtgcgcacatccgcttttcttccaactatatagataattcctaatacaatctttgagaattaggattgaatgaaattcaaagtagcaaccagcttgatttctcagtgcactggcttgcttgtgctcatcccaagattgcagcagcattgacaagcaaccatttggctggtttatttcaccagctataacttcagagggtcacataatccatggttgtgattagatttcaaacttttgcctgcttaggtgaccttggctaggtttcatctgacacaatacaaagcacaatatatttaagcacactgctctgccatcggtatataatccgtctagctgtccttttggttaacattaatccttctttttcttgtttcagaagccagtgttacttagctcctagatctggaaatggaaatatcttacttttacattttgcatgaaaagtatctttttctactgagctgttagtcttttaattcagcatcacagttactgccttcaatgtggaattactattctctttcctctaatttgtgctgtcctgggtaataaccatgctctataatttcattcaattggatacctgtacaaaggggaaaaaaattcactatcatttgtaactttctttttgctgcatcatgacaatataattcccatcaagacttcttttgtggctggctattaactgtgttatggactatgcacagatttcaaaggagcatgggggtatcatgagatttatccaggtttcttccctaggagcatcggcctcttctccttctagaatgctgagggccaaggctgctggggaggaatctgtgttgaaagaatttcctgaggtgatcatctacattaggcaatactgaactcctgtttctacattaccgaaagttagaagcaaacatgtcccatttatgttggcagttactttaaccaaaattttgtttgcatggatcaacaggctacaattatgaggcctgcaactatgattggcacagaagatcggattttgaatagatgggcacagtttgccaaaaattggggtttcctccctcttgttgattctgggtctacaaagtaattgaactttcctgttggctgctgttgtaatgccttgacttaaaatttagtctagaacattaattgatcagagaatacgggcctcatcatttgccctatggcttataagccattgccaaaatttgaattttaaaacttgattttgaagttgattttgatgctaattcaacgtagtttctttttcatcattagcttttaagtcgctaaagacacatgtaaaagtattactcataaattactttttatcagtaataagccgttacggcttataatcagtcgtaggcaaccgatggggacctacataaacttccacagcaggtgagataacatgaatgcaaccttttggtttttgcaggattcagcctgtttatgttgtggatgttgctgctgctattgtcaactccctcaaggatgacggcaccagcatgggaaagacctacgaacttggtggaccagagatttatactgttcatgagctggtaattatcatgcacaacattttgttatgcagcaatgaacgaatcttcaagttggttggtcgagtttttttatataaaaatgttctggatgttacaggctgagctgatgtatgagacaatacgtgaatggccacggtacatcgatgttcctcttcctattgcaagggtatgaacttaaataatatcttgtgttggtcaaggcaacctgagtattggattgtctcgtcttttaacagttatgcttcgggttgtgcaggctatcgcatctccaagggaaatgctgctaaacaaagtgccctttccgttgccaaccccatcaattttcaacaaagatcagattaatgcattttctgtagacaccctagtgtctgataatggtaagcatgatatcttatgattgatctgtaacctattgtttgcacaagctcacatttgtttctggggacataatacagctctcaccttttcggacctcggaatcgtgcctcacaaattgaagggttacccggttgagtttcttgtgtgctaccggaagggcggtccagcttttggttctactgtcagtgagaagatacgaagttctgagctgtagtcttccactcctgaagacactgtagaattaatcttttagttgcagaaacgttgttgtgtttgttttcttactatctgctgctgctgctgccagccgcccaacagcgagcaggaccatattcgatgcatatgttggttcctgctcatgtttttcaccaataagacgcacaaaatctttgtcaattttttgagttgcaaatgcaagtgaggcgaatcgttgcagtcctacgacacaataacaaagatatgtttctttctttaccctatacatatatgctcgctggtttgcattgcttgcaatgatgctacggtgtgataatgtgataataatttgtttagtgtctaatttagtattaggttactatgttgtaggagtagttgattagcacatgtacaaattcactgtataccattttgcttgtgatgccctgtccataggccacacagcccatcaaagctgcaaacacctctctctgcttcctggctgttaggcctccacaattctgctactcctggcccaaaacgcttgtacactgatcagatcgattgattgattggtcttctaatttcccagaagaaaacaaaagggagagattgattactgtgttcactggcactgtcatgagaaatggatgtgccagccaccagctgagctgacagccgaggacaagcgagccaagcaaagcaaatgcatggaccagcaactcgattacaacggcattaccggtaatcaagcaatcaaccacgcgtgcatgcagctaccgctttgccacatcactcaattcacaactactacctctaccagactaccagtcgtactgaattcgaacttgtggggtttaattccagagtggtgattttgatcaatctgaattcgatcaatgacggggacgcgtgacgacgtcgcccttttggcccgccgattaagccgctggctgagcttgcattgcatgcatgatgcatatatatggacacccagatgtgcagccctggacggacggaccgacgcatatattgctgcttggaatttctgacgacttgatgcatcaaccaacgagctcaagtaccaccgagatgcaagaggccgtcgtgctgcatgccatgcatgcacgcacgtttcatctgtcataatcactccggctaattataagagagaaattaatttgtatgctcccaccatttcatattataaatcatttggctttttggtacaactgataaattttcatatgaaaattgtttatttgatcacctcatggcagccatttatatatactccctccgtttcgaaatgtttgacaccgttgactttttagcacatgtttgaccgttcgtcttattcaaaaacttttatgaaatatgtaaaattatatgcctatataaaaatatatttaccaatgaatcaaatgataggaaaagaattaataattacttaaattttttgaataagacgaacgggcaaacatgtgctaaaaagtcaaccgcgtcaaatattttgaaaccggggggagtgggtccaaccaagagtcagtacaactgaaacaggtatataaatgaccgtatcgtattcatacccgcgctcctacagcaacagcactaacaactcatgttctctctcaaaaaaaaaaaatcatatagtatcaacttggttggtactcggagagattaacgtttcaactcgagcacaaacaagggggaaaatgggcaaatgagagagatgtgattggaattagttgactagcttgctctagggtgtgtttagttcacaccaaaattagaagtttggttgaaattgaaacgatgtgatggaaagttggaagtttatgtgtaggaaaattttgatgtgatgaaaaagttgaaagttcgaaaaaaaagtttagaactaaacaaggccctaattaaatggagtgaatgaatggaaaatgagtggctggtttgcataaaagcagatgcactaacagacagctgctagttttgatgacacatagggtgtgctatccagctatcctatgaatgctagacaagaatggcatcctggacactgttaaactagtatcaatgaaatctcagaaatcatcttcataagtcataaagtagaaagatttgcaattttcagaggatgtactccgctgagaactattacttgcaaaatctgagaaagtttatgatcaaaatatgtatgtctataatttgtagggattttttttacggtgcccctttcaaaacatgacacactaaattaagaaaagtgattacaaacatgttattaatttacttgcgcctacacacatgttactcgtaagtcgtaacaggagtaataaaaaaaactggtatatagtctccactcctagtagagttcaatctagacctatcttctttcaatggatcatatttatttttactatcatcttaactactatctctatccgacatttttctcagtcctttgaaactagataccatccaaattcttatattttgataccgaggtagtactaattaataacctcaactgtttagaactcctaaatattaacgatcgagattatttccacttctaatgatgagggagtactgtagtgtgctgataccagccggcttaagacaaactgcagatcaaggcaggaagagagatactgtagagctacatctatcattgttattgtgtgccttgggagttagacaaaaggcagccgcatgctttgatgccctaatttttggtctgatgtgttcgtgtggcgattgttttcttttccctttttttttcttttttgcctcccaggtagatctttcaggttaagaaaagatgatcagacaagccattgattggaggttttgactctttccttctcccaacgcgtttacttctcttgcttgctcgcttccatatttgttttctctgcattctgattctgatgctgttgtacctcttgccaactttttaattgacacaagtgcgccttctttacgagtaggactaacaccgtccattttaaattactggtatttctttatatctttgcaataagtcaaacatattttagccatcaatttctacaagaaattcatatattttaacattataaattttatgtttttaagattcatcgaaagaaatactttcatagcatatatataatctaagtattgaataaagtgcagttctctcctttgtggagcaagataagcagaaagaaagcagatagttaaagtatatagtgcacttacttttgagctctaacttttgaccactgcaatttacttgcgtttgtagcttcctaatgcaaaggatcagtgatggctttctgcgatcctaccctatatatgcaatcagtttgggttcacccattggaaatgtacaaaacgattggatacattatacagtagtattgctgtccatttacagatttcactgttcagtatatttaatttggagctgtaccagtcgctggagattactgtacgtacaagggattaattttctgtactggctacgaaagaaggattgaagctaccttgtttttactgaaggtgactcttgtgtcctactaccagatcgtacaagacggtaagacggttaatgtcaatcaaaccgaactccgaaccatgtgtgcttggttaatgtcaataaggtgattgcaggccgtagtactgcttaaatatccttggcctgataattaatttctctaatagtaaatatatgatgttgttgatttttcagcattcatcttatttcaaaatctacgtcaatagtatttatttatgttattcttttttatcagtaaatgtattttaagcatactttattatttatttttacgtttgcactgtttttttaataaaaccaataatcaaacactatgtttaataataaacaacatcctgtacttaaaaaacaattggtaatactccctccatttcatgctataatactatttaactttttttaattcaaactttcttatatttaaccatacttatagaaaaatgtagcaacatctataatactaaatagtttaactaaatatagcattgaatgtatgttgatgctatattttgttctatgttaaaaacattgctataattttttgtaactttaattattaaggtggtgtttggatctagggactaaattttagtccgacactaattagaggcattaaatatagactaataataaaactaattgtataaatgagaggtaattcgcaagacaaaatttttaagcctaattaatccataactagcacatatttactgtagcatcacatagactaatcgtggattgattaggcttaatagattcatctcgcgaataagttcaggttatgaaataggtttatcattagtatacgattaatatttttaattaatatctaaatatcggatgtgacagtttagtcccttatctaaatagtacctaaataaatgatttagaaaaaaaaaggttaaagcatcggagggagtagcagttttggtatataaagctgggccccgcattaacgcgcttgattatttccatgcccaactttttcttagataatgatctccatgtccagcctaggaggtaatcaattgatccggccatgaaattctgctcactttgatgcttgaaataataataaaaaaatagcagatgcatagagttcgattgatccccaccaagagcaggtaaagtaatatactataaatcggttataagcttatacggataagataaaagagaagagagaagacaagtgagttacatatctgtatatgtgggactaattattaataatatagtatatatttatagttaattattgtataaattagctattaatttaactatggatggtattaaacttgctccaagtagtgctacaggataatttggcgaggtaggtgctgcagcattacatctgagtacactcattgttgagctaaaaaaaaggggctcccgtgaatggcggttacttgtctccacgttgttaggcacgaaatcatcatccaaattcacaagcaaaattgctccctaccctttgcagttgcagtgtttcatcattcgagcgcttttaattcacatcacatgcttgcatatgcgtatgagatgaagaggatacagtgctcgtttgtacgcgatgttgttggatgagagacatcggtcgagcacatttatgtcgcattctctactcatcaacatcatacaacctactactaactccagcttaaaacatgtagagctgtttacttttaaaacataatgctattccattcctttcatgatatatccattttgatgtgatttgtacgattattaaagatatttcaggtatgagttatatttttaaatacttccactaaatttttagataaaataatccaacagtatcccatggtgactttatcaatctcaagatacgccagctcagtttttttagagatgcttatagagatagggtgtgcgtgtatatatttatagaggtgagtgtacgcgcgttgtgagcgtcttgcatttgtactgtgttttttaaaaaaaatatttaaaaatcgagaaaatagaagcattctccgccgttgataaattcttccttggaaagacctcgtaacacttccttggaagcgttggcacacaaggtaggtaagcttagctttgagtctttgacaacccaagatcgatcacgaggcaaccgtccaacgtccagtcgtgggggccaacttcttctgatcgaccgtgtggctattttcgtcatttttctaatccgccgttggcctaatttgacaaggaattaaaaaatggatctcacactagagaatgaaataaatgaaattaaaggaggagaaacctcacagatacgccaccgaccaagcatcacaggctggaattccccgaaatgccccctccctcctcttctctgctgccatccacgagttggatgagttgtgaaaccgtgtaccagcacggaatcacgaggccataagctgccattaattaatactatattccaaattaaaactagcccctcgtatataagagcgagtttaatattatagccaactactaactttaaatcatttatatttaatttaatagccgatttatacaataattactacaaatatataatacactattaatacttgatcccatctgtcatacacatatcgtgtcttaagatccgtaatagagctagttataaatttttttaaaatatatttatagctgtcttatcgtttgcaattatgagtacttctctaatgccacagccacaaacgctgctgctctttccttctacaccgggtgttattctaccccaccgctcaccgacatggtggggcccacctaatgatccaagcctggtggggcccgcctatgatctaagcctaacggcgccctgggtcgttgggggcggtgacggtgaccgcgcgtttccagttttccgtggggtgtcgcgggccccaccgcgggtgcgtacccacgaacagcgggtgtaccactagaaaacaaaataaaagaaaaacggcaaatggttttatatttttcttttctccctctaccttatgacctgctaaatctggtttacccaatgagttggcgccacgttggatgcaaaaataaaatctacaggtgtcttagcggatccgggtttttgcgtggcttcgcgggtccaggctccgaactttctttctacagccacacaacacacagcacctactcctagcttgtccccaagaagtaagcttacccaccacatacaaggacaaacggtgtatacatgaattctgaattctgtactctgtatttcgtaaaggggaaaagttacatctttttatactttttgcacgcttaatactaatctttataaaaaaatatgttacgaagtgccgtaccttaaaccaagcgatcgtcgattaaataattatagatcaaacaatggtacgaagtgatgctccctcttggctatccaaatggtatatattatcagtaagctaagattatggtacagctataattcgattataaagttgtaggaatccagaatgacaagctgtgtattttaactttttaagaagttagtttagccatgaagcatcatccttgcgtgagggaatgtaagggaattcaactagctatacatagtgaggcacacgagtgacaaaaacatagtgttacttaagtttgagactgcccgaggactgaggttcacgtcaaacaaaaccgattacacgggagccacacagtacctactcctagcttgcctccaacaagtacatcttacccaccatgtacgaggacatacgatacggtgtatgcatgaattttgttctatatgtttcgtaaaggggaaagtttcatctttttatactttttgcacgtataatactaatctttataaaaatatgttacaaaattctataccttaaaccagatgattatcgattaaataattatagatcatacgatgataggatttaggaagtaatgctccctcttggctatccagatggtatatatgatcggtaagctatggtgtggctataattcaactataaagtagtaggaatacaaaaggataaaaaggatgcattttaagaagttagttcatcatgaagtgccatcttctcgtggtagtgatgagggattgtgaaggaataacaactagctatactaagcaaataagtcaatactatagtgtcacttaagtttgaaattgcctaaggttcgagtcaaacaaaaactgatcataagagcaaggtcaatagtatagtctacggttggctccaaaaacatccacatcagcaatacaattaactagtaaagataacatacacagtaatgagctattagctcttctatccataaatttgcatgtattacttttcaatattttaatctactttttcagttactgacagacctctgtttctgcatggtttcacttggaccccacctcacaaccgtgtggccagtagaagcttatctagagctgctttgcatgcgttggagcccttgtgtcgtcggcgataaattagtcgcccactttcactctctctccacttatttcttctccagatcatcacttttgccaccgtgtatagattatcacccgcttaaacaacctattgtacctgctctaagagtgttgcacgtatatgtgcatatcgttataatcgatcaataaatatttttttatatatattctcatttgtcactctatacgtgcaacaaatgtaaatttatagatcagtagtaaaacaacatgaatagattacatattaataaatggctccataccacattttaaatggctggcggtttttataaggtcatgacgtcatcaagctgtcaacatgatttcattttcccgcgcatttgtagtaaactaaccctctttttccacgttcgacatatagtcatatacaccttataactacgtgtgctataccattgctacttttccacatgtatgtcttgaatgtctcttatttatcatagttatcatcgtacactccaaactttagataccattttttccgtgctctcttcttagaatcattagtcgcgcaagagaaccatctaaccattttttctacatggtgtacagtcacattagtgatcacgcgccattatatatatatgtatatatacaagaaaactatatataaagttgtttcgtgtacacataacctattcggagcatacagaaacccaaaacccgctaagcaaatgagaagggaaggaaaggatgaaccgaaagacccggaaggagaaaaaatgcctcagactacaagcaagtagtactagtagtagtaaacgaaaacccgaagaaacccaagagaacaaaaaaaaaaaaaaaagcgcaggcggcagctgttcctcctcctcctcctccccgctcccctctcccctcgccattcacattccctttctccacgagagcgaggccaaaacatccggagaagagagaggagagggagggggtttggactttggagaggcgccgccgcgaaacccccgcggcgcaatcgcggagagctctcctcctcctcgtcgtcgtcgttgttgccggcggcggcggcgctctgtaaggcggacgcggtgcatttcgtcggggttgaacggcgggggcgggttcggaggcagtcggggggcggtgggagatacgagcagctgttgctgctttcgtgggtggaggggttcgggg

SEQ ID NO: 64034 - DNA, 688 bp, Oryza sativa
cctctccatgtcctcaaacgtactgaaactcacttcttccagatccacgcttacgcttccacactcatcaccactaatgagctcgtgagcaagctatgtccctcctaatgctattaacctataatgaacgaaggatggacctaggcctgctcatcgtcgaccataaaccgtagagatggccgcctccaatcgacgcaagcgcagagctgctctagcttggggactatgtggtgtaggagcaaattgacgagatgcgagcagtgcgacggagggcggtactccataggctctatgttactgtctgtttgagctttcacaccaacccaacaagctcaagaagacagagagcaaggaagagagggaaagatagggaagaagcaaattgcccaaagtaaaacttatatgtaatctttttgggttcaaatttaaagtgttgggctgctcggctgttcctacttcctagtcttttactcttaccacattggtaaaaagaagtggccctatatgccatttactcttaaaagaattggtgtaagtacaggataaggcgacctcgtctaaacccccacgctcccatggccgccgccgccgcgtaccccaccggcgccactctccccccgcgccgggcacctacgccctctctccggccgtcgccgacgctctcgtggttcgcctacatcgcccacct

SEQ ID NO: 64035 - DNA, 7757 bp, Oryza sativa
aaaaaaagtgtagcttgctaattaaggtatggccaaaaatttgattgtcttaacttagataaacatagcattatttatccgcaaatgatgataaagtatggttgcaaaccacttcctctgagtctcatttgtacctttatcttattacttttccttttttattcatttcatttgtttgattattttctagtattctttttcgattatggaatatatggaaaacatatgtgcaccgtctgctagtatccatcaaaacactacccgtgttaccgtgtaatatctttttaacacgcttaaaaaagctatagaggatgaataagagggataaattcgtgaaactcactaagttctcgagtgaaagtaaatataccttatgtgtttggacctcatacaaagatcgtgttttttccacgtctctaaaatactttttaactttaaaagaaatattttactgtattgcttattatatcgtttggttaaactatgccaaacaataattgttgttgcatcccggccatgcatgatgggcttgaattaaaaccattatcctctctaccattagtcatatcttcccgtcgtcatcaacaggtagattaattggatctctaaaccttctgaatgttcatctccacacctaaatgatactactatgatagaagtagtctttatattctggaaggtgatttgtactccctccgtcctaaaataaacacagccatgagtttttgtgtctaactttaatcgtccgtcttatttgtttttttcttgaaaaactaaaaaatataagtcatgcataaaatactattcatattttataatctaataacaataaaaatactaatcataaaaaaaaattatataaaacggccgattaaaattggacacgaaaattcatggttgtgtttattttgggacggaggtagtaggtttttactaggtatgtatatgttgcttcagctacacccccttgctgttctctttcacggtacctgattgatatacagagatgatggctggaattaattgtggtggtcatgctcaagcctgtgcttttcactatttgtgatagggaaaacaaacagagaaaatcattactgatccgtgaagaggaaaaaaagtattatttaggctaaaaaaagtaggctcacagatcataatcatgatgacttggatgagatgcttgtgcaattaggcacctccaaaagctggacattcggatggtagatagattgagtgaccccagcaaaatgatcataaatataaagcttccaaatataagtcgaactcacttgcgcacacaccacactcatgtttataaagagattgggcttatccttaccattaaatgcacccacgtgtatatgaaatacttttgaggttaaatctaaaaaaaatacgagcatcagtagaaagtctagaacttcaattaagtagaaaagtttcattacatgaagcttaaaaagatattcactgttgttcatgtcaattcatctgaaagcttatgttcagaaagggaagataagtatatacgagaaagaaacatccaacatgacgactgggttttttacaatgtgaaaaaagaacttttcagaacataacaaaactagtgatgcttggacggttttaacttttacacaggaaaatgattccaagtatatatgacaaaaccgaaaggaaaaactgaaagggtcatgaatggtgtcacatccttggccttgataggcgatgatgccaccatcttcagatagaaacaggttggaaaattcaggagttatgaactcttcttcccatgaaaatctacagtcgtttgattttcaaccgatgaaacaatatcagattttcagtaattcatccttgtgacagcaagttaattctactttcagtcttttcctaactgggttcgcaagctgtataaatcaatggagattctgaatccagctagctaaaacagtgagactggtacaagcagcagcacaaaatacacagatgggagatgggcgtgttgttgcttcagaatgcaggcagacttcgccatcagctgcaactggcaaataccaggcgatggaatggagtggatgtgtgtgaagaggacaaggcaaaccatgtgccctgcaccgcatctcaggcagaatttctaggccagaaacatgcatgtgtttgcttgcttccctggaaatcaaacacaccagaagaatattttttttggaaacacgatacaaacacaaacgctcacatacgtgcgtacacacatcctattcccatgaacacatccaagagattgaaccagtgtgtcttgagatcgatgaagttagcacagatacctcgctccgcctctaatcactaaaagaaaaataagccgtgaatataaacattaatatcaagtctagagtttaaaccgggataggtaaggtctaccataagggacctaactaaatgagctacacttggtaccagaagaatatttttgctagacagtagtacagttgagaactttgctgcactgtcaatttagggtgaaaaagatggcatctttgctgctgtaacaatggggacacgatcacaaggttgatagccacacaccatgtgcagatctctgaagatgatagtgaacagggagaaagaaatcctccccttttttcccctctgcatcaacgtgggaattaagcctgaactcttgttagccaggagttgtagcagcaacttagcaagcactttcgtttcggcacgcgaaccgagacggatcggttttttgtcaaaattgaaaggtgcccaacaatggcatgcctaccaccaaaatctgccgaaatttctgctcggttatatcatatcacgaaaaagttgagaagatgacgtttcatggaatggaagaaagtctgaagaattcctttgcttccagtcactcacagtgcttttctacagaagccacaagaaggtgaccaccacaaccagaaaagtattcagagaaatttgtcaccacaccaggatgctctctgcacagaatcttcaccatgaattgaaccatcttggataggaaaccatcatgcagcctgcctgttggacttggatcctggacagacaaattgacttgtattttcagtttctgaagctcaaattgtgcaaaatctgcatatttagttttcccaattggaagaagggtctctttcaatctgcgccgccgagtcttatcttaatcaaaagaatggctagcatgtaacgccggccatcggatcgttctgaaatcgaggttgagataagctacaatattccgattggccggcggcaaatccatcattcaggccacatcttgcctcaatctgaatcatccccagcaatccaatccccttttctttcatacaagaaagctcatctttttttttctttcatattgcacaaacaagatctatattacatgatgaggaaagccacagggattatactgaaaacacatggaatctacaccctcaagatgcatcacacagaaccctataagataaaaagcttcacactgcaactcaagtactcaactgtgtgcccgaaatgggatcagatcaccccaaggacaggaagcatacagaggaagaagagctttatccctatgaacaacttagctatatacttacaggcaggaagctactgtattctctcagcaagtctttatgatctcaggcttccagctccgccatacaatctgccggcaaccgaatttgaattcttggaaccttctcttcagtgaccccttctttggccgctttgagcccggttcagaaaccgacccatggtagtgcagaggaggctgtggtgtgccggtctcaatgctggccacaatcttctgaaccatctcatacacctcactcatctttgggcgcgactttggtagccggacgagacagcggttcgccacactagccagctttgtcatggacttgaggttgtagtgcccctctagccgtgggtctatgatgatggggaaccgcttgatatcagatatgtatggtttcacccaatccaggagcttctgctcaccctttgggcggttccggtcaatgggacggcggccggtgatgagctcataaaggagcacaccatagccccatatgtcactcttggcagtgaggcgtccggtctgcatgtactccggagctgcatacccaagagttcccacgacctgtgaatttcagatgttagttcagtgaaagaacaaagaagtgaggctttgaaatttagtacagggagaatctacttggaaatttagtgcagggagaatctacttggaaatttagtgcagggagaatctatatattatatcatttgtaatattataaagcatgcttagcatcaacactttaaactgaactttcactacatggtgttggctttttgtaaacgagtgatgggtccattttcccttttattttggttaaatatatgaatgctgcattcctagatgctagtgctttttgactgcttcagaaactatgatacataaatcagagatcaattatgtgtccaaggcaattctacaattggttgtggagcaactgagtgtccaacttcgttggtataaaaaatggatcctgttatagatgtgaaacagaaccaacttactaaatgcacatacaccatcaattatcatcgagattttctttatcttaatttctcttaggtcatcatgcatttttttttcccaatacaccaagttaaagactctgggggcagaaaatccagtcacaatacaaaagtgcaaaatggttctctatttttttaaaaaaaatgtgggcagtgtaaaatggttcttggtatatcaatgcacataccgctgtagagacatgggtcaggccttctgatggtccatgcctagccaatccaaagtcagacaactttgcattccagttctcatctaacagaatgttagatgtttttaggtcacggaagataacctgcatgtatatattaagtttagcaccatagatatagcagacaaaaaaacctaaagaagtgcatctttcaacatttcattgcagataggaagtgatgcaacattgcacaactgtttcaggtacaactggtagcagttttcatcatcagagagcaaaagagttacctgaaattccatctcttcatgcagatacttcagtccccgagcagcgtccagagctacttttagtctcattggccatgatagagttgaatttgacctacttgacaagtgatcatccacgcttccattaggcatgtattcgtatactaggagacgctgtacgcccctttcatcatcttcagcgcagtagccaattagtttgacgaggtttggatgctctacaatcccaagcacattcagttctgttaaccattctttctgcccctgaaaaacatgataatttattagaacccaaattagaggataaggctagattcctgcataagtgacttaaaaaggattcatcaagcaaggtgcacttgagaggaatttcttatgccatgcttgactgtaaattgtcgtgcgggtttcctgaataaagtaatggtttcttttctgaagaaaatagaactggtgactagaaaatgctggtttattttcgctccttttaaatgtgggaaaaaaaacataatgtaagatatgcagtacaagtagaaggaagttgctatgtgcattgaaagcttgtaatcggtacagttcagacgagaaataacttgcctgaagtcctttgcgattcagctgtttaacagcaatctcggtgcgctcagttggttcatcggaattcttgatgacacccctatacacacatccaaacccaccctcaccaaccataagagaccggctaaaattgcgagtggcattcttcagctcagagaaagagaacaccctgaggttactgggccgatcagtgaagctgggatactgtgtcctccgtattgattcggcactcatgtcagagacattcaaggagttgaagtcggagccggaccggacatcccgctccgtcgatgttgtgctcaacgaccggacagaagccgacttgttgacgggatcctcctctttggaatctccatgcaagaaaggcaggcacctcattgctgcaatgcagtgggaacaaattaggagctaattcatgcttcctccatgcaacacaaacacaaatagagaattggaccgagaagatccattaggaatggctgctaactactgtgaattagaacaggtataaaactatcaattactttcttaagtttcctgactaggaaatgctttcccttgcttcaagcaataattttagtactgaaataaggacagaaaaaactttggagcctgaattatgcaaaatgacaccagctaacatgtgtgaagggaagatcttatcatgaactgacaagtatatcaaatctaaaaaaacaagcatttttactgttccaggatccaattacagcaacaatcaacaggaagtaggacaaaaactgggcctttacaccccagggacagaaattgagtgctgagagaattctgtaaatgcaaacatgcctaagctcaagattggggaaaacagcatgacgagggcgaaatagcaccaggcctgatgaaaccatacagtcatacataccgcaactagcgttaattaaaccgaatcatcaaccaaccttaatcctaccaaaactaccgctattcctgacaacaaatcaggaaggaaaaaacatggcaagatgtacgattccaaagtcaaaacactctcgaacgcaaaacgcaacaagaacaagtacagttatcacctaccctagttagcatacatacacaacatctcaaccaaaaaaaaaaagaaaagagatggaaaagaaaagatgataccttgccaatcttgcagaggcgaagatgatccgagaggggaagcaccactccgcctgcgagggatctctttgtgtgtgcgatccaggcaggaagcgacggggaaaggggagagaagaaggcagatgagcacggagatggagatggggggaggtcggaggaggaagaaagacttggacttgggctaagcagcagtcaaagttgggagctttgcctcatattgatttgttttatccctctccctctcatcagtctcaggttctcccctttctctctcacagtcacacacacctactgatatttttttaatatttttttaattttaacttacttatcgttttagtttattagtattagtctaaacctaaggtggtgtttgaatctcctgaatatgaagatgaaaacgtatatgaagattaagtgtttcacgcaaaacgaggtactaataacatgtgattaattgagttttaattattacaaacttgaaaaatggattaatctgatattttggaataacttttatatataaatttttcgcacgaaatacaccgtttagcggtttaaaaagcatgccacgaaaatccaaaatttcatctgtagtggaaacgatcaggacctgtcacacacacctactgaacatttttaaatatatttttaattttaacttacttatcgttttaattagtttattataagtctaaacctaagtcaagtataatttttaactgttaatatttttaaatccactaaaagaaaatagttttattataatttatatgttgttaaactctacggaattttaaaaattaatggacaaaaatagttatgtttgacttaggagaaacttagaatgacaagaaatctaaaacgaaatatcactattaagcagtttgcactcttattctagaaggaataatactag

SEQ ID NO: 64036 - DNA, 1276 bp, Oryza sativa
tgcagtcaccttgcaggagcctagaactgggtgatacaggatggtgtcctgtccagaacatgataactccatgagaggtgtgccgcacgacggagattgtgatgcaaggcggagtgggaaccggacttttggtccatgtttgctgcactgatttggtggacaactcttgaagttgaagaagctctcggcatcccatgctgtggccgcatagatgagaagagatagtagcagcacaacaacaagaagtttagccatgtttctgtagtgctgttgaagattgaaggcacaaggagaaggccatgaatgtaactataatgaaatttactgggagtttatgctgtgcttgtcatgaactcatgatagcagcgtacttttggagcaatcccaaagtacaatgaaacttctgtggtcccatgttgcagtcctttttagtgtgactgcattcctggcgtcatcagaaaatgaagccgcacttccatgcaacggtgaactgttgttagtgttaaacttaaactgtgaatttgctggcagtggctagaagctattgtaaatgaccctctgcagcacagccctgtgtagtaaagatattgtgaagttcttcatagatagtttactccaatccatatccaattgtaaaagagttctccgaaagccttattctgcacactgatcttcctaattattttgtgacagatgatgggacggaccagcttcagtccaaatgtgcatctcgtcttcactctggaattccagatgaggtactccagttttatttgctctctccaaatttaccagaccacatgaattgaatcccatagttttcactgctttactgatactgatgctctaatggattgaggctggagacatgctctcttttgtcacatccaggctcgattgtttccttccccaagtcagtcaatgccatcactgtcatctgctctcagccatgtaattgttacccacccgtgtccatttgcaattgagatcctctgctgtattatccctatattgaaagtcactgacatgtgggctaagcatatagctagctagcttggacagcaggcccctctctattgtaataggcttgtttgcactgcctgtgaagctagctaccgtagcgatggctggtgcgtttcgtcgttctgctgccctgcaggccatggctgccttctctgtgcttgcacttgttgtaccagatcaggttcaggggagaggcaagtgcccatctttctcctgcggacgtcttaactatgtgcatttcccattccgtcgt

SEQ ID NO: 64037 - DNA, 17202 bp, Oryza sativa
aattgcaatgcactaagttgatttcactaatgatattctaagagaagacacttacccagcacagcacaaggaaaattgaatgctgtgataacaccaacaactccaagaggattccacacctatttgaatgagctttagggattagctttcttccacatgagaaacagagaaagtaaatctggagttaaaagaactggtttgtgcctacctccatcatcatatgattcgggcctgaaaaaaagtagaagacagcattagaaaatcttccagtatacttatcaaacagagcattgatgaattttacaatcccataagtatgaataaatggcaacattactacaattgagaacgccatggctcaaccttctatcctaaccacaaaaaccaatggtgataatttgggcataactctgtaaaatattgctgtctaacggacaatcagcgaatatcttatcattactacagaaaatcgtgtgatggcacattttgataagtaatggtggtatggcatgtcaagggacaggattttgtatagaacagtaaactagaatggcaagtatattgtgtgttcaaattagtgaaatggagaatcacttaacatgaaataatccagagagcgaattagtaataatggagtaaaattgcttattctaatgaagtactaatttcattagaaaacctggaaacctaaatcaattgaggtattctttttcagacagaattaagatataataatatttgtatctcaaccaaatagagaaaatatgatcagaagtatctgctgttatcatactttgaagcgggcatcagatataaattaggaaagggagaatgggcttacgttcagatggtatgatggacccatttagctggcgacttaggcccacagcataatcacacatgtcaatgatttcctacaaaacagaggttacatttatgtcaacataatcatgccttcatggtggagaatcaatagtcgcagttaaatattcgatcatgaaattatctcaataatggccaaattcttaggcaagacattcgattggcagaaagatgattaacagagagaaaaggaaacacaactgcatatcatgttaggggctaagttggtaattctagcaggcaaggtattgatgataatgaagcattcgtgatgagcacaccattaatgttctaaagataaatcactgaatattctgaagaaacacaatatagtggtcatttcctatcctgagtgcaaaaaacaatgaagctctgagtggaagaactggcggcaattatacctacctgaacctctccaatcccttcaggaagaattttccccatctcaagtgacacaagcctgcccaggtgatggagctttgctctcaatgcatcaccaatttgcctaacaatttctcctcgctttggagctggaatctggacatattaatatgtaactgttagtagttttacaataaaataacttaaaaaaagggatctcagctgcgcttcttccacatatttgaatttttgcatcataacagtgctgctagcttctatacatcatagtgtgcttatacatacatgtgtattttaattaaattttgatatcacaatcttataaattaaaacatgtatgaaatatgaaatcgtagtgtgcacattgcacacagtctctactttatcagcattttaacatcggacatactgttactttgccatttcccattttatatcagatttttggtgttcctgaatcatataacgagtccataccaccttctcaaaggaaggagatcctctgatgtagcaccatgctacggcatagggctatagtaccaggaattagcccttgatccttgtcgtttattaacggactaatggtaaaggtgagttgttacatcactttcgctacagtaatgattatcatgtacagtaaattaggtacagtaccgaacactgtttgctgcattagagcgctatagcagactcagattcctgtaaggctgtaaccaaaagctgaaacccccaaaacacccaagttacagggttttgaggcagcatttccaaacaaataatatcgcaacgtttcgaattgcacaattgctggtttccacacagtcagatctctcacgcagcagaaaatagcaaatgacacacaagagcatagtacgagcacttcatcatccgaacgaattgatatcagcactccaacacagcaagtcaagtgaaactcaccgccatccaggtcttggcggcatcgtagcaggcgcgcatgccctcctcgtactcacgcgcggacgcctccacgacctccgcgatgacctaaaccacaaaacacccaaaaaaaaatcccccatcaaaatccaccacaatcacacacaccccaaaaatgccagggcggcccaaaccaaatcgagcgcctagaaccgagcggatcgtgtggggggagacgcgcctggttgttcgtcgggttggtggacgtgacgacggggcccgagccgccccaggcgccgcaggcgaaggacccggggttccgcggcgcgaggccaagctcggcgaggaactggtgctccttcctcgcgaagctccccatggcagaagagagagagagagaggtagccctcctcctccttctagaagacgggttccttctgcgcccgtacggcggggaggggatcggggtggggtgggggaggcggtggctgtggctggccggcggtaaggaagggatacttatacggaggcggtggagtggggactgtgtgtcacgggaaggggaggagaagggagcgtggagtggcgggtggggtcaggagggggtagcagtagcacgggacgagacggcacgaagccgaaagcgtgagctgtttggtgaagtccagaaaggtcaaaggttttattttcccatctttttaaagccttcatcgtagcgctcttgtaaactaaaatttaataaaatctaaatttgataactttttaaagtttcttcatcgcattttattttacatgaatttgcttttgaattattaagcgcacgtatataaaagatttacttatagattagtttttggttgctaataagcaatgcaaataaacataaacgcacattcctttttccctataactacctttcatccaaaaacttttgtcttgaaaaactttcttaaaagggcttgggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcgagtgagatatagcaaaattgaaaggactttacgcaattacgctacaaacacagctacgctaaaaatcacttcctttctttgtttttttcctttgttgtttagattttttttaagtacgtaatactactatacttgttgtgttgtatacatgtctatcatgccataaagttggttttggctatatttgcatttgactttataggtcatgatgactcgaattcgctatccaaataaggtctgccgtgttttggaaaagagacactccagtaagaaaaaaaaggaaatgaaataataaagcactctaaagtctagacataagagaaaaggagagctgggacactccaacatcagctgaaaatgaattttatgctaacaagatcgggtgatgcaataaataaagcatggataagagtcatgaatttgcttttggctagctagtataagctgagataattactcaacaaaataagttggttttggctagtacatgtgagtatactccaggtagattagacaacaaaataaatgtacaataaccgaagtttcaatacagaagggcgcagattaaggagaaacacaagattgaaaagaaagaaaagaggattcatactagttggaccataaataggctagaatttatcaaaccgttttggatgggcttaccatcaccttatagtttgatgtttatcgtgataacagcacggatatcgtaaggtatattgtggtttcaaaaactgataaggttaccgtacgtcataatcgcgataactgtgtgataaccataagattttgtaaaccctagaatagtccacctgtaatgaacagaggcttcatatatgaatcatatgatggtgatcttaattagctcgcttttatagatttctgaagttgacaggaactcgcttttcattacaagatagagcgccctggtattactactggactcactcatagtgtaagcaacttttcaaaacacaatgtcaccatcatatgattcatataaattgacaaatatattatattaccacatcaatgaggagcaatcctaattgtaaacttccagtcaatccgtgttctctcggaaagtgacgtctcatcccgttccagtattccattccatctcattcctccgaccaaaaaaaatcacccaacataaccatcgaagtacaaacctattcttttattccctgagatttaacagtaacttcagtggagtgctagtaattttaacctcgttttactgacaggagatcgagccgtccaagtgtaactgtgtaagcgagcaccatctctctttctcacaattggccaacaaattaaaggcatttgtccctctgtgccaataatgcttggcatggatagctaaaagtattacagaattgcacacatgacagcgacagagtaggtcactgtgagcacacagctcacaaagccgtgccgtgtgtcgatgcccctctgtagcttgcatttcccggctttccgcgcgccgtcgcccgtcgtcgtcttcggtgcgaggatgcaagatgcgaggcgtgcttcacttggcctccccgtctgcatgtacgtggagagacgttttgggataaggacgatctttatcaggccggagtcgtcgttgcaaagaggcaaacacatcgattcgtttttgtttctcgttggctgaacgtttcaacgtcttggcttgtgaaatggaagcgacctggtttgcatcccaccgcgcaggaatatagggtgtcccatacgacactcactctcaggctcccccctgcaaacagggaaggattttcagatttatcagaaaaggagagccttgaacatggaggaatgtagctcatgtcgacacgtacgtaaagaaagaaaaaatgtagtagcctagtaggtagatggctgttggtgcaatgaatagagagagttggctacggtgaattacctgaaacaatttcctattatgaaatacatgtactccatctgtaaaaaaacaaatttagaactatatgtgacacattctaacactgcggatttggatagaagtatatccagattcatagtactataatgtatcacatccagtactaaattggttttttatgggacggaggtagtatgtttcagccaactagctaggttcactattcagacccctatcgattaacttaaaaaagttaaagccaaaatttaaattttaaaacttaattttgatattgattttaagatactttcaatgtatctttttttagcattggttaaaatcgctaagaatatatatgtaaaagttttatacacaaattaattttattgctatataagctatacatgttacctcttataattagcttttggcaaaccaataagacctcacccttaaaactttgtttggatgggccgcatgccgcgccagcaccatcaattgtcgcctgctcgacttcctcgtcccgctatgctaccagagaggaaggcgggggaggaagctcgacgccgacaccgggaggagagggaggtggcggggaggccagcggccacgccggatgcaagtagtgtcaatgacaacatggtagggggccggagtgcagcggtggggatggtcgtcggcgccgctatatggtccgaccaacgcggaggccgtcgggagggggtcaatgccgggagaactaatgatagatgaaaggagaagaaagaaaaggctgacaattgggtcccacctattgattcaactattggactagtcaacacatcacgttagtgaaaaccactttcaaaatcatcgaaggaatcatttcatacgggttttagtagttgagggttctaacatatatggtattctgatcgggttttagtattggatatatatttgagggagtcgaagtggacttattctaattcccgcctggctaactgcatgggcctcattgatccaactccacgctggcccaaaggggacatctcactggagtcccagcccaaaagaaaaggaaaaagtgcaccaagggtccctcaacttgtcatcgagataaaaaaaacatcctccaaccgtaaaaccaaatatgcagggtccctcaactatataaaaccggtcacccgagatccctatgtggttttcaacccggttttgtctgacgtggtggctgagtcagtgtgggacccacatggaccccacatgtcagctagccacatcatcactgtcagggttatggatactacatacctaatagtagttgactaaatctcggcaggacccaccacataccatgtcttatacgggaactgactgcggatatatggagggagttccggataaggaaagacaaccagagttctacatggaaacgacaaggactactcggattgtatccatattggtttctctagttctacttggacaaggggacatctatgggtataaatacaagaccccctaggaggagaggagacacggacaatcaacgggcaacatagacgccacaaagccatgaaccaatacaagccaacatacgccaagacaagacgccagatatcgatttcggagataagcacgactagtcccctacggtatctccggatactgtcaggagagacgaaagcgttatctttgatctcgccgagcacgaactcgaggaggaagactaccctgttgtcgactacgagtcagaccttcagaccgccatatctacaacaattagataggctaccccaaatattgtactggtgtgattatggtgaataagagcaataccggcttcggccaacaagatgtagggttattacctgacaattcaggggcccgaacctgtataaaaatcctcgtctccatctcttttacctcagtctcgcgtataccctagtaccgacgatccccatactatgcaaataccggaatcgcgacatcaaacgtcgacaatcaccctttccctcatctctttttctcctatctctctctctcttctcgtttggtgctcttggcaggccggcgccgccggccgactgatggcgaggagacagactgggcgacgcgggagaggaggtctggcggccggcgacgtggcggcggtggcggcgacggcgacgacgacgacgacgcgggagcaggggagctctcgccgtcgtcaccgagggcccaaccatgatcttgtagcggcgtcggtgcagcaataaaagggaacccaccgaggagtgctagggccatgtcagcgccgacgtgcaattggtctcggtgaagatggggaagccgacgatccatattcagaggaagatatccccttcatcgatgtctcggccggtcacctgcgcctctctaccccgaggccccgagcggccgagttcccatcgtctcatcacctctcttcgtcctcttctccgcccaccccaagccgccacctctccccccatcctcccatctctgcaagctcctccgtctcaccgcctccacatccgcctcctccccaccccgcgccggccgctcccgggaacccacccatgccaggccccggcccagcccccgcccctccccctcctcctcctcctccctctacgcgcgccccagcctcctcgacatggagcgtggccgtgcagcccgccgcgccgacgtcgacgcgttcctcgcctctctcggcatcgacccgggtgagctcgctggcctcgagctccacgccaccatcgatgtcatgcgcgagcgcgtcgagttcctacattccctcaagcgcgtcgagttcctgcactccctcggcctctccgcacgacgtgacgatggaggggatatctacccccgccggccgcacgccgctcctgcccccgtctccgcgcctctcggccttgtcggcagcagtggcgtcgtcctccactgtcgttgccctcctcacgaaggcctcggtggctgacgctgcggctggtgcccgccgccactccgccggccgccgccccttttccacccggccttgcacgcgtgtattgttgtcgggtgcggcgacgtaggtggaggcagaggctgacgttgcggctggtgcccaccgccccttctccgcccagcctcgcgcttgtgtgtcatcgtcgtcgtcgtcgggtgcggcggtggagcttggtagtcgacgcgccccgcctcgccagcacagagaagatagagagaggaggaagagagagaaagggggaaaagagaggtgacgacgtgtcacctgacatgtgggtcccatgcttactcagctgccacctagatcaaaaccggggtcaaaaccactgaagaatctcaggtgaccggttttatatagttaagggaccccacatatctggttttgtggttcgagaacgttttttatcccgatgacaagttgagggaccttcggtgtactttttccaaaagaaaacgagtgcctgcgccgctgcgcggctgctcgcctgctcctgtgctccagcctccaccgactcttcactcactcgtatgaggcgcgtgtgcgtggtcgtcgtcgaggaaacgaccggtaaaacggagcgcgtcgcgtgcgtgggccgtggtgacacccgctgacccgcctgcacgaggcgcacgttgcgggcacgctatgcgcaccgcagccaccgctgctatgcgacgccggcctaggcaaggcgctcgccgcccgcccgcaactgaaaaaatgaaaaaaaagaacgagtcgcgacggcattgcggcctccgccagcccgcgcgcctctcccagcttttttgcccggacgcgggagtacaagtgtagtacaggtcgtgcccctgtactgcctcggctgcccgcctgattgtactgctgctgatgctccatttgatagggcacgctttgcccgctaattacatgtgagccacggcccacagcctcggcgtcgatgccatctattagcactagcactagtattttatagtatccatctggtttggcgtttcttgccacttgcccatgattcccactcctacgtcctcttgccagttgccacagcatgatgaccaatgcagcagcagcactcgaggaaggagagccggacggggcaatgcgccggcgagcggccgaaaaggagggggaaggtaaggtacgtaagcgttggatagtggcggttttgacccagactcgttccaaacatgacgcacgcgagcttgtttgtagggccttaagctaggaggcgaagcatctgtcggacaagtcataaacataaaacgaccactaaacaatcaggtgagtcgatcaccaaccatgattatcagattatctaggataaagtgaagtgagtataacttatcttgttagttttttttttggaactaactcatccgggttaagtcataaacttgacacgagtgctcgtatttattgcttattagtttttagtggtaggcagcgtacccgtcgacagcgagataccagtggttactttgtcaatttcaagatatgtccgtccaatcttttggagatgctcatagagatatggtgtgcgtatgtgtgttcatagagatgaggctcataagggtagcgtgtgtatatgttcgtagagatgaggctcataagggtaggggtgtgcgtgtgtgtttatagagatgagtgtacccgtgtcataaacgcgtgcgtttgtagtatgtttctaaaacaaaattatgggataaaatactatacctacatgttgcttccacctataaacttttcacttattcaaagcatcatgtttcatgccatacggttgcaaattactaaattaggcagcgggaagccacctcttaagctagtcagacgatcacctcaacagagccagctcctctgcttttaggggctgaaggtagaggcgtagggtaaaatgatcctgctactacagtagggacagtaatttgtagttaattactataggtacagtacaaaacacagtaaatacagtgttcccgaatattgtttatgatgtacctagtatactgtagtgatcgatctcattcattcgctgtaaatcggacaactgagaatatcccaaagtaatggcactgtacgtctctctgacttcattatgtgaagtcagtggatcccaatccctgctcaaccgactaccgccgatatttgaaaaaaaatagctagccgataaaaacactattaattgtttggactcaacgatatcgttggcttcattacttgagttatacataactatataggaatcaacatcggatatacagataacttgctttgacatgaattattgacatatgggctactatcaagtagaaacgcatgttagtgatagaaggccccctttaaatcaaagaaaaaattatagaaattctagaggattttatcctatggaaaataattctatagaggtatcctttgaaacggagaattatttttctatcaatttatttgaaatttctatggaatataccttactagagcaattttagagaaaaataagtatgaggtctcacctcatgttttcctcttcatgtgtgctaatcaaacgatagtttaaagactttcctttgtttcgcaatcccacataaattcaataaatatggcattttattcctacgtttttcctatttctctattatcataagtaaacatgaattttgtgtcatgattattcatcttcaagatagtgcttctcaactcagaagcagaggacatgataaaggagaatatttaagttggaagataccggttattactattcagaaacttctaaaataaatcttacaaaaatacctgccgtgctgggaaacccaacctccagtccagtggcgcgaacgtaaatacaaccaaacccagcacccaaaatccaaacctcgcaacgaaggccgctccttcaaaatcccaccggtctctttcgccggaatcctcatccctcctccccttctccgtccaaactacccgcctccgctcccaatccggcgagatcaccaaacccctctcgccgcctccgccgccgccgccgcagcagcagcagtcactccgccggagcaccatgatgcacatgaccttctactgggggaaggacgtgacgatcctgtttgacggctggcggacggccacgtggaccgggtacctcctctccctcgtcgcgctcctcctcgcctccgccttctaccagtacctcgaggcgttccggatccgcgtcaagctcctcgcgggcgccaagccggcctccatcccgcccccggcgtcctccgacgccgcgcgggccccgctcctcctcccctcgtccgccgccggacgctggccggcgcggctggcgacggccgggctgttcggggtgaactccggcctgggctacctcctcatgctcgccgtcatgtcgttcaacggcggggtgttcgtcgccgtggtcgtcgggctcgcggcgggctacttggcgttccgcagcagcgacggcgaggacctcgtcgtggtcgacaacccctgcgcctgcgcctagggtttggctttgcggctgcccccaggtgtggctcctctgtttggtttcccgatcttgtatgacaagtagaaataaatctgtgtacaaattcaattgcgtgacagggggattccggtgtttctgtaatttggggggaaattgtagagtacaaaatgagaaagctgctacttttgtgtttccaaccaattgatgcattgatgcctttgtgaatgaggaatggataaagatgacttagatcaaattgaagaataatcaactctagaatggacagagctttctctctctgagctgcaacgaatctaagaagtatcatcagttgaaagatgataagcataggcatatcttttctgaagaactgaaaattgacaatatgaggagcctagattcgatcacggaaagaaaattctcccttttctcgctcttcttgaatgaaatgatgctgtccctgtgactgaatgcagagacagtatgagaatgggtaaactgtagtttggatcatgtaagagcatgatcttgccttgtttatagttttgctcatgattcattggcaatttggccttatgggttccttcttgttcagtgatcgatatgaacttattagtgaaaagttcaaaacactaatgggtactgatcatgtagccatgcactcaatttattcagagcttggagtgaaagttaagatatgtgctttttcatgattcatcacattttggctcgcatggtgatattttagcataatcttaagctgagatgatgaaatgagtaggtcgacgcttgattgatcctaggcagttggcaacctccaatcatgtggacagcgcatgttgctgcagcaagtacttgttcaataggtgtattgtatttcctcatctgtggcatgaagccatgaactatgtacaagtagtggtatcggttgctttcggttgccctcgtgagagatgctcaactttgtgactttgtcttgcaactagaccttttctagttgacggtgatgtgaagtaataatgggcgcctcgccttatccatttcaggggaaaaaactgttgcattgcctagattaagctttcacacacattttaaagtcgcccaaatggtgttgtttgttttgctgcttgaacttgaagctgcaattgatatgtataactttttaggtattgttgttatggatcggactgtgtcaaacacttcgttggcaggaatagtctcatgtgcttcttttttgaaggaaggtctcatgtgcttctgtgcatgtttgtttatctgtgctgtcactgggctctgctctggctcctaaagcaggtttaacgcaagagcaagttctttcttctctgatactactccatcgtaaacttcagtaatagtagcagcactattatcaattggattgacacgccccttgtctgttgctccagtagtgagttataccttttgttcagatctgacttgtgagaaatggtgatcacccttcatatcgtcattgcttcttgtagggttaccgatttgttcacagttaacgcaatctagactgaagtctcgttcgccaaaagatatcgccgttctgaaggcctgaaactcgcatctgtagcttatttttccagagggcgcatgtttggctagtcgctcatgcgcagactcggaactttgccaaaaacttggttgcaaacttgggctgcttggtggatgtcagggaaggcgaaattctgtggctggcctggcctggccttgtactagtctgttcggcacttcagcctgataacgttatgggctttgacagatctggccttgcaaatataagcccgcacaccgggcctggcgtcattgtgtgagctttagtacattcatgcgttgcggtttggttggtcagttttgacctttcttatggtccttaagtcgcaatattaaacattaaaatgattgatagtagtaagtactggactactaatagttgttttttagtgttacttagcaaatggccgattcattgtgtacactgatctaatcgtgttttagtttacctttgtttctgctgaacaaacacaccataattagcaattgtgcaagttggcaacaagccaacaacgagaggttgaacggaagaagcaacacagaataaacgataaaagaaaaaaatgaccaaacatcaaggagactaggggagagggtttcttgacacattatttctgcaaaacatatacagtcacgcattgaatttacaagtttattactagttacacggcgagaaatggaagaaaaaaaatacaatatcacgacagatacgcgcgcaaagctttcattgccatcagagctcgagtagctcagcggatgtagtagtgcgagttgcacctcagcaccatgcgcgccaccgccgcgggcacgacggccgccgacctcgccggcgccgcgccgatagcgccgccccgcgacttcgccggcgcgggctccagcgccgccgcctcggcgacgagccgcctcatcatctcggcgtagtactccctgagccgcgccagagcgcgccgcgacctcagcagcagcagccaaaggaagaacgtcctgcgccgccgtggcgcgccaccgcccgcgcccgcgcccgcgccgagccgcgccaccgccatcttcggccgcccccggcgcgcgcgggcgccgcggccggacactcggaatatcatgccgccgctgatgcgaaagggattatctctccgtgacaggaatgtgtcgaagagaccgacgacgacggtttgatatggtaggcgcgccacgccttaatgcagagatggatcggctaaaacggcgaaacggcttggcaaaataggcaaataccgtgtggttggcaagttcaccaaacagactggtccgtggagttggtagagcgaacagcgtcgagccgaacgctgactgctgcagtttgctgattcaagcggcggcaactagcactaacaaaccttaatttcttttaatacattaatgcttattactatgctcatgacgtccgcacacttaccttttataaagccacacacacatacctaattcctatgagtacttctgaaagatttggtcagtatatttttagatcgacaaagttactacggcaaggatatgagcacttctgaaagactaagccggcatatcttaagattaacaaaactaccataaacgtttcgctactgacgaatatatcacctacactgaaatattcccttcaaatgttgacaaaatactttaatacttgaactcaggtagacaaaatttcaccataactccataagaaatttaaccagttaagttatgctcactttacaacaaaccttaacatatagttcagcagttagaacttgtagttgtgcaaagtttgcagtaaagcatactctcttcgtcctaagaaaaaccaatctagtactaggatgtgacatttctaatacaacgaatttggacatactcttcttttttttattaaacaaaaaagtatgccttgcgtcactttcatgaaaacatgtacaactctgagttctgaaggacattgaggagcttctttaatttgggattttgaagaacgtgaacgtcaaacgtgtagtttaaatcgaggtcattttatttttggttaaggctgacactggctgatatcatgaatatgtcagctgtgagctgacacgaaacacacattaatggaagttagcactttgaaagcgattagggaagaaagcatttgcatggatcctgttctgtgcggtgaccagctcacacccgcaccaatggcaatgcatgatcgatgatcatacagttgaggatccattatggtgtaaaggtgatcagtcactgcataggatcctatctgcgtccacgtttcaataaacactgagctcaatgttttcaggtaacttgttttgattcgactagagtatgtttacttcctgaatgtgtcggcacttggtcgatcgctgagttgaatgttcatgaacgctagtaataaatggctaatagcgtaacaaattatcctctgttcattgtgattaggatcagcagtaatcgttagtatgaacgttcgtacgactacagtgtacgagctacagaaatgtgtttcagtgtattgttgtcacagcggagacacaggaatgcatctgacttttgacggtatatctcctttagtttttcacaggtcaacgtacacgacacaaattaaagattggatagtgacatagtgtacgacagagctgagcaccttacacagcaaagcaaagtcagtcttcagattacaactgcaagcagaggcgcaaaacttccatatgaaatgccaagttctttttttttttagaaacaagcgcttgtttagttccctctaaattcctaactttccatcatatcacatcacatcgaaaactttcctacacacataaaccgataatgctattggtcggtcgaccgacgggggagaaaaaatcgggcgctccccctgcggccccatccccacgcacagtgataccattgaccccaccataatatctgtccccacttgcaacaaatcaaccatatattttgcaaaccctatattaagggaatttagtttattttttgttccaccaaaaatgttgcacctagtatactcacaatgtttcactatgtatagacctaatgttgcagtgaactgaaatattccgttgcaacaaaaaaaacccacatattttggaaccccctattaagagaattcgttttattttttgttccaccaaaaaatgtttcacctagtgtatttataatgtttcattatgtatgaaccaaatgttgcagtgaactgaaacaatctttcgctatttgctgaaacattgtttttatataaggtgaaacaacatccgatttaaacgagtgaaacattttcgatctacttagtgaaacaattccgatatacctagtggaacatcgtgcaacatttaaaaataattcaataataagctaaaaaaaatttcgtcggaatatatccatgtgtggtcttgttttgaagatttaattgctacgaatttaatggtgcaatcggatcattatttagataagtagtttaagagaaaaatcagtttaaaatagtttttgcacgtaaatcgggcgctgacgtcatgctgacatcagcgcccgattttaatcggctcccatcgggcgcccgacgggaagtcacgtctgctcttaggaagtcttcatcagggaaatacatttgcacccttgcactcaaactttcttgttcttgcagcattctccacgcttgtctcgctaggaggttaaataattcaaatcctttaaccccatccctcccatttcttggttctggtggtttgcctt

SEQ ID NO: 64038 - DNA, 16133 bp, Oryza sativa
gagccatgggacgccggtcaaagctgcggcgcggcggccgggccatcaccgccataccggggggattcctccacctctccctcctcgcctccctccgccgccgcccctcgctccaggcgcacgcgcagctgctcctcgtcggcctcccgctcccggcgccgaccgcctcccgcctcctctgcccgcacctccgctccgggaacccctccgccaccctccgcctcttcctccgcgtcctgcgcgaccgcgaccggcggccgtgtcccgtcgactcccaagaggatgtccccgactcaagctccttctccgccgccctcgccgcctgctcccaccatgcctcgccgtcgcccggattctctatccatgccttcctcctcaagtccggattcgcctccgacgtctttgctgccaattcactcctccacttctatggttccttcggtctccactccctcgcgcgcaacctgttcgatgaaatgccggctagggacaccgtctcgttcaacactctgatcagttcatatgtgcattcctgttgtagtagcgatgcattcgaggtattcaggattatggtggacagcgggttacggccggatgggtggaccgtcacggcgttgattggtgcatgcgctgagctgcaggacttaagggcagcaaaagcagtgcatggggttgccaggaggatgctagagccacgagtgtttcattcaggagaggtggcaaccagtttggtggatgcatatgtgaagtgcagaagcatggagcttgccaggcaggtgtttgatttggcaggggataatgcaaggaatgcgaggttatggacaaccatggtgtcagggtatgcaagagctcaggagtttgacatagctcaaagattatttcatgagatgcctgagaaggatacggtcgcgtggactgctttgataggtggctttgtccgggcagggaggtacaaggaggcagtggtgttgtttgaggagatggaagaggcagggtttgaggcagatgaagccacaatagttacagtgctttcagcttgtgttggttatggtaacatcgatctggcaaagaggcttcattgtcttgtggggcgtgatggtctgattaacagaaatgcaaagcttgctactacttttgtggacatgtatgcaaagcatgggtgcatacagacagctcagaaagtgttttctggtgttgatgatgattttaagacattggagttgttcaatgctatgataaatggacttgctcggtgtaaatttggcgagaaagccattgcactttttgatgaaatggggtcacttgggctccatcctgataagataacgtttgtgtgcgtcttgtctgcatgcagacacagcggcttggtatctcaagggtttcatatatttgattcaatggaggagaagtatggtgtcaaaccagagattgagcactacacttgcatggctgatcttcttgcaagggatggacaacttgacgatgcgtacatttttatccagaacatgcctttcaaagcaaattctgttgtgtggtcatctcttgtgagagcatgtatgctccacggaaatattaagatcagaaagcttgcagaggagcaacttctttggcttgatcccaactacaagcctgaaaatctccccttgtcaaacttattttctgagggaaaaagaaaagagcgaactgcaagggtgagaaagtttctgaaccacaagcctgtgtgtaagcataccaaataatagaacatagctaagactggaatatctgtaagtgctactcatacttcccaccctcagaccaagctgattaatttgatgcttgtcgggcagctgatctttacaggacgcggtatgagtggggataatactgttcaccacatagagatggttgccgtagcatttgggttcgtaagttcagcccctgaatcccctgtctaaccttgggattcatgacaaattttagtaatcatcaatcagtgttcaagaatctgttaaagattttcaacaaagatatatggctgaataacagggcaacctccatgaaatggaaacaagaggcatgcccttgcatggacaatggtgatgcatttgcagatcttgtgaacactggcagtgcgttctctagctgtggtttgccttttgtatacatggtgcacgcggaaactaagtttgtgctcagttcagtaaaaagatccagaagtccccaggttaatctgataacagaagtcatggcttctgaaattactgcacagcagcccagaagaaaaaaaaaggtcgcaggagaattttcagggctatgttcttccgtaagtattctattcacagtttagaagttttgcgagttttgcgagtgccctttctccatggtacctaagatatagtaattctgatgctgaatgtttaaaacccagcaccttgtcatggaaattagttagtagcttattgagatatgaggtcatcaaaatactgtgttctgttgacatgtatctagcctaattgagtttatcaaaaccaacaactcaccattgaatggagattgacagctgacctaactttgtcaagataaatgtctgaacattccacagtgtatgtgtagttgaattgctaaaataaaagcatagaagggagcttacagttgtagttgcaatgacaaactccagacttatctttcaaacccacgctatcagatctcttcttatcatcactttcctccagtactgattcactttttcacactggttttttccagttagattaagcatgagtcactcagtttatttattggaagctcttttcacccataagaatgtcaatgaggtgatggccaaccacagcaaaatctaactgttttgtttgttgctgtagcttttgctcagtataattatataagcatactcttcctgaagaattagagtatcataccaagcttaagcaacctatgagtgagcatgggaaaaatatgccctttccaatcatttaaattatacccattcatagtatcataatgcagttatttcttcgcacatgtgattgtgtgatgagtgcattcagtggcaagaacgttgcaaggctaatgggttaaagacttctgtattcagcgttgacatacactgcaagtgcaatggctgcatcaagaagatcaatgatggtatgaaaaggatcagcctttcagaaggtacatgaacttccataagcatctccttgtgatgttcttgtgtgtagtggtgcatatcttctgcttgcatttcattgatgagttatctaagtttagaccttggtatcacttattcactgatgaaggggtggagtgggctgatctgatgatggataaaagcagaggtggaagtggtcgggactacggatccagagaagctatgctgtctgttgcgtgaagtgacaaagaagcagacagaaaaacgtacagaaagcaccgtatctgaaggcggcactgcaacatctcagcaaaccaaaggcctactagttggccaggtaccaagggactgacttactggcaatttcagtcaaataagccgtttttcatcagaaggatccatgatacggattacggagtactaacatatcaccatttgtcgattcgaacgttattgaaacgtttttgtccaattcacgactgcgattctgaactggatagtatttcagggtcctttatgacttattttctctggagagctcaagtcgagtgacaccaagcgccccgctattggcagaaacatggaggcagcgggaccgtgccttcagagcgatgtgcatacgtttggcatatgtggatggcatctgacattactgggacattagcgatgtatgagctctaatctaagcagactgcatatgcttcaggagttcaggtcatctccgaatacataccgcgtattgattttcctttttctggtgaattttggagcatatgccatgccatccccgatcactggttgtctaggtttttgtgtaggtttatagccaaaaatatattttttagacggagatagtggtacttttgctatagtttgccatacgatgtgctgctaccagcttgaggtgtgtgctgaactttaggtttagtttgaatcagcttttcggtctgactactactttttacaaaaaaaaatctacatagaatttctcttaataaataaataaatacattttttaaaaaaaatgtaataattagtaataaattaacaatgtgttaatggttcttttcattttatgtgccacaaaaagtcccaacggaaatgctgtatcgaactgagttcactgttgcgcacttgcaggcttacttgagccaggcccgttcgaacctgatggatgaagattaattacgtgcaagtaaacgagaaaattattagcaaaattaataaggttttaattattttaaacttgaaaatggatttatcaaatagtttaaagcaattttaatatattaagttttcgtacaaaatacactgtctagtaatttgtaaaatgtagagtagtagtatatagaatgggccatagtactactataatatatattagtactccctcggtccgatagaacgctatgtccatattcgtctctaggattttgttttttattggatagaggaagttactatagtaccaaaattttagtaaaatagtaaaccaaacacttgaacattacctttgttacaaatttggttttacccataaacttatctcttagtagggtgtgtttaattcacgtcaaaattagaagtttgattgaaatgagaacgatgtaatgtaaaagttgaaagtatgtgtgtataaaagttttgatataatggaaaagttggaagtttgaaactaaaccaggcctagtatattttggtttcactttaaatcaacaaatttaattctaccctaccaaagtttagattagatagtgtgaaaagtgaaaactggctctaaatactcgtagtagatagactcgtagaataatacagtactccgtaggccgtagtagtactactacgagtactagtagtagtatctgcatttggaagttgttgattgcacaaatcaactcccagtcagatgaagtctgaatagccgtggcctgtgaagtgaagtaaatagccgtgacctgaggagtgaggaaggaggtaggaaaggggcgaaatgacgaggaaggatgagaggaaggttggtctagccctagcccgtgaaccacgcaacgacttggaacgacgccagcaccaacaccaacaccagcgtcaatgtgcacatggttgcactgctaccataatattggctcttggagcgtcaacgaacgctcacccgtatcttaatgttaactcctccaactgatatgtactctactcgtatatgttcacgcggtgcttaattatagtcaatgcctcgcaagtccctttttgtactgctattcttggcgcggttcgttaaggtgtatttttggcccctctctctgacagagcgaagtctccgtgtaaatcactgcacatgcattgctgatgctctactattgattcctactatcagcatccacatctcaatatattggatcatctacatctatcgtgaaatataatttattctagtattaccaacctactccctccgtctcattttaaatgcaaccatgagtttccgtgttcaactttagtcgtccgtcttatttgaaaattttttataattagtatttttgttgttatgagatgataaaatatgaacagcactttatgtgtgacttatgtgttttaatttttcttaaataaatttcaaataagacggacgatcaaagttgggcacggatattcatgcttgcacttaaaatgagacaaagggagtactacgtacgaatagtaattttgtttaggccctgtttagatctcaccctaaaatttttcaccctgtcacatcgaacgtttgaacacctacatcaagtattaaatataggctaaaaaataactaattatacagattgcgactaatttgcgagattaatcttttaaacctaattgctctatggtttgataatatggtgctacaacaaacatttgctaatgatggattaattaggcttaataaatttgtctcgtagtttactgacggattttgtaattaattttttaagtgcccgaacaccctatgcgatactctatataatacttaatgtggtacgccaaaggatgtgatcggcagtgctcgctgctgcagccgctgcggctgcaagacagcaagagcaaaaaaacgactacagcggcagcagttgaaacacagcagcagccatagcggctgtagtagccagcagttccaatcagcgccaaaactctacatccctggatctagacatccccttgaaatggaattagtaagtggctacctgctgcttgggctgtgtttagatccaaagtttggatccaaacttcagttctatttcatcacatcaacatgtcatacacacgtaacttttcagtcacgtcatctctaattttaaccaaaattcaactttgcgcttacccttagttatggtttggtttcttcgattgcaaggtaatcgagcatgcacgccactgcgcagtctttcagtgaagtgatttgacgcgagctattagtagctgtactgctgctttatgtactctatagagtactacttactgcgttcaaatcctaatttccgtgtccaacgtttaaccgttcattttatttaaaaaaattaaaaagataagtcacgcataaaatattaatcattttttatcatctaataacaataaaaatactaattataaaaaaatttcatataaaacggacagtcaaacgttggcacggaaacccagggtttgccttttttttagacggagggagcagtccatactccatactgccttcggataaaaataagtttatttttcacctattattatacacgtatcaatataaaaatagaaaaaactagaataactctatattatcaaattctaatataactattcatccatttatctatttctaacaaaactatttccaatgaaataaataataggagctaaaaataaacttgggacggatgaagtattatgatctgtttagtagatctttaactcttaaatctagcttcaaaagttgggttcggaatggagttgtggagcaggctaaacctaacttcacctctatagcttattttctaagaaagttcgtcctattttaaaataggaggtaaaattgtttacaagctgtgcagacatatcaatagggtgtgtttagttcccacacaaaaaaattacacactgcatcgtcgtattaaatgcatgctaaaaaataaatagattacgactaatttgcgagatgaattttttgagcctaattgctctatgatttaacatcgtggtactaatgatatattaattagacttaataaatttgtctcgcagtttacatgtggattctataatttttttttggttattagactacgtttaatattttaaatatgtgtagtataccttatctgagacggcaaaaatttttattcctatctgaacacagcctaatcactgagctcgcctagtgtgatggagtcgatctctttcacatcaatcgggttggagcagagagcatcaactccagtttgtcgggcctgccgttgactgacccgttgacacggccacacgcagtctccaacccaacccttgcagatcaaggagccgcgtcgtggcccccgcccaagcccagcttctcccttcccctcctctctataaaaagggctccccgtgtgctaagctagtagtcatctcacatctcatccattctttttctcatcttcttcttgcttccatcgcaacagcagcagagcagctactactagttgatctcacttgagagaaagggatccatccatccatccatcaagatggggaagaagagcaagaacggcggcggaggaggaggcgagaagaaggcgacgacgacggaggtggtgctgacggtggccatgcactgcaaatgcaatggctgcaaggacaagatccgtaatggcgtcaaggaactcgccctcgtcccaggtactacactactccactagcttagctgcctggatcgatcgatcgattgattgattgattgatcgggcggtgaagtgatggtgatgagtgattgattgatacaatgcaggggtggaggcggtggacaagtcggcggtggaaagcaaaggggaggtgaggctggtggtggcggccgcgacggcgaagcccgagaagctcaaggaccgcctccacagggtcaccggcaagaaagtcgacctcctcgtcatcgcgccgcccaagcctgccgccgccgccgacgacgacgacaaggccgccgccgccgaagcggttgccgcgctgatcaggcaggcgcaggcgcaggcgggcgtccacgtcgtcccgggcgcgtgggcgggcggcggcgcggtggcgtacccggcgtggggaatgcagcagccggagggcgggtactactactcgccgtcgacttaccctgcaggcggcttggtctacccctacgcggcggcgtatccacctcccggtcagcagctgctcggcaatggcggcggcgtggtgtcgccatggtacactcatggctactagcttagtagtacattaattcgtagtattagcgatgtttgttttgtaattagtgatacagtacgagctagtacttgtatccagatgagtatcagtagtggatcgagcaggagagtactccagttagtaatggtggttgtcatctatagttaattttggtggggtgatgaggctcatgtgtgtgcacatgtagtggtggttataacaagtgtgttaaatctctgtctcatcggaactgatggtattatacgtagaatcgcgatcgtattcggctggcagttgccaccttccccctgtttgaaatcatcatcatacaatgtgctagtatgctatacgacgaagcaaaaaaggcttttggattcggttcatggggttgcattggcaggcagtgtggcatgtacagtacactggccggagcggaagtagagcccaaaaagttgtttgatttggcctcctctgggaaacaattttaatcacctaggtgtacatccacctattcgttacatatcaactaaattggtataaaatatttaaaaaaatttgacaactaaattggtataaaagtattaaaaaaatttgacaggatagattcatatgtaatatatcaccccccacaaacatacaagttcaaattcaatttttacaagttataacaaaaacaacaaatcaaactctgattagtatacatatattcatagttaaatttgttatttttgttataacttataatagtgaattttaactgtgttacattatatatcattctatcttctatttttttaaaaaaaaaacttataattatttaattgacatgtattaaacaaatggacatccactcgagggattagaagcctatctccaggctcctctctctggtctggctggtttggcccggccagcttctttctacaggagtatcatcatctttgtgttctggctcctgtgttgtgctgcagcagcagcagcaggcaggggaattgaggccagatgaatcaaattgaccatggtggtggttgtggttgggttggtgtctgtcttttgtacttgaggctgatctcgctggtgccaatccgtccgtcgccacgatctcacgcaccgtatgttgccctacgtgctactactagtagttgtagaatcgtgcgtgattcacaacaccagcagcagcagcagcattaatttgttgatgatcgttgcggtgcctttactggagtgagtacgtacggaaggaaggaagggtcggtggggccccggtgtcagtctccacaccccaccactatcatcgtgcctgcatctgcatgtgtgtacgtactacgcgagaggaacggacggctccgatcgattcgcccgcctctcccccgaaaaacgaatcacccacacacgacttgcgtttttgtctctctgctctctgctgctgctgctgggtcccacactcccaccaccaccaccctggccgcaaaaaggcaaccaaaaccccatcacaattcacaagcctaaacccccccccccccaccccctctctctctcgccgtctcgccgccgcacacaacaccacacctcgccatcggagcagaggtcgaggaggaggcggaggagaagccgccatggcaaaggtaatctcctagctctaccctcccctctccctctcatcgcatcgcgctactcaccatctcagttgcagaagaagaagcgcaccggcggcggcgagcagccgaagcctgcgtccgacgtcgcggaggacaagcccgccgaggacacctcgcccgatgtgcagcagccgcacctcaacgccgccaccaccacggcggcgccggggacggacgacaaggacgcctccaccaaggccgacgaccccaagaaggacgccaaggagaaggagaagaagccggcggcgcttcccgtggtcaccgccgtgctcaatgtcgacatgcactgcgacggctgcgccaaacgcatccgcgcctccatccgccactacccaggtgagctctccctccatccatcatcctctgcttcgactccatctcttctaatcctcctctgctccatctccgtcgatcgaacaggtgtggagggcgtggcgatgaaggtggacaagggcaccatgacggtggtcggccgcttcgacgccaagaagctccgcgatcgcgtcgccaacaagaccaagaagaaggtcgacctcctccccaacaacaaaaaggctggagacgacaacgacaacaagaacaacaaggccaacgaatgcgacggcaagccggcggacaagaagcagcagcagcaggaggacgacggcgacgaggcggggaaggaagacaagaagaagaagaaggagaaggaggagcaagacgatcagaagaagaagaaggccaaggacaacaagaaacccgtcgtggtgcgtatgatactaataaccttcccttccgttcatgttcatcgtctaaattcgattctattcgatttgactgaattgttccccgttgttcgcgtgaatttcgttggagtttgtttcgatctgttccagcgaattttctgtgccacctatagtcctactagtaccatattctgccttgcttgcagaattccattgtgtcgtgttgctggttcatgtgttgctgcattctgatatgattctccacaaaaagctagcgtgagatgcagcggggagagagagagagagcgtccgtgtgttgcatgagcctttgctctcctttttcctccctgaaaagaaagaaagaaagctgtagtacgcagcagcagcagcagaatggttgcctgccttgtttgagcttttgccaccatgcaaaggaacagtaaaccacaccctctctacatgccaatgccatgcatgcatctgcatgtctcttccacactacagtacagtacaacccctgcaccatttttctttgtcttcttccttcttcttctctgctgctaccttcctttttcatctcaaagaaaaaaaacacacacagatacagtagatacattgtgtttggatgtttgactgcatctgcattgatctgcaacatgaatttgcacgtaccgtacgccaatgcagccggtgcctgggacggtggtgctcaagatcggcgccgtcggcctccactgcgacggctgcatgaaccgcatccgcaccaagctcttccacatccaaggtaaacaacctctcaattacttgtccatgatttcattattcagtttcagctaattaaactccagtgtgatctctgtgtggttttgcaggagtggagcaggtggccatggagatggccaagaaccaggtgacggtgaccgggaccatggacatcaaggccctgccggagaagctccgcaagaagctgcgccgccccgtcgacgtcgtgccgccgggcaagcagaaggacaaggacggcggcaaggacaaggacaaggagaagcaggacggtggcaaggacggcggcggcggcggcaaggacgcggcggcgaaggcgctgacggcggagaaggaggcgtggaaggcggcgttctacgaccagcaggcgctgctcgccaccgagttcatgctcagcgacgagaaccccaatgcctgctccatcgcctgatctcttttgctggtgattaacaaggcaaagcagtgcgagaaatctaatcagtgttctggtgatctgttggttggtagtgtttttttggtggcaagattaagatcatctttgacatgtgaaagactatttagattagcatctagggaactgaaagagagactgaaagataggaaggagtactagatatgatatgaaaagagaggaattgaatagggagggatgatagacagaaaagagagattcagaaaggaatctgtaactgcagttggccaagctgcttttttcttgggagctaatcgttgaggcattagcaatgctgatgctaagtactctttttttgttactgccacttgttaggagtaccaatgattaacacaaacacactagtgctactagtgtattatctgtttgtcatgtgttatctatgcagtgctgctgattctgcttgtgtgattgtgtgtcactgtggtgttgtgtgtgggctgtgacaaatggaacaagagaaggctgcaacacaacacaactatacacaagagaaagcagcagcgttttctttggctgtctgcactgcacttcactgcagtggagtagaagtaggagtatgtgcaaatttcatatactagagcagtgttggtagtggtccacggaaagcagctgccaccgcttgttttggccttcaccggagaggaaacccaaaacaaaacaaaaccagaaagcgagacctccgacctgctttcttcctgcacaaagtgcagatatgcagcagcagcagcagcctctgctgctctgtggctcagagcaggaggcactcaggcacaggaagctggttgccaatgcctttttccgtttggccctcctcttctcgtctgcatctcggaaaacatgcagagaagggaagtgagaggaaatcatcaggacagggcacgacgttcagggcaattaaactgggagatttcttttttcttcttactagtagatgaaattgtttgatctagacaagtgctcatactccagcacgaaaatccttcaatttgaagttgaaagttttgttagagctagcagtccacttcaaattcaaggtggtagtggtactcctcctagtatcactccctccgtatttcaatgtatgacgctgttgactttttgacaaatgtttgacctttcgtcttattcaaaaaatttatgtaattataattaattttattgtgacttgatttatcatcaaatgttctttaagcatgacataagtatttttatatttgcataaaatttttgaataagacgagttgtcaaacgttggttaaaaagtcaatagcgtcatacattaaaatatggagggagtactttttttacaagaacctaaaaccagacagggaagaaataggaaacacagatcatctgaaagaaaaaaatagagggtacgtggaaacagatttatggtccatgagctgctcgtgtcctctgtgtggttgttgggcttatgttgtgggcctagtgggctgggttagccatatctttttgggccccttatgtatgctcacttctgatccaatcacattccagagtttaacttcccagtatttttattttttcgcttccagcgatggagcaggaagaaatcaactactgtatcaattgaaggagttgtggtatcttcccctctctaataaataaataaataatgtatgtatgtatcttagagtattctttatagtgagatactgtacagtagtagtgtgcgtgtgtgaagaaggtaagtactacatacgtatatataaaaacgtgcgtgtgcgtttatgtatggaaattttttttcgccatctatctatgtaaaaggggttgaagtttaatatattccctcagtcttaaaatataataattttataacgagattagatatagggtatatctatattcgtagtaacgagtctaattatgttactaaattttgggactgaggtaatagtttatttagctccatttgagttttttttcttggatccgctcgtgcgcccatagtgtaatggtttcatttagaagtaattgattgtgagattgtggatgaatggatgggatcgcgaagaagcagcagcgagcagggtttcccaaaccgccggggccggggttaccgcgctctggcggtaagcatggttaccacgcggcaaccgtgaaaaatcgtacgaaaccgtgcaaaatttatcaaaaatctaattttttaaaaaattatttaaatttaaggaggttaccacagtatttctattaccgtaccctcatggtaaagacggtaaccgtgataaccaagcggttaccgacggtaatgtaaaccttggcagctagaggcctgcaagagggagggagaggaggcaggcaaacgagcggcggggggccacgggccatttgcactgcgccatcacatgcgcttgcagcagccactacttgcttaattgcactctcttactggggtcgatccatctgctcattaattactcatcacgctagctagcttctttcattttctgcctagctatatattggatcggagtaaattaaatattttcacgtacgcacggtacggccggcaagccggtaaaccgtttggacctggtcgatcgatctttggagcactgcatttgcatttgcatttgattttgcatgcggcgtagagatgacgaacgagatcgatcgatcagatcagagtgggtgccgtacctacatgcacgcgcgcgaccaattggacagaggcattaattaattattttttattatttatttgtctctttgtggatgcatggcgataccgaatactccctcgttccaatatgtagcaatctaatcctattctatgttcagattcgtagtttgttacatattggaacggaggaagtatataattaaggaagctagctagggagtgcgcggttgatcccaaaaccgatattcatctgcatttaattacatgtgtgtgtgtatagttaggttatgttgtaagtgtgttaattaacagacgatcaatctagattgggattttttttacggagggagtacgctctaatataagatgacatgggtgagctagcgagtggtggatctatgcagtttctaaagacacacaacatacaagtggagggaggggtgcatgagagagatcaagacaaacgaggatccggcctcccttgatatatatgttcatttaaaaaaaatcaagactacaaattataggtaggagaacggcattgtagcacgttggtagaggagctatatggtgttcttagtggtcaaagtttgagtttcctcaactttgattttctcaccattattttcttctctcttaataatctatgctaagtatcctacttttctctttttcaaaaacaaattatgaccatcaacttcttttctcttaataattgatgctaagtttcctacttttctcttttcaaaaacaaattatgggtaacctatatttaggacgaatcataggtaattaatgcatgtcaattagagttgagttgtgttgattgtataggttttctcgccatttcttctctcttaataattgataataattgatgctaagttcctatggatccacgaggatcctatcggtgaatcattggtaatgcatgtaggttagcactatcagagttgagttgtgtcttaataattgctataattaatgcttagttcctatggatccatgcatgaggatcctattgatcaatttctacaatgaaattcttggtcgccgtgtgatagcaagctgctaacttcgaaatccccagcgtttgtgatgatcctgcttgtctaggtaaacatatcttatgaccaagacctccggtcgtcagtagaaataggctaagggtggattttacaatgatttttttgggtgaattcgtcatatatcaatgccggattcattaagaatttaaagtctagatctgttgtagtac

SEQ ID NO: 64039 - DNA, 832 bp, Oryza sativa
gcagtttctatgctcctattcctatattcctgtagaatgcgtatatgtgggcttgtacgatttattatcttgtgcttcatctgtatgaatgcatgcaaaaatcgagctaagctagtgttctgtgttggtcggcactgttgctatgttctttcctacgtgactgaaatctagcaattcccggttccgattcatattttgcttatctatatgcttatttgtacgacttattagcaattaaaaaaattgtagataaaaattttaaatacgggttcttagtaattcaaaagtaaatgctataaaataaaattccgtgaaaaaaccacaaaatctataagttataaaaatggtcgatttacagttataaaaatttccacgagcagaaagaagacaggcctcccgcaggtcttttttggtccaaatgcaaataaaggcccattagcggcaggagctttagggccggccccattactagccctaggccgagcttagtttctggttgcaaaccgtacggaatcccctttcctccctctcttgccacgaacccttcgccgtcgccggcgatcccaccgactcccggccgcctctgcttccccggcgatgtctcttcttagcactgcgccgtcaacgcgcgttgcccggtctatgcgtcgccttcagttctccctgcgtccttgtgagacccgagccgcaaatccaggccccaagcgagatgccatgccgagccgcaggattgacagaactcggggagatctcctgatccggtggttgttcagttcgctgccccctccttgcattgataaaggtagcccgtttcctctgcttttgattattt

SEQ ID NO: 64040 - DNA, 742 bp, Oryza sativa
tctgcagctttgttgctggataatcattgatctcgcattgttttatatctgactgcttgcttgctggagccgtaagtagatgtaactggagatggaatttttgcagcaattggtcttgccaccgccgtcgcacgcgctgcccccaccaagtctcccccgaggccggccgcacgaatcacgctatgccgcattgccacgggctgccgccggcaatccatgtgcgctgatgtgcagacagaggtgcaggaggaggggaaagcgcggcggggagaagttgtcgtatatgatggtggtacgggcggcgctgctcctcctcgtggcgctcagcacactctcgctgctcgccgcggggtctcgggacgaccgccatgccggcctcggtctcgccgcgcttctgcccatccacagttgtccccggcaagcctctccccgcagcatcgtcgcggtggctaggcaccgtgatggcggcgagctcctagccgtcgggatcggccggaggagcgagagaagaagagaagtgtggttgatagtgggccccaccatttttcttttatccttgccactgacaggtgggtcccacctgctgactcagcaagtcaacagggtcaaagatgccacgtaggacaaaaccgcctccaaaaccacccggggagttgatttgcaacggttttcggagttgggggacgggttatacctggttttgtggttgagggatggtattcatacacggccatgttgaggg

SEQ ID NO: 64041 - DNA, 2495 bp, Oryza sativa
gatgaatttgtccaatggttgctacttcattgatgaattcttctccatttcctgtagtgtgttctatcattttaactgccacgggcactccgtttggtagttctcctttgtagacacttccaaatccaccctgacctaattgttccttgaagcgtcttgctatcttcttaacatcagagaaattgtaccttgtgggtttcgatgtgccgtatgtcctgaggaacatttcaaccttcaaatgtacctcctcgtcataccttgacttcagcgaaatatagagcacagtggctatgatcaatgaaagaacaacaaatgcagctgccgatgatgtagctgaataaacagagaatgggaaatcagcgcattgcaataggatagaaagctatggactagtgatcaactgattgtagttgcctgatgggtaaggcaaggtagtgtcctttttagcaaaatattgagtcagaagcgccagcaataagaactttttattgctgataagttataacagtgcttcttctctcttttgaataatgaatagagggtaggtttgaattatagcagtacctgaaatgactttgacactcgaacctgcaagtaccaaaaaagataataagatttgattgatggtttaactgataatgaacaagtacttcttgaaaaaacaatgagatccagcatagttaattagttacacaacatgtcaacagaacatggccctagtgggataggatagagttttagttttaaaggaacaactgcactatgagtctatggttatatgaatatgtttgcaatagtgaatttttccttacatcttagttagcagtatcatcataagccagttctgcatactagctctgataattttgtcattatgctagaatgccagataaggatgttagagcgagttgaggttgattgcgggttaacttatcaagggttccacatatcaactcttgtatctactgatcattcattgaagcaaccacagatctagctgcagctcctgttgtatcagttaacaaaagcaatactcaggttatatctttctcagtcaagtgctccctcgcagtctcaattatttacactttcgagctactttgtaattctagaggcagccagacgccaccttggttactcctgggtgttttgttttgtcttgcatggtttcatagttcatatgggtccatcaaactatttcatttttccaggagcacattacctcagtgtattagcaaaatcagctccagaatgagccagagtgacatcgatattcaatcattttctcttttttttttccaggattggttgtcaactggctctcctgcagttccaggatgaaccaggacagtatcgaaaatgcagccacaaaatctgacaagtcagtaatgccagaagggaatgtgattcctatggactcagcgactgaagtataatatggtctgacgtgtttacttctatggcctcatgagtcacttgatactgttggtaggtaatcttttctgttttagtttgtgtttattcctcagaaaatattcttaaggattgtatcaagtgcgtatgaactagcatgtgtactggtccgttaccaactctagcaactcgaagttctttaatttttcctttttgttatttgtgacgatgctgagctaaatatgttgatggaggatttttcttctctatgttatccaaattgtgtttcttgggtaaatatcgtgaaaaatcttaacagtatatgagattgttacatataaaaactggctggttatgcttgtttaaaaataaaaagctggctatttattaattggtgcaaaagactcagacagttattatgtgtgcaatcttttgtgtgtaacattatatcaccgtacttctcatgaaacttttggccaatttaatttcatcatttgctttctggtcctttttgtaacaatgctctagtgtcctgtatacctgaaaatatctctgagaagttccagattttattatcaaatatcaaattatcctactgatgcccgtcgaacaaatatagttctatcttcatttcactaagtattgggacatttttattggaattgtatggaaggaataatgacttaatgtgcgagaaagctagctagtaagcttcctagatggttgctaggagcagactactggcctgcaaaaataattttgcagtatatctcatgtaagattaatgatgcgagagcagcactctagtactgtatggctaaatcataatagctactccctccatttcataatatagcaacctaggaccagatgtgacacttcatagtacaatgaatctaaacagtaagcaggttcggatttgttgtactatgaagtgtctcgtccggtactagattgctatattatgggacggagggagtggaaaatagaaaagtagttcaggaaataaaactagggtgataggattggattttgagaagttagcaatggtaccgtgatgctcgcggctcatgcagaatgtt

SEQ ID NO: 64042 - DNA, 752 bp, Oryza sativa
ccttaattctcctttggattcttccctttgcttgctatgcttttgcttctcttctccgcgtctcgttttctgatcatcctgtcatgttgttgctgctttatttcgatcttcttttctttctttcttcttccaagcagttattgtcccctatctccttaaccgcattctagcttacttctccttaatttctgaggctacagagtagtatttatgatatgcaactgtcgattgactatctgaatgatgcagacttcgagtatatgatcttggttcttgtccatgaaaaaggtagtatcagagtacacatgcatgcagagaaagtataatgcctgcttggtcactggctgtttgaccgtattaaccaaaactatacgcaacttacgtagaatgtatcgtgtgctcgtgcagattacgagacgacgacgaaaagagattggcacgccacacgtgcaaacggttgcacgagcaacgggacttatggagactcattcatcatccatcccaatgggagtttttttttttctttcttctcctctcattcagctactacaagtttacaagataggtgagatcacaagaatggagatccatcaatgacaacgtacccatgtacatagccagccagctgcccagctatatcatcaaagtataaatcgcattcttgccatcaaaattccaagcaattgcatcatccgtatatgtcacatactcacaacccatgctgatgtacacaacatctcaaaatgaatgcc

SEQ ID NO: 64043 - DNA, 1180 bp, Oryza sativa
ttgcttaatgtactataccgatcttttgattgatagccagatattatccagctttttaggtgttttgtcgcttaatgatccggttatcgactcgaacagaggtttaccacatacttcctaatgaatcatgtgattcagtatttccgactatatgtttgctcatagaaagcttatactccgtgaggcagacgatggttatatctagatttctcagtggttcagtacaactgaaccataccgactatatttgctgattgaaagctgctattttgtgaggcgatttgttgatagaaagatcaaagatagactttcaagctgctactaggaaacttttgaccgctatagtttatggtgaattgatcatacctgatacaatcacatttaatgtatctcaatatctggcggtctgggtacaccagcctgatattgcaagttttttctcatctcaaaaaagggagagagagagaagtcttcaattttttccccaggtttcttgctgggtcctgttgatagaaatatgccaatatctttaggttgtgttccattcaggattttgtgttagtatgaattaagaggaatctttgatcatagatgttaaggctgtattctttttcctcatggcatcttgccattatattccatgagaaacaatagttctcacaaatcaataacatttgagcaaaatgtggcagcagttgacattcattttttttatgaattccaatatttgttgtgagcaaaccttaagcagctttaataacacgtcatcaaatttattaatcttgcataatttcttctgatcaggtgatgttcatggacagtattctgatctcctgaggctgtttgattatggtgggtatccacctcagtccaactatctcttcttgggcgattatgtggaccggggaaagcaaagccttgagacgatatgccttcttttggcttataagatcaagtaccctgaaaacttcttcctactcagaggcaaccatgaatgtgcatcggtcaaccgcatctatggattttatgacgagtgcaagcgcagattcagtgtaaaactctggaagacttttactgactgttttaactgcttaccagtggcagcattgatagatgaaaagattctttgtatgcacggaggtctttctccagagttgaataagctggatcaaatactcaa

SEQ ID NO: 64044 - DNA, 2142 bp, Oryza sativa
cattaagaatttaaagtctagatctgtcgtagtacaacgtgagtattttcataggcacgccccagtgttgacataacagacttggatagatatcttcaatccaacaaaggactttggcaatttagcttctcgacaccattttactagaagctcacccatataccctctagcaatcatcctagagaccatgtcattcttatgccagttcatccccacctcccatgaactcatctcgacaaccaagtcagtgttttgccggttggtctctcatctccccctcacatcctttgctccactacttcgctgcgttgccctctaccgagctcaatttaaccaatcgagtcccttttccccgctaccaaccctatccactcctctatcctaacgagcgttcagtgatgccaccatgtcctcgccatcactgctgagaccaattgctacccattgcctacaaccggccagctactccctacccctccaagcctaggcaatccggcctctaatttcctccctcagtggccctccctcccacccatccatccacctctctctcggaaccctaatccaacggtgagtggacacgtcgcacaactaccggttgaaacctgtttgcagggatgacgttgtcgcaaacgttcgcccgttagcatttccgtgtacatgcgcatgcatatatatcatgtatagtgatttactattgacatgattaactgagtgtaccatgggtagtacccttgagaacagtgagagattaggacagggcgatcgatgatcgagcattgctatataggagtatgacgaaaagatatcacaacgtttggatcgagcgatatccaccacacatagcgtaaggtataacgcaaagacaggtaagtacagtgcatgaattggacagggtccaccttaaactgaagtctgaacctagcgctgttcgatcgtacgtacgagagccctagctgtgaccacatctcatgcatttcatcatgcactagcactgtacgtacactgtcagctagctgctagtagagctacttgaattattaatttctgctgtatatatatacattctttgtccaaaagaaagtcaatttttaacttcaaatttacccccagaagttagttacgtttctttctataacgtagcgtattcctcccttcatattcagatttatggtcatagaatatgtcacatccatctaatatcttttatattttgagcccgaaggagtatctagtagcgaattacgactaattatttatacatttattgtgtcggcatatatggatatataggcatgagtttctcatctcagcacctcagcagccttcatctgaagcagaagcatgcgcatgcatatattgaagtagtaactgatgatctgtacatatgaggagatcgataaatgatcagacactcaaacacacacatgaattaatatacgtcagatgagatatgatcattgcaactttcatcagatttcaatcgatccatgcatgcatatgaattgatcgatcttattagctagctgctgactgaagccctgaagtttcaatcagctgcagggcatgcattgcatagtgcagcatgcatgcatgcagcagcagaagccgctcgcattcaacatctatctgaatgtcgtctgatgatctgaaagctagagagagcatgcattgtcgtcagcaagtcagcaactaattaagctcatcagcagctctagctcgtcgtattgggcgcccacattggcgttattcagttaaatttgcagccttgcagttgcagtactgaagcatgaatgactgcaggccgacatatgtgtacatacacttgcatgctagcctagttgcagctgttacttactgcccggcactgaaatagttactcctcctactgatcctaactccattgcagtagtaaaactcaatcgatacagggctaactacagcaacagcactagttcatgactttcatgtgctagtagtactattaattaatcataccagagtggagtgtacttcttaatcaagaggaggaacatatatgtgtgctagctcacagtaatatgtacgtatactgatctgaaatgcaatatgtagcatcgtactacagatcaattaggactgcaatagctgattaactagtag

SEQ ID NO: 64045 - DNA, 1711 bp, Oryza sativa
atctcttaaggggataccacatgtacccttccctttttaaactggacttttcttctttacataaatggacggagatttgcacggttgccctccgaacgtccttctgatgggacggcacatacctacctccacttctgccggggcaggcgcgtcgtgggaacgtggctgtgcgctgacgacatgagcagtgtcagaccggtcaccaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtatcacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaatggtgtcttggccgtcagtcatgggcggtctcttcaagactgccacatcacttgagcagcgctcgaatctgggcgtgcagattcgtttcgtctggagatatggtaacgtcgcttcggtcggcgatcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctcggacaacatggcacggggctccgctctgctcgacggtagcgtactaccgccttcccgcattgtgggcgagaggcaggctgggctgccgcgtcgcttcatgccggaatccgccaccggccgggagatagtgatgctgggcgaggcgcgcccagcaccagattacccggggcggtccatcttcttcctcccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtg

SEQ ID NO: 64046 - DNA, 13377 bp, Oryza sativa
taaaaagtcaacggtgtcaaacattttgaaacggagggagtatatttcagtcttcatccttgtagcaacgccgaatcctagaagcgagttatagacatcgtgggtgctcacggcgttcttgcaaacgagtcggcgggccaccttgggtgaggggcgacgaaagaaccttgatttgtggccggagcagttgcaatggaagcagcgcgtcgagtctcggcaagccgctgctcggtggtctcgcaggcagttgaagcacctgcctagaatttctatctagaagaagcgcatcaaggtgggttcaacctagcgaagttgcgggcggcagggataggccgcgcagcccctcactcgctagacaagtcgcgcatgagccgcgtgccgccgagccacagtgagggtgggcaagaagcaggtaaggagctagcgtcggaccgagcgagcaagcggtgggcgccggggccgtagtggccactggcgcagagatggtcgcttgtcgcttgcctgctagtctcccgttatgactttaaaatccttcgagaagtatgtggtcgaacacatctatctattatatactaaaagtacattaatttttctataatactgagaaaataaataaatgatctaacaattgatttttacttaatccaatgatcccataatttgaatcattagattagatctactttaaaaaagcccgaagtatcctatccacataggtcccctcccgtgtgtccatatgtgcgacgaatctacaaacacccataagtaccggcctccccatccctctgcctctcgtttcccttccaaatttctaggattaactcaaacaaagaaacatcccgatccctctgcctctcgttttccttccaaatttctaggattaactcaaacaaagaaacaatcaacatttaaatttggtcccatatttttttagagaagggtatttttacccggcctctacatccaaccggacatatgtagcctttctaacttaggaacttagcttatcaaatagggaacttagccctcaaataacacaatctaaaattcgctcctatggatatttgaattcaggaccttagggcgctactcaagtcactgcaaccactaggctacatgccctttcacggtcccatatattcttaagttgtatattcaattttgaatatgtttggactgttattttatttataattagatcaacaatttaagacacattgatatcctacaaatactactaagctacacgtgaaactctagagagcaaaatttatactttacaggcaataaatgaatttaaatatttgagtccacagtccaagttctacctccagcaaagagctcagaaatgggatgcgtactctggtccagattccaaaggaggcagagctgcaagatgtgatcagcaaaagtggatgctgacctactacaaggagtttgtaattaaatttcaaaaaaaaagaaacattcaaaaataaaacaaaattttcattaaaattagaaataaaaatatgacaagtccatgtagaatataaaatatcaagagtccatgtaaaggtataagttataaatatcggaaatttggaataataaaatgagtattaaaagaagaacccaaatacaacacaacacaatttaaaatccctaaaaaagacaatttagaataaaaataattaaactacaaatttgatttcaatacagatttgaaattataatcactcattcgctaaattcagaataaaaaaatactttaaaagagctttgctatctttattaattcacatccatgtatatgaatcaattaaagagaggtaaaataaaatacatttatttagcaataaaactttctcaatcttaagaaaaaagacagagacaataaacattcaattaaaaacaaaaaaatacctcactttaatttaggcttattttgttagacctatttccaaaacaaactaatatgcatgcctacgatttatttttattttttaaaacatttttaatataatattttaataacagtctatggcaaattttattttcaaatctaaaccttttggtcacgccaagaaagctggcattgcaaaataaccctataatgccacaagtattggtgtgacaaaacatgtcacgctggatcgagaagccacattgtacggctgccacgctagttaaactagcgctgctaaaccatgtagcaacgccaacatgcatagcgtcgcttggcaggcctacgtgtaatgcaagatgaaggtgaagtactactgtagtattgctactccctccatttcaggttataatacgttttgactttggtcaaaatcaaattgctttaagtttgactaagtttataaaaaaagtagtaacattttcaacccaagataaatttattatcaattaataatttgatgaaactaatttagtattataaatattattttatttgtctataaacttagtcaaacttgaaacagtttgactttgaacaaagttaaaacgtcttataacctgaaacagatgtaaaacagatgtagtactgttttgtgaaaaagaaccttgtgtttgtgggttctacatcattttcttatgtttaattcgtaactgaagattttttggttgatctatctctcatagcatctatccagatcatggtatgcccacatatctatgaaatgagtttaatatgtgtgtgtatatatatatgtgatgactgattacataattattaatattttgtactttttaatgattgtgatgaaatctagctctttattcttatgatttgtatcacattgaagttactcaaggcgcagataaatggctttttccttgttaaatatatataatttagatggttgcactgttacagaagcattttcatgtgtgtatgtgtttcccaaattgtcggttcagcatggcatgtttcgtcacgtcaattaatgcttatggtgtgacaaggttattttataacgtcagttttcttggcgtgatcaaaaagtttagatttaaaaataaaatttggcccgatctattattaaaatattttattaaaagttttaaaaaataataaacattccctacgatatttttattttaaaattctcactagctagctatttatctgcattaaaaattcgctgccttacaactcctagttaacttgatagtaaaacgtggccatgattcacagaacttagacacatccatatgaccgtatttagtttgttattaattactattattactattactattgaattctaaaagttatagactaaatttagccgtgcaatttggatggacccttgcttgttacatggccagttacttgtttggaaggtagcaacagtacactatacactgactaaaataacccaccacgtgcaacactacagatgctgacttgattgcgaccaaacatcacgagtgagtaacatgatcaccgagcaaacctcctagctatcgtgtaatgccgcacagcaaaagataaaacgacagttaatattttctcttctaaaagttacacatgtaacttgcttattgtgtttgagactttgaggtgaggaacacactcctaacgcatcgccggcgctttgatttctataagatataataaattaagataataaatttgtgtgatatacaaatatatgtactccctttctcactgagtaagacgtatacatgttttaagatccaactctttgaccaataatattcttttataattaaattgatttttatttaatatcattgggttgatatttgaatttactttcgtataactgtgattgtgttgctacaaacatcgtaatatttgagaaattcaaatataaatattagttttgaataccatgccaggtttgatcatgccataattagtacggtgaagggagtatagttaaagtttttttttatagcttgtataaattgaatttaaacttacatgttttctagactaatatactattaatctatcttttatcctttttataactagttactctaattcggattaggctttgtttaggggctggtttgcaacaaccccgcttttttttctctaaatcttaaaataacttggtctggtctctttgcgggctgggcgaaaaaaaaatatgttacacatgtctagattttcaacacagttagttcactatataagcatcagcctatcagctcgacattttatattcacaggtggccggctctcttctgcacacaacgtgtagctcgacaatctacttagcaagatcactttagaaccagaatcaccagcaaccatggagatggagctaccatcatgggcctcagtactggtcattgtgctcgccgccgtcgtcttcctcctcgccaccattctccgccatggccgacgcgcgtataggctcccaccagggcctaacccgtggccgatcatcggcaacctcaacctcattggcgcgctgccacaccgctccatccacgagctctccaagcgctacggcccgctgatgcagctccggttcgggtcattccccgtcgtcgtcggctcgtcggcggagatggccaggttcttcctcaagtcccacgacattgtgttcaccgaccggccgaggaccgccgccggcaagcacaccacgtacaactacaccgacatcctctggtccccctacggcgcctactggcgccaggcgcgcaagatgtgcgtcaccgagctcttcagcgcgaggcggctcgagtcgttcgagcacatccgcggcgaggaggtgcgcgcgctgctgcgcgacctgcacggcgcggcggcgcccgtgctgctcagggactacctgtccacggcgacgctcggcgtgatatcgcgcatggtgctgggcaagaagtacgtgggggttgagggagcttctgccggcaacggcggcggcggcgaggggacgagcccggcggcgacgccggaggagttcaagatgatgatggacgagctgttcctgctgagcggcgtgctcaacatcggcgacttcatcccgtggctagactggctcgacctgcaggggtacatcaggaggatgaagagagtaggcaagaaactggatcggttcatggagcacgtcctggacgagcacgacaaggtgcggcggcagcagggtgataggtttgcagcgagggacttggtcgacgtgctcttgcagctcgccgatgaccctaacctcgaggtccaactccggcgtgataatgtcaaggcacttactcaggtgatcgatccctgctcatcatcctactgcagcttctttactcaggtgatcgtcctttccatggcacacggtgtaagctagctcttccatatgtggtgcaggacctgatcgccggcggcacggacacctccgccatcaccgtggagtgggccatttcggagctcctgaggaagccggagatcctcgccaaggcgaccgaggagctggaccgcgtcgtcggccgcggccgcttggtcaccgagacggacatgaccagcctcccctacgtggaggccatcgtgaaggagacgatgcgcgtgcacccggtggcgcccctgctggcgccgcacgtagcccgcgaggacgcctccgtcggcggctacgacatccccgccggaacgcgggtgctcgtcaacgtgtggaccatcgcccgcgacccggcgctgtgggactcgccggaggagttcatgccggagaggttcatcggcagcaagatcgacgtgaagggacaggacttccagctgctgccgttcgggtccggccgccggttgtgccccggccacagcctcgggctgaaggtgatacagctgagcctcgccagcctgctgcacggcttcgagtggaggctccccgacggcgtgtcggccggcgagctgagcatggaggaggtcttcggcctgtccacgccgaggaaggttccgctcgaggtcgtcgttaagcccaagctgccggcccacctctataccgggccctgatgtatctatatgtcagtacgtgggccattgataccaatacttcccatgatctctaccatggaataagtttgttatggaatattatctcctcgggagataagattctttcttgtgaaccaatcccaactagagtgagataagatttatctcctcctaaaaccgctgtatatggtaaacttgtaatcaagatcagatttataattaagagagatttcaccctatatatgtgttcactacttctgaaatgttcttgaaggcaaaaggaagggcatgagtgttctacacaatctcatgcatctactgctgtgagagggatagggaacagatccggtgatccactaataggcgtatttggtttataacaaagttcactctaggtcccttacgtccaattcaaatttcgtccttcgatgatatatccctcaacttataatactgatatacttgatgtcccagagcagtatagaatccaattttggttgatgtgatggctgagtcagcgtggtcctatatgtcagtgccccaatcttcttccacctctctcccctctcttcccatctcaatctaagcctccaaggcgacgagcggcggacggcagggagaagctcgacgacggcagccagtggggagaagccgctgcctaccggccaccgcccgtcgccaccgttgcactgtgggccacgcccagagggaggttgcgatgccactcgagctgtcgtggggtctatccttgatcatgggcacgcggaagactattcttccccatcaagcggcaccacttccttaccaacacccaccacacaacgacctcgttgacatcaccgccaccaacattgtcactgtctgcaccccaacatcactgccaccaatgttgtcgctatctacgtctcctgcctcaccatcctcatcgttcaccacatcttccctatgtaaggtagctcatcttcacaagaaaactacaaatggatatctcaatcatcaacaaaattaaattaccaccccaattcaagcttgatcatgtggacgccttcatggaggtagagcaacatacactcctggtcattcgagaccttgacagcaacttcactgtcaccgcctttaaagccagccacttccccagcaccgtaatgttcctcttctagggagactccttcggtcatgtcctccacactagcgactgtcacttgcccctcttccacctcctcactgactacgtcttcctcaaccgcaccttcgtcgccacctactctctccacttccccaccaagcaaggggaaaggaccggtagcagcaaagagaagaggaagggtccggtcgccaccgttgagcatctatctgctgaccgccacccttctcccgtcagtcaccgctcactgccatcgagcttctccgcactgatcgccctggaggcatagattgacataggaagagagggaagatatgtggaagaagattgggccgctgacatgtgggacccacgtgggtctcatgctaactcaaccgtcatgttaaccaaaaccagagactatattttcctgggacgttaattataccggtattgtaagttaagggactacggttcaatgatataattcgaaccatactttaaaattagagacctagagggaacttattcccgctgccatattggtggcgttccggctttagcacttattaggcctctttttggatcgacgtacatgtcatgtctcttattttctttgcttcgccgtgattaacagaagtacaacaccgtgaagtaaaattagctacaccgggagccagctgacggcgacgaactagagcggccttataatccctctttgggaaactcataaagctgaaagatatcaccggataacacataccgatgaccgcgcgcccagctagcttgccaggacaaccaacatagcaacacataaacgaagccagaattcttccagcctccggtcgaacacttccaatctcccatcttgcccgtcatgttagcatgctggttaattaatcgccgtaagcccgtaataatcgatacgtgtcacatcccccacgtgtacgatatcgggctgcgcacgtcgtgctcgccgttgctccaggtcagccacccgaacgcggcgtccgtcgggccaccgggcgtcgtcgacttgaacgtcacggtgtacctcagcttgtccccggccttcttgaacgcgagcctcgccggcttcacggccacggctatgtcgctcggcccggtgaccctcgcggtgtacaccgacctgccgtcgccgacgttggtcagctcgcgccggtacttgacggtggtgctgcgcgacgacgacgaccgccggccgaacacgacggagaacgacgggtagttgaggtccccggggctggacagcttccgctggcacgtcacgttgggcgccgccgtgatggcctggacctgcggcggcgacgtgccgacggagcacaggaaggcgacgtagtcgtcgacggaggtgtcgtagacgaggcccggggagagggccttgacggggtccacgtggccggcgccgatggaccacggcgtcgccgtggtgttgctggcggcgtcgacgatcggcgagccggtgttgtcgacggtgtatgcggtggtcatgagcgccgacttgattgcgctggggctccagtccgggtgtgccgccttgacgaaggcggcgaggccgctgatgtgcgggcatgacatggatgttcctgcgatatcacgattgagtctttaatcactctagttaattttatggctcaaaatatataattaagctgagagtgcagctttcagcaatgtaaattacgaatctactaccaaggttcagtgcaaaaaaagagagacatagccagacacatgtcagaatatcgtgcaactaaagtcatgccgactgtcgagcatatcatgccatttgggtgcatgcgaactgcactacagcacttgaaagctaaacagcaccatcatgaccaaatatgatcataacggcatcaaacagctactgttagctggtactgatctattctcgagcacgccggaccgtaaagtccgtgctcgaactttcggtgcaacacactaattactaattagagtaagcaacatactttcagtcggtatactacagtctacgtacagggctacttgcatggagggggcaaagcgtgcactgacctgacaagatgttgaacggcgaccgccgctcgtcgacggtgagcccggtcggcccgacggaccccgtccagccggcgaggatgttcacccccggcccgatcacgtccggcttgagcagctgcgccacctgcctgttcggcccacgcgagctgaacgcggccaccaccggcgccggccgcacgtcgagcgccgtgccggcgaaggttagccccacctcggcgtcggcgtccgactccacgtacctccttatggcgtcgccgctcttggcgccgacggccaccgcggggagaaggtggctgtcggccacgacctcctcgccgctctgcgcggtgttcgcgagcaccataccgacgccgccggcctgcttcaccaccagccccttctccaccctcgagttgccgccgcggtcgcacaggaccaccttgcccttcaccgccgccgcgtccagcgtgccctccatgcagagcttgctcgcattgctgccggcgcggatgcctttgttgtacacgaccgggagcttctcgtcgccgagcccgtcgccggagtagagcgacatgccggcgtgggtctcgccgttcccgagctcggcgtacgccgggaagttcctgtcgagcgtgcctgcaccgacggtgatcacccacggagcagtgttcaccagcgacgacggagaaggaccactgttccccgcggagcacgccacgacgatgccgcggcgagtggccgcgagcgcgccgaccgcgatggggtcacgcgagagcgggaacgcgccgccgccaagagacagcgagagaacgtcgacgccgtcatcgatggccttctccatgccggctagtatgtcggagctgaagcacccctgcctccagcacaccttgtacgccgcgacgcgcgcaccgggcgccatgccgcgggccgtgccttccgcgtagccgaggagtcccgcgtcggccacgacggcgccggccgccgtcgacgccgtgtgcgtgccgtgaccgtcgtggtccctcggcgaggagaactcgaggctgacgtgggaaccgttcccgccgccgccggccccatatccccggaagaaggcgcgggcgccgatgagcttgcggttgcacatcgacgacgggaagtcggtggcattggtctcgcagctcccgcgccaccgcgaaggcaccgggcccatgccgacgtcgccgaagctggggctctcgggccagacgccggtgtcgagcacgccaatgatgacgtcggtgctcgcaccgtcggcgtcaggggcgtcgtacggcgggaggtggaggaacagaggcgagcgcgtggtgtggagcgggaggatgacgtcttcatggacggacgcgacggcggggtggccgcggagcgccgcgacgtgcgacggcaggaggcgcgcggcgaaggctgacggcgcggcggaggtgtaggagtagaggagatgacgcgaggggtcgacggagagggaggccaggtgggcgtggtgccagtgtaggtgagtggcgtacggggccggcttgagtgccgggttcaggtagacaatgtaggtcgccgccccatcgccggcgccggagacgagccgcacgcacgacgagacaacgacgaggacggctagagcgaggaggaagggtggctgctgcatgctgggcagtgttagcgaatggagggagttgtctgtgcgagccgcgttcgattcaaatataggagtggcatggcatcaacctgggtagtacagcagcgcgcgtacagtcgtctcgatgtcctgctggtaatgtggtgatgtgccgtctcgatcgatcaccaccgaaaacgcgatgttcgtacgtgtagcgtccctagcgaacagacatgcaatcgttggagtcaacatcgacttttttttctccctggtgaccagctgcttcggcatactgttaaagaaaaaaaaagcgcattaagcactgggatcgtgttcatcatgcacgtcctcctccaggccagccttaacgcaattatttggctggcccttcctttacaagcggcacggtccgcggccgcgcacgtcgcggcgcccatagcactcctctccctagccctgcctcgttgtaacactacgacgcacttgagcggcgtgtgccgccgccgtcccgccgcgatcggtggtcgggtggatttgtggggggggggggggggggtggatcgctggtgcgcgtgcccgtgcgtgcgtgagcagtgagtgagctctccttcctttccaccgaggccgcggccgtcagcgcgcgcggggcgcggtgcgtcgccactgcgagcgaccgatccagcgatcgcgtgcgtgcgtgcgacacttttcgcccgcccgggcctggtggtgatctgatcgtcgcgctctctaatattgcgtcgcccatgcctccactttctcgggcgatgaaccgcgtggctccacgcctcggcgatcgatggcgcggattggcagctagctggattctgttgcgaaaggtggacatggaagatgcactttcttactcgccatgttggggaggcaaaggcaggggcgcgatatgcgctatatcggcatatccagtgaaggagtggagtgatcgtcagtgcgtgtctgaatgccgccattgctgttcgtttggtgcgtgattgcgttttctcccttggtgatttgtcaatagtgtctgatggtgtcgagggattatttgctagtaaatgcaagcaagcaggactctttgatcaggaagctgcgagagattggttgctgcagcaaactgaagattggtaggtatcattgatctatctatcatgccaagttgccacactaactttgcagaagaactgtactataatgtgtgattgtgttcctttcttggttgtgtttagatggtggaaaagttggaaagttgagagaaagtttgtagtttggagaaaaagctggtagtttatgtgggacgtgacttcccgttgggcgtccgatgggagccgaagtaatcaaggcaattagcttaggttcatcccgaatccattccatgtttcttaaacaagtccttcaaaccatcgtgctaacaagccattctcctccgaaagtcccagagctttttctggtccatatgcatcaatcatcactgttttgttctgtaattccatttcattttatctattttcttcaagaaattccattgatgtgcttttctattgctctcattcattcctattcaatctattcaaaactatgggtactggtctcaatgggaaagagccctaattcgatatgtccttccatgagtttagatatctatgtatgaatctcttattcaatcccatactttttctcatttcagaacgatcagcatactgtgtgacttctacgtgacagttcttgcatttcatttgttgctttgcatgaacattttatattggaaagcccttaattaggaatttcatagatagagaaggacgggaaaaaagagagagactaactaactacccggatcaatgctgattgacgactgaataaatagccggaagcaacaactgcacgagagagaaagagcggatccaactaaggaaatgcagtacctgggcccaagtaggacaaagaaatgcaagtaaatgccctcgattcattccttttatgtgagtgggaaagctagctagaaatcaatgacaaggagtagaggctagagcaaaagggcctggcgtcaggttagttaaagcaagaaagtcaatgctcagtgtattattcgggaattggtttggaaagccttggtagtagtgcactcaaatcgacattgagattgggacatagccgcccaacgattagaccgaccgggggactggaagatctggaactttcctttggccgcaaaccttctttgaatacgaaagaatgcttgttttaaggcaatgcgagagcttaccagagaacaaaggagagtaatgagttgatagataggaggcaggcccaatgatattcaataaaggatagaccgaattccgtccgtataaacataatttttattttcttgtaaagtatttcttttattttagaggagtctctaaataatattcatcatcatctctaaagataaaggtgagttccagcagaatgtctattgaacaagagcacagcgaacttcgaaataagagactgaacttactttctttcttgcttgcttacttcttccttgttaatagtagggatcaagctagtcaattcaaaccttctccgcttacttgtaaccgcttaccatttgctgatactctagaa

SEQ ID NO: 64047 - DNA, 26275 bp, Oryza sativa
tttgatcctaccaagttgttctatcccatgcatattatccttcacaagtttaccttagtactcctcatatagtcgtgttaggcttttagctacacacttacaccaactgacaacactatcatcaagctgatcaagcacaattaacttcacaatgcccatctggagttcaaatcaacatcaatcttgctccgattagcgccaatgtgtcataatgaatttgaatggagctcatagaagtccatcactattcacacaaaaccactttgactctgactatccaccttagtccttagctcagtacctctcatcacacaaatcagaagcatcttcaatcgcccaagctataccagcaaatctacacctgcttacaagaaattctctccatagcactcacaatgcgttctagcacacaattcttttattttatcttattattattattatttaaaacagagaggggatctcccatttctagcacacaaattcacccaagagcaacacaccccatcccacagctgatcaacttaccacaagcaaacagcaacgtaaacaagaatttcctacattttcagggaaaaccccatcaacacaaaccagccacgcatcctacagagccccccaaggtggcggcacccaagatccaccgggtcgtcggctgccagaccgactccagcgcagaagccccacatcgcgcggaataacacagattgaaatcgatcaaggcagcagcggaagtaacagcgagctaatcaaattttaatttaccggatgaaggcgtcggccacggcggcggcggcggcatcctcgtcgtcctccgcggtcgtcgcattcgcgggggaggacggcgcgtagaggccctcgctgccggcgtggaggatgaacgcattgcccttgttgaggaagccgagcccgcggtactcgtgcaccgacgcctccccgccgccgagcagcatcagcagcagcccagcgacggccacgcagaggctcatgaggtggtgcaggcgggcggccgccgccgacacggccgccatggaggtggggggcagcgaagcgaggctggatctgagcgtgcgtgaagtgaagtgaagacgacgaggtgagtgaagcggacgctagctcggtcggggagaaaccgcaagaggccaagagaagccgcggtaataaacgggaggaggagtaggagggggtttggttggtgagagacctcgtttattccttggtgagagggagtgtctccccgtgtgttgttgaattgttgttggttcattttggtgatcagaggagggtcaatgggacattgggacaattggcagggtaaaccatgttgttaaaaactaatccagggtgggtgggctagctaggactagttacacttattagagcagatacaatagcaggctataagtcaactataaatatattttaaagagttaaacgaagagaaaagagcagatctgcagcacggacttcaagatgtgatgtgtgtatgacagatgagaatagtatattatgcaaatattctataaattgactattacattggttataaatgatttggagttagtagtaggctatattattaaacttgctcatagggccctggactctgctgcttgaacaagcaaagtttacagtaaataatgcagtgggtgcatatgtgaagttctcattttattttatttcttgtttgtgatgttggagtgttatccttttcgtttttagcctctcaccattttccacacagcatataagccaccaacaaattttaaaggtgcatttaggtttttattcatcatagtttttttttaagtatttgtcttctaaatcgttcgtatatataaatgttttatcggtaaattatattcctattgctgctaagcccaaacaagatatcagccctatggcatgagataagacttggaacgaaaaatgagattacatgagaaattaccactgatcaaatctgagaacatgtttggaacagaaaccgctcctacgatcgtcgatcatgtctgtcgggtctggatcctagtagaaaagaagaaaattgaacggagattaattactgtactccacacagagctagtaagcacctttcatctttaatcatggcctctcttttctcctttagagcagatacaatagtaggttataagccagctataaacatattttaaaaagataaagaaagagagagaagagcagcgggctacagatctgtagctagctgcagcacgaactccaagacgtaatgtgtgtataacaggtgggaccaaatattaatagtatagtaagcaactattgtatgaattggctattacattggctataaatgatttggagctaatagtgggctgtactattaaacttgctatatcccttccctttcctcccagtcccagccaggttgcttctgatcagtcaccataccataatagtaggcttaaacacctagcgcatatatatatatgctccactgatccagtacttaaacactaggagcagtagcttaaacacgagggtacactcaggtagtgtctagtattgcaccggtcgccctctcgcgatccgagcggcgaggccacacgccgatgtaaaaccaccccaattctgcacgggaaacgagcacacccgcaccgtgcgccgcgatcgcttggctttcacggtagccgcgcgcgcgcaccaaggggaaggcggaaggcagcagcaaccagcaagtcccacgttttttagccgccgggattagcgcggcggagcgcctagtcggcacgccgctttttctactttaaccggtgaaccccccacgtcccccacctcgcacggtgcgggtcgcaccatcatcacggtcgcacggagccgtcggtggggagaaaccaaccggtcgggccgcgcgcccgtgaaatccccgtttcagtggaccgtgggctagtcaccaacctggcgcaaccgggccgcacgcccgtgaaaccgcgtgggctactcgggcgaaaacctggcccagactggcgctgcgcggccgccgatttcacagcggaatcggctcgttttcgcgaaggaatttttgggccggccttctcgcacctatgtggctgggacaatcgcacaatcaatggaccgctactcgtctgatggaggagtgcacgaacgcgaattatttctgcagtgcagtagattcgtcaaggagagttttttttttaacacatatcagacgcagacgctcgtaacacgtacacactcaaacatcctactcatataagtactttcggaaaactaggtcgacatattttgaggacgaagtcactataggcgtctcgctatcgacaggtacgtctaccctaccattgaaaaaataattagccgaacatatgtatcaattctagaatttcaatccgggtgaattggttccaccacaatgaaaaaataattagctgaacatatgtatcaattctagaatttcaatctgggtgaattggttccaccgcaagtaatccaactagtcgagctaagcttaatctgcgtcaaggagagagtttttttttttttgaggtaagtcaaggagagagttgatggagctgccacgagaatacgctcttctgccagatctaacgtaggggggaggttcaccggagcagcggttgcgccatgctctctcgtggacgagggaatcctgcccggccatcacgtatggccggggtacgggccggcagaatctcgccgatgtcaagcgtgtccaaccacaagctcccaagaacgtacagcagcaacgcaacgcaacacagacaggcgtccgtgcctgcaacggatggaatgtgcgttttcttctctgccacacggacaagatattacgctctgcccgtactgtaccaacaacgttgtcaatcttaccgttttattactctttattggagtgtagaaatcaggtgatcaaacagttattcagcaagtgttagagatgatgtgaatttaactagtgaattgaattggatatggcagacaactctggaatcaacagatggcaattgtcatagaagatagttgaaaaaattgaatgcgttctttacagtttcagggcagaagagagtagacacatggaataggcctttgtcccagaacctccttatcatgattcaaattacagatggttcatgtcagaaataatggaggagcattacatgatcatagagcttcattgctaactatatcccatatttatatcattacgtagtaacaccataaaccccaagcttgccaggacctttggaacctgcagattggaatcacactaatcagatcaaaacagagagacatgctagatcaaggataattcacatttgagttgagttgaaaatttggggatcaaagaaaggtatatacctggcatgaacgaactaacatattcacccaactttacatttcaagcacaatatctggaaacaagaaaagttcatattcagtcagttgctccattgacaaaagtggcaaaagaaaaggttcaattcatgataggcaagtatgctacttacactctgaatcagttttgacccattttgcaccatcatcgtctagatcacgcagtgcatcctccaggcactcattgatttctgtctcatctggcttccagtccaaatgcctcttagcaactagcgtggaagaattttgcgggtgtattttcttctgcaatattgccttgagcaactgcaatgaacatcatataagataataagaggacgagaaagtatgtaaaacttatcatgttacataagaaaaaaagaatttcactgtgtaccttctccattcttgattgaggaaatgtgttccttggttctggaactacggaggtaaagccacccttacacatgaataacttgagcaacgaagcgactgatctcggcttgagtgtatttcctttctttcctaacgaattctttgatttacttacaatgatccttttgttgatcaactgtctaatatgcttctcattgtcttccccatcggcacgcttttgtaaacctacttggtcatcatcatgcgagcgttgagcttctgcttgatctttgattgctagtagcgtttcgaattctttccgtatcttgtctacttcttcctctgtaaatttgacggtatcttgcactgactgcacattgtcggatgaattctccacctgagctacctcctcaatctgcttatttccaaatgtcccaatagcaagcaatgattggggccaatcactgaattcatcctttcgacaatctgacacgttagcacctgcgcattagaactcgattaagccgcaagatcagtaaacaaacataaatatatggtcctaagttcatattagcataaattggatgtctagagcatggaccacaaatttttaatccttaaacacccagtgattctcattggcctatcactctttaagtacaatgtctgcccatgcttactccactccctgatgttttcacctgccatttttctgtataccaggaataacttatcacagcagttgttaccacttaaacaatgcattctctgtacaatagtagtctttttatgtaatcttgagagataaataatgtactgtagtccagctggactagtggctcagatctgattccttagtacgatttacgaaaccatccgaggtcaggatattgtctgctcaaatcaaattcttcttggtcacaagtggagggttggggttataaatcaactaaataattgaagccatactgactagttggaaacacttgcttgcagggttgcacttagtcaagactttgacccatactgactagttggaagcagtgctttacagagatattggcgtggcgggcatcaggccatgaaatagtcctttgggggtataacatatgcacaaaaatctctcacttttcgtgctagggaagaggaaaataaaattgaaaactcctactgaacttaaagcgccgtttaaaatgcaggaattttttttccggaagtgcgataattgaactgtttccagtgaaattcctgcgttccaaacaacacccaagtgcatataagaaaattttctcaaaggatcagaaacaacattgtcataatacatcaatgtttgctccatcacattggcgttgtgataggttactcaggaatcaggggatggtaatccagaaaatcgcagagcgaaaagcgttctgttactagcaattaggagaaacctttaaatcgttcactcttgtatatggctaccaagacaacaaagtatatcagcatattcagaaatgaacatggcaaatgatgcctaagcggaaactgctaagaggtaaagacaccataaatggagcagaatgacagcaggaaaagattaaattaggacaaagcaataaagtatcatcgtatccagaaatgaataaggcaaatgatgcctaagcagaaactgctaagaggtaaagacattataactgcagcagaatgacagaaagaaaatatcaaattaggaaacggcttccaaattactgtccgtactctccctctcccctcaaggaacagggaaacatttcataagaacagcatgaagcctggtgaacaacaatcaccttagttctgaaagaatttacaaggaaactgaaagttcaggtacactcacggtaaggcgcagaagaatttgcgggaaaccgatttgcttcttgcttcccactgatcttgttggctacccagctgaaaatctgcagagaaaacccaagcctcatgatgccatcaagaaatggatcaacactaccaacacttcaaatctattaacctctctgaaatgattaatcacaccgatggtttgagcctttaccttcatatcctggcctgaagaatgagagattggggagggagaaagcagctagctgatgaagctaccaagaaatgcaagctcctagcaatggcagagagaggaggaaaggagagatgtaagacttgtagtggctgctattggcgatggaattggtgcagagaagtactactagtagcctactgggtgtgatttgaaggggttcaagttccaaggattggagggttcggtgcagcgtggctggctgtaggatagcttgctatacttcatctggcatgtcacttcctttaccttccttttatagatgactccaaaccgggttaccagctcaacaggtgagccatggaatgataacaggacacagctatatatataaacaatggaatttgcactttcttcggaagagaaaattcggtatttgcaactccagctaccgtacgcccatatgcgccatacggattgtaaatattgaattgatgtttctagatatagatagtgtaaacttgtgatcgacctcacacttttgaggaacccaaaattgtggtagctacacctcaacgggggtgcttctaccctacttaaattgtagagaagtttatggtacttaagaaagtacatgcaggacttgtacgatatttcgagacacctactagagatattaagttttacgataaaaaaccatcatctcgatataccttcttaagaatgataaaactatctgactactctctctgtcccaaaatatagcaatttttgtgtgtccaaattcatagctaaaaattactatattttaggacgaaggtagtatatcgtgagatcgtctagtcaggtgttcaaaaactcaacatgtaagaaaattcccaatccatccctagaagaagctataatttgacggttcagctgcaataagtagggtgactgtagttttaaacagtcatattatgttcgccagatcaaaatcaaaggactcagatttacccaggtattgcagactgtttgaataccgtgcactggttcgcttgcactgcagccagcgagagagtatccaaaaatcaatgcctcaaaggaagaaacccggttgttaatttttttttccagggggagaagaagagttattagctaagataaagtacagcgcggcgagatcgacggcaagttggggcaccaagtgtcacgaccgcgccgcaacggatcccatcgcacttggtcgggcccgacgcgtgtgccagaatcacgtgttaacttccttaaacccggcattagcgcgggtaagtacggggcgcccgccttggttaaccagcacgaggggcgcctgcaccgatgctaatcacgtttctgggggttaactgctgaagtacacccccatctccactagcagctattccgtccattaactacgcaataatggtactagaccgtggatgcacctggaccaacaagctaacatgacatgatagtgctatatatatatatatatataatctgcaaaactaaaattacgttgtggcaatacattgtaacaaaaccaaatttatcagtttagattagaagcgctaacgaaaattctactaattagatatctctagtcaatttctaaacacacattcttatcgctacgtgggtgagtaggggtggttattcagtctgaccgattaattttgtttggtttttcggtcctctcaaaacttcagcctctaaaatcaagatcgaaatttaatataaaaccgtaaaacctaaaatattctatcatttttatagttcggtcttcggtcatggccgagctgaccgatcaatttcgatacatgttttgagagtaaattttgcctgcaattcctcaatcccacaactgtagttgtcgttctcctccttcaggcactctccttcagcggcctggaggcattgtcgccagccacctacaagctagtggagggagcggaggcacaagatgggaggagagtgcgactgtgctgggacttagccagtgactgttggggaagacgagctagggataaagatgaaaataaggtggtgcttgaaactaataaagattaagattaagtaagagcataaaaaaaaagaaagttactaatggttaattaagttttaattattactagttggaaaattgatttagttaatattttagagcaatttctatgtagaaagtttccgtacgaaacgtacctttttagcggtttaaaaagtatgcgaacagaaatcaaaatatatatctatatcttaataaaaaaagcagggtaggtttgcttggtttcgtgctatatttctgctcaatccgtcaacggttaactgaggccttatgaccagaatttcccgtattagatttggttagccaagagcacagaccgaattctttaacgggaatgctacgggacgggatactgtcccccaacgggatgctcctcctccacaacacgattctcacccatgcgacgcggccgaagccctcaacgcgcaccaggcctgctcacccgccgccgcggccgtccctcgccgccatcgtcgtccccccccaccaccgccgcgcccatcccccaccgccgccgtcgccgttccccgccgccgccgcgccgtcccgtgccgtcctcgtctacaggggacggctacagtaggccggccgcgcgcgagtcgggatgctccccaacgggatgcccagctatatctagtaggaatcacctgatacctggtaggtatcatccgatacctcgcaagtatcacgcgatacatggtagaaatcgtctgatacctaacaggcatatcacatgatacctcgcgagtatcacgcgatacgtggtagaaatcgactgatacctgacatgtatcacataatacctcacgagtatcacgcgatacgtggtagaaatcgtctgatacctgacaagtatcacatgatacctcgcgagtatcacgccatacgtggtagaaatcgcatgatacctgataagtatcgcatgatacttgcaagtatcacctgaaacgtgtgtagaatcgtctgatacttgaaaggtatcacacctgatacctactcgggatcatcccattcgaaaacgggattccgttatatactacccccattctttaaacatatcttaggtttggccagtggggcgtatgctccaattttatgatattatatgatcctaccaaaccaaaatgatactgattctatctagtatcctacttttcatagtattttgatctttcttttcacacgatcatacgaaatcttaggtagtataccgattctacgatccccacgattctataaaatactatttataaaaagatggattcaaaataatatgaattaatatggttaagtttacataaaaccaattaaatttatcaaaattaatattatatactttaatttatacaacatattctatattccatataaaagtatatactttctaaattctgatagtttcccgattttatgatactacagataaaaaatgatactaccctcgatacttatcaccttcctcttaggcctagtttagttctcaaaaatttttcccaaaaacattatatcgaatctttggacacatgcatggagcattaaatataaatttaaaaaataattgcatagttaggggggaaatcgcgagacaaatcttttgagtctaattagtccatgattagtcataagtgctacagtaacccgcatttgctaatgacggattaattaggctcaaaaaattcatctcgcggtttccaagcgagttatgaaattagttttttcattcgtgtccgaaaacccctttcgacatccggtcaaacatccgatgtgacacctaaaattttttttttcacgaactacataggcccttagccaagagatcctcaatttgttaggcgcatactccattttgtagtagtacaacatgcgtacagtcggaatgtcgattacgaatctcacagtacgggaagaatatgctccgtcctttgcaactaacctgaagatccttcttcagagagagctttcaacttccaagttccaaagccccctggcataacgcaacacaccaagctactgctgtcactgcttcctctccagatctttcctgcaacctgtacttccagacagcaacgtaacccccctagctgcaaacagcggaccggaccgcgacgacacaccctgctgcttgctatgtgggcatgtggcgcatgaggtcggcatccggcatattatccttgttcgatccccccaccacagtactgtacagtcctactacactcgatcgatcagtccagtctcctccatctatccatccccacatgtacgtcctctcgccatcgccgtctcatgttcatgccatggacaacggcatccgtgcgagcgagatccatgacgagacgagagacagcttgcccagcttgtgctcgcaccgtcgtcaatttgcgcaagtctgccgtgccggcctgcaacgtgtgcttgccctgcaaaccgctagcaaacgactactggaagagtctccttgcctacactagctttgcgtacgtgcagactggataagagatgataatcaactagccctgtcgggagaaagaaggcgtaatcgatgtactgtgatgtggggttcaggcgagaaagcaaccgtaaaactgtgggtgctcacaagatgttttactatacaggtttagaagaaaagagagggctctaaggcaccatgttacatagtatagacgtcggatcacctcgtggcccacggatgacataacaacgcctacttcccatattctgccggtatactctgaagatagccctacacctaatagtgaaatacaggtacacagagaatttggggatcaatatcagcttggatctcccacgagcaaattcaggcatcaaattgaaataaccctgtgacggtccatgagtggtggatggatctagcctctaccccagaggtaccaaagaaaggcttgtgcaactttatcctcctggcataatgggagttttggaaggagcgaaattagggagtgtttagacacaaagaactatcggcaacatacttggttgcaaagatcaaagagaaggcaaagacttggaccatgacagaagcgaaagtactatgtaacatagtgccttagagcgctttcttttcttctaaacctgtataaaactattcatgtacagttttttcctactatattcaattaaattggcatactctaagtgccggtttgttaaaaaaaagatagttaactaattccctgatcgataataatgaatgcacaggtgcccccgcgtcgccctcccccaggcggctcaggaagcgacgcgcccaccgccgccttcctctccccgcctcctccgcctcgccgccgcctgagcaggcgccggcaaagccgcgcggccgcaaggacggcggcggcggggcctcgtctcgcccacgttgcgctcgaaggccgggggagctgtccatggcagcagtggtggtgaccagatccgtgccgtgtccggccagatctggcaggggggtggccggcggcgggggctgacggtggtggtggcggtgctggtggcggttgtggcagcgacgacgctggtggcggatatggcggcgaaggagatggcgacgacggcagcgggccgcggcgcgtgtcgcgacgccggccgggctcgtcaaggacctcgccgccacgacctccggcatgccgccctcgtcgacgctccctccatgacgctgatgacccgcgctgcgcactgcacctccagatccgcgccacccaggccggatctggccggctggcggcggtggcggatggcgacggtggcggctagcgatggtggcgccagtggtggtgatggttggcaggccatcacgaccgaaggggctgacagtgcgtcgttgttggcggcagcatgtggaggcggggaaggagaccgggtgtgggcgtgacgtcgacggcgagaagatctgtggcagtggcctaggctagatcgctaaagggaaaatgtagtcgaccggcgatgatccttcttgtgcggattggttgtgtgggtttggacagggaatcgctggcaaaagcctcactgagccgtttggctggctgacggcggcgacgccctttggcgtcgttcccctccctggaggcgtcgttttagcgtacccctctcctttccttaccattctccgggtgaaaaccttgcttcggcttccgaacgagcggtggcggcgatccacgtcgcgtcctccttgggggcaccgctttggagaaacttattcgtacaaggatgtcgttgattgtctatgcatttgcttcgaatcttttcagccctaggttttgatgagtcctttgctttctagctccaccttttgttttgcagtggacgacctcgctctttgtttgattttgctaggtggagtcggagctgcttcgtcggggtgacgaaactgggcaacgatgacacgttgcgttttctttctaggggttttgttgttggccgtaaatagattgtggcgcttaggcggctttggctgatgttcatcgtgggaagtcgaagctacttgatcatttgcagcatctaggtttagatggtgcatccggtttgaagtaggagctgccgtgtcgcgtggcggcaagctcggcaaagatgacacggttgcaaagtcggaacctcctatgttgttttggtcaaccttggtaacgacatcctacattggactctgtcagtggttttagctgttagtgagttcggtggttggtttttcttttcttgtaacccgtctagggtttttactcctgcttattgaaaatataattggcagctcccctaccggtttagtttaaaaaaaaaagataataatgccagcaggagctagatgatgatcgatacgatacctctcatgggaaaagatcagatcattccacggaccactgtttggccactgtttacaaggccaatcttgtatcatcgattctacctgccgacttcagagatcgacgcagctcagcctcgatcccaatcactgtcaagtcagcgtggcgactgatgaggagcaccactagcactgttccatttgtaagtactctgctagctactagcacaagcaaagcgatgcagggatcagctagggattcgtcagcttggccgtgctgataatataggaaatgcccttggtttacaggtctttcattggacgcaccggcgacggctttccccatgtggtgttcgccggggttagcgattttgatacatatatctggcaggtgaaggtgctgcgccgtcgagatgcgcgcgcggcgacttttcggcgcgtcaaacacgagaagcatatagaaggaatagaatagttacatggagctggtctttagccaaattctcctgaaatgggaaagcctatgggagaagcgcagatgtcaaccatcgacccttgcattatttggaaaattctaagcttagggctaatagcagtaggagagtgtggagtgtggtatggtcgaagcgtacaggccggtacatgggactgatggtcccatggctatggaggtctaggctggctttttctagcaagatatcatattattgtacaagcttcagctctcaaagatgggtggagatttggtggtcctgaaggaatgttcatcgccaagaatgcgtttttagtaggactagtgttcatcttgcctgcagcttttgttggcacactgcctgagttgaaaaaaaaaagaagagcattttgtgtacgaagtacagagcacagtaatttgtaaggttggacttggaggttgcaatggtcatatcttatcctccaaagtgagcggactagacatgttattctgtaattttcatagactgtgcatgattaatgagccaggacatgttttctcaaacttgctgcaattcacagatcatagctaatgcaatgcatcctaatatctctttaattaaccttaatagctattgtttgatcagaaggtcaacagagaccgatccaagtttggattgcattatttggtgtttccagtgcgatatcgtggatgagaaaataattctgaagcaactagtgtgcaagagttaagaactaagaaactgaacttgtagtttcagactacaagcaccttattccagtagccctcaactgggttaagcagacctttatgacagttcactcactatcagcacattagctatggatgttcagatagcatcggcactaaagttttttttaagggatgcacattagctatggatgttcagatagcatcgatactaatgtttttttttaagtgatgcacattaactatggatgttcagatagcttctttctattaaacatgtgtgctaagtttacataatcatgtgcatattgtattactcatgtagctggtgggtgatggcagcaagaacaaataataaatggatagatgataggaaataccaggctgatggtggatctgttcagcaaatcgagtcatgggctgatgggtctcccttatgacacaccttggctgaattttgctacgtcttcatggctctttctccttgaccagctgctgcacatataagcccataaaaaaggctaatgctcaaggatcaagaattcaagatatccaaatatacgttgagaaaaaaaaaaacattgctccacatgattctaccttgttttgttgaatacgtacatctatttctacctatcaaacactggattggacagttcatctggcatcaggaattttgggggcagctaagttcatttccaattgcgattatcagtacattgattctgaagcttctagctgcagacacttatcagcatttacctgaccacattttatcgttatcagctatcacattatatcaagttatacatcctctcatgaatctttatccctgtcatcgtttccgaaactataatactagatatttgagtccattcctattatattcagttcagcgatctagtgctcatgaacaacaaattcatctaaaatattggaaaaacaattgtaccccatccctgattcatctaaagaagtggggaaggagtcacctcagttgagcccgaagacgaagaggaagagaggccgcggcaaccaccgggatcgcgactgcgatgggggcacgttgagggctctaccatctcctccagcaacgtgcgagcctcgcgaagtggctccacgctccctcgcctccggattccggcgccatcgccgatgtggggatctcacatggtgaagaaattctccaagctcgcctctcatggcgcgatgtctgaacaccggatgcggcggacccgctgctcggctatttccgaaggcggccgcggggtgggttgtcagcgagtttgggcgtcatggcagtaagagaaaagaggcgccatcaccgggaaaagatcagagcgccggcggcggcgacgacgaagacgacgggaagggcggtggcggcagaggcggcggaaggatgctggcccaaccaatacgggccgcacgtacaccaccagcccgttacgaggcccaatttccatatgcagcacgttacaccgtaagcccgtttaggcccaactaatatgggccgcacatacaacataatccccatttggcccaaatagtatgggccgcaagtatagtgcaatcccgttgcagcccaaccagtacggaaccgtcactttcctacctgagagagtcggagattgtgcggtgcaaatgaaccgtccgatccatcttgtgcggtgcagattgaacaaaggagaggtggcggattactgcgtatacgtattaccgtttgccccctctctggtgcggggtcgatgggtcccacttgtcggcgagatggcaagaacggggcctctctgtctcctgctcgagaatccgcggccgcggctgccgctcgccggagctccgccgacgatccggcggcggcggctcgagtttcgtaggtgcttcaactgttatcgtcctccggatcacagacgttgtttaacatggtaccaagtttgcgaagcagagttccctaaaaaagagtgcgaagtaaatcaatttgcagaggaatcatcagactgggaggaaataattgcgtcgatagcagttcagttctggtttgtttgttggtctgttgcgttcagtgtttcagacagtgtcaattgtcaagaccacatgcctcaaatgtcaggtgctgttgataatcttcagaaccgctctcccctctttcgtaaagcgtaaaaaatagcggcacttggccatgtgttatctgtgattccactaaactgaaagtgaattgtatataatcaacactagttgatgaagtgtttcaactcggcttacttccagtggagcacaggaatggcaccatggttgtttatttagttcatatcactggatatctggatcaccaggcactgttcagtttcagtacttcagttcagatatgcagagttgcagactgaataaatatcgtcttacctagttatttacatcatagatgtttcttttgacatgatcagaaggtgcttccatggacaacacatattctaaatctggagctcacatcgcatgccatgcacagttttcgggaatacgcaaggagcgcatttttttctattaagagaaataaaagttatttacaaggataaaaggaaaacaagtaagggaccaatacaggacgctatggaaaactataggaatatctcgcgctaaatttggctaccacgacctcataaaggccaaacagcggggatcccgtgattagccgactttcaaagcatggcctcctccgccattgctttcaccacttcggtccaagacctttgttgttgattgaagattcggttgttccgtttcttccaaattgtccaagccaccagtatcatgacagtgtcgaagcctcgacgatgccgctccccaatcttcattcggctctcacagagccaattgtggaaggatgactcgttgacaggtaatcagttcagactccttatcgcctgaagcgtccaccaccataattgtctcgattcagggcatgctaccaagatgtgatcaatgctttcctcctgctgatcgcaaagaacacagcgatccgggtgtggcaaccctcgactgcgcagacggtcaacggtccagcatctattcattgtgaccaaccacaagaagaagcggcatcgaggcggagcgagtgacttccaaattggggtggaaaggaaggtgacacgacccaaaaacaaggccttataggcagattttgagctgtattggcccgaactctcccatttccagatgattgaatcaggagtagtaggatcaagatccaccatttggacaagcgaccaaagctttagatattctagaataggttggatcccaagtgctcctcggatgtctttgatccattggcgacctgttagtgcctcagccaccgtccgacgccggcgcacgcatggtggaattttatcatagatgttcggagcaaaggaccgaatgcaaccctcttgcaaccagctatcttcccagaagaggatagtttgtccgtctcttaattgatagacggtagaggctgcaacgaagttcctttccttttgcgaccccggaatggctagcccctgccaaggtttgcttgaggaggtccattgcaaccatgtccacctggaacgaagagctatacccataagctccagattcggtacacccaaaccgccgtagtttttaggggcgcaaactctggaccaagcgaccctgcaacaccctccattagcttgcgcagttactcagttgatgcatgcaaagtgcctctctggctggggcccgggggagtttagagtcaacaaaattatgatgcagctttagcgggcaagcatttctcatcagttcatcaccaaagagatcacagatcggcactcgcctgagctactgtatcactgtgtgctgctgaccattagtcaagtggcggctcagtgcagccaccgaaaggcttcaagattcaagaaaccatcagcccacagaggtaaagggagctcatgctcatggctgttactagtaacttttttttaactcatagaaagaatagacgctgctctgctcagtgctcactcggaacaaaatttccctttgctcgtgatgaagattctgctctgatcatgtagtgccacgaggttatcggatgaacaatcatgtactaggatgtatactctatgtacatcctgttcagagttcagacatggtgagcacgcatttgttttcatgtgcctaatcaaacatgaaaattgggagaaccaaaagatgacttgactgttcaccatttggaactggggttccattacgaaaattatatatatatttaatataatagttagtttggaccatatgtctgaagctgcaaatgtgcaaacccttgaaaggattagcaatttatagaactaactagatttctcagagtatcagaatatttggattaatcgaacaggccctaatggacttgtgcaatttttgtttcttcgtacacatgtaacctgtcatatagttttattttccatcagaagttgatgcccaattaatcacatgacagtgccattttctgaagtctgaactgaagaagaagaagaacagagattcgtatcagccaggccatttatgcgagaaaacaacatcaaaccaccaataattcacgctcgtttgttcgtttgcacctttcggatggcatcggaagccaagaaacaggcccatcaagagatgtccagctcctcgcatttataatctcttggatagaaaccatggaaggtgccccagctgttcagatggcttgtgatccagctgctgttggtgccactttacggtcaaccacgagcagtggtcgagggtgtcgttcagtggcagtctttctccaaaggcaaggtgaatggcactttctgcactgcagaagtgcagattggtggatgcttcggtggtcatggtgcactcaacagggcatgtgaccttagctgcatctttgctgtgaaactgtactaaaagcaagtggtttgttttcttctatcccgggaggcatatacctccttgacacgtctcctttagatccaagaaacatttcttatgagatcctttggaacaaaccccaattctataggaaaattaacatgagctcaaaccttatgtttgtttttttccctttgactagtaacatacctatgcattgcaatgggctaagacaatctagcataaagcagtgagctttttttatccaatcacttttcctctttttttctattcatttagcgtgtagcaaccatttcttttctctaacgatttttttagcgtgcaacaaatgttttccttttttttagcgtgtgctacgtgcgagggggagtggggggggataaagatgattgtacttttatagtagtagagataattctaatgcactctctccatttatttctctaatttctctttttagcacaagcaagttgttcaaaattgttgtatttatttcttgcaaaccatccaaatgaaccaactctaatatttatgtgctttagaatcatataggattctgaaacacatgaacattctattcttgcattgtgtttcagaatcatatgtcagggctcctttcaattggagtattttcgtagtagtttttctaactaggttgtttgggatgttggattgaaagttgctagattcttggattgcatacttatacctcattttaattttcctttgagaagcctaatacatcttggtttctctctctctctctctctctctctaaaatccatccaagttcatgtgttatttttttctgaggtatctaaacaattaatctttcaaattctcgtgttttacaatattcatgcgagatatgctaatatatgacatctcattcattccaaacaagccccataactcgagtccgtgcatctaaaatacatgcctatgtcatgaagatttggtttagtagtgaaacctaaatattgctacaattaataataatcagagaaaaaaaggaaaataagtggtggtctaaaattctccgtacaactgattgaaccacgtggtgttttataatttgtccaccgtcacaaaagttccataaaatagaaatgaaaataataaatagctcacctaatattaagaagctatggtgttgtgtaatacgttactctctttctactctgtataagaagtgaaaaaaaaacaattggtgtagatttaaggtggtttttggcaaggtgaggcatgaaagggggcctgtggatgtgagaattgtcaagtgggtgtgtattatatgaatgtttatataaaaatggtcaattggaaggttttatatgtatgggaggtgcatgcacatatttgggtttgtacaattgtgcacttcaaatgaatttgtagaagatttatagttgcatagcacataggaaaaaagaacacgatcatacccatacttagtcccagtttgattaatctgaatgatgctagattatctgattttatggtaatatttgagggcacaaatgaattaattaactattataatttgaaaaaacgtttttaaaaaacaattacatgaaacctatatatagaaagttttcgtaaaattacaccttttaataacctggatagcatgtctgtgatagttcataatgtaaaaggaaaagaaatgagctttaaaaaggataaaataacttatttacaatgtacaacaaatatctctgtgcttttgagggcacacatttttatgaaatgtacttttttaagtacacacgatttttttccatttcagatatttctttgcagttgcgtattgtctaacacgtactagtatgttaattgactttttgagaagttcttaatagtataacaccactgtcaacttctcgtattcaatacgagcaatgagcaagaaagaaagtacaagtacaccactcatcagcccaacaacaaaaaggaaagacagcaaaatacagtagacaaccacgtaccagctcactatctccatcacaaacgttgaaaacgtatagatacaacctacaagtcgtgaaataaacataacccagctggttagattttctctacaaaaataaatcactcggagttctagataatgatgctcgaactaattgataagtgtaaagatattgtgagcaactacaattaattgcatcatggtaaagaaaaaataactatacaattatacaaccagccaactgtccacctaatgctcagattaacactaatatcatctctactggctgccattagttcattaggtcccccactaatactgaccaccattaaattagagagaaaaagaaattaaaaaaaaagaatactaagaaaaatcaggctatccgaagttcccaacggtcacctcgtcgtcgttgccaaatctgccatgtcgccgccatggatcccctaatcgaggacccccccaacctagcggagacgaagaagaacgagaagggaagcccaccgcgtcgccatcattaactcctcctctcctctcgtctccctcgaaagcaccaccggatccgacgaccccctcctcccctttctcccctcctcacgaaaccgcctcgccttcctcttcttttctttttcgctcgcttcgcatcgctcacatgcccctgcctgccgccgcagacggggcgccatgtcgcgtagcggggtggaggtggtcgtgagcaggggttgctccaggctcgtcctccccgggatgcagccttcctccgcctccgccgcttcctcctcctccttctcgcgcggcggacatggcggcggcggcgaccggaggccgctgcccgatggccccttcgccggattggtcatctgcgtcaccgggctatccaaaggtgcgttgcttttttgcttcttgatttttttttggcccaaaatggtgaaatctctgctgtagtattgatgaggtgcgcttctttttttttgtgtgtgttcttggtggttggggatttgtgttgtgtgcagaggcgaggactcaggtgaaggaggcgactgagaggatgggaggcgagtacagcgggagcctgcatcccaagtgcacccacctagtggttcagatatccttgcaaagatcatggattatggtagcttgttatctcttctcttgggtctcctgctgtttttgtttgtcaaattcaggacggcatatgcttttccttagcgcgcagcacagcttcgccggccgcaagtttgagcacgcggtcaagcatggcgcgaagaatggcctctttgttgtaacacttggttggcttgtggattgcgtgcggaggagcagtaagacgagtgccatcctcttctgtttccagtgaattgtggcggcatcgtgttcatgttacggttgtttctatcgcagtgaggttggatgaatcgttatatagcatcaagaacattggggagaatggaatgccactcggggagttcaaccggcttgtcggcgctcctgttagtgggaattcttgccttccaccgatgatgtttcaggaaaaaacattttcagacacgaccgaaaagcatcggcttcagacatctagaaaagaacatgaccatgatgaatttctctttacaaacgactcgatctacattgaccctgggatatctggtgaaatgaggaagaaggtatgccccgctcttgctgctggattttattatggttggccttccaagtatagctttcggacagcaaaataggacttcaggacatttctcacgatggaacgttgtagcagagcatcatgtggatcaaagttttgctaagcatcgtgttaagagcaatgcaagttagatcgtttgatgcgattgtttccctctgaatttctttagttgacaaggataatttttattttccataccttcccctttgcccatcaatacaacaagacatctcttggtgaactgcatggctacgtttacataaaatgcatcttgtctacaggtatctgatgctgctactagagaaggtgcaaaattgttggaccactggtttattggctgtcatgcgacatatgttgtgtgtgaggacgcttctgtcaagagatatgttggtcattcagacaacattgtaactgtaagcatgttgcctttggttctaaacttctaatgaagtttggcagattttgcttgtattaacattttctgcatttaatttgtcagccactttggatattgaaaaccgcaaaggaaaaaggtttgcagcgtcttgtccatttgtcttcggacctggctaggcaggttgccacgattcttgaaaatgcccagacatttcaagaggtatgacatgctatacatgtaccttaatcaattatcctctcatccagtatacattttgtattcctaaaaaaaattgcctttcaagagatttggaaaatatggattttctcagacctcacaagctcctagaactaggaattctcctgtagatatctttttcttgggtacttccccgctctttttttctctggaaggaaacgaaaagacagtaaatgttacctgacatattacatgagcaatcctctatcttcataaaacgttcctgaaataaagaacagatagagatgggcagctaccctcctgtaatgtatttagtgaagagcagagaagactggtccacgtagatgggaaataatggttctgtcaattttaccgtttcttgaatagtacaactgtacagttcttattatttatgtttagattccttacaactgtacaaatgtcaatttatgtttgtgatatgttcatttttccacatttgactctttaattcattcttggatgattacaaatgtggtattgtgttgaccttgtattgtctactgttttagaatagaaaaattggggatgttccttctgtcaattcaaactccagtggagtaccatcaacccaaggggagatagatgaaattcatcaagagaggcaaaaatttgttgaagtagcaaagaaaaatgtccgagatcgccgtgctcgccgtatgcaggtaagggttgttttacctaccagagcagtttttttttcctcttcatttctagatttgagaacctgcaggttcctagttgcgtttatatttccagcatcactgcaacatttatttttccaaacgaaaaaggttccttggattaatgggacataattccgtaccagcgcatctgccttgtgtttttggacttgtttctgtaatacaatgccatgaaattcatcttggcatgtgtatgaaactatgaaccaggaactagaacacaatcaggacacatttcattatctgtagtcccttattacacaattgtgtacatataatgtataaaaacctagtacttttgtagaattatttggttcttctatattatataaagtttttgataaaatgtctaaattatggttttaagccagtcatgtgaagtaccaatccatccaatcacgcctgtgaaacttatggaatcaatctgttggaccgtatctgagccaactacgtccgcatgcatttatacggagttttcatggtcagacgatgcctttgagcaacaaagcactactttcttcgatgcgaatggggatggcaaggatgatcagtcaagcgatagtttcacccgcccactaagagaaaggtaatcaatgcttgatcttggtcaaattctttttaactgttgttctgatatgcttgtgttgttcctttagtgagaagagtgaagtgatctttaagaaccacttccttaccgtactcttccccattgatcgttttggtgagcttggaccttcctcaaggacattcttcagcaatggtggtttcacacgcatacaagtgcttgatcacatctacaacttctaccaggtacaatcagtatcttgttattaagtttgttgaattgagtgcaatactgcctctttctgacagaactcttgaccaatttttacagtggcttagattttgtgtttagcttgtaagctaacccataattatctttctcgtttgtgaaggaaaatatgtcttccgatgagataaatgtagccctgcaaacggattcacgacatgctgatcgacttcgctcgctgtacgcaagtactgaatcagcagaaagaggttttgtaacattcaaaagaattgattttttgggaagccgaagaagttttgaggggctaaaacgcctcagcagagagaacaatagcaatgtatatgagcttgtgattagggcataaactgcaccatactcggtgttatttagtcaaatttgtttgttgtttacaggttgatagtgatgtactaccatgtatgcacgccgaataaaattgtaggagataatgatatatttatagatcaatgaaaaagatcatgttgggcagttcagccgcaatacccagtgatggacagtagtttagacaaggctgcagatctgttttcgactgttcatcagttcatgaatcattggtgtactaatctgtttgtcttcaaagggaagtggacattggtgtactgatctgttttcagtatg

SEQ ID NO: 64048 - DNA, 41366 bp, Oryza sativa
ccctctgcctgcgcagcggcagcgcgccggaggccggaccggcctactccagctagcaacggtgggggggcactgggtttggggctagctgtgttgtgtgtgggcgcgcgcacggtgcgacgttcacggtcggcagcggtgccgcgcttgccgtgggccgccgccgcgtgctggctagctgggctcgcagcggagcctgcctgatctagtggcagacgatgacggcagatgaaacgaagcgagaacaagtccactttgattccttctaatatgagtccacggataggatagtcccttaaaagcaatctaaactatagatctagtagtatttaaggatctctcaactgcaataacacatcaactattaaaatcattataatttaatttcctcggttgttttaaatgtggttttcgcttatgtggctagataaattggtctagccagctgagccagcttatggagcccacatgttagcagatctatatcaataggctgggtataatagctcagcaaggtcatcgaacttgttagggatgaatcggctctgcgcccttgtcagctagagactcttatcttgattatgtttctcaatacgtaggatgaatttgaacttgttttttatagtattagatgtcaacatactttatattgctaatttcccataactatttatattgaatttagaaaaaaaaaagtacacgaaggatattcccttatcatattagaacccattccccatcttattggagtggtggagttttcacagggaccatactatattggtttccatgaagaggtcaattataaagtcactaacaatgttctcagctcaattaattaaaccttcacccacactctttgactcttctaggcttactctaagaaaaagagaaagagaaagaaaagaatcagaaaagctttgccacacctcacaccttgtgtccttgtgcctcctacaaatagctcttgccattcagtttcctctcagcagcccaacagtcgtcttaaaccatccagctagaagacaacatcctcttaattccggccttaatggaggtagcactctgtgcatcctttgttgccattctgctaaccaccatgctcttcctaaaagccatctcgacgaggtgccgccgtcgaaagtataacctcccgccgggtcccaagccatggccgatcatcggcaacctaaacctcgtcggtgcgctcccacaccgttccatccacgagctctcaaggcgctacggcccactcgtatacctccggttcgggtccttccccgtcgtcgtcggctcgtccgtcgagatggccaggttcttcctcaagacgcgcgacgcggcgttcatcgaccgccccaggacggccgccggcaagcacaccgcctacaactaccgcgacatcacgtggtcaccctgcgacgcgtactggcgccaggcgcgcagggttgtcctcaccgagctcttcagcgccaggcggatcgagtcgtacgagcacatccgccgcgaggaggttcacgcgctgctccgtgatctgcactacgcgtcgtcgtctggcggccgacgagctatcgtgattaaggactacctgtccacggcgagcctgaacatgatcactcgcatggtgatgggcaagaggtacgtgcagggcgaggtggtccatgaggagccgggatcggcgcggacgacgctggcgcagttcaaggagttgctcgaagagctcttctttctcaacggcgtcttcaatgtcggcgaccagatcccgtggctcgagtggttggacctacagggctacgtcaagaggatgaagaaggtgagcaaggcgttagaccagcttctcgaacacgtcgtggacgagcacagtgagcggaggcaacgtgaggggaacgggtttgtggcaggagacatggtggacgtgctccttcgactcgccgatgattctagcctcgaggtcaaacttagtcgggacagcatcaaggcatttactcaggttagcgactgcatagcgtacatcgtagtactccctcgtccaaaagtctaggctgtttggatggtattttcagtacatgtcacatcgatcggatgcttaatactaattagatgtttaacgtattaaacgtagactattgacaaaattcattctataaccctgactaatttgtaaaataaatctattgaacctaattaatccatgataaacctatgtgatgctacagtaaacatgtgctgattggcttaaaaaatttgtcatgaaaattagctctcatttacgtaattaattttgtaagtagtttatgtttaatactccaaattagtgtctaaacatccaatgtgacagggactaaaatttagtcccggggtcaccactagtcctagcatggtttagtttccaactttttcttcaaacttctaacttttctatcacataaaaacttttccacaccacaaacttcttaacttttccatcacatctttccaatttcattcaagcttccaattttggcttgaactaaacacaccccaagactaagaatcaattaaatcactcacgttgtgacaaaaccaatgaacatgtaactaataagtactaaaatggtttcttggttctcatcaataatttaatttagcacataatgactaaaaaatagaacttagacttttagaaaaaccaaagaatgaaataagttttagacttttggaatgaggaaggacatatcaatcaaggggaatagacaattttgtcccaaatttcgtccacaggtcaatttggtggttgatttttcattttgtctaaaggagtcctccagatttgcgcaggaattaaggacaagctaatgcctaaccttatggtaaaatcccagtgaagtatattagtccctccatacttcctcaaatactccgtttcaatttacctatcacgttcaagatttgttttaagtcaaacattttgatctttaacttcaatttctacaaactcatgtagttttacatcataaaatttatacttttggattcatcatgagaatactttaatataatatataattcacatgttgttaaattatacggatttctaaatattaatggttaaagatagacatgtttgagttaattagactaaatctaaaatgataagtaatataaaatagagggaataatgaaaaggaaaagtcactccagcggtctcatctattcgttcccatcaggcttgctcaatgcaagaaggtgaacaacagtagccagtagttacatcatgttagggggggtacagcacacccaggaattatctgagatgttaattaaagtataagaacaaataagggcaaagttgaaaactcttttgttctctaatgaaatcatattagattacttccaaattactaccttcgtcccatattataaggtaataaggcatgtattttttacacggtctttaataacatactttgactattaatttactacatgttatgttctcaactatgaaattagcatcacataaaagtacttaaaaatatgaatctagtaatataacatgcataatataattagtacaattattaataaaaaaaattaccgagtttgattttctaaaaaaaacatatgtaatttggaacggaggaagtaagaattttccatgaggctaaatgttggttctagctttgctcacacatataacaaacttaaaaaggtgggaccacaggacctttctaaacctgcagatatagaattgtaggaatcattttatgaaatcccaaaagcaaaatgattacacggtaaaccttttgataggcaaaattaatcagttattctcctccaccaaaaaaaagttaattattctcccccaagaataagtcaagcaaataactggcttggacgttggaagttcaaaagttcatactaatatgctgtgcaaatttagtatatgagttgtgaagtgtaaatgactgaaacatactacctccattttttaatagatgacgccgttgattttttctcacatgtttgaccattcgtcttattcaaaaattttatgcaaatgtataagatataaatcacacttaaagtactatgaatgataaaacaactcataacaaaataaattataattacgtaaattttttgaataagacgaatggtcaaacatgtagaaaaaagtcaacggtgtcatctattaaaaaacggagggagtatatatgaaactagaatttcttacatgcatgacgccaaaaattattggcttatatataggagtaaatatcactataggtcgccgtgcataatattttttacttcagtgcaccctttttttcatagttgacaaatactaatccatttttttgtcaaaaaatattaatccaatttgtcttcacaaccaatcaatcacatacgtggacaactgcagaaaatgcacattttttttcaaggagaacacattacaagaatataatcaaattaagatgttacctcctccgtcccaaaaaaaaaaatcaaaccctaggtctgaatctggatatacatatgtccagattcatatccagggtttgatttttttgggacagactagtaagtcgtttctgagttaactagtccaaaacggcatgtgtaggacctcattgctggcggcacggagagttcatcggagacaatcgagtgggccatctcggagctcctcaggaagcccgagatgtttgcaaaggccacagaggaattggatcgcattgtcggccatagacgttgggtcaacgagaaggacattcttgatctcccctatattgaggctattgtaaaagagaccatgcgccttcaccctatcggacctttgcttgcgccacgcctttcccgtgaggatacgtctgtgggtgggtatgacatacctacgggcacgcgtgtattcgttaatgtgtgggccattgcccgtgaccctacgctatgggacgcatcggaggagttcatgccagagagattcttgggtaagaaaattgatgtgaaagggcaagactttgagctattaccatttgggtctggtcgacggatgtgcccaggctacaaccttgggcttaaggtgatccaattgagcatagccaatctccttcatggcttcacgtggaggctcccgaaggacatggtaaaagaggatttgagcatggaggagatattcgggttatccatgccacgcaagttcccactagaggttgctgttgagcccaagctctctagtcacctctacaaaggtgattgatatatgtctctatgtcattactcatgtagctggtacataaaaagtatatgtatttctgaacaagaattctaagccctcaagagatgttctattatgtgtatgatacaaacagtcatgaaagattctaaaatatttgattatacagagtacaatgatatctacaactccagaaaatttctagtctaaactcaatatatatgaagcgggaaaaatgaaggcaatcttagttgtatgtatcattcctgccatgccaatataggtgtggcccttttttctatagaaacacggttctaacataggcgctcacaatgtgagtgtactcacccttatgaacacatagtctctacccctatgagcacctccaaaagtctaagtcagcacatcttgcgattgataaagtcaccgaagacgtctcgtttgtcaatgggtatgtcgtctaccactgaaagaataattaactgtaaatgcgagtacccatgtcaagtccaggacttgaacgtagacaatatagagaagggtgatgtgcatggcttcccttctttcctccatgtctttatgccagaatgatgaaccttccaagtttgaatgtttacagactgaacctacaatacaaccttgttgcatatgcaattaatgcaactatcatactcatgcgaatggcctatcatttggtccacaaggtatatcttttaggttttcttccacatttagagaggtatatacctctcctatttcaaaggtaaaaaaacaaatcagttgaagtaaacagaagacaagtttatgattagcaatgacatgacttctcttgttgttaggaggtacatcaaggtatatatataccacaaagtgtaagtctggaggtatataccttaaaaaaagatggaaagtcaaaaatatacttacaccatactctattagttttggtacttcctttcacaaagaggtctatattaaaaatgaagagatataagtatgggagaaacccttttatttttgtttttaggttgttgtaccatgattttttttcttgtttatcatgttaggagtatttggccttttgatggattctatgatagtgcaaactgtgtaatgattatgtacatcctagttagggcagagattctcccatcctatatttctagttgtcatgcttaacaatatttcactagcatactttcgggctagtatatatgaaaattaaactggaaatcaagatactaccactactggagaaaccatctttcgtgggttggtaaaaaaccacaatagtcccgattcaactaaaaaccgggactaaaaatcatttttagtcccgatttaaaagtgcaacgagtctatatgatatttagtcccggttggtgtatctgcctcccatgtcctaactcggccacgatcttatctctctcgagaccaagcgtcttcatcttctctctcgcctctctctctctctctctctgtcctctcctctctcgcaatggggtcggcagtagtgcggggtgggcagcgggagaagaagtggcgggagatgcgacggcagccgggcccgtgccggtggcaggacaagaagccacggtagggtggggttggcggcgcctctctccgtcctctcctctctcgcagtggggttggtggcggccaggcccatgccggtggcgggagaagaagttgcggccgggctgtgtcgacggcgggagaagcagtggcggccgagctggggaggcggcggcctcgccctcccttccgccagatccggcaggaggggaggcggcggcggtggagcgactgcaaccagaccggaagaagattttttttttaggatttgcgatgaatttgtttttgagaattagtgatgtttgatctgtgatgtgaatatgtgatgtatttgtaatgttttttttaaaatttgtgatgtgatttttttgagaatttgtgatgtatttgatctgtgatttggagattatttggggatttcacgatttggggatgtagtgaaatcaatattcaagcagttaaaagcaatgaaaaaaagaaaaagaaactctataccaggactaaattaggagcactagccacctgtctctaccatcttcaccaactagaacttaaaaatagatctttagtcccggttattttaatcgggactaaagatagtcttggattcgtagtaccagtttgcaacttaggactaaaggggttgcaaaccgagaatacagaccacttgttcactggtgtttttttttgcttaatatagagtgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacggactcaacatttcaggtagttcaacactccccctcaatctaaaccataaaggttaagattgtatctaaatacagctagctgtttctcattcaagggttttgtaaatccatctgcaacttgatcttgtgaaggaacatactctatttccaacaatttcctagatactctttcacgaacaaaatgatagtctacttctatatgcttagtacgagcatgaaacacaggattagcagagagatactttgctccaatgttatcacaccatacctttgctgtttttggtacttctatcttgatctctttcaacagagtttgcacccacatgatctcagctgtgacattagccaaagccttatattctgcttctgtacttgatcttgacactgtaggttgtttacgtgcactccaagacacaagattaggccccaaataaacagcaaagccaccagtggatctcctatcatctaagcaacctgcccaatcagcatcagagaaaccactgacaagtaaagaagaagactttcttatcttaagaccaagcccagatgtttgttgcaaatatctcagaatcctcttgactgcagcccaatgaactgtagttggagagtgtaagtactgacagactttattaactgagaaagaaatatctggcctagttagagtcaaatattgcaatgctccaactatgctcctataattggtagcatcattaggtccaagaacatctccctgatgtattgagagtttctcagttggtgacagaggcgtactcacaggtttgcacttatccatattgattcgcttcaatagatcttttacatatttttcttgagataacagaataccatcacatacctttgttgcttctattcctaggaaataatgaagctctcctaagtcctttaaggcaaaagacttattcaggtcctgcaaaagagctgtggtggcatctggcatagagctagcaacaattatatcatcaacatatataagaacaaatataatgacatcacccttgctgtagaagaacagagatgtatcagccttggaaggcatgaatcctagctcttgcagttttgtgcttagccttgagtaccatgcccttggtgcctgcttaagaccatataaagccttgtctaacttacatacatgattaatcaaggatttatcttcatatcttgggggttgtttcatataaacctcctcttccaatatcccatggagaaaagcattactgacatctagctgtcgaaggctccaacctctagagatagcaatagacaaaataattctgattgtaattgcttttaccacaggactaaaggtatcttcataatctattccatacctctgtttaaatccctttgcaaccaatctagctttatatctgtctaagctaccatcagcctttcttttaatcttatagacccacttgcaatctataatattattagctttttctgcaggaactaaatgccaggttttattacccattagtgcctcatattcagcatccatagcatttttccaatttttatcatttaatgcctcatgtaaattttctggttcaccagaagctgtaaagcaagcatatttaactgtaccatctgtgtataccttttctttgcggattccactctgtaagcgggttctaggccgaactatttctggttgatgctgctcagccacaggagagctcgcggcttcttcatgcgatgcagaggattcagagacatcatcattacctgccatcgtcgtggcagacggagactgatcactcggctcgttctcaacacgcgtgcctgaagttgctgcatgcgtgtcactaccagacctgcgcacacacaagggtgtcacagatcccggcgactgcggcgatgatggttgctgctgtgacagctgctgcgtatttgcttcatccacccagtcctctgcacctatatttcctgtatcttctgcatgctcaacagattgatcaggcatttcattaggagaattaaacatctgatcattctcaagttctcccccttgatgagacgtgtgaataatgagatcagagggcaaaagagagatctcatgacgaatacgtgcgccagcattgtcatgcaatttagaaaaaggaaatacactctcatcaaaaatgacatctctggatatatagattctaccagaagcaatgtccagacatttgtatcctttatggcggtggctatgaccaagaaatacacattgctttgaacgaaattggagcttatgtgcattataaggacgaagattaggccaacaagcacaaccaaacactctaaaggatgaatagtctggtgtttgtttgaagagacgttccaggggagactcaaactcaatgactctactaggaacccgatttataatatgagtggcagcaagaaacgcttcatcccaatatttgagcggcatactagcatatgctagaagagataggccaacttctacgatgtgcctatgttttctttcggcagagccattttgttgatgagtatgtgggcaggagacatagtgagatatacctattttctcaaaaaaggaattgagtttctggtactctcccccccagtcagtttgcatggaaataattttacgatcgaacaaacgttcaaccaaattctgaaaatcatgaaatttctgaaaaacttcagatttgttctttaaaagataaatccaagtgaacttgctataatcatcaataaaactgacataatatttcttatttccaacagaaactggagcaggaccccaaacatcagaaaacacaagttccaaaggatgactcgatatactcaaagatttagaataaggtaactgatggctcttggcctttagacatgcatcacaaaccggctctttattggactcatctagacaaggtaatttattcttgctaatgactctggagataatgggtgctgaggaatgacccaagcgactatgccatctctcaaaggatggcgtgacagcacaaactacttttgcagatgatggaggagatgcagatggaactggatagagtcctttttggcgtctccccttaagaaccgttctcctcgtggcctgatccttgatcaaaaaatgttttgagtgaatttcaagaaacacagagttatctgcagcaagcttatatgcggaaataagatttttattggcttgagggacatggagaacattattcagatgcaatgggcgagtaggggtatgaactattgaatgaccaatatgtttaatctccatacctgaaccactcgccgtgtggatttgatcatgtcctttgtagacgtctcgagcggtgagtttctccagttccgaggtgatgtggtcggtggcgccggtgtcaacataccagttggagtcccgtgcatgggtgtggatggcagcagcaactagcttgtcgtcggggacgaaatcttcatcaaatcgatgccaacagtccgctgcaacatgtccgcgtttatagcagacctggcacaatggacgattgtcatagctgcgctgctgctggttgttgccgcgtccacgacctggtgcggcgctgcgcccacgagttgcgccgcgtcctcgcccagggtttgcgccaccaccccgtgagccaccaccaccacgtccacctctgttcgccatgttcgccgtggcctgcgcctgcctcattgctaacctgttttcaaagcttaaaagttgtgagtagacttccgcaaccgtgacaggttcaaccctgccaacaattgtggagacgacggagtcgaaatcttcgtcgaggccgttgaggatgtaggcgatcagttcttcatcatccagtggtttgccggctgctgcaacttcatctgcgagggtcttcatcttgccgatatattcagagatcgacgagttgcccttctatagagtcgtcagcgccaggcgcacgttgagagaacgcgcgcgtgtcctggacgtaaacatgtcgtccagggttttccatgcttcggccgccgtcttcacagcagctacttgtgagagtgtctctctcgtcaacgaggagaacaagaagccgaggatctgctgatcagcagcgaaccattcatcatagttcgggttggaggtcttgacttcctttccatcgacggtcttcgtgatttcagcaggaggagctgggtttttcccattgatgtgcccctcaagtctggcgccccgaattgccgtgagcacctgcgccacccagagcccatgattcgccttggaaagcttctcggtgacctgaactccgatcaagggattggagctcgcagcggagttggatgtagatgccatctgggtgctcttttcagatgcaacctcttcttcagatgactcggatgcaatctcttcagattcagatgcagaatcgatttcttcttccaatcgctctgataccatgaagaagtttgggaatctgtggattgaacgccggccttctcaggtccaggcggttacgtgttgattgatagcacacgaatcggtgcgagattacatgtatatatagcacaccataccagccgtgattatctaacaaattaacaattaactgcatcctaaatcacagccggcatagtatcctatattgttacaatacgactcaacattccaggtagttcaacatagagaatatctactagcagtacccatgaatctgtcttgtgcacaaatatcagagtccaagaacgaagaaaaccttattatcaagcatattattgactcactcttgccctattattccactcttacaaagacagaaaataatgcataagcaacaacaccagtactaatactgcaggcttaccggactgcagcgacgacagatgcagtaacaactgtaatcaacagacatgcaacacacagatatacatcagcaagcagacacatagaggtcagccgggagcttgggctcgacgacaacctcgagcgggaacttgcgcggcgtcgacaaaccgaagatctcctccatgctcagctgctccttcgtcatgccgtcgggcagcctccacgcgaagccgtgcagcaggttggcgaggctcacctggatcaccctcagcccaaggctgtagccggggcacatccgccggcccgacccgaacggcagcagctcgaaatcctgccccttcacgtcgatcttgctgccgatgaacctctccggcatgaactcctccggcgcgtcccacagcttggggtcgcggccgatggaccagacgccgacgagcacccgcgtgccagcggggatgtcatagccgtcgacggacgtgtcttcgcgggacaggcgaggcgcaagcatgggcgcaaccgggtgcattcgcatcgtctccttcatgatggcgtcgatgtaggggaggctcgggatgtccttctccgtgacccagcggccgcggccgacgacacggtccagctcctcggtgaccttggcgaacacctccggcttcctgagaagctccgcgatggcccaatccacagtggccgatgagctctccgtgccgccagcgatgaggtcctgtgcacgtgcagatgatgagcaacgttggagtttggaccggtgaatcaggtaaagaaacgagaacacagtcacaaactgaatattttgatcgatggtaaaatagcgtgcactgcactcggcacaacacatcttttcataatcttgtgttagttgctcgggttgcagtttatgttatgtaatccatgaacaatgtgtttcaccttctctcttcttagtataatacagggaagagcttccagccacttgcttaagaaaagaaaagaaaaagctctgcacaacatatgattaattagctagttgcggagacaatcaggttaatatttaggaccgattgggcgtcaacgaagtcaagatgtagctagtgcatggttatgtacgatgatactattataatccaactgactttctattccccataaaagaatataagtaagtacacatgcagtatttaaatttgtgtggattgttgcgttcgccagcagagactgtgagtgagtttgtttcgttttccacgcgcacatttctcacactattaaatggtgtgtttttttaaaaaaattctatacgaaaattactttaaaaaattatattaatccatttttgaagtttaaaatagtttatactcaattaatcatgtgctaatggctcacctcgttttgcgtatcttttcaatctctaaactcctaaaatatattggtttctgaacttgtcctatgtattatataaatccaaacagactccaaactgcttcatgtgctaatgtgacataccatgtcagtaggacttacatgtgagacacatataaactttttttttaaaaaaatatcctctctcctctctttttaattttattttttcaagataaaaaaatcattttctcctctctttttaaaattttatcaacatatggatcccaccgacaccaatatggcatgtccatgacaaattcaggaatccaaaaattccttttgatagtttaagaatggggcaattgtgttcttatctctactttcatatctaattgtgattttaccccctcttttttctagggtttgtgattttgccctcatttttttctgaaggaagctgtcgtttgcccctacattggatgaccgtttggtggacccaaaataagagtgtaaaaaatatagatgaaattactaagagaaaaacaatggaccattataccccagtgcaaagaacaacaccctgcattgcctttttcatcccacccgatccccattctgattacttgattagcctaaccctagtggcaccgccggcggctgtgcacaggcgagataggccggcggctgggcaaggctgtgatgcccagcgagcagcagcagatgcccacatcagcaaagctagtagggggtgttggcgcagtgagcaagccgcggcttcggcggagcgagtgaataggcggcggctccgagcctccgacggcagccgcaagcaggaggcagcttcggcggcacgtgcgagcccgcagcagcggcatcgcacgagaaggcggcggctccggtcgtgctgcagccgcctcttattttctttttcttttttccgatcttgtgctactttgtgaggagcttgtttgtttggtgattttttactggtgaatgcgatggatctttcgtacctggtgaaagttctgtgaaatcctatcaatgatatcgaagttctttcaaaatttgtccaagtgcgatcatatttttttggaaaatacacagatcctaaaagaaaagtagggccaactgtacagggttatacctgtctttttttagttttattgacaccgttaggtggttttaacagagtaggggcaaatcagagtttcgttttgaaaatgtgagggtaaaatcacaaaccctagaaaagaagggtaaaatcacaattgcatatgaaagtaggggtaagaacacaattgcccctttaagaatctagatgacacatctactataagattagaaaccaaccctacactacactcaaataatattaatatattgagatgctatttgactcggttaattacctgggtgaatgccttgacgctgtcacggctgaacttgacctccagcgaaggatcgctggcgacattgagcagcacatccaccatgtccttcgccacgaagctctccccctcgcgacacatccggttctcatgctcgtccaatacatattccaggaactgatcaaacatcttgctcagcttcttcatcctccgaatgtacccctgcaggtccagccagcccaaccacgggatcgaatccccaatgtcgagcacgccgttaagcaggaagagctcatcgatcatccacctgaaccgctcgggcgtcgtcaccacttctccctcgtgcaccacctcgcgctccaggtacttcttgccgagcaccatgcgcgagatcacgttcaggctcgccgcggacaggtagtccttgagcgccaccacgcgcccggacgccgcgtgcagatcgcggagcagcgcgcgcacctcctcgcggcggatgtgctcgtacgactcgatccgcttggcgctgaagagctcggcgaggcacaccttgcgcgcctggcgccagtacgcgccgtagggcgaccacgtcatgtcgctgtagttgtaggtggtgtgcttgccggcggcggtcttgggccggtcggcgaacaccacgtcgtgggtcttgaggaagaacttggccatctccaccgacgagccaacgacgacggggaaggacccgaacctgaggtgcatcaggggaccgtacttcttggagaggctgtggatggagcggtgtgggagtgagcccatgaggttgaggttgccgatgattggccatggcttaggcccaggagggaggttgtacacccggcggttgtgcctcaagatcagggttctaagaaataagaggatggtggcgagtgtgatggtaaggtaggatacccatagtagaaactccatctgaaaaatgtatcttggctggtgaagatgactgaaccacgggcgaacttttatagatcgcaagagggagtggcttgctaacgcaatagatataccattgagaattcaggctgcatatgggcattcgatcgatgttttgtttgcacttggcataaataaagacaatcattagtcaacttgtactggtcatgttaaaaaaccactgtggttaattgcccaagttgctaattaatctcgtgatctggaagggaatatatttcccgtgtacactcctaacacaccaactgacaaatgtcacagaaaaatccagaaaaaattagacacataattccaatggtattatacttacgtgtgaaatcttatattcaaatacattatattttagccgtaacaaaaaaaacaaatttctaacagatttttacttttaaattgtcagatttttcacttttttgttacggctaaaatataatgaatttgaatatgagactttgcagatatgtttaatactattaggagtaaatgttcaattattcgtagaaattttcgtgccatttgcttgttggtgtgcatggagcgtgcacgagaagtttgtacatataggatatgtacctctgatcaattggtatctattttacaatagaacaaattgcattgataaatggtgtactttttgtatgacctgttgaggtagtcattttcttttgagacagagaagctataagaaactgcaacaatgctatcaatgagtaagcaacagtaggtaggcatacagccgtgcaccatgtagagtaccccatacatctcaaaatataaacatttttaagaatacagtgacatgcaaactttattccaaacaagaggagtgtttaatttgcttcccatgtctaaccctctccatagacgatgtcttctgtttttatcaatttgctccacaactcttaactggaagtttcagttggcacatgtagaaagttagcagaaagcacatagttaaccagatcgagcctatttccataagaaagataaatggaacaggagacgagccttcttttaattctctatactattgggaagaaatcatgtatgagtggtttggtgagacttaaaggtaatccaaggtaactgaaaggaaaggatcgttgcgtcattgcagagtatttgtgggaatcttcatcttttcttctgacacattaattggcaccatgaatgatttgttgaagtttattcttagactagtcgagtccacaaaatgtatgtaaaaagctttgagtcaaaacaattgtctagagcatacatatattactaggagcgtgtcatccgcatattgtattactagtaagtcaagacacgtacaagttgaaattgtcagtgaagattgcaaggtccctctgttcataggtcatagctttattgtgaatagattgtaggaggtctgttgctagttaaaaaaggagagttgaatgagactccttgtctcactccccttctggattgagatttttttccctggggcactccattcaataaaatggaaaaagttgtagatttttagatttttttttctacccaatcaatccacagttgccaatccctttacatatcagaatctctaggattacactctattcagttttaccaaaatgccttctcaaaatcaagcttgagtgcaatcacttatttcttggattttatagtaacatatgcattcaaaaggccatgctaggcaaaataaacataatttatcctctgttaaaaaatatagctacatttctagtagaaatttgagctttttgattggttgtttatgacggtgggagtaattgaggacttttatgagaataaattctttaaatggttttaagagttgagaatgtttctttatacaatattaaagttaaagttaaagggtgtgtttggagtttggacttggggtggacaaaaaacttaaagctcgtagcgagcttggctcggattgagtcgaatttgtagtcttaataagtcgagccaaagtagacttttagctcatgaagctcgcgaactgctcgtttagctcgttaatacaagaaatcaacatatcttcatgtacttcgtgattttaactagtattcagtcatttaaatacaaccgaactatttatatttagtgaattatttattagttagtgtttattttcatgtttatatatgataaaatggtaaatgtgaaattatgaaggtagaataaatacgttaacaagcctaactaactagcttaataagtcaacttatgagactagccaagccgagctaagcttctggatcgttaacaggctcgttaagataacgagctcaaacgagccgagccagctcgtaaaaaataactagttgaggtgggcaatatggacttatcctacttcctacatatctgcgacagtggttttttttcatagggaatatctactgccagtatgatgaatctattttgtgcacgacactccaatatcgcataacaccttattatcaagcatattattgactcacacttgccctattacattcagctctacaaaggcagcacaggatgcataataagtaacaacgctagcaatacactgcaagcttaatgttggaccgcgacaggagcagtgcctacagtacagtcaagagacacagaacgtacacacgcacatcatcaaaggcatatcacatcaggcagcagcatagaggtgagcgggcagcttgggctcgacgacagcctcaagcgggaacttgcgcggcgtcgacaagccgaagatctcctccatgctcagctgctccctcgtcacgccgtcgggcagcctccacgcgaagccgtgcagcagattggcgaggctcagctggatcaccttcagcccaaggctgtagccggggcacatccgccggcccgacccgaacggcagcagctcgaagtcctgccccttcacgtcgatcttgttgccgatgaacctctccggcatgaactcctccggcgcgtcccacagcttggggtcgcggccgatggtccacacgctgacgagcacccgcgtgccggcggggatgtcgtagccgtcgacggacgtgtcctcgcgggacaggcggggcaccagcatgggcgccaccgggtgcagccgcatggtctccttcacgatggcgtccacgtaggtgaggctcgggacgtccttctccgtgacccagcggccgcggcccacgacgcggtccagctcctcggtggccttggcgaacacctccggcttcttcaggagctccgacagcgcccactccacggtcaccgccgagctctctgtgccgccagcgatgaggtcctgcacgtaacgatcgatgtgaattgctgaattgttgctacttagatggtgttgtaatggtgatcaacaatggactaagtaacactccagtgatatgatgcattgttataagatttaagacataatgaagagtgttgatctgcagtctgaaaattgttttttaatgttgtttttgttcagttataaacttattctgcactgtttagatcacaggagggggtcagtgctgcttgcaatgattgacgtcccatgcttatcagcaacggaatctgcaagctctttgggcagacaagatattcagacagttcatagttgtgtgggctagctctgtggcaagcacattcatttccctaatggatagtgacgtccatttgggcaactccgatcttttatgtaagtccgttttctgattgaaactagtaattaataatgtggtttggctatgataaatgacaaccctaccatacgtagtatcccaatatcctactaagaaataaataatttatgtcacggtcaagtttcagaagttgactaacaagaatgctacgagtacatagttgcagcctgcagctatcattctgagagtttgtgactgcacccattcaagattgttcctattaattacagtattagtatgtgattttccagtttattgaagcgtgtagatatttgaagttgatctgaaaacattttttgggggcagaaatgcagtgacagaaagactcacctgagtgaatgccttgacaccttccctcttgagcttgacctcaaggttgggattgtcagcgaactgcagcagcacgtccaccatgtccttggccacgaagctctccccctcgcggcggcggcgctcgttgtgctcgtccacgacgtgttccaggaaccggtcgaacatcttgccgagcttcttcatcctcttgatgtacccctgcaggtccagccagtcgagccacgggatggagtcgccgatgttgagcacgccgttgagcaggaacagctcgtcgagcatccacttgaactcctccggcgtcgtcaccgacccccccgcatccttgtccaggtacttcttgcccagcaccatgcgcgtgatcacgttcaggctcaccgtcgacaggtagtccttgagcaccacgacgccgccggccgcgccgtgcaggtcgcgcagcagcgcgcgcacctcctcgccacggatgtactcgtacgactccagccgcttggcgctgaagagctcggtgaggcacatcttgcgcgcctggcgccagtacgcgccgtagggcgaccacgtgatgtcgctgtagttgtaggtggtgtgcttgccggcggcggtcttgggccggtcggtgaacaccacgtcgtgggtcttgaggaagaacttggccatctccaccgacgagccgacgacgacggggaacgacccgaacctgaggtacatcaggggaccgtacttcttggagaggttgtggatggagcggtgcgggagcgtgcccaccaggttgaggttgccgatgaccggccacggcttcggccccggcgggaggttgtacacgcggcggctacggccgagcaccgctttcaggaacagcacggtggcgagcactacgccgacgaaggacgcccatggcggcagcatcagctccatcggtaaccggtcggtagtacgtggattggctgcaattcagttactatgttataggctgagctgcttggccggtggtggacaaccagagctcgagctagctacttatagaagacgacgagctcggaggtgtcaccatggcggtagtagagcgcgcgagcgtgtggaggaagttgaggtgtcatatggtgggaaaggacggggaaatcgatccaagacgattctcacgatgtctggaaagaaaacttggccgcgaaatgggccaaggcgtccacttgtgcaaattgtcgttttgccgagaaaaacgtggagagagaccgaggccacggaaccaccgctgctcagctaggctgcacaagcacaacgctctgctgcgtatgtgaagttgcaggtatccctctttgggggaaaaaaaagaacgtgcagaaggtgcaaaaaagtcagaatatttataccgtcatatttttcaacagaaaaaatagcatatatttatattggaagtttataaatttcatatgtaattttagtgtattaacaatgtaatttatatgtgtaatttgtaatttgtatttacactaaaattacatatgtaatttataaacttacatatttgtaatttgcggaaaatatgtaagtctgtgtaatttgtaatttgtatttacatatgtaagttatatgtaagtcaaacaaaatgtggtggttgcttgcatggtaaatgtcttggtttgtaatgctcaggtcatgcgttcaatcctgctcctctcttgggttcctttgatgtttttgtatgtactacacgaatcttaacgcatatcgtattatctaggaatcgatatatttttttctacaaaatatggcgtcacctttttagactctgacctatcgctaatcatagtacatgccctccgttttcggggtggcaagaagttcctaattttttttccgaaaaacatcacattaaatctttagacgcatgcgcgcgcgcatatatatatatatatatatatatatatatatatatatatatatatatatatatatatatatatatatatatatatatatatatacacacacacacacacacacacactaattgcacaggttgtatggaaatcgcgagacgaatcttttgtatctaattagtccatgattagccataagtgttacagtaacccacatatactaatgacggcttaattaaactcaaaagattcatctcgcggtttccaagcgagttacgaaattagtgtttttattcgtgtccgaaaaacctttccgacatccggtcaaacatccaatgtgacactaaattttttttttttgagaactaaacacaccctaactataaatggttgatcaggtttcggatttccatttcagtggctggcagtggcacaagtatatgtactatggacagtgacagatctttttggctctgcctgcatatactgtattatctatctctaatcagtgagcagacagagagtgggcgaaacaggaatacaagatgttgatcagacgcttatgaccacacagataggcatgcctcaccaatcatcaaccggtgtcacggtatggcaaaggaaatggagccgtgaaagctgacagatcttggagcacactccattttctctgggtggacagaatgaatcagagttctgccacactatgccttatctgtggatgagactcctctaacgttgtgcagtttatagttgtgccactgacatgtaggccataccaaagtgagacccacatgtccgtggcacaactgcagattgcacaaagtcagtgatctgtttcccttatccgcgtatgcactatcaggacctttacaatgatacgccgtagcattcagcctgagccgcatacgtcgacaatttctgagaaatcgaagccatgtttgtagccgggcccaccaaaacaaagtccacgcttccaactgaagcaacgcgttcttgggcaatatcgaagccgcgtgcggttgggagaaggggtggcaggcgtgttgtggggcgagtggcttctccctcgttcccaggcgcacgccccgacctccgcatcctagattcgccctcaccgtcaccctcgcctgtgcccttgccctcgcgctcacactccagatctttgttcaagttcaccaccaaaacaaagaaaaaaaaagaggtttatagtcgaagcgctaacaatttggacgtcgcctgtgatgctcaacagctgagctcagatgatttcactgtcatatgaacgtaagtcacaacaaacggggatcattttagttagtgtaacaggtagctagtgtgtcatccattaaatcatttagtaatttccccacgaaagaaaagaagcagggcatcctgtttcaccgcactacagagcaacgagatggatcgttactgtatcttcccctgcaaatgcatcgcgattagcagcaaacgacacggaaggttgtctgaactaaactgagactcgaggcaggcttgacttgacctgctcgagtttgattaaactaagaacaggcaacccccacatgctcgaccgtcagcaacttgcgtcgtccacagcaacgggtgctgcaagaagaaatttctgctcgatgccataaattcataatctaaggcaggtctttagaaaagaagtcttcggcaaaatgttcagatagaataataattaagatcagcaaattggattttctcaatgaaattggcacttgatcaattagtaggatttagatgtgtgaactaatatgtcggggcgtgtggacctgattgacttgcataattgtgtctaccactgaaattgcgagggggttttcacgggcatcactaagaaagtaagaaagtatagtggaggaacagtggacgtggactgactgttatttgaaatggttgactgaccagcagtagaccaacagtctcttctgggaataaacattccacttgtttcttttttacgtgtctgctgctctggcgatagagatgcgtcccttttttttttccaaagaaactctagaattcgggtgactccaccaggattaattaactacataattggaatgcatacatcatatgttagagaaattatatggaagccacacgcacgtatctcaaacacatagtacatcatatgtttgaaaagatatattagtttgtgcattgtttcatgttttatgctttttgttgagagaatgttttgtgctctctattgagaaaggttgattatgctatttattggaaggatacagtaataattgaccgtagtttccttgaaacaaaatctgaaatttgttccattatctaaaaaaatcactttaaccagggcagtgccgtcaaatttggaggccctatacaagggtctaagtaaggcataaatcaagtaccaaatatagctaaaataatatatatattgtaaagcaaatgtgatatatcaagaatagtatattttttaactcttgttttgcataataaaaaaatgtcaaactgaaaacggagaatgttcgttgctgttgctagcttgctgcctagtgccttgcttgttggttgcttgctaagttgctattcgctggttgaatgaaaatataaaattggatgagttggctggcggcctggtgctcggaggagacgagacgtcgagactcgagacgaactgaataagtcacagatacgaaaaaaaagagaatacaaaacgccgtggggcctcagggctcagagttgataatacgaagcgccacgcacgcgaagtcgccgcgcggagacatgcgcggactcgaacggggttctgacgctctcacctcacacgaatacatgggccttcttcggttggactgatttttctgaggccctgaaaatttggaggctctgtacggtcgcacgggccgcacgcccatgtgcacggccctgactttaacacaaattcgcacactgggtggaccaggaggtgattccaccaagccactcttcatgtccactcctctcatctgtgctagtcgggtgccttcctttttgctttctctaccaactacctcccacgcacattaacagcgcgaatctagatgtagaagggccaaagtcagggatgggggcagctgcggtggcacctagacaaacggatctgatgtgtcatcaacggcttcactgtgatggctttgacggtgaaggaatgtggctatcgattgtttcagtgacgggatggctttggttgcatcagctaagatgatgagcggttgggatggttttgacaccatcgagctagttttggcagcttctgctatagcgtcgattgcacggcggtccaaacccctcctctcgtggcgcgcattcggtccgaattagtgcggtcgatggctgtctccgtggagctcatcatctctcctcaacggtctatctgttgtcggcatgtgaatgctccttgccacaacgtctttatcactggtcatcttggacccagtatattttagatgtgtgcctattgatcttctcacgatgttatccttgtaaaggtggtgtgacgttatccttataaaggtggtgtgtccaacgaaggttatagcttcgggtgttcattctagctatgcaaagaccgataaccgaaagtgattttaattagttggatcaccttttaatgtaattatttaaaatcaataaaactttatttatcataaaaaagatatatgagctaacaataaatccacgatcttactaatcctacttaaaatgcattaacatgcgattgtaagagctaggatttaattttctttttaacaataaaaaaaaaaggcaaagtcatacgatcataacggtgctatcaataaagttaaaaaatacatcaataaccactcgactatcgtggttatcagagctggtccacattggaatctcaataaatcgatcgagtttaaaaaaagtaaaaattaaaactttgtcaaaatttattcgaattttatcgcttttcgtccacaaaccaaccaggcgtccagtgaaactgttgatgggctatagccgatttgcaattgcattatcaaactctggataccaactccaatgctcagtcataagcatataattaacatggtgttaggctgttagcgcacgcagggacggatctacagtgttagcatcggtgtcagacgacaccgatgactttcggcaaaacctacagttaaactgcttatccatatattataacacactaatataagtataattagcatgctatgacaccgatagacatattataacaccagtgaatcaattttctagatccgtcgctaagcgcccgagagacacgctaaccagtcttctcttcggagaagacgcaagctcatagagcctcatatggaagagaactttgttgaagcgtccagccgcccacagtttctctcgagaggtttttgtcatatcaattttttgaccgaccttgaccgacgactagtcagtagtagtagtcagtagtcactcatatcgttgtcgtcgctcatcgttgggtggcaacgcaacacgcgattttgcaggtgcgcgtcgtgtgggggggacctgtggttagttggtgcgggtggttgcccgagtcattttgtgtgcttgccttgggtcggaaaatgttgctctctctatctgtggacgggcgtagggcacctggtggctgtgtttgctactagggatgaaaacggatcgaatacggtcggaaacaagctctatcatattcattttcatattttttttctcggaatcgaaatcggaatcggaaacccggatacgaaaacggaatcgaatattatcgaatacagatacagagcgaatacgaatcgaaacgaatacggtaacgaataattatcaaaatattaagacccctcaaaataagcttattaaatcgaggaagagatgtagccattagttttcaacaacaaaatatcagtattttcaaattttatctctatttataagggcaagggggagatagaaaatgttgtgtttacttttcatacaaatttatgttatcatgaaacaaataattaatgtgcctcactgaaattttcataggcacattgaaatttttgaaaattggttgaatattttaaattttgggttgaacatttcaattgaaagtttttaaaaatttgagtggttatttttcagaattgaattttttatttgtttgtatgtggaccacttaaggacccacatggaaaaatcaatttttccatataaaggtgacttaagaagccgtatgcaaaaataaaatttgagaatttgaaactagtttatctcactcatatgaactctaaattggatgattttctttctaaatgtttctaaaatcatgccctatcatgttattgtgttcttactgctattattttggccatttttttcttgtgactttgttttatcaattaaaaatttgaattttaaaacttcaaataatattttgaagctgtaattaattgcagctaaaaaagttgtgaacataaaagttgtagatctcatcaagacatacaacttttattttggtcatttcttcatccgataaagtgataataatattgttcacaaagtttacatatctctattgtagtttatagaaccagatgagatagatgtaaattttgtgaacaaaggtactatcactttgtcggatgacgaaacgatcaaaataaaagttatagatcttgatgagttatactattttgttgttgataacttttcagttaaaatcatttagtattgcaaaatgttgtttgaagttgttatattttgagattcaaattcaaccggttcaaacaaagtcatatagaaaaatgaccaaaacaaaagttgtatatgttgatgtgttatacaactttgtttttgacaattttttcatttgaaatcattaactacccgaaaaattatttgaatttcttatattttaaaattcaaattttatatagttgaatcaaactcggaaggagaaatgaccaaaagaaaaatggtagatctcaataagttatacaattttgtttttgacaactttttcatttgagttgatttagttccttaaaattcgttttaaagagccacatataaaaaagaaatcgatttttacattgaaaaaaatccaccattttttcccaaccttatctactcttgactcttcctctcctctctctcacagactcacactttctactctatctccctctcacttccctcatccacagcggcacggggcggggcaggcggcgaccggcggctggccgagagcggcgcaacgcgtggcgggcggcagcggcgggcaggctcgcgcagtgggcttgagcggcgggcggcgacgggcgaaggcagcgggctcgactgccgcgacggcttcggtgggcgtcgacggcgtcggtgggtggcagcggcagggggatccggcggcgccgccgccggatctggccagtccctccgccttttggccggagtgctggcggcggcaccgtggggcggcgcatgtggagtggctcggtcggtggtggggagggccgctgcggcgcgaggcggcggagtccggcgcgtgcgtgggtggcggccggtgcacgcgtggcggcgcggagactggcggtgggcggcgcggatctggcaccggccgggggtgggcggcgcgaagctggcgcggccaactagggtttcggttttttttggctgaaaaatatcccttttgctagcatgtaaactaccggatatccgataaaaattccggatagtttccgaccgttttccgattccgtcggatatcacccttactgtattcgttttcgtatccgagaaaaaaatccgaattcgtttccgaattcgagaagttccggatagttccgaccgaatttttccgaatctgaaaattggtccggacggacgaaaattatccgaaccagtttcatccctatttgctacagaatgctagagcgtgcggtcccgcggaacaggtgcgtgccgtgccgcgggggctgaatccacgggaaacctaggctcgcgtactccgttcgcatgcaggcctcgtgtgtggactttgccttctcgttagtttgggccgagcagcaagcatgtcacgggcgttcttctagaattttggtaattcctaataccagaaatcttcaccctcgaatgttcaaaaccgtgcaatcaaggtcccatggcagtatatatgggtggtttcactgatgtggcatccttatcagcaatctgggcccacatgtaagtaaaaaaatcatatgtggtctgcatcccttctttccaccattttcttctttttaattttttttctcttctctttttgttattctctttgtcggcatgccacggagggggagcgacgagcggccagagcagacgggcaagtgcgcggcggccggcagagcggagcggcgcggcggcgggcgagcacgtggccagcagagcgaagcggcatcggtgggcgagtagaacgacggcggcgagcgaccggagcaggctgaggaggagatcgacccgtccactccgctccacgtgttctggaggaaaagttgaatttaggtccctataatataagtcaaaatctacttcgtatcctcaacagcaaaaccaggtatatcaatccctccaactattgttacatatcataaggtattttagatttgtaataattaagtcaattttgtttatgtttgacaaagtttattagaaaaacatagcaacatgtaaaacactaaattagtttcattaattccaccgctgaatatattatcatagtatattgttttgtgttagaaatgctgcttaggaaaaattaaaacactttacaatatgaaacatgagttagttaaaagaaatatgaaacatgagtaattataatagttataaatagagtgaaagtacttgaaagtttgaaccaaatggtatatattttatatgcttagtgcaattgtatattattatttgaaaatgcttagtttaactttctaaaatcaaaatactacctctattttaatgtaggacgcttttcgacggactatgcgtgcctaaggtatttgtagagtttggggaacgttggaactaaggtgtatgcgagatcgtatctagcagacaaggaacaagggtttatactgatttggggcttcaagataaataacaaccctacttcagtttataagtatatatctgaggaaacgtatcacacggattacaatgaaggagcaaagtggctaatctgatctacagactagaatccaccaagcaccgctcggcacaatcttatcggtcactaggcttcaacttccttcagatggtctctcgatgcggctttggctgtggcttgtaatttgatgtcttcaccttcacgggggtttgtatttatagcgatgaacaccttttctccaagtagcactcgaaaaacttgattggagatggaccaaggaggccttttttttaataggactctcacactttctatcccaagaaaataatttctttccagatttactgtattttattaattaattataccttctggtatatcattaagtatgtgatactcctatatattacgaaaccaactataggatgtatgccttattttaacactgacaacactagttattgaattttggaatttacatttgatcattcgtctgattaaaaaactattgatttattttatcattaaagagactagactcgtatttttttgcatatttgcattaactttttaataggataaatgattaaacgtcatttgataaaacttaacaacatcttatgtttaaaaacctaggatggcatacatcttatttaaaaaggtagtggagggagtatatatttcctaaattacattgtcggtaacctatttgcgaagtagcaacagtactgcttactatacaccgactaaaataacccaacacgtgcaagctacttgattgcgaccatacagcacgagcacgagcatctccatgatcgccgatcaaacctccaagctatcatgtaaggagtaccaacaggacactaaatatagtttatataaacttcacattatcaagaaaatagtgctttctccgtttcacaatttaagtcattctagcatttcccgtattcatattgatgtgaatgaatctggacatatatatctatgtagattcattaacattaatatgaatgtggaaaatgctagaatgacttacattgtgaaacggaggaagtatacactactctttcaaggtaaacatcactttttcatacttaaatttaatgctactttatctcacatgatgttttcgatgttgtgtatgtctcatgtaacatctggttttcttttctttacttatttattcacttggtacatcatctttcatttgaggtgacagtttatttaatactatagatatcatcttagtcattgtgatatgactggcctagtaccacgaagcaacggacaaaaacgacggtgagtatattttctcatctaaaaattacacatgtttagtttttttaaccgagttgttcactacatcaatgccagctcgacattttatgttcacaaatcacaaatggccagctctctttaatttgcatccaacgtgtagctcgatcatgttaattaagcgactttagcaagatcacttagaaccagcattaccggcaacaataatggagctacccccatggccctcattactggtcattgtgctcacagcagtcgtcttcttcctcgccaccattctctgccatggccgacgcgtgtataggctcccgctagggccaaagccatggccgatcatcggcaacctcaacctcattggcgcgctgccacaccgctccatccacgagctctccaagcgctacggcccgctcattcagctccggttcggatcatgcagggaggaggaacggcgccggcaaagaagaacgacgccgaagagggtggggcttcggccatcaatggcggatgagaaacgggcggcataaacggcgattaagagctctattgaaggggaaaacatagggaagataaagagggggaagaggaaaaccgattttcgcattcaattggaggagaaaacgcttgtggaggggtatcgacatgacggcggcgctagtttcttcggccgggagaggaacgggcggcggctggaggaagactgtagcgcccgttccgtcgtggcgcctagcgggaaaattatctcttaaaaaccctaattgcgaaatttgtttctttgcttgttgtctagcgtccgtgccatctcaagatctcaaatcctcgatctatcgtcgagatcaattccgaatccaaatccttccaaatcaaattcctccgcaaaagtctattttgcctcccccgggttcgatgggccgaatctctctcggcccatctcctcctccctcccgggcgctctctctctctccccctccctcttccgctctgcccgcgcgccgcgcgcgcgtgcgcgagcgccgcgccgagcgcccctccctcgctctgcccgcgcgtgcgcgagagccgcgtggtcgccgcccggccccgctgccctgccgcgcctgcagccgcgcagccgctcggccccgcgagccagcgcgcgtgcccgagccgcgccgctcgaaccaccgcgtcgcccgttgcttcccgcgcgcgcgtgccgtggtggccgaccgcctggtcgccgccgccgtcagcctctgccgcgcctgcccgcgcctgccgcccgtgtcgtcgcgccgctccaaaccaccccgccgtcatcgccgacgtcatagcccggcccccgccactccgcgcgcaagccgccaagggacggaggcagagccctcctccctctgccgcgacgcccccgctcccctcctccttttcccaaagaagaaaggggcgagccccctttctctccctccttttccccttttttctcccgccggcgtcatcctccctctgccctgtcgccgtttggacgcgagcgccgagcgccagctcgcgccttgaccgcccaagtcggttccaaaccgacattgccgcccttaaagccccgggcgccctccccctcttcgcctccacgacattgccaccgcctcccgtgctctgttcgccgtcgccgttcgtcgttgcgcgtgtcggaggagccggcacgagcaaggacgcggaaggggactccaggcgcgccctctccttcctcttccccggcccgaggccggagagattactcccgcgccgtcggcctctcgtcgttgcgcccgccctcacggtagtgcatctccccgttctccctcctcgttccatctcctccccttagactcgggtagtagcacgagtagcctccccgtagctagccggcgccgccccgaccgttgccgtcgctcgccgtgtactcgccgccgtcgccgcccgagctccgtagcacccgctcgtcaccggcctcgctcggcgtagctccgcccaatccgacgctagcaacggattcccgtagccgcgtagatgctctcaccaccgggaattggcctctcgtgacctcgtcgccgtttcccccttctcccgccgccggttgccgccgccgcgattcgccgccgtcaagctccctccggcgaatccgagccgttggctcgtctcccctcgtctcgtgcaaccacccggtgtgctcgctttcgcctgtatcgccgtggttcgctccgccgctcgccgctgtcgtccgccatccgttccggccggtgtcgtcgtctacctcccgccggcccgcgtggcagccacgtaggcgccacgtcggcgccagctcggccaagaccgggtcgagccgaccccggtcagcccctccccgtgcgcgcgttccaccgtgagccgtgaggctgcgcgtgggcccgccgcatccgcgtccaccgcgaaccgcgcgcgtgcaccgcgtccctccctcgcccgcgcgcgtgcgccgcgtgctcgctccgcacggtgaaccgtgtcaccgacaagcgggtcccacccgggaccacgcgtggtgagcccggtccaccggctctctctctcctcccctcccgcgcgcgcgcgccttgggccgccttgggccggccggcccatttagctcggccggaccgccccatttctctcgggccgcgccctagccgcccgaggaaagtctattttccctccctcttttcttttcttttcttttctttttcaaaaaggatttaattaaatccttttcctttagaccaaaaatccaataaacttagaaattcaatatcttcccaaccgtaaatccgtttgactccgttcaacttccaaaattcctcaaatcccgagatctatctaatggctcgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgatacgatcgcacttaatctgtttatcccgtctgcaaggcagattggcggacctacctagtttgttgcatttgatccttcctttgttaattgttataccatgttcccttgtaaccacccagttgcgcctcggaaatcatgaactctgtgcgagtaccgacggtcgccttcaaacttaaaatctgagtaacttcttgggtaaaacttgggttttacaaaagacttggaaaacccgacacctgggtcggtgcttgcgaactaaatggattttccaaaaccgcggaccggggaacgtaccgggtgtacggtttcccgctcttgcacctaaggaccgtttccttggaattttatccgaacataagacaagtacgaccacatgggtggaatgggacacccctggctgagtaactagcttatcagggaagccttgatgccgagagacatgtggattcgccggggtggtgtcggggaggacccctgggctttctggcacagtatggtctgggacctaacctgttgttggtctgggacccctctcgtcggcatatggtaaacctgtgtcggctttggaaatgccttgtcacgaaagcttggaggtctcccgacgtggctgatccccacgggctgggtgatccgggttagtaatgtcgtgtgggtaaagtgtacccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacatactctgaccggacgagacgcactgtctcatccgtgtcgtttgagaagcactcacttagttgtttttagaaaagagttcaaataaaatcaattgcaaaaaaaacaacagcctttctttgaagcctgcattaaacacttatttcccatggcttgctgagtactcccatactcacccttgctctatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagaccactgttgctatgataatccgtcttcctgtgataccagcactgtttcctgggactggtatcgattaacaggttaatttggagcgtcacgggctagttccggtcggtactagttcggggcgtgacaaagacgatgacggcgccttcctgggccggctgggccgcgcccgagcaagggagggggagcagatgggggctcggccgaagtggctgcagcccaagggacagagggaagaagaggctggccgaggagggaaggaaaaaagcggaaaggctagttagcgcgccggcggcgcgcgttttaggccaagaaggcccagcgccggcgcgcgccccctcctgcacgctctttttttttcctttttttcctttttttccctcactttttgtctgattttttttatccttttagcatgttttgagtttgaaagtttttaaattttgagttgaaaattttcaaatctggatttgaaagttttcaaatctcgatttgaaaattttcaaatttttcaaatctggatttgaaagttttcgaatctcgagttaaaagtttttaaatctcgagttgaaagttttcaatttttttcaaatctggacttgaaagtttttgaatctcgattctcgagttgaaagttttcaaatctcaagttgaaagttttcaaatctggatttgaaagttttcgaatctcgagttgaaagttttcaaatctcgagttgaaagttttcaaatctcaaattgaaagttttcaatttttttcaaatctagacttgaaagtttttgaatctcgattctcgagttgaaagttttcaaatctcaagttgaaagttttcaaatcttagttgaaagtttttaaaatttgactttaaaatttaaaacttaaatcgaaagttttcaaatctaactccaaaaaaatttccagaatattttcttaattactatcattagtgttaagtatattaactaatatatgtaattaagactaaaagggagttcgccaggtccttttgcggcgcgcacgcgcgcgctagcaatccctgggaaaaggaggcctgagaagaggggaaggggacctcagcggcaggtcgaggaaggaaaaatggccttaggatcggaagcgacccaaggataaagagagatttatttttagatttttcattttaattaactctaaatttggtttttgttgttttaaaattatttccggtgctttgaaaattcaagtaaaaaatttagggacccatttagagcatggaggatttcataaaaatactccaagccactttcgaatttttcttgtacatattttagtgcttgagatttcttttagacttttaataatttatattactcattttagaaagtgatttttaacttgggatgaatttatcaggatatgaaaatgttactcctgaaggtgaattctctattgtcatctctattttgactgtttcatgaagtatgaagtatgtacgactatcgttagacgaactctagtccctccgctctaaaaataaattaacataatacgagatataattagatttgtttattttaaagcagatgaagtataatttatcaacagtagtcacacatacttaataattcgtgaatatcccatagtatattagtttattttataacggaagatactatatattagtttattttggtacggacataacagggtagatagatacatagatagatagatagaaatagtcacgcttgctacatgtgagggagattgaagagtggacgtggactgaccgtttgaaacggttgattgacaagaaatagtctcttcttggctttatatctcgtggtgttaggataatgtcgtatttttatattagattggtttgtttgggatagagagagtaggggtagatagatagatataattaagtcacacctgctatagttttttaaacactgtttgaaacaattgactgaccagcaatagtttatttctgtctttgttcctaaaataaagggatgtaatatagcttaacactataaatctagatgaagagatgtccagatttacagtatatgatatgccaagtcctaccacggatggaatagatatctgttgctcgggtgatagagatagatgtctgtcctttttcttttggcaagaacaaactttaagtcgggtgactccgttaggatttattaacagcataaatggcattgcatattttgtatactaatgatgtcccgcgttttgttgcggacggatatatattagatgttggaaaaataatgaaatgatttggattgaaatattataaaaatgatttgagaatgatgatttagcatgtgtatgtttagtttcagaatgaaattaaataaatagtagatataactattatatgcttgtatgttgtgttttgtgtactaatgggttgatgtgacatacttgtatgtaggtttttaggagtgataataaatactatgcttgcatgttgagctttaagtgtttagtgggtattagctttatatagaaagaaggaatgacacatttgatatttttaatcagtctgacaattttaagattttttttcaaatagactagataaacattttttttcctttttaccgaattggacgtagactcgtttgatgcatgtcaactataaagtcataaaaaaatctttaaaaatggaaatatagattaaattgtgatatttcgatctataaatttgatttatacaggtagaaaaaaaatcttaatttgatttatatttgtaatttgtgtttctattgtgtgtatgtcgaatttgaatttgtatgtcatatattgatctatcttattaaattgtttaaaattttttgatagccttgtacggggtcgtggctagaaattgaagacccctgtgtgaaacgcataattagaacccgccctcctaagatttaaaagtacggcgtacaacaaaaacaacgaagatggtgtcttgtatgtaatgtaagtaaaaggaagagttgaagagataaataccaatagaaacaaaatgtagggcctttcttttttttttttacttgtgaagtatgttgtcttttttctctattagtttgctttcataattaatactaattagtactaatggatttgggccctaatttggggcactaaactggtgcgtagctcaatgttccggtcaacggccctaccttctacctcataattaatagtatatgcctgcagtactgtgtatgaactggggctgtatttagattaggggtgaaaagttttaattagtcacattaaatatatatagacatacatttaaagtattaaacatagactaataacaaaacaaattacagaatccgtctgcaaaatactagacaaatttattaaggcaaactaatctgtcagtagcaaatgtttactgtagcaccacattgtcaaatcatgtagcaattaggtttaaaaagtttgtctcgcaatttacacgtaatatgtgtaattagttatttttttatatttaatacttcatgcaaatgtccaatcattcaatgtgacggggtgaaattttttatcattggatctaaacaggcccggatatatatcttaatcttgtccagtccatcgtatatgactgtgggatggatgaactctgctactgctaccagccgtagcagatgcactgatcgagcattctagcgagtcatccatgcactcacattactgtatgtatatgcacatatcaatgtgatatcactaggattgccatttcgatgttaaaaaaatatatttcaatttgaatttgaatttaaattctatgtattgtaagatgaaatagaggagaaaaagaaatagaggttgttgttggagttagaaccatttttagagtctcgaggaaagggggacagcccccattcagggtttatcttatcatttgggccggggttaccgtcaccccgcaatagcgcgataaccgcgataatcacctaaaatcgcacaaaaattacatccaaaaattcgaattcaaaacttggcggtttcgcggtttcaccacgataatcgtacagtttcccgtgataacctcgatattcgcacggttatcgcgagctgtgtgtagctaaaatcatgtaaatgaaaaataaatatggaaaaaaaaatcaaaaatacggttgaatatgtgtagaaaactagaaattgagaataattggaagaatacgtagaatacttaaggcctaatattgtcttcctttttccaatttataaactattttcggtttttccctcaaatttgaatttagctttctctatttcaaaaaatttcttcactattagcaattacaaatcaagaaccacatccatgattttttttttcatttttttttgatttttttccggaattttgaatttggtcaaaattcatccaaactatatcgccggttttccctatcgtaccccatgataagcgcgataaccgcaataatcgtgcgattatcacgcgataagtgaaaccctggccccttttaacctttaggaactttaaaaggagctattgctgaagatgctctcaaagaggaggggttagggcccctcatatctggcacacaaaacgaagcacatattattaattaactattagctaaaaattttaaaaaataaattaatataattttaaagtaacttttctatatatttttttaaaacaaaatacaccgtttaacaatttaaaaacattcgcgtgaaaaatgagagtgaagtcgataactttagacataagaccacagccaaactgcctagtcaatttgcgatcgcattaccaaactggctacctaactccaatagtgctcaatcatgagcatataacacatggtgttagcgctgtagagcacgagactcacactaatcaatctgacgacatggagagggaacttaggtagcaaactcacaattgaacatgatcgatgcacatcaacagtgtgtacccatactaatttaatggaaataaggtttctaaacataaaaatgaaataataaaacatcttcctagactaagtgaagatatctcccccatccaattaatatcctcgcaatactacatgcgcagtactgctcactcacatgtgggtagtcattgagcagtcttgcagacgacttgtatccctccccatgaagcttttcccgtttatgtggctttgctcctatttgttatattgaataagtgctatgcacctaggtcattcaccaagaattaaaagcacataaaagtatggcactccagagggtgactagctggttcaggagcttgactgacataatgccgctagttgaaaggtttaggtcttgtatcaaagtgtcacgctcgaaggcctgcttcaaagatttcttctttctcctcctgggcgcgtacacagttggtgccagatactccctccgtttcgaaatgt

SEQ ID NO: 64049 - DNA, 4193 bp, Oryza sativa
atagtctacgtgactagccaccatttaatcatacaagaggtttattttttttgagtgccgaatccaaaccgtgagcaagcctgctatgtggtcgcagatgttttgacaaaacaaaaaagttagcaagctaataagtggctagctcacttatagattcataattttaatggagagtgcaaaactatgttaaaagtggtctactacgttcgagagatgtatggctatgaaaattaatcatttttgtgatggaagcaaaggtgagttgagtcagtgatggatggatgggtggtggtgggtcccgggtgcctgtgatgtgggcaacaacctagtaccgatcccattgagcccaatgcaagtgggcccccaccacccagactttcacgagctatagtcacagtcttcgtctacctctgctgatcagcttgctgctccaatcaaaccgcccaaccaatctcttgctccattgctgctgctgttcttgcagatgttgctttgctactagtatgaagtatctctgttcagagttcaggctagtagtgacaaagaattaaggcagctgcctgaatctgaatatatatattgatttatcgtctgaactaatgttcgtgacgacgatggcgtacaattaatggcaattgattaattaattaatccatgttgcgaaaaatgaagaactggtcctgcatagtaaatgatctgtagctcatagttttcattggtgtacatgtaatcgatcgcacactcctattcctagctaattcatgtcggatcgatcgttcgatcatttcactgatcaccaatggcgatcgacatggatagtacaagtgctgtattttacactgttcgatcttagggagaaaataaaaagggacaaagacatgtgcaatattattgtacgtatatgtacgcatggatgtgatgttagatttgttctatgtttcatggatgatgcagtgacagttgatatgcacatttatatgtttcatggagtatgttctattttttgcatgttcttctgttgttgtttttgtgtatgcgtttacgaaagaactatagtaatacatatcacttagatactatccttctataataattgagacaacaagagctcttaaccattaatacattaaaataatatttttattacttttattttcttttcttcactcctactatacaataaaatttctttaataaatactaggagttactttgagccggtgtgtagcaatgatgtttctttttttctccatcaccaaatttacttacttacatagtaacatatagagcttgtaaatcaataaacaatgtgggacatgtctctttggtgtgtgactccatcgtttgattgatagtggggtggggtaaatttattgtcaactactataaacttagagcaagttttatagtggaggtgaatatcacctctaatttaaaacatatcatctactcattaattaagaggtgacaagtataacatatcgcatctaactcaaaaatttcaatattagttcactctcacaccactttacacttttcttaaagattaagcgaaggttgctccttgaatgaggggtgactgattttctctcctatattttatcacctaattctatatatatgataaatttagaggtaacgtgtagaggtttatagtgcttgctcttagttcttcagtttgctttttgtgtgattggttgaggactagtttttgtacgcatgtcggcatgtgtaaccgtgtgtgactggatcgattgcgggtacatgggtaaattaattgccaactactataaaattagttgaattgtacgttttgtatacctgggtaacggccatacattttgatccagctgctagccacatcataccaattaattacatgtttggtggatccaatgttgactattcaaacttgatactgtgagtaatgtgacctgtacttggtacctaattagccttaaagatttattattgtcagtatatatatgacaacgaccaatggtacccaaaatgtggtagcaaacgacaatagtacaatattattagtgttaatccataaacattctatccttttccaagttttttcaaggacctcggtgcaatttctttatctttcctgggttgcacttataaacctaggagtagtagtgcagtcgagatcctagtacttcatccattccaatttaatcatcacccatgcatatcggtagaaatcaataatacatctatcctttttcttaatatgctaaatcaattgttcttttttctttgtgggggctaaatcaattgttcaatttgattgctaaatcaaaatcgattttgctatacatgtgtcaccacattttatcattggaattggttgaatttttggtcggtttatccgcattgagatttgttcctggatctccacgtcttgactactaccacggagtagcttttgctccctatctagttccacatataaaagggcttgttcagataattcccataaaaaaatcgagaaaattaggaccatatataatccactccaaatcagcttgattgatggattatcccaaacaagaccttataagtaaccttccgatcccttcttcgtggtaaccaaaggactttctagctattttcacattatttttcgttgaagttacatcctataaacaattgtaactttttggtcaactgtagtttttcttttcaatatatgtaacttttgttttaattattcaatgcaaaggtactccgtattgtttttagtcatttttacagtcttttttttattgaagttgcatactatataagattgtagcttttgttgtttcagtgtttttagtcatttctacagtctctttgtattgaagttacatactaccccctccgtcatattttaaatataatgcaaccataattttccgtgcctaactttgattgtccattttatttgaaatttttttataatagtatttttattgttatgagatgataaaacatgaataggactttatgcgtgacttatgtttcaaaaaaattcaaatcattttcaaataagactgacgatcaaaattgtacatggaaaatcatggctgcacttaaaatgggatggatggagtatataagattgtagcatatgtatgatctgatatttttttagtgttgtcaaagttgctagttatttgttagcgatctttttgagagagaaaatatatatcaactaatatatactccttcataaaaaagttaagcttattttattttctggttttttaaatgagatatacatatttataatcactagtcccggccaagcatctaagacttgaaaaaatggcttgtcttttagttttgtagtgctaaattaaattgttgaccgaaacctaagctggcatttaatactaattgatttcttgtatgcatatagttacttggtttttgttacatgtaggatgagttaatttctccttggttttgataatctctactattataaaaattaaagatgtttccgcggtccatcatccgtgtttgagttggttataaaaattgaaaatgtttccgcggttcgtaatccgtgtttgagtcagttttaattttatgttttggttttaatctatatctcttctctatctctactattataaaaattgaagatgtttggtacgtcatccatgtatgagtcggtttttaagttcgtttgcttttacatatctgtatttgagtcaatttttaagatcgtttacttttggtaatacagaaggaatcatataagaaatatgtttaaaaaactcacatgctaacttgagacgatcagactcctaactgcatctcatgattttctgaaaatatatatatccaagcgaactcccacaatgaatttcatcttaactaaaccatataacaataataagattaaaatagacttcacccgttgcaacgcacgtccatttttttctagtaaaagaaaaaaaaagagatctcccttagcctgtgttgtttaggcccaataaatattggcccagttggtgtcgcactccgtatgaaagcccacataagattcggcccattaaggctcaatagggagtaaaaggggaggcaaaggttgaagaagaagtgaggccggagagctcggagaagggcccgacgaagcgcaggtggggatcacctcgccggcgatggcgcggaggaggggaagcgcggcg

SEQ ID NO: 64050 - DNA, 624 bp, Oryza sativa
gaaaccatactttttacaggatttttgcatggcacaatagcggtagcgtcgatgaggcgacggtgtggtcgacctcatgcgcgacactagaacactgtcacaccctgaagttctctccccaagcctaaattgaatttataaatcaccttgagaaaatatcggtgtcaaagcaagagaaaccctaataaattaatgcaaataataatcggaattggtgtgtgggatttttcttgagttctacatgtcgaaatatgctaacaagatttttagtggaattttcagagctctagaaataattttaaccaattaaaattgagcacaagcaatatttaattccctggaaattcttttcctcctttttctttctttttccctcctttttcttttcaggatgggccgccggcccattctctcttcccccccattccatccgctgggccggccgacaggtcgcagcccagctgagccggcacccctcctctcactcccggggtcgccgacaggtggggcccacctgtcgggtccgtccccaacctccagtcacccgcaccgcgcccgcaaccggcaccgtgtccacaccccgactccaccgggccacgttggccacgcctgcgcatgcgcccg

SEQ ID NO: 64051 - DNA, 5272 bp, Oryza sativa
  unsure (1)..(5272): unsure at all n locations
atcggcgggaggtgggggaaggaccctacaggtggggcccacctgtcggtggctcgggggaaaggagagaggcggagtcggttggggggagacgatgacaggtggggcctcgggtccacctgtcgtcgaggggaggagggaggaggctgggggttatgtggacttggaggagggggagcctagctgggccggcccacgcgaataaaggaggtaagtaggcaagggaagggagaatgggccgagcccaaagacaaagaggggattttaattgtttttctttttattttaattgatgcaatgatctttgtgctattaaaactatttatcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaatgatttttaatcccgaacgaaaatcggggcgttacaaatctaccccccttacaggaatctcgtcccgagattctgggatggctagaaagaaagccggtgctggtcggcggtctgactgatctgcacattgaactaccacattctgcttcaaactgattgattgactggttgatcaaacctgcacgattgaactggctggattcgacctttctgttcctttgctttgcgaaaactggaccgactggttctgcatgaactgacctagactaggactgcggatgctcctgaaacttacttatcttggactgaactgttgaggttggcaattttggtaacctgagaattcaccacgctggctataagaggatgaaaatggaatctggcatttgtaaatcatttaccctatgtccgcttggattggtcccaactcaaatgacaagtaattccaggaaaacctgcttgacctgtctttcgtctgaactgcaaccatcctcgatgctacttctctaagctgaactgttgacctggcctcacgggtgtacattagaatcgaacctgtcgacctgagattggggtgactctgctaatggttcgcaactgactcctttaattacgaaccaatttgctgcactgggttgaacctacaactgaaacggcaacgaggttagccaaaactcatctgtgagacctaccccccttacagggagtagtcttactttcgcctgactgggaacaattgaactgttgtccttcaaatatagccaacacttctctgatttaccaagagccctgactttgaaaactgaaaacttcatcggtccatcaaattgaagcaatggcgatgcactttcaccccgacaagatttggaacttaacccttagttgatgataggaaattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcatacatcttccatggatagttggacactttgcaaaaactgcgcttgaaagccataaccacaataggtagcatatattactcctgggattggtggtggcttagctgtgctgatatgctgaggacttggtggcgtactatctgaggttgcgggtgcttcctctttgaaaacaaactgactgtcgctctgatcctgattccggcttgcatctgagcttgtacttgttgttggagacactgttgttgcatctgttgcatcggactttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatctgttgtgagtacacttttattgttcaagttgcttaagcaaacaacctagtatggtcgcatccccaccaatgatgcaaaccatacccctgcacacaagcaaacaacacacgatctagaagctaacgaaactactcttcagggaaggattgggtttaggtcatctccgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagactgggaggagaattttgaaaaactgtttgacaaagaattgccgaagggcgagaggagacaatttgcaaatagggttttcagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaaaggggaatgatagcaaggctgagtacaaccaccgtactcagcaagccacaccaacgatgcagacgtgcaaggggatacaaggacggtttgtggctatttgcataaaggcggttgtaaaacattttattgagcaaaacagcaaaactgttgagtaattaaagtaatattgaatctccactgatcaacgctacaccacgttgaacaggcccaaccaacccacctgtactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtctttaattgccatgggtgcgactcgcaaaaccatgcacccacagcccaccattcagtcgcattttagttggataattacgaccatgaaacatggccagatgtctcgagcacgcggctcaacaagatactagaaaggtctaaaactgtaattatcccatcaactgagctagtggtaattaagcatggctaagcatatagttctagctaggtcacataagtaacacaagctagtcgattcattacccaaggttgacaaagaatagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattatttacgaattattgcgcaattattatttatttttacaaaggaaaaggactgccgctgacgtcagcaaagggccggcgccgacaggcgggccccacacgtcagcgagtcaaagggggagggcgctggtacacgggcccactcggcagcggctcaaggggggggcacggctggcaagcgggccccacggctccggcttcacgagccgatgtaccggccaggcccggtatcaagccggccggccggccatggtaaggcggcggcgcgggcatgcgaccgccaccgacggcgagcgncggcgcggtcggcggacgtcggcgcgatcgtctacgaccgaaagcgacagcgagcgcgcgaagagggcggcggcgcacggggaaaaaaaaagaagggaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaacccccacggcgaccatccacgccggccggagtcggaggggagagagaactcaccgacgacgcgagggaaatggggtttcggtggtattccggcgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcggaaaacgagagaggagggcatggggagcattttataggcggagggggaggcggacgtggccgggaggcgctccgatttcgccggcgacgtgggggaggagagagagaaggtgggggggaagattcaaaatcgaatcccgcccctctcgtgcgctggcgcggccgggagacgcggtgagagggcggccactggcgtgggcgcggcaacttggcgtgggcgcggggaaagcgg

SEQ ID NO: 64052 - DNA, 33643 bp, Oryza sativa
ccggggaggtagtgcgccacccgggagcagacagcttggaaatggatcgtctccaccgccggcgacatcgtcggctgaaaggagaagctcgaggtgaggtggtcgtctcgcccatttctacatgtaccttgtcccctcccaggaaaaggccgtgcaagttaatgccgtcatttctctctttcggttgcttaattcgtgtaggatccgttcctggtacttggaggattgaacagagtaatttagtgatcaatttgtgatgatgatcgtgcaggtgcgttcagtttggaaacctctctgaagatccatgccatcagtttgcatcctggtgcttccattgaacaccaacttagttatgttttcgccaattgtggatgtaattccattttcaatgtcagtgagttagctatatgcttgatagggtaggtatgtcaaatttatagtttaagtaattcattttctattgattgctctttcacagtaaagagttgcgagccagagtttctgatatcttcttgaacttgtctttaaaagctatcgacatatcgggcgtttcgatggtggtgagtaaatttgatcattggactctttggtactgaggcagctgattgtatcacttacatttaatatctgagaatggattttaacgaccaatatatatagttttcacttctcagtttgcaagatattaactctgctgtggttaatctctgggagaatatcttggttgtagttttgaaaaattaaatcgttggtatcctatccatctagagtggagggtaatgtaaagatggcaacctcatttggcaggtcattgatggactgaaatgtttcatggaccttaatcttccattacagacgacattcttagcggaagttcctcttgccaaatccttgactggggttctcaaaatctgtggtcaggtgctgcctgaatttctttaaaatttacaatcctcgtagcaggattggcttttacttgttaactgtcatattataacatcactcatgctcttcttgtcaccaagcagatttgtcactgctgtaagttttgactgttttgtgttccttttcatctaattctcatgtgtcttcattaatgatacacttttcgttggagtagttcttaacttcttgttttgaaaatgcagttaagtactttgcctgtaagaagttatactcaatgcatccaatgttgtcagacgaagaagttacagtaacaaggtgcagactgctaaagtcaccgacttctatgattgtgatccagcaaatcctggacagccctttgcaccattcctctttttcaagcgaagcaaaaaaaggtacacaacacacagtgaatcagtgacagatctctgtatctttaaagtgcatgaacatgtctaaggagtaacttctttttatgcactcctttttggtacgatcctcttcatcttgctctcttctcccattccgtgcatttcaaacacatcaatagattcttgtgctgctgagctgatggcaataagaaagaaaagcttctctgcttcagcatctttcttcatcaagtgttcgtcctaggctcctagtaatcactgtaaagagccttttggactggagctagatggctagatgctgaacaatcaatcacaaaatggaaggtcatggtgtgttgggaccatgatcagcaaatggcatgttgatacatcacgaaagctaagttttgcatgtacagcttggtgtgtcatatcaatctatgatcacctctgcttgctgctttaagcctctcttcttttgtaataggcaacctgtgattttgttctctcctatgattcctctgaagttaagtctcagtggcaagcaattccagcattttgcagacaatgatccaaacaaaaaattaaaattcctacttatcttcatgaagcttccatgcacaagcttgttgtgtattactatcacctctgattgctgctttaagtctcttcttttgcaggcaacctgtgatttcgttcaatcctacgattcctctgatgttaaatctcagtggcatgaaattcgattgcgttttgcagacaatgatccaagcaaagatattccttctcatctccatcttcggagacgaataaacatggacacttgatgcagaagcctgtcttggagaaacatctctgatggatggacgaggcaattcagcagagcccttctttgtcatgactaccatatctgtctctctgcacaactcagatcttctccacaggtaactaaaatagttaagagcacatgattaagcatgcattaaactagtcaagtaccctccttttggcagcaagctcgatcgagcttatcgtaatccctgtgcaaaggtagttcaggccaaaaacagatacattgattaattgggttagcacaagtattaaatttgcaagttgacacttaaagaggggcgatgatgcatcgcatctcttgcaagcttgcctccatggccatccaagcctgtcagcgtcactgattatactaattaagcatgcagtgtaatcatgctttcatgctccatttgttttgttgtttgtgttgattgattggtgtgcgagagtcctattttttcatgaaaaactttgtgcccgctccttttccttcgatttggagatcggccaagttcgcctttttattatgaggcgtggagaatgtcgtgttaaaaaatactgtatgcaaggacatagggcagaggaatacctgcttataaaatacggcttatgaaaagagtagcctatcagtttgtcagattaattatggaattgtgcctgtggttacgtcgaatgccaggtaaatgaacttaatagtctaatcttaagttgaaattgtaaaactataatataatcaatcctaaaaattgtgtacacgactacatgagaatatgatatcaatcaataacctatgtacacaaataatgtatacatttattacaaaataattaacagaggcctatatatatttacaaataaatgatactccattcgttccaagctaaccaactaagatggagggagagtgtatgatcacccgcaagtccggccttatcaaatggtaattttatcatcttaagaaattattaggacgtatcatattttgtagaagaaattttatggtccttgaaaaaatacctcgaggtatctaaattttacactaaatttattggtaccttgaggtacttaagtaatagtgtaaaatttggtacctccagatactaagtacctcgagatatcaaaaattttagtgaaaaaatttagatacctcaacgtaatttctcaattaccgtaaaatttctttatcaaagagtacagatttctgatacatttgcgtattaattaagcattctgctagctagctagctatagtgtgctatggtttcaacacaagatctatgaaagctctgatatcctcaaagaaagggagaagctaataattaactagctaaatcttttatctcatccaattgcagtatggtttatgggcgtacatatggccatgcacgaggataaacgttaacgtccctctctcggcatgctaaatttagcttttgcccataaccttttatatacatgtatatactccctccgtactaataaaagaagtcgtttaggacagcgactcagtctccaaaacacaactttaacttcttatttctatatttattaaaaagtgatatatgtatatttttatgaaaatattttttaagacaaatctattcatataatttttacattttcaaactcaacaacttaagagttattcatgatttatatttctaaagtttgacttaaacattgtcctaaacgacttcttttacgagtacggagggagtactatatactacatatatgtggttaataatatctgcagttttattgtcactaactcgatcgatcaccatcagcttgatcaccatatatgattgttctacagaaaaggtgatcagcttggtcaccataattgtactagaaaattagattggaggggtcccaggcaatgcacgcacgcacgagttcttgctacttttagtttgtgaacgcatcaaactcaccccgttgattagcggtagctagattgcaatgtgatactgtgattaatctgtccttaatttgcaaatactgttggcatgcactagctaattaagctgtcagcaatatatagcatctgtaaagagaagatgcatgcacatggtaattaagttgcatcacagtactagttttcatggcttagtaataattagcacttgctgtgtacatccactttgaatgtaggggttggtttaatataaaccattacctaaaaaaataaagtaattaacacgtggaatgcgtgtggatgccgatcgactcatcgatcaatattgttcttgagcagattaagccaaatcaaatacgtatataggagtatgaagataggatagtatgtgtacgctgtacctaggagacttctaattaaaggaagaatctagactctgaaagtattggtctgacaaatacagcattacttggtgaccaaagctaatgtaatttaaaaacaaatcggtcgagtgatctatgcatgcatcaacaattccaccaacctgcaaaatggaattaaactgaactctcttcgtcacaaaataaaccaacttttaggatttaaaatttattccaaaataaattaacttctaccttgttacctaccatcattccgtaaatcaacaagttttatctcttcaatactccacacctacccactcattaattaggggcattttggtcatttgctatttccttgtatctatcttaggaagctaaggttggacatagaatgggacagagggagtaactctgtaaggatggtttattaagtggtgatgtgtgtactgctctgctactgcatatgtcaaaaaggttgcgcgtgatcgtgtgaggtaggtctaaaaaaaatatcataaacccttttagatctcattcgtacgtcatgctcaccgagatcgtaaccaaccatatgatcgattgatatttacttttcggactatatatataacatcatatttgtattaataaatacaactaatgttttgcagtactaattataaatcttatactgtaaatttgaaaagttaatactccctccgtcctaaaatataagcatttttagtgtgtgtctgattcatagttaaaagtggctatattttgggacgaaggtagtaggtgtagtttttttataatacatactacataagagaattatgataaaaaaaaaatttattacctacttaaaaaataagggagaggtagcagtgtcataggagtattagtgacaaaaatcaagaaaacaaaatatgacaccgtatctttgaagttgaactgtgaactttctggtcgatcgaagttgtgcgtaattggaatgtgatgagaaatatatatacatagtgcattccagactagccagctgaaaatgatagggcaagctcagcacttacaatgagcacaagatggtatgtatacattacatcctcatccattaactaagggtgtgtttgaggagtaggagattagagtgattgggaagatagctcatgattaattgagtattaactattttaaatttcaaaaatggattaatatgattttttaaagcaactttcctatagaatttttttgcaaaaaatacatcgtttagtagtttgaaaaacgtgcgcgcgaaaaacgagactcaatctcccctatctcgccagaacgaacatagcctaaatattcctcgcaggccggtttacattcaagtgacatctcacgatccatatactccgtactcgtaaaggaagtcatttaggacagcgacacggtatccaaaacataatttgacttcttttttctataaaaatatttattaaaaagtgatatatgtatacttttatgaagtatttttcaagacaaatctattcatataatttttatattttcaaactcaataacttaagagttattcatgatttatattctcaaagtttgacttaaacattgtcctaaactacttttttttatgagtatggagggagtatattataaatcagtacgtagttaagtttgttgattaatttcacctatataaatttcatggatcgagctggggtgcatgacgtaagcgtgaatgacaccaagtgatgcaaatttctgttgttaattcaaggtgtgtgtttagttcctgaaaaaagttggaagtttgggaaaagttgaaagtttggaaaaaaagttaaaagtttatgtgtgtagaaaagttttagatgtgatatgatgtgatggaaagttgaaagtttggggtagttgggggtgaattaaacacggcctcagtcgatcaagctggtcacggcactatgcttgcggaagaggattctctaacttacttccctctgactttaagtcactgatatgtactccctccgtcctacaatataagggattttaagtttttgcttgcaacgtttgaccactcatcttatttaaattttttttgcgaatataaaaaatgaaaagttgtgcttaaagtactgtagataataaagtaagtcacaagtaaaataattaataatttcaaaaacttttgaataagacgagtggtcaaacgttccaagcaaaaactcaaaatcccttatattatgggacggagggagtatggttcactggatagagggtccacacgttagtgacacaagtttctcttatattataggacggagggagtagagttcgctggatagagggtctacatgtcagtgacacaagttagaggaaggtaagttagaggatcttagtcccatgcttgcatgtacgtactcaattcaactccatccatttcatttcaattaattacatcagcatttcaattactcctaaccagcatgcatgcatgcgcgccctgttggatacggaaaaacggcgtgggtatccatgcttgactgccgcgtaagcacagatgcatgcatgccaacgtacgtgacgtcgctaacgtgtgcccaattaatcccagagatcgctatacacacacgcgcgcgtataatatccaactgcatgcacacttgcagaattttcgtcgagatatgatatatatacgccatccatgacgtactgaggcccgttcgaatccagttataaaatgagaaaaaagaataattggcacacataattaattaaattttccctgcaaaaataattttcaattatttaaaagttgaaaacttgatttgtctaatactagcaactttaatatatataaataattttttttgcaggaaatacacctaatagcagtttaaaaaacatgcaaacaaaaagcgagataaatttttttctccctccatcccattttaagtgtaaccatgatttttcgtgtccaaatttgatgtcttatctaaaagattttttaaaaaaatttaaaaacataagtcatgcataaattactattcatgttttattatctaatagcaataaaaatactaattataaaaaaatttcaaataagacgaacgattaaagttaggcacagaaacttacggttgtacttaaaatattttaagactgtccccaagagaagcaacctaggaggggaacaatgaatctgtaccaagagttgtctagatttattggggttgtctttttttatttttacagacataggattgtctagattcattggggttgtctttttttttttaaaggcagaggaagtatatctaatcagacctaacttaatccattgatgatacgcgcacctctcatctctcgatcggcgcctgtgcccctacgtctctgtcaccgcacgaacgaacgatcatcgactagactgatgcaaacccatgcatgcgcggatgcgccgccgtcgtcgtcgtcagtgtgctgtgctcctactacactgtagatggaagaacagtgtagtaggaaccatgcccatgcatgcagtgatatgatgcaggccatgagctattgagctactactagctagctatgtgatgggaacagtcgctagcaaggctactacattcgacagtgcaggggcagcatgcaacagctacagcagccgccgttgactcgtattcgtgctccctccgttactaaatatttgacaccgttgactttttaaacacatatttaaccgttcgtcttattcaaaacgtttaagtaattattaattctttttctattatttaatttattgttaaatatacttatatgtatacaaataattttacatattttataaaatcttttgaataagacgaacggtcaaatatgtgctaaaaagtcaacgatgtcaaatatttagaaacggagggagtatatatgaacaggacaagttcatatatatggaactgtgagaaggaagaagaggaaagggtggcgccatgatggatcaggatcgacttcacgagcccacgctgccgatggatgagatgattgctcaaatggttataaaaaagttaaaaataattgagaaaatgtattaacattagatatatcattttcacaaacatgcaaagttaaatttcacttttacgtgttatataaaagataaatttaactataaatatacgttaactagctatagtttcatttgttttatttttacaacttgtaaaagttgaacgaaaggagcaggtttacattatcggttgaccactaaattttgagcctcatcagtatcacggttttcaataaatttcaactgaatatactgtttaaccttcgaaatctcaatcgaaacttaattccgagccatgtcgaaacatcgaaattttacggaattcgaccggttttcgtcggaattgtgaacagggagtatcttactcacatgctccggtttgattttcctcgtggatttatcctcttctcccgtcgccatctccctcgtcacggcgcgcgtgccggccggatgaagggttggtttggtttgtggcctaaatagaccttaccaaattttgtcaatgcccaaattttgataagttttggcatgactaattttggtatggcaaagttgtgtttggattgaagccaaaacagcctaagttcactattaaaatggcctattttcttagacatactaaaatttggcttcaaaccaaatagacactaaacactattgaaattgtcaaatattggtaagcctaatttaagcctcaaaccaaaccagcccgaagtcttcagtcttcacgcacgctgcacacatgccactacctccaccactccactgtagatagtggccatggcgccaatgatgcagccaagcagagctctgaatgcgtatgcatgcagaagcagcagctgcaaatgaacagagcatgcgtagccgctgctactgtctgtgtgtgtctactattccctcagttataaaacaaatactactccctcccttatagtatgaaggattttaaatagatgagacaatttctgtacaaattcattgtacttatagtaattaagtgtcatatccattgaaaatcttttataatttgagatggagcgagtacttgacatttggcaatggccattggctggccaatacggattggcagattattgcagatcagagagatgggtgggtgtgtagacttggcggcttccttccttccatcaaacgtgctgctgctagcttgggcgtgggtcccacttcgccagctgttactgtgtgggccccgttcctgccctagctctgcaagctcaagctgccgagctggctgccacgtccactccacagatgcagatgcagcagctctgatgatctcatgaatctgctacctgctgctcatcatcagttctgtgcaactgtgttgaaaaacgaaacacaaacagtttttgggacaaggaaatgttggaagttgcgtcgggggagggtctgatgatcaattcaatctctcctccgccgaagaacaaaacaaacaaatccaatattagatgcaaggagaacgacctgcgagttcacttaaaggttaaatagatgataacccatgaattttcgcgtcgtggcctaacttatcagatctagatatacaaatgggtcaatttataaacttatttatagatcaaattaataggtaacctgcaagtcaaatccgttgattcgcggataagcccgctcgcacccctaggaggagggtctaatgatcaatccaatctccgctgaagaacaaaacaaacaagttatagtattctctgctctcgtctctgaattccaccaacttcatttgctcaaatccaaagcgtcaacatatacaagcacattaagggcccctttgaatcggatgattgctataggatttttgaagcattcagtttcctaaggaattttttctatggaactctttaatttataagaaagaataggattgtatttctattgcgcaatttcatagaaaaataaacaagaggtctaacatcttagaaattttcttttgattcattgtttcctatggtgatattaaagggatcctcttcatatttactcggttttctattcctgtaggattatggaaatatgtcacttcaattcttatgtttttcctattgttgtgtactattcttcatttcaaaggggccctaaaataaaagtaaaattgatactacaatttacatggattggctgggttcatattgccagcagattttccagtgtgcaatgagcagccagaaaatgattaataacgtaagcaattaagggcttaattactttattgtaagaaaaacattaccaatatttggtaataccaaaatttggcattaccgaattttgataaagtaaggtaaattttagttgaaattttgtgagtggaaagttccggaattaccaaaatttgaaaggattgtgttggtaatggtatgtttaatttgctaccttacaaaatattgataataccaaaatttaaaaatgttgacaaagtgaataagctctaagttcggttaataggctgacaaaggatccatttttttctatttcctcatgctatttcttgttgcaaaataccaatcaatatattcagctcgttgtgttggcgacttggcgcaaatgttgtacccgtgaaaatggggctagtgtcagcgcattatctctcacaagagttctatttttctggattagacgaaaacacaagtagtaatattatgcaacaatcaactattgcgttccctttgccttgtctccgacatatatatccatttcatacagcatccctttatcaccaatgtccaatatgcttttcttttcacacacacagtagttcagatgacccacaaaccaaatttacgattgtttcaagagttgaaattctgctagtagaaaattatcactaattaaatagccatgtttagttggtttttagactagacctaactcaggccaaccgcaaaaactttgcgttttgaccaacacggtagtggcagttaccgtagcatgaactaggtgtagtttgtttggcacctttgagcctctgtttgttttggaaaaaaaagttttattagcagcttaaaaataatttataggtaaaacttttcttttttttgaggattaaaaaaaagaagaaaagttaatattctaatcgatttaaaagttaatatatattggaaaatagagtatgattaaataccctcaaaatcaactctaaaaataagtttcaaaatttaaattttgaccgcatgcagctgataagccaaaaggcaaacgacagcgttgtttgttgccgcgagaaaggactggaattctaatggaatttctagcttgtgaatttcttatccctaggtttctttgcccccatattttggtgattggagaaattaagggcccctttgatttggaggaaaaacataggaattttagagaattttaatcctatagaaaaatttcctatgaagccatttgaaataaaggattgaatcatattcaatcctttgaaattcctatggaatggacaatcctataaaaattttggaggaaatttagcaagagcttcaacctcttgctaactttcctttgagtctatctctctcatccaagtcctgtgtttttcatgtggttcaatcaaacggtcattcctgtgttttgcaatccgctgttttacacttacattcctatcaaaatcctacgtttttcctatttctacgttttctcaattctgcgattaaaaggggccctaaaggattgataatttttacatatatatatatatatatatatatatatatatatatatatatacattaactaatcttaaatctacccgtgttttgtatgcatgcggccgatccttataaaattaacaataatcctgccctgtctggccacttcctgtgtactgtacatgtaacatgtgtttttcagttcactgtgtgtatcaaacaacggcaagttgcaacgaaagcaagccacttcgcccgattataaatagcctccactacttctactactcgccgccacccaaacccaaagcagcaattgcaagaagcaaaatctcttctcctcctcctcctcctcctcatcatcatcctcctctcgcccttcgacaacgcaccatagtttaacccaagctagaagaagaagacgatagatatgagcactactcgcggcgtctcctcctcttctgctgctgctgctcttgcgctgcttctcctcttcgccctctgcttcttctccttccacttcgccgcagctgctcgcgccgttcctcgtgatgaacaccaaggtagctagctacagcacttggattattgattgttcaattgatagtgtatgcaaattagctgacgttttggagcttttcttttcagagaatggcggtgtcaaggcagtagcagcagttgcagctgatcagcttgtgctccagctggaaggtgacaccggcaatggcgacgaggtctccgaggtgagaatcgatggaaatatacagagctataaatcttcgagtacctagctgattagacaagaattgatgaagaagcaattagtggtaactaatcttgattgttaatttatttctatcttgttcttggtcagttgatgggagcagctgaggaggaagcagcagcatgcgaggaggggaagaacaacgacgagtgcgtgcagaggaggctgctcagcgacgcccacctcgactacatctacacgcagcacaagaacaagccttgatcgatcgatccatccatccaactacacgctgaaatccaaagctaatacaaggaagatcgagatcgagataaattaaccaactctatatgcatatctatctatccatctacctctgcatgctgttttcactgcatcgatcgctactgttctgcagtgccaatcactgtccgtttctgtacaatctgtgatactactagctagtagcagtacatggcatcgttttccttcaagtgttcgttggcttttacttagtccggtgagtgcttgtgggttatttctgacgagggagtgtgatcagtacgcgtactaatggtattttggtttgtcatggcatgatgaaattaagctgtggtagcaatataatgcatatatatattacctttgtctcatgtccttagtatgtagtagtggtaaatagtacatagcatgaataatatacttatcaaggaacacttgtgttttgtttaatggcgcatgtctgtcttcctgtctgtaaaaaagtgtagtacttaatttcttcgttttttaatgaccgaccaacgttaagccgagctatacaaacttggacagttcttctttcaacaatgtttttacaaatggctggaactttaccggagcaaaaaaattctgacaaataaattaacatcaatttcaacgtacaatataaagcaaacaaaagatgttatcaatcagggtttatctctaccaccttaaaagcggattcatcgtcctcctcaacatcgtaatcccgcacgtaaaaaaaacagtttcccaaaaaaacaccccacccaaagatcaatattttcacacaaaaatttaaaaggaatggatagaaaaagaacaaaaccctataattccagtgccattgcaacgtacgggcatgacacttgtaaatactaaaatgcgaataaaatataacgaaacctcaacattttctcgacactaatagttctcccaagagaaacttaatcctttttttttttaaaaaaaactaccagtccaggatcctactaagatcgattgatcagtcactctctgtcagtctgtctacagtgcccaagtcatgggcaattttgtatcaagtctttgttccagattccacatcatggtcatcagaagtcaacaccgtggatgcagctagctgctatacagaggctttgataaatctcatctgaccagcaaaaggggaacacacgaagattctccccacatgcgttggcatgcaatgattcagtcacactgctaacatagctacctatctctatctatctatccccatgacattgcaaattattgtactatgtatcgatcgagcaatttgtggttagctttttcacaaagatgctgtggtagatgcgaaagatgtcgtcgagttggagcctcgaaccagcagtcaaaaattcagaccgaggtgatcacaaagctcattagtatctgagtatctaggtatgtgtgagctaaggtcgtaggttacacatacacacgtactgtctgatcataatctgatctaatcgtcgaaatataaaattgactatcttttcttatcactttaagtttttgttgaactaattgttgcatacaactcaatactgaactttgattgctgaccatgcacgatgtcttgtttggaaaaacatcggaacttcttttagtatcatatagctctagaatctagaaaataaactaaaagttagatgctacaaaacacagttcttcttggttctcaccggtgggctactcaccatctattttttaggatctttagctcgctaaacagggactgagcttaatttgatatagtagaaagtgaactgcacgcccgtgcactagtgtatgtttgggttaagctgagtggccaatagtgatcagctccattatatatatctgaatctgatgactagtgaactagtgataaatcactagtgtgagtagtcagtgacgacatacatatgatagaatcttagttgggcatgcatatgttgctgctgttgtgctgttgtctgaagatatgagtatatatagtagccgtagtgtggtgtagtgcgcgcgagtggggttttaattggttaaaagcatgttggttgctggtagctaggtgtcaggttccctcactagttgattacatgattcatggctttttcgaaatgcatgatttttaaaacacatgaacaaaaggaaatacatatataactaaaatactataacatctcaaattttatggattgaaaaaaatgaataacaataatatgaatgaccatttaaatagggcataggaaaaaaaacgatggaatcagaagttggagaaagattttcccaaatcttaataaacttcggctggcttccgccaaccggcgaaaacagaagttggaggaagatacaaagaatttatttccaataggttaaagcacatgtcagaattcctctaaaatatctatattttgggatataattcaaaggaatctcatagtactctaactaaaaaaagacaaactctaactacgaatatagacacacacgtgtccaagtttatagtaagaattgaacttttttttttgtcggaaggggtaggattggacatgtagttaggattggattttttttcggagggagtaggatttttggatagttatttctttgatccaagtgatcatcacataggaaaatcctccaagaatcatttgttcgaagtagccttcatcatcgaagaggaggctagtagtagcagtgtagcacgcacgcatgtaggcgatgtacgctttagttgcttcttttccggcagatgggtgtgtgtgggcgtgcaacagcaagtcagcaacagagggaggtcggccacttcgcaattggagtgaggggccgcacacttttcgcctgcacttgctaagctagtagctgcatgcaaacataatctgtctatcaattcatcagagattcagaatatgtattaagttaaagctattctgttacaggtcgaaaccaataattatttatgaatggagggactaatgtgtgttaattggtgcgatccaagctggtcgatggcttctgcacattttggctggtatgcttgtcttcactctgctggccggtccactgtcagttcagataatgcagggtgttacgctagctaggtcgatttcagttcagataatgcaggcctacctcctcctctttgatttcattgacttcgacgacgaccatacgaattaaaccgtgttaatcacagtggtaaatacttcacctgaaacaatcaaatccatcaagtggcaggttagtactatgcgtttcagacaagagaggcaacagttatactccctgagtgcacaaatatatttgtccataaatataaatataagatgttattttatttgttcataactgtaaaggatttgaaatgttacttatcccatcaatcatattccttttaattttctttgcatcttaccctcaaccattaccattacttatttaatgaggatactgaagtattttctcctcaactttaatatctgctaaacggcctagtggtggagagccagcagcgccatcgagcttggcccaataatagcgtttttcaatagccaactatattttccagacatcgatagcacaatccatagtggagacgcatgtaactgaagagagttatattaatatactccctccgtcccataatataagggattttagagggattcatcatactagaatatgtcacatccctccaaaatcccttatactccctccatttcaaaatatttgacaccattgactttttatcacatgtttgaccgttcgtcttattaaaaaaaattatgaaatatataaaactatatgtgtatatgaaagtatatttaacaataaatcaaatgatatgaaaagaataaataattacttaaattttttgaataagacgaatggtcaaacacatactaaaaagtcaacggtgtcataacattttgaaacgaagggagtattatgggatggagggagtagaaggtctagagtaacacaatctctggtggccgtcctccagggcctgatattacctgagcatctccgcgccagtttcgactccctggtgctcctgatcttttggcagttgtggaagaaatgaaactctagggttttcgactccacgctttcttcagtctcagggttctggagtccatccactcggaggatcatctgtggtctttagctggcattgtcgcttttagagacttgttgggagtgtagcgtggctcgggcccttcctgctgcttggagtttgtgttttagccgtcgtagtttgtttcctaagcttcaagtttttatttttgcttcggtctggttgattgcgttgtgtaactataactattttcttctaatatattcacgtgcaatcattttgcgcatttgagaaaaaaaaacacttcacatgttccaaaatataatcattaatgaaagttttaaaagaaaccaagtttatggtgaaaaataattgtaattggttgaggtaaagagttaaatagagaaattggttgaaatgagatactgtatgaaaaagtgcttatattgtggtataaattttgaatccttaaaatcttatattttgaaatgggtggagtattagtactctaaaaacagaatgcctactccttatgtccaaaaataagttttactcttttatttactctcggttcacaattaaatttataaggtttatctctttagtaacccctacatgtgcacgtgatactattctctccaactcctaaagttgaggagaaaaggggggtttagtgtacctgatttactttaacgatggatggtcaggggacatcaccgagcatgcgtgtatgtgtatggcctattatgtgagggttgattttaaactctacaaaggatgtcccctagttatttgcatgtcacttaaataattatggaaaaaattaagaagatatattaacatgtaatatatcacttcacaaatatacaagttaaaattcaacttttacaagacatgacgcaacatatagaagttaattttatcttccatgtttatggagtgatctagcacatattaaactatcttgttgatttttttaaatgtttttccagtgacgcaaacaacaaagtgactttctctcgagagtttataatgggtgtgtttagttcacgtcaaaattgaaagtttggttgaaattggaacgatgtgacggaaaagttggaagtttatgtgcgtagaaaagttttgatgtgatgaaaaaaattgaaagttcgaaggaaaagtttggaactaaacaaggccaatagtttctcctattctatctgggttatatattatatgggccaaaacaactgcggtactaattgggccttaaattattcgtcatggcaagcccaacacagggtccagcgacggatcgcatcgcgttgcgggatcagagagaagtgcgatgactgtaaaccatcggactcctccgagcggctagtcgatcgtccccgcgcgttttcctgtccgtttccgtgtcggaatttcagagttgagtccgagtccgatacggagtaaaactacttgatcgcctcgatatattgaaacaccaaacccacgcaacgaactcgatcatctgaagtttccttcaattccccgtcgccgctgatctcacgatatgatgatggccgcggcggaggagcagctcgccacgacgccggagatggagatggagatggagtatatcccactcgatggttacaacagccactacgtgcgcgacgacgatccttaccggcgttaccgcgagctccggatgctcgcgccgccggcgaacgagatctccggccgcctcctcgaggcggcggacgaggacgccgccatgtcgtcgtcgctctgggacgatgagttcgagctcaccggcggcgccgacgccgaccgcttcaccccgcccggcccgcgcctcccgcgcccgcccacccaccacctcaacatcttctcttcccggctgcagcgcctcgcgtccacccgcgcgccgccgccgatgccgccgccgatcgacgatggcgacttcggcgtcgtcttcttgacaggcggcgcccggcgccatgtcgccgtggccgccgccagggtggcgccggcggataccagctgcctcgggaagagcaagtacgaggaaccgcgcggcggcggcgagacggcgatgggcggcgcggattcgacggggtgcgtgatctgcatcgcggagttcgaggtgggcgacgagctgagcacgatcccgtgcgcgcacaggcatcggttccacgacaagtgcctcgccgagtggttgaagcgaagccgctcctgcccgctttgccgccatctccttcccgccgtcgttcccgccaatacccgccccaacatccattttctttaaataaattttgtgggctttttgtttcgcgtgtgcatgcctgcatgcatgctgatgtatagttgagatttccattcttctgtaaagagcattgagctaagcaaaggcagtgtaatacttcctccgtctcaaaataagtatagttttacactgtttatgtgtcacgtttaaccgttcatcttatttgtaatttttttatgattaatatttttattgttattagatgataaaacttgaatagtactttatatgtgactaatttattttaattttctcataaatttttcaaataagacggacggtcaaacgttggacacggattctcatggctgcatttatttttggacggaggtagtatgtgttttagcaattgatggaccatttttcttttaatctagagtagctgtaatgataagattctcttattcaaacaagtggcataacaatgttttcagaccctatttagatgggactaaaacttaaacgtagactaattataaaatatcacatcggatgtttggacactaattataaatattaaacgtagactattaataaaaccatccataatcttggactaattcgtgagacgaatctattgagcctaattaattcatgattagcctatatgatgttagagtaaatattctctaattatgaattaattaggcttaaaaaatttgtctcgcaaattagctttcatttatataatttgttttgtaagtagtctatatttaatactctaaattagtgtctaaatatagagactaaaattaagtccatgtattcaaacaccacctcagccttgattttacggcagaattcgagttatgcccgtcttaattccaattaaccgcttatccagtgatagaccacatgtttacagatattaggatgaacatcaaattcccccttataattctttttttttcgcgagaaccctttataattcaaattaatgatgtgactatatataatctattcatcgtataactatctgagaccgccaaatcacttgcgaggtcggtggcaagcatgatgagctttttatgccttccttgacgttgttgcgttgcaccaccatcgcttcccatcaaaagaagtgatcatctatggtcaattttttttagataatgaaagttttatttagactcagataattatatcaagatgatacaatcaaactgagtcacccccggcctctgcataaaatgcacacagccaaaaaagaagataaaaataactagaacatctcccaagcataaaagtttaacagaaacatatatcttagtggctatcaatccttaggctagaccgccacccatgctcctgggtaaaaaactcctgtgccacctggtccaactgtcgagataccaccgtatatcttagtggctatcaatccgtagactagatcgccacccatgctcctgggtaaaaaactcctgtgccacctggtccaaacgtcgagataccaccataatagtatcccgcaatcccggttggtggaggatagcccaggtacgtagccaccgggtaactaaggtgataacctgcaaaaaggagaagacaccatcttcttatcaaaaattactccattcctgcttagccaaatggaccaacacagagctgttgcacccatcaaaagcagattcctcatttctttggggacacatgatagccaactcccaaacatatgaccaacattgtgaggaggttttagattagaagccaaatgaattacagaccacaccaagcgagataagcggcactgaaagaataaatgttggatagtttcatccttgtgacagaaacaacatgtattgctgcctttccaatttctcttagcaaggttgtccttggtgagaattacgccccgacgtaaataccaaagaaagattttaactttttaggggtactttcaccttccaaatctgtctattgatattcggaaccccggtatgtgttagagctagataatgagatttgaccgagaagaccccattcggggtgaggttccagtgaaactcatcttgctcctgtactagaaccaaatcagctatgcgaggcaataggttatgccaagcagctagttttgcaccaattaaatcccgtcgccatgaaaagcacggaggattggtttggaaaatctgtacgatagtcgactgtttatgcctaactatgttatagagacaaggatactgttctcttaacgaggcattccccaaccatttgtcttccaagaacctaacttgggagccgtccctaattttgaaggatccaaaacggaaaaaatcatgtttgaccttcataagactagcccaaaaatgtgaatcccccgctttccaataggcttgagataaaggttgtgatcccaaatatttattgcgtagcagttgttgccatattccatcggtggtaagtagtttgtataaccacttactaatcaacactttattctttatctcgaggtcatgaattcctagccccccattgttctttgggacgacaaataatgtcccacttagcaagccggtatttcttcttatgtccatccccttgccaataaaacctagatcgaaggtaatcaagttttttaagtaccccactaggaattgcaaaggaatgacatcatatacattgggagactactaagtaccgagttaatcaaagtaagtcgtcctcccaacgaaagaagttttcctttccagctactcaatttcttctcaaatctctcgaccacttctttccattccgcatttctcaacttcctataatggatcagaatgcccagataacggaatgggaagttgccgacctggcagccaaagagctggttgtattgatcactataatcaagtgcttcaccaaaacaatacagttcacttttatgaaaattgatcttaagacccgacaactgctcgaaagctagaagcactgacttcatgttctgagctttttcaaggtcatgattcacaaacagcactgtgtcatcagcatattgtagaatggagagtcccccatcaatcaaatgtggtatgactccatcaatttgcccttgtgttttggctctgtttatcaatgtggctagcatatcagcgataaagttgaataggattggggagagagggtctccttgccgaaggccctttttatctgaaaaaaaggcccgacgtcatcattgactttgattgccacgcttcccccggaaatgaaagactcaatccagatatccacttgggcgaaaaacctttcatacgcagagtttgtagcagaaaaggccatttaaccttgtcatacgtcttttcgaagtcaattttgaatatcaccccactcaacttcttcctatgtagttcatgaactgtttcatgtatgatgacaactccatctaaaatgtttcgtccacgcatgaaaactgtttgggtcgggttcactaaatggttagcaaccgagctaattcggtttgtagccaccttagtgaatattttatagctgacatttaacaagcatatgggtctgtattgttggatttgatttgcttctttaacttttggaactagagtaagtaccccaaaatttagtccgaaaattgggaggctaccagtatggaattcattaaaaaggttcatcaggtcatgcttaataacatcccaaaatttttggtaaaattcagctgggaaaccatctagtccaggagctttattatgctccatcgcaaagatggcttctttcacttcttcttccgaaaaaggagcagtaagaaaatcattttcagcttgtgaaacttgagccatatcaccaattatggactcatcaagcgaaaacgagttctcctctggtggtccaaaaagtttcctataaaaactcgtaatataagttttcaaggcctcaaccccctcaattttcccttcatcctggtctaggaaaaagatcctcttcttcctatgtttaccgttggctatcaagttaaactattttgtgttgttatctcctaagagtacgtccgagactttcgagcgttggtaccatttaatctcctcctcacggagtagacttgccaaagaatccctcgattgatcaagaagaattctttcttgatccgaaaggagtcgtacctctactgcgatgtctagagaatcaattgtgttttgcaaatttgcctttttctgcttaaagacgccactggtatgagcagcccaacctctaagatggcgacgtaaagcgctcatcttgttattccatctttggaccgcattacgacccttgactagtttgttccatatctcgagaacacgatcatagaagtcatcacgtagaaaccaacccagttccaatttaaactgtttaatgtttcccgtgaaggccgcttcccctgtgtcaaggagcaaaggcgtgtggtctgatacccctctgtcaagagcatgaaccgaaaccaggggtacttggattcccattcaattgatgtgaggaccctgtctagtttctcataagtaggaatgggaagcgaatttgcccatgtaaattgcctacccgaaagagcgatttctcgtaagtcaaagctatcgatcacaacattgaagagaaaaggccaacgagagttgtaacgggcattgtttttttccacactacttctcaggatgttgaagtccccccctgtaagagtaggtagatgattttgttggcatgtacgaacgaactccgccaagaaactagatttaaaatcatcttgggccggaccatacacagccatcaagatccatttaaaattatcctccctattgttgagatgaaatttaacgaaaaattccccttcaacaattaaagatatatccaaaacagctgcattaattccgagaagtataccccctgatcttcctttaggtgggagacaatgccacatgaaatcagcacccccagagaggcgatctaaattcatctttgacatttcaccctttcttgtctccattaacgcaacatagtctagtatttttctctctaactgtttctgcaacataacggtatttagccaagtctgcaagacctctgctattccaaaaaatacctttcatgaggaaacagatttagaggcttttggattttgggaacgagcctttcgctcttttctttttgaagaagatttggatttttctagtggataccaacaagtcacaaattttgtcactttggtccacatcgtccatatcaatctccgtgagatcctttactaagtgagcgagtagggcaacatcatcgtcgccctcgtcatcactagttgtaaaatgatccacttctgaaaaaacgtgcttagaatggttacattcactagtcttgtttgttgctttagttctatcaacctcaatatgtttcaaagcgttaagcgagaaagaaatttcatcatgagagttacccaaagaaacacctaaagaactaagattggaagcaacaaaatcataatgtaaagaaggtaaagaaggggatgaatttataacagtatcttcactagaggatgttttatgagaggccgagtgctgctaagaattcgttgccgaaacctcccgtccaacaaagctgtcatccaaattgcgcaatgctttcctcttcattgccttgagcagtgagtcatcatcccccgcagcgatgccatccatgttctcaacattggatctcacactacgacaacgaggtgtagaagatgtcttgctcagttggtccttgctgcgattgacatcggttgaggtaggtgtagccatctgaggtacagctagggagagtgcagcagtggtagctgccaaagaggcctcgccggtgatcttggcagctgcagccggctgagaggacagcaaggaccaacgttccaactccggtggcagcaaacaaggttgatcgggtgtaggactgtccactggttgagacaaataaatttcatccaccttttctgctgctgttattacctcacccaccactgttgcacctgatttggtgtgaacaatggtgtaagctatcccatttgcgatcaccagacgaggtggtggtggaggccgacaatttccaaacggtgttagaactagttgcatggctgtaacatctgatttttgttcctttgatattgttggagaagctgaattcttagccctcttgtgtgcctgatcatgagagccatcctttgacgagttttcatgatcctcctgtgcatccccgtcatggtccataaagtccacctccgaaatctgtgccggctaacaaccttcctcttccaaagcaaaagtgattgggtagcccaatttcccaaaaaccacatctgtagtgacagggagttgtatgctacaatgcatacaaaccttcacacgaatcactcccgtccgcctgtaggtgagcatatctacttcctgagtagctccaataacacaaccaagtgcccaaaaagccaagtaatgatgccatgggctaggcacacccgacacatgcacccacacttcatccaactcatatgccggaatcagctcatcagtcgttttccactcgattattgtcattgacacaccatgattttttagacggaattccacatcatccatcctcttcaattcctcaatggaaggaaaagcgacaaggaaggaattctcagcatgaaggactgcctcccacttccaatccggtctgattcgatgagctaactcagtctgaactatttcaggcgtcaaggagccgccacgaatagagaccaaagctgttggaaccaatgaagcctcctgtacattcatcccaaaatcactgatttggataaaaccgaactcggttttcccaaatccaaaaagagagcatgtaggtttcggcaatttgagcagcgggcacttgacagctagatgtgactctttcttgttacatacatagcaatcgatgtccgctttacatacctgcgctatgtgaccactcgttttgcactggtgacagtgaggtggcctcggcttcttggccttagttgcttgtacagtaggatgtggctgcccaccatctgttgtttggtccagtttctccgtttgctggccttgcgccgccatccccttcccccgaggtttgggcttctgatcttgctggtccggacacgggagatcatcatggtctcgcctgtgatgacccccagcattgtttccctgaggaaaccatctgttgctattgcattgagactgcccggcgcctccatgccaacgccctcccgatcccccagtcccagacccaccggcatggttgcccccgaacctcgggaaaaccggtggccgctaaaactggcgcggaggatagtggtttggcccgtgctgatttcttgcattgaaaggtggattccctgtggctccatcatcccgtcgctgctcggccgtcgctgcatcatcacgagggcgcgccgccatcgctgcctaggagggtttcttcggagaactctcgctagatggcgtgcatctgtttaggcgaaagtgggctagggactttccacgaaattggtttccaatcggtctgtgtgggaaggaaggaataccgacactcataactgaattctggggaagggaattagccaaaaatcgtcctcccgcactttgatcgactcggtttgatgcggacaccatcgattgccgatcttgggtaggtgttgattttgaatttggtgaagttttggcccgcggcaagaaatctgccagcaaaactgtttgcactggccgtggacgaggtaatggtaccttccatggacgcattacccatccacggcgatggcactcagtggattttgtcttctgttttgatgagactctggtccactgatcgtcctcggtgataggtggggcagtcggagtcacccctgacactatcgggcttttttgttcccaccaacgagaagcaggagtgggaaaaccaatctcgtcccagaacccttggattagggagagatcggactctcctgattgagagtcatgcgttttcagtcctataacctccatgccggcgagagccgttgagccgttgtgatgaacttgagcgggagaatcaggagcagaagttgtggcagccatggttgcaatcagattctgtccacaaacgtggtcttgattgcagccggctgaattaacgatctctccttcctaaatgacgtcagttaggctggagaagcgagatccacttaccggcgaaggaattggtgctagggttagccgacgtcggtgggagtcatggcgccgtccatagaccttcagacttcctgcacagagatcagcacctgcatcctaggtaggaaaattaccttgctcttgtcctgaggaagaagaagccgccaccgaaggagatgcactcatcgccggcagtgaggaagaacctcaggggagcctccaatggaccattgatccgtttttggagcaaggacacagcgccggcgagggaaggatacagctccactcccggccgtcggcctgaagaacgctgtttactagactgaagaatgtcggacttgaaacattggcccgattcctggttccggaggtgttgacagaaaacacgaggcctgggagatctgcttaactctagtgcaggtccaaaactcgccttcggatgtatgagcgtgccagttgatttgatcctgcaatcaacaagaaacaaagacaaagaaaccgtggttaaatccacaaatgatagccaatcggctagatgccgatgacatatcatttgtctttgagccgatgtcatatgtagatcgatcggcaaccatgaataagtaaagaagaactagatctactcgatcggctgtagacattaacaatatataatctttatgtcgatatattcttaaatcaggtgattgggatagatcggtcaccatgccgagacagtataaatcatttagatcgaaagatatattaacaacaagattatatatgttcatagcatagccgatcagataaatttagcgtgtattggctaatactccgatacgactttatattaagatgctagggcaagtaaaatatactagacagaagcctaatatacttaaatgtaacaagatcttaacctaaaggacggatttaacatatcaattaagcatataagataaaagtaattaaatcagataagatcggctgaaactccgatactactctaatcggcaaccagtaggcaggctagagattgaaattctaaacacgacttaatagatcaaactcaactgatgtagcattaagtatgaaaagaagaacaatatctagacaatcaagccgctggatgtttcataaagtggtggatatcttatataatctaagccaacgtcgttatttaacctaatcggctgccttctggtaacagatattagccgattgcaggttagatgacgatactgtcaaagattatgtaagatatatgataactcgacgaattacataaacaagactagagtatcataaagatggaagcactaatcttgagaacgcaagccgccataacaagttttacctcttgttgaagatcgaaaccgatgcagctcaacccgaaagcaagaactcgtcgaaataaaactaaaggaaaaagggtggcgatgcgccgaaattgtattgaacgtgtgtgttaatcattacatagagctcggggcctatttatacccgagaattacaagatatgcccataccggacacgactgttatctctaacaaactctaagatatcacaagtctttacggcagacttttgcccacacttatctataaggaatttacataaaatatcctaattaatagatacaattgccttcccaggactctatccgtgcgtggcaatcatcttgacgcacatcaactcgaacccgatgtcgtacacagatcgtattgtcggaatcagctgtatcacctaacccggtctaactcggacttagccaatcccaatcgtagccgatcctgactccagccgatccttactctgtttccataacaatcctcatcttcgattctgcctcgaccccatcttcatctccgatgctgatattaccaaatttggtcgttaacaagaggaggactccagtggctggatggccagcgccagaaacagggccgccacaggcaagccaaggaggccggcgtcaccgccggcgaagccccgacagccgccccccatgagatcgcccagaaatcgcccctccacaaaacccggaattcaaaatgtgaatccaattccgcgcgcgctgcgactacgccacgctatccttatttagatcgaaaattgagcattgcaacttgttaggttatctaagatcaccgacttatagattcgacatgaaaatcctcaattaccatcctactgacataaaagtcaccaacccaatcatatctaccccctccgtctcaaaataaattaacttttgaaattcaaactttgtcccaaaacaaatcaacttctaccttctcatccaccctcggttcgcaaaatcgaaaaattttattccttcaataccccttacctacctattcaccaatactaatttgctatttataatggatattttggtcctttattctcttatttaattttgcattgagaaactcggagttgcctctttatgagacggagggagtatttggtaaaatttggcccctccaactttgaatatcctctaaatgcaacagccctactctcccatagtcccataccgcaaaaagagagaagtctaaataaacgtccaaaaacacggaatttttttattaaaatatttaaaaatatattttttctttcgaaaattaacaaatctaatcgcctaccgccctttgggagggcgatttttaaaaacctaaatgcaaaatttttatttgtgtttaaaccctttccaccggttttaattgcttaaaaactaataatgcttattcgatactccaaatgattttaaatggaaaagtgataaactacaaagttatagatctcatcaagatctacaacttttatataaagtttatctccattcaatgtcgtttgaaatgtagatctgagattttttaaaatgtgttttatattttgtaatgaatatttggatatctaaaacatcttaaataaaaaagttgttaactacaaagttgtagatctccttgagatctacaattttgatataaagttttatttcatctgactttatataatataattttaaattataaaattatagagctaacaagttgtgctgaaaaatttgcatttaggtgccttgccgccctctggaagggcaaagggcggcaggcgattagatttgtaaattttcgaatcaaaaaattatttttgtaaatattttaataaaaatgtataaataaaaaaattccaaaaacacgttggattagattcgggccaacccaccttgaacataccaaaccacatagggccagcccaccttgaacataccaaaccacatatttcggcttgggcccagtttccatagaatttttttcggttttagatttttttaatatttacagaaataatctatcgaccaaaaaaattgcagaaatagcccctgccgcccacctctggggcagcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaagaagagaggggaggagaagagaagaaggggcaaagccctaccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaattaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatctaggtgtgcagacgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcagtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatataaaggaggcggtaaaacattttgcagtgtcacttcataaagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgtcaatttgccacgcctgcttggtgttatcgaggaaagaaaccctgggagctcttacgaagtgaagaaatttccctcaattgaacatcctggcaagagtgtgctgcaaagggcgtttttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtattggttcctgaaattggttaaaacaaaagttgttggtatgaggccaaatgtatgcctgatacatgataggcacgctggcattctgcgagcgataggagagttgtagtttgggagtgtggaacgaggataccccggtgtttgggaagatgtacagagtaggtggtgcatgcgtcatatgggagctaatttcttcaagcaattcaagaacaaggagctcatgtacatgttcaagaggctgtgcaatcagaaccaggagaaaaaattcaatgagctttggaagagattagatgagttgacagccaaatgcagtgatcagcgtgcagcggcctcatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggagtaatgacaacaaatttggcagaagtttacaactgggtgatgcgcggtgtccgtggactgccactagttggcatagtggagttca

SEQ ID NO: 64053 - DNA, 714 bp, Oryza sativa
cctcgagtccgagctcctgcatcgagcccacccatgtcatcgcccctgcgacaccactaggtcggcatctcacctaccaagctcgggccctagatcagcagccgcctatgcttctcgacaaccgctgtcactgatgccaccggcgccccaccgcacaatagatttctccttgatagtagcgacctctcacctacctcttcctccctccctccagatttgccactatggttgagcttgtgcttgtgactcactcatcgagtagccgagttcgccaccaccgcttcctcgctcctcagttacagtgtgctcgctcacctccgccgtggttcggcagagtaccctctagcctctagagcctatgccttgctccgactacccacaccacgccacgctatagctcgcgtccctcagttcactgcccgctccctccctatcgaatctgaggtgctgatggatggccatggccaacacttgctggagctcttcctccactggcgtctgggacaacagagatagaatggggaatgttgtggagagtggagcttgataggtgcggccaacgagttttttttaaaaaaatttctaggtagatgccacgtagatcgacaagtcaacactatgtactaggtcaatatctacctcatccgaaattgttgtaaaaactgggggtggcaatttccccgttgggtccgaggacccgcccctatggagccg

SEQ ID NO: 64054 - DNA, 3787 bp, Oryza sativa
ttttaaagagcaagcaaggtcacacattccccttgagcatgttgatcccaatttacaaatgttttactgtttgcaaacaaatatgcatgttttgctaattacatggggtcagggttttacctatctgctcgcttgtgccatgtttacttgatatatgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggcggcatgtcggcgcacggaaacgtgtcgtggggctgtgtcttgtgggtacagttgtacacctctggccagagtaaaactattcgaatagccgtgcccgcggttatgggcggtcgaccagattcaccgtgattagtctcacacttaataaatcgacccaatacactgtagtccaggtgggttggttgggcctgttcaacgtggtgtagcgttgatcagtggagatttaatgttactctaattactcaacagttttactgttttgcccaataaaatgttttacaaccgcctttatgcaaatagccacaaaccgtccttgtatccccttgcacgtctgcatcgttggtgtggcttgctgagtacggtggttgtactcagccttgctatcattcccctttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaattgtctcctctcgcccttcggcaattctttgtcaaacagtttttcaaaattctcctcccagtctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttcccggagatgacctaaacccaatccttccctgaagagtagtttcgttagcttctagatcgtgtgttgtttgcttgtgtgcaggggtatggtttgcatcattggtggggatgcgaccatactaggttgtttgcttaagcaacttgaacaataaaagtgtactcacaacagatcagtaggcaagtggtttagtaccttatctttagcaacccctctcttccacctctcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagccggaatcaggatcagagcgacagtcagtttgttttcaaagaggaagcacccgcaacctcagatagtacgccaccaagtcctcagcaaatcagcacagctaagccaccaccaatcccaggagtaatatatgctacctattgtggttatggttttcaagcgcagtttttgcaaagtgtccaactatccatggaagatgtatgacagggcacctctcagagggttgttccacagtaaggcgtcagcgtcatcacatcaagagctttgttagcgacaccccaactcctcgagttgtgtcagttccaatgcagagtcggttagttcagtttttgcaactcgacaccgaagtcaagatagaagcaggacagtcatgccagtagttagaacttatgggaaagttagtcaagagtcagtgtgttcatgagctaaatgagagtcacttttatgtggaatttcctatcatcaactaagggttaagttccaaatcttgtcggggtgaaagtgcatcgccattgcttcaatttgatggaccgatgaagttttcagttttcaaagtcagggctcttggtaaatcagagaagtgttggctatatttgaaggacaacagttcaattgttcccagtcaggcgaaagtaagactactccctgtaaggggggtaggtctcacagatgagttttggctaacctcgttgccgtttcagttgtaggttcaacccagtgcagcaaattggttcgtaattaaaggagtcagttgcgaaccattagcagagtcaccccaatctcaggtcgacaggttcgattctaatgtacacccggggatcctcaagagttcagctgcaggcatgcagcatcgaggatggttgcagttcagacgaaagacaagtcaagcaggttttcctggaattacttgtcatttgagttgggaccaatccaagcggacatagggtaaatgatttacaaatgccagattccattttcatcctcttatagccagcgtggtgaattctcaggttaccaaaattgccaacctcaacagttcagtccaagataagtaagtttcaggagcatccgcagtcctagtctaggtcagttcatgtagaaccagtcggtccagttttcgcaaagcaaaggaacagaaaggtcgaatccagccagttcaatcgtgcaggtttgatcaaccagtcaatcaatcagtttgaagcagaatgtggtagttcaatgtgcagatcagtcagaccgccgaccagcaccggctttctttctagccatcccagaatctcgggacgagattcctgtaaggggggtagatttgtaacgccccgattttcgttcgggattaaaaatcattaataatacattttctagaaattaaataaaagttaaatcaatttatccaagtgaaatgttgggagaattaaaattttcccttaaaaataatggccgggaatattttgtatattttttgtgccctaatgtactctccggaaatttccgtgaattttcggactcgataaatagttttaatagcacaaagatcattgcattaattaaaataaaagaaaacaattaaatccccttttgttttgggctcggccattctccttcccttccctccttcccttcttttttgcgtgggccgg

SEQ ID NO: 64055 - DNA, 719 bp, Oryza sativa
cttgtacttccttgcattaattatgcatctccggtgtggcttgctgagtactgtggttgtactcattcttgctcaatcttttcccccttcagtaagagaagctttggagaagaagtcttacgtggagtcttggcttataccccagttgagcgcctgtgaagatggagccgtaggcccgctagtccgctgctgtttatttttgattgtcaggcctgaagcgcctttgtaataatgtaaatattatcggtataataaagatgtgtcttttatatcatgtttgtgtggtgtaccccggcttttcctgggacggggattaatacactagcgttcgggaaaaggcaattttcccggtcgcgacacgacccaatcccgcctacggccggaacctccgggacaggcaggcaggactgagccccaagcagcagggcaccaaccctctgccacgacatctcgactaccgggccgcagctcgtgtagccttcatttgccctggagaatgttcatcgacccccgacttcatccatccccaatccgtgtacttttgtttataaccagactgagccacaaactaagccttacccactagacatgtggaagtacggtagtgctttgcaacagaggccctaagaccggtccttatatggccgaggtgctactatcaaaaccatgcaccccgagcccagcctgaaaccattttggggattttgaatagaaggagc

SEQ ID NO: 64056 - DNA, 1002 bp, Oryza sativa
gccccctcccccctcacctcctcctccaccgccgcccctccctctccctctctgctccctctcccaaccggcgagcagtgtcgcccacgtcgggcggcctccccacgagcgattctccctctccgtcaacctcccaccggcggcatgtgtcacgaccggaaaaataccttttcccaatcgctagtccattgatccccgtcccaggaaaagtcaggtacacataaaaaatcatgatacaaaagacatctttaaagcgataatatttacatatgcttgattggttactaaacagccaccaagtatgatagcatcaagattggtgtcccttagaattttgttggccgcttgcatggttagccgatgcttccatttataatcattatgggtatcttccttactcactgttacatcctttataggacgcatatgtcctttcatggttaagataggtgtagtcactaggactgaaagtcttgcaacttgttcaatgtctttaaccagagataggctagttgattaacttctctaccaacatctaggtcattaagttcaagttgactatgattcatcataaatgaaactctaaatctgttttggttattatcagttgtagagattgttgtacatttgtatcctcaacatgaatcattcataaacatagcaaactcattctttatatatataaataaactcattctttaggttgatataggatactgagaaactggacccgaatcagccaaggaaggcttatgacaacaatcgacccaacgacggtcatcttgtctataaagaaggagaagttgcaacaaagcaagatggtcatacggaaaagtgtttcagtaaagacaaggattgaaattattagacttgaccgggaagtcaagatgggtaacatgaatagtggtaatccaaagctcgatcgaacttttggcttgtatcagatgctacacagaataaaaacacttgcactagttactgctcaatgtgctttcctcacaa

SEQ ID NO: 64057 - DNA, 607 bp, Oryza sativa
cccttcatttctgttgtggtatgtatatcaatctctacaaacatactattaggtgtagcgtcacaaacattataaaaaagatgccccctttttaactagctagggaaataagatgtgaatgtttaaagaaggggtgatatatatagaagggtaagtcgatatggaggagagccgtattgctttgtgcactgcagtactataggatcactctttaaatctcattatctctagacttcaattatttagtgcggtcagcaatgcgcgcggtggcatcaccaccagagctgcagcaaggagcaaaccggggacaaatgggaggggggatgtagaggaggccagccaggccgggtgccgcaccgagacgttgatgccttttgatgctggcgaggtcgggaggcggcatggtgaggatggatgaggcgggggactgcatagtgtgaattgcaaagggtgctacttcctgcacataaacataaaacaaaacaaaataaatagggaggcgggggactgcatagtgtgacttgcaaagggtgctacttcctgcacatgcataccaatgtcacaaaacataaaacaaaacaaaataaattggaatactgaacgaata

SEQ ID NO: 64058 - DNA, 2674 bp, Oryza sativa
gtaccaaccgggactaaagatcctcggccccctgacatacgtctgacaggggatgaaccgggagtaaagatcatctttagtcccggttggtgttaccaaccgggactaaagatcaaaatttttataaccgggacttaaaaacaatctttactcccggttctttttgaatccgggactattgtgaatttgtcggaccgaccaaagaaggtatctccaccagtgtgggttatcctattttttaaacaaagtttgccgaatagcaaaaattctggcaaataagcttttcactcataattcggtaaaccgtcgtgctcgttagcaatatcatacaccgcgtatgtatgtttgtaaaccatagttattgctgtttcatgacgcctcttattcgtatcatattaagatgtacatacagcgaaattacgtgggcatgatgaagacgtcataattgcatgtaatgcatgaactgtaattagtgtttgtttgaggagcgattctcgatcttctgctctctactgatagtatcatgacaaaatttggtacaagacatttaaaaattgtgtaattagctggtagaaaaatctggattgtttattattaagaataaatttgtaatttgttaatagagtaatgagggtaacttagttcttttttttgtttttttttgggtatgggtcactaacgtcaggcccatttgcatcgtgccaccggtgggctgttttgattgttacactggctgtggctggtatcggcggcacatcgtcaatatttcaccagaaaaattggatcgcaactccttcgcccggaggcgcttttgggtggcaagtggtgagtcctctggcagggaggcgcgtgtggatcctgccggcggtgacacatcgatcccccataatccgtttctctgcatcccgccggtggcacgcgtagatcttgtcggcggcgacatatatataccggctacccgtttctctctctagccttttaaagcagaagtactatatattttagggcaaaatatattacgtcccgaattcatccggtctgtccggatcgatggataaaaaccatgttttttcgatcgtgcaaacataaattgaagcaaaactactattttagatcgttctaatcaggacggtctagatcgggttgacaatgaaaatacacgtggtttttcagtggtgcacacataacttaaagaactactattttaagataaaatatattacgtcttgattttatccgaatagttcggatcaggtcatcaacgaaaaaacaaatggtttttcggtcgtacacataaattaaaccagaactattttagtacaaaatatgttacgacctccggattttatctagtctcttcggaccgggtcgataatgaaaaaacacgtggttttttttgatacacacataaattaaaccacaactattattttaggacaaaaaaatatgttacatccggatttgatctgctctgttcggactgtgtcgacaacaaaaaagcatgcgggttttttggtagtacacacataaattaaaccaaaactattattttaggataaaatatgttacgactgaactgaatttcatccggtccgttcggacctaatcgacaatgaaaaagcacgtagtttttttttgttgtacacacataagttaaaccaccagaagtactatttttgtacaaaatatgttacggctggatttcatcttatctgtccagaccgggtagataaaaaacacgtggttttccgatggtgcaaacataaattgaagaactattattttagaataaaatatgttatgttttcatacagacggtccggatcgggtcgacaacaaaaacacatgttatctctagtttttcctttttcagtccgtacgtgaatacgtgatcctaatttcccattccaagttcgttttcgttttcctatttttctactttccgatcgacgcaggttctgttttacgtaccgagattcacctttcttcaccgtgatttatttactaatttttcataataccccttcttgatcaattctactaccgttaagtgagaagatagtaaaaataaatctaaaccctttaattaaatgagattaatagttcaaattgcttgatactacgagtacggaccatcggagtgagactcttgttcgagacatcagagccatgcacaaatgatcgacaagaaggcctcgttccctagatagcagatagcatgtacaactacgaacaaggccgtcataggcgatgcaaaagccttaccgaaggttggtatgggaaccatgtcttctcttgtgtgaatgatattctggataaatccaagccgacattcaccttttccctcatgcctcatattcccaaaactctttgatatcctctccgcatctttcttcttgttttgtgacttacctcattaatgttgctatgtctttatacagtgatctgttttttatatatggagtgaattgttgcatgctcaaagacgtgatataaaaagagttggagaagaaaactacaaggaggttttttaccgtaattgaggttgagggcatgcaataccatatcctagctgtcgatctgggaggatccaacgactgaaattggttggtacctcatggtaccgtgtctctatgaggggcggtaccaattgtgataaggtggtgaaagggta

SEQ ID NO: 64059 - DNA, 2529 bp, Oryza sativa
accagctcggcacccaattgaataagacaagtggccaaacgttgtaagtaaaaacttaaaatcccttatattatgggtcatagggagtattaaacttgctcgtagtggtctgaactattgaccttgctgtaaagaaattgtacggacgtgcgtggcaatccatgcatgccctgaccgcccgtgaccagttgcatagaccgtacacgagaggacagtaaatactgtagtactatgaccgttgatacagcttgctgccagtctctcgggtccaatcgaagagctctgtaccaataaagacaacgtgggagctattccgaggagaaaaaaaaacagtgatatgatcgttggtacagcttgatactggagtaccagtctgtggtcaaattgaggagctctctaagagcagctataggctataagccagctgcaaacatattttaagtaggtaaataagaagagagaagggcagcgggctataaatttatagccagctgcagcacggactccaagacacagtgtgtatgacaggtgggaccaggtattaatagtgtagtatataactattatatgaatgagctattagattggctataaatgaattggagctagtagttggctatactattgaacttgctctgatactcccttcattttataaataattcgttttataatataagatattttgatattttccttctactgtttcaccactcatcttatttaaaaagtttatacaaatataaaaaatgacaaattgtgcttaaagtgctttcgataataaagtaaataaaaaaatataaataataattttaaatttttttaataagataattggtcaaactgtgcaaacaaaatattaaaattttttatattagaaaacagagggagtaatgaaaacaacgtggcacagctattccgaggagaatttttttttcaaaaaacagagtagtactagtactacttaccagtacaccggtttgattataatattccttgctccagtccaaaagcgaacggtctccgagtatctcctccctccgttccataataaatgcagttttacactattcatattcaacgtttgaccgttcgtcttatttgaaattttttaatgattagtatttttattgctattagatgataaaatataaatagtattttatgtgtgactaaatattttcaaaatttttacaaatttttcaaataagacggacggtcaaacgttgggcacagatatctacggctgcacttattttgggacggaggtagtaattaaggtgtgtttagattcaaaatttggatccaaacttcagtccttttccaacacatcaacatgtcatatacacacaacttttcagtcacatcatctccaatttcaaccaaaatccaaactttggatccgactaaacacagcctaactttggttagtctatataagcagcggcagcagcctaagaatggagggctataagaagtctgaatgccgatgtggatgagagaggagaggagagagatgagaagcgggctgtaagtttacagctggcttaggcacaagaatcaagaaaatctatgagacaaacaggtggaccatatatttatagtgaaaagttaactattatatgagtaagctgatagatagactacgagtaagcagcttgctgtattattatccttgctgtaattaagatagaacaactgcagctagcgcttgtgtctgaaactctgaatatacctacagaaattgaaaacacccgaaataaagagaagagccctttgattataccacagaataccctcaacaaaagaaagtttcacaagaggtctaacctcttgtttatttttctatggaattgatcatatgaatgcaatcctatggaagttttcctatcatcttcctatgaattaaagggctctatagaaaaaattcttaggaaaataaatcctctaaaatttctttgctaatcctccatttcaaagcggcccgtacagccaactccacaccgcgttctgcagccacgtccgccggcatgagcaatagaacaaggatggtacctttctaaaccatgtacctttattacagtctctcgaatcaacatgcgctacagcctaattaatccataatctaaaccgggtcttagggaaacagtgatatgaccgttgatacagcttgctgccagtttctctggtccaatcgaggagctctataccaataaagacaacgtggcaactatttcaaggagcaaaaaaattttcaaaaaacagagaaaaagccctcactgggaccatggagtactactccctccgtcccataatataagggattttgagtttttgcttgcaacgtttgaccactcgtcttattcaatttttttttgtaaatataaaaaacgaaaagttgtacttaaagtactgtagataataaagtaagtcacatataaaataaataataatttcaaaaaatttttaataagacgagtgggtgccgagctgtgttcgctcgttagtgaggagtcgatccaatcacgg

SEQ ID NO: 64060 - DNA, 11548 bp, Oryza sativa
caacggcgtcaaacatttagggatggaggaagtatatactgcatgggagatctaagtaagtccatgatgaaggaacaagcaaaggaccttgcggaggaactggggcgcttgggagcttggcctgctagggttggagagcgattccgcctcgaagatggtgacgtgcatcgtcccatggagcaggatcttcgccattgttagattaaactatctatccctcaacacgatctcgatgatcacccctgcacacatacaaaaagggaaattgtgtttaccatgatgcaaaatctcatgctcgatcatagacaagttcatggctagaatctatacataaatccgtcagataagaaaaaaaataaagatgattaattatctgcaatggcgaacgcaccgattgatcgaacagaaggagaaggaacagggagagaagaggagataaggaggaagaagaggaggaaaggacggtgaattaatttaggaatttctagggaaggtgatccgatcatccgaaaataggaagtctagtgttgcagcggacggcggaggcaacaggggagcggagcagccgggcatccaccatccatccatcgctgcatttttttttcttttttttgtccccggttgcgccgcgccaacgtgctgacatggaacatcaagccctggagtttgtctcgccgagcatcaccaaaggtcctcctatttcatcctcaaaactgatttggagagattttagttaaaaaaaaacactccaaccctgctaccttacatgatttttggagtgtacaataattttttcaaccatagcacaccttctgcactgtatcaaaagatcgaaaacggaagagtcctcttcttcgagaagagtttttcccgcagcaatgcccagacaagcaaataatactagcaaattcgcaaaacaatatcatagcaaacaatatgtgcgggttggaatacttgtacataagtagtagtattaaaaacttgcaacacgcggaaggacaagggcctttagcctagtggttacaagcctcaatagcaccttaggtcctagattcaactttgcgaattttctaatatttaacggctttgtgctttcaatggtaggcgacgtactcgtcaacagcgaggtgcctgtggcagggtttacattaccggttgaccactaaatttcgagtcccatcggtatcacaattttcgataaattttaactaaatttagaccaaatctattgtttaaccttcgaaattccaattgaaacttaattccgagccatgtcgaaacgtcgaaatttcgcggacatgtgtcagtgtgcgtgtccccatgggagcgaattttccaggatttaatggacctatgtgagtgtgcgtgtccccatgtcttcgaagatgctcataggggtagggtgagtatacatgcgttgtgagtgtatacgtggtattgtgtagttctaaaaaaacttgcaacacgtgatttttttccctttttgcacaaatatcgatgtgttctaatggtacagaaatcaaaattacgatgtagacaataagggcatgtttagatcccctgtcaaaatttttcaccctgtcacatcgaatgtttggacacatgcatgtagtattaaatataggctaaaaaataatcaattgcacagattgcaactaatttgcgagacgaatcttttaagcctaattgctccacgatctgacaatgtggtgctacggtaaatatttgttaatgacggattgattaggcttaataaattcgtctcgcagtttacaggtggaatctgtaatttgttttgttattagtctatatttaatacttcaaatgtgagtccgtatatccggtgtgacacgccaaaatttttcaccgttggatctaaacacaacctaagtttgcaatgtaactagatgaaccctgcatgttgctgcaggagttttgtacgataatagtagaaataacacgttggatagctagatgacataattttatatattttatataattttcatatttgatcaaaattttttaaaaaatataatggtttataacaatttaaatcatatatagattgaccatttaaattaatgtgaaactaatgtgatgtggcagaaggaaaataaagaagataatatagattattcatccaaagtaatatgaattcataagagaagaaaaggagaaaaataattcgaaccatagatcaatcatctaacggctaaaaaaattaaggtgatatgtcttaatgagattagagaaatagtattaaccacacttagtgagcatgattttatagatacacaggattacccacatttgaaatttcttttttttataaaaataaaacccgagacaaatttttaatagtctcgtttattatgtgctactaccgtgtgtaaatagggagtataaggaaagtaacatctgtcataaattagtaacagcagcgggcatttggtctagtggtatgattctcgcttagggtgcgagaggtcccgagttcaattctcggaatgccccattttttttccagttctttttttttcttaacctgcacactcccgctaacagcaacgcgacacgcaaactcgccgcgctgctgccaccgcggcgcgcgcatcgaaacggacgaccgcgacgcccccacccccagtctgccacgccgcagatcgccggggcccccgcacctgctgcactgcacgtcgtcgtcctcctcctctttgtcctgtcgccgaatatatcctcaccgtgcccatgcccatcacgcattcacgcctcacggagtcaatagcgtgaacaatggtgtccatggcgccttcctcctccgccgccgccacccgccgccttccccttcttcttctcctcgccgccgtcctccttctccacccatgccacgccgccacggtccgttcttgccttcttgctccctctctctctctctctctctctctctctgtctggtcgtctgacgcgtgcgtgcgtgggtgttcgttgcaggaggcgtcggcggcggcgaggcgggagtgcacgtacacggtgcgggtgaagacgagctgcgcgtcgccggcgcggacggcggacattgtcagcgtcgcgttcggggacgcgtaccggaacgaggcgtacggcgcgcggctgccggcgggcggggcgtcgggggcgctcgaccggtgcgccgtcgacgcgttccgcgtcggcgggcagtgcgggtacggcgtctgctacctctacctccgccgcgccggccgcgacgggtgggcgccggagtgggtgcaggtgttcgagcctggcgccgccgccggggagaagccgtccaccttctacttcggctcgccgctgcccgacggcgtctggtacggccacaaccgctgccccaaggcgtccccggccatggcggcgcgccggacgaacacctccgcttcacctctaggctagggtagctgctcgctccgcaatgtactagtagtactacggaattggcgattttcggaattcggatgcatccatccatcactcaagaataaacagcctcgtgtgtgtgagaaatatcggaaataagagctttcggatgacacatttatttgtctttgttcttttgtgttcaaatgataaactttaacttatcgaattctactaaattttgttagtccgagcaaaatttagtcatccaggaaaaggtggttgaaagagaaaaatactgcattgtagaatattgctgctccctccgtttcattgtatacgctctctcaaaaatcgttaactcaaaggtgagaacatttaggcctctttggcaaagggttttcataaggttcaaattatgaattttttccctataggaaaagaaagaaagcttttcatagggttgtattcatatgctttacgtttcatagaaagtttatagaggaatgcaaactctcttttgttttcttccatcgcactatcaaagagctgtaatcttttcttgtaggatttaagaatcacactacaatttccagtgctcctatcgaaaatattctttccaacaaacaaatggctatcccaaaatcacttcgaatttcttaggattttctcaaattacaaggctcctcgggacgtaggattatcaaaacgcacaaataggaaaaatatatgaataagatgtcatgtcacatacttttgattcctatagggtattaaacacacaggaatttcagattttttgtgcatttggatggtttgtaggaaataaaactcagaatttttggaggttgttgttttgtgtgtcagatatagtagacagacaaagggatactgcatgggacttcagactcctttggatttggctaatcatggtgcatgataagaaaaacataggaattgattgccatggctaggccaaatcctacagaaagtaaaatttcagggatttgctaaagagcatgtttagttagtccataggaaaacctcaggaattgtgaatgaaatacttcattagaataaataaaatatgagagataaagagacatgttgtcttggccttctcaaaggaggaaaggaagcgatcctacagaaattttggaacccagtcttacaatccaaaggaccttatagggaattttctataggattttaattctttgaaattccttggttccaaagagagcttatgcttatatcctatggaattgaggcataggaagcaattccaaaggatttttatcaatcgcattcctatgatccaaaggagctaatagggaacttttttttttctaaggattgaaatcctccaagtttcctttgaaattccttcagcccatagggattttggattatttttaatatgaagtctaatctctaatatccacttcgtgacacaggattatagaaaaataggaatatgaaaagcataagaataataggattttaaaacacaggaatcctgaatttagttccttttataaaaacagaaatagagaggaactagataggtaaataaagcacaacatttttcaaaatatttaatgagtatattaaaaaaaatcaagcattaataccagcacatgacacccctctacatcattcaaagcatttattgcaaaatgggtactcccaaaataatatacatatcaacatgagctatcgagatcaccgtgggcagcaacaatcagaagcgagagggatgatgcagcgtctccaaagtgtgcaggtttgcaagatcaggagggaagcaaataggattgctcatgctttagctcaaatggctatgaggtctagatcgtatgaggagtggaagttgtgtcctcccgcagaaatcttagacttgataaatcaagaatgcaattctcttttccgtaatcaataaaattccctctttgaagtaaaaacaaaaacaatatacatatcgcatatattgtaaaatagagagaatccgtgaacacatttaaagatgaggaagctacacatgaccacaaaataaattcatatcatgtttgcaacatacatatacttctgtgccgtgcggtttggtttgagccattgaaaaacatgtgtgttgtaccgaagaaaatgtgataggtgcccgtttataaaatccacatgtagagacgaagaatcaaaacctctggtagctaatcaacgtcacttagactgccacacaggagcacaccaactccctactagaagtagtagaacgccacgtgtgcaaaccaggatttggatcctctgcatagaggatgaatagtaccgtgtttatttaaggtacccggtagccattcgatcgagatcgaacggactaggtaacacgctgtgatatttgtgatgttgtagccaccatgatttaccacatttcagttttagcacaggacacattttattgcactacaagagattctcttgatttattttaggacgggtgggtagttttctgcgttttcttttgtatttttggttgaaacagaagtccacggaagtcaggaaccagtttagatgagacttttgactttttactattgagctctatctattcacttattcttatactaaccgaatcgcttattagcaaataaaaatatatgtttgtaggtaattattttatatacgtattacaaagaaatactgtaaaataaatttagataaaatgccaaaaaaaactcaatttcaaactaagttgtaaattttaaattttgatctgcataagcatgcgaaacaatgagaccttttgatgaaaggcctggttttgttcccaaatttttttttcaagaacatcgcatcgaatctttggacacatgaatattaaatatagattaaaaaaactaattgcacagttacagtaacccacatataataataatggattaattaggctcaaaacattcgtctcacggtttacagacgagttaatcccttctaaacatctaatacgtcgtctaaaaatttccttttcgcaagctaaactggccctttgcattcgaagccgcaaagtgcaacaaagaaaaaaaaagtgcactttcctggccggctgcactgcagtgacctcttctcacctcccacctcctctctctctctcccctttcctttacccgccgccgccggcgtccaagaagcgcgggggttggtagggcggtgaccggcggcgaggtcaaagggattgcttgctgctagtgctgggcaggtacaaaatagtcgcttactcccattctctcactacctcaattccacctgctgctgctgcctgcgacaccgtattccagatcacgccgtggaaaaaggtctctcatctttcgtttatttccttccctttttttttctttccctcttatttatttctttcaggttggttctttttctgccaattcctggagaatcgcgcccttttttggctcccaagattcttcccccctccatttctgcgtcttttccacgccacggtgacggcgacgagcttgctttttttttttttttcttttttggggccaattagtgattctttgtccggccttgcgattgctggagttgtgttggggatcgaaaccgaggtgagccgatgagcaagaggagttgcggcggcggcggcgcgcggttgcaatgcgcggcggcggattggggcggctgcttcctcgcgctgccaccggcggcggcggcggcggtgccctcaggcggtgacaccgatggcggattcaacctggcgtggactctccaccagtcgttccaccctgcctccggcctcttcgccagcgtcggcgtcggcttcccggcgacctcctcgagctcgccgtcgccgccggacgctcccggagacccgtatgccaagtatgtctcgccggagatcgagcaccatgctctgcccggtcaaagtgtggaggtggagctaatggagaaggggaagaagaacaagaagaagacgaataaagcattcaagctcaagatcaaggtgggcaatccccacctgaagaggctgatcagcggggggatcgccggcgcggtgtcgaggacggccgtcgcgccattggagacgatcaggacgcatttgatggtggggagtaatgggaattcgaccgcggaggtgttccagtccatcatgaagcatgaagggtggactgggttgttccgcggtaactttgttaatgtcattcgagtcgccccgagcaaagcaattgaggtaaccgactgatttactgatcatggtggagtcatactttttttacagtgtttatgtgtaatgtatattgatactgtactgtgctttgtttgtgatttacatacaatgggggaatcctgttaatggatttttgttttacaaaatatgtaacccttattcttacaaaatggtactccctctgtcctaaaatgtaagcatttttagctatgaatctttgtctagattcgtagccaaaagtggttatattttgggacggaggtagtaagcattaatgtttgttgcaaatcaatgtttgtttctttccgcttttcgtgtgcttaattgatcctgtaaacggcaaaatgtgttttctcccttatgcttaggatacattatgcaaattgttaggtatgtggttcaaataaatctaggtatatcttttatattttaagattaacccctgttacccaagaaaagctgaatagctcttttggcatagcttaaaatttgttgagagattgtgccattttggtattggataccatagagttaagttatataggtcagtgtgctagccttgcgcagtatgcaatttcggagctagtgtaaggctgaaagcatcgatgtaatttctgttataacacatcatttcatcagcgttgtgctatcttgaccttatggatgatattaatgggaaaaaatagtgatgattatatacccaaaaacaagaagcagtttgcagtttagtccaccggtacgtaagaattgctcttatctgttgccataacatttccctgctcaagctggtctgaagataagtagcttgaacagagtatggtcttcataaatcactatttttttttattttaacataatagaaacttggtatttgctttctctccagtgaaccatacctgataatttacacaatattagacaacagctgagcgcaaaccgaaggcacatacaagacaaaactaattatatccttttttttttttgagatttccattcccagaggtattggcctgattaaaccaaggttttgatctgcagctaaataattcctatatctttatgtttgagtgagctgctccaaacctcaggcaacttgttgcatgattcatgtaagaaaaggtttgtatgtttcaaggaagctacagtcagaaagttcttgtattgattttttatcgtaattaaaaatgtaataagggctataaaaaggctaattctcatgcttatttgaagtatgaaaacatcaggcaggtccttgcattattgttggctttcttcaaattttcatttcttttatcaagaaaccttttctggcattcacagttagagggttgaacagaacacagttgggtgtttaatttttatgttctgtttgttgcttagttcacacatgttggatgcgcatggttgtgtatatcatcggacaactacgatataaatgatggatgcatgttgaaacataaatagctagttgtacaagtatttgtgcacatacatatattaatatttggccgtcccttctttttctgcagctcttcgcttttgatacagctaacaagttcttgacccccaaatctggggaacaaaagaaggtcccactccctccttcactagtggctggggcatttgctggtgtcagttcaaccctctgtacttaccctctggaattaattaagacacgattaaccatacaggttagttctatccctctgtatgcctccctgaaactagagccttttaacttcctgagacgcaatacacgaatgtcatacgatggttgtgccttaaaatgtgcagagaggtgtatatgataactttctccacgctcttgtcaaaattgtccgtgaagaaggccctactgagctgtaccgaggtttaacgccaagtttaattggagttgtgccatatgcggcgaccaactactttgcttacgacacccttaagaaggcctacaagaagatgttcaagacgaatgaaatcggcaacgttcctaccctgctcattgggtcggccgcaggagctatctcaagcacagctactttccccctcgaggttgcacgcaagcacatgcaagttggcgcagtcggtggcaggaaggtctacaagaacatgcttcatgctctcctgagcattctggaggatgaaggggttggagggctttacaggggtctggggccaagttgcatgaagttggtgccagccgccggtatttcgtttatgtgctatgaggcttgcaagaaggtattgacagaggaagaggatgactgaatagtgtgtccttacactcttcagagcgcagttttgcaacttttttgactggaggcatcttttgggcttgatttggaatcaaatcatgctggaatcggatgaaactcgtgtagtttcttaagaatttttaccccaactctgtgctgtcagcttggcctgataaaacctgcctctttccccagttttgcttcaggatatcatatgcagagaacatgtccaataactgatttctgctgagtttatgaagtggttgaaacgcaaatgggcagtcataattcccaggtggtgaaacaactacgagactctgtaatctgtgtgcagctttgcaagtgcatgaaaggttcatttgatccatttcctctgtgtttgtggcctctggtttatctgtcgagttaagatggcatcaacaatgttgtaacatcaagaagtgtgttctcagtgataattttttttcagagctcaataagaaacttccaaactagcccagcccagaaagcaggctaacaatgtccatgtccatatccagcccatttgtctgacactacatgggcttaagtgggcctatcgcagcagagctcgctgaaggcccataggccgaaaccgtagcaggcttcctcacttatgtacctatagcttttattatggaaattacaataatagattggggcagagctaaaacgaaatggaggagcttaccacttatttgttttactctgctttataccaagtttatatgtataattctataaaagaaattaatgggctgggtttgtgggtgcctccttgattcctcatgtagctccgccccccataatacgcaatactaatttctttcaagaaaacgacaactctctgtaacatgtggtatcgatacatcgtttgacgtaagagaaaaagttgtaattttgtatataaaaataatgtgatacttttgtagtagtttcgtgaaatgcaggacgacataagagaacaaaagtgcaacaacttttctttttatctctagttttatatatgttcaaatcgtagtgtacagatcggcgcacctctaaataaatatatcatgcatgactcatgtaacacgaggcacgacctaattaattgtaacaaagtggctaaactatatgttcatataggtccaacaaaggtactcctattgatcatataacgtaaaggaacgataacatcgtcatcagtatgtgtatattaattggtttctcgaataaacataactatatgtatattggttaacacaattcaatgtttcaggttgtagccataaagtacacatcacggcccacatactcttggaagccctagctagagtaattgaaaaaattccaaggcaatttgacaatattgatattgcaacatatatagatttatcattttcttaagaagaattcggagttctttcggtagacaaacaaaatagacaagtttcagagaatatacaatagctttatcattttttcagatttcaacttcagtagtatttatctcttgtgatttctctaactacataactatactattccatccgtttcacaatgtaagtcattttagcatttcccacattcatattgatgctgatgaatctagactgatatgaatgtgagaaatgctaaaatgacttacattgtgtaagggctgcag

SEQ ID NO: 64061 - DNA, 40877 bp, Oryza sativa
gcccaccggaggggaagctgctgccgccattgccgccgccgccgctcgacggcttcttgcggccgcgccagcggcggcggcggtggcgcccgcgtcctgggaaaagctggaagcacgacacggcggggacaatgcaggacgggatgatgcacgacgaggaggaggaggaggaagactggccgccggcgagggcgatggggtccgagatgacgtgcgccggcgtcggcgccgtcgggtcgcacttgagcgagaggtcgaagtcggtgagcatgatgtggccgtcggcgcggacgagcacgttctccggcttcaggtcacggtacacgatgtccaccatgtggacgtactccagcgccgccaccacctccgccgcataaaacctacgcaaaacaacacattatcaccatcattaacaagctcccaaaactaacattaacttttgaatcgtttagcaacttctagcatatgcaaaaaaaaaaaaacaagttggccatggaagataaattccattgaaaatcttaaccttcacaccaaatttaagtttgtgttattaaattaagcattcaccaaacatttttgcttttagagaattcaccaaccaattcttaggctgtgtttagttctctttaaacttccaaaaattccatcacatcaaatgtttcgacacatgcatagagcattaaatgtggacgaaaaaaacaattgcacagtttgcatgtaaattgtgagacaaaacttttaagcctaattacgctatgatttgacaatgttgtgctacagtaaacatttgctaatgacgaaataattaggcttaatagattcgtctcgcagtttacaggcggaatctataatttgttttgttattagtctacgtttaatacttcaaatgtatgtccgtatatactttaaaaaaaattgaaatggaactaaacacggacttaacaactttgcaactgtatacaaagcaaggctattgcatactgcaactgtatctgaagcatggaagtgaatcccttgactttattcacatgtcacctcaaccaacccacatatttgtgtatcaactaacgacaaatccaactgtatcaactatcagcactatttgcattgatacacagacatgcatggatgccacagtgtgatccagtacaacaaaggaaaaggtcacaagggagcagaggagtgaaaaggtttcagacagtactcgaactagtgcatcattgatgttggaggtttgcacgttccaaagctgattaggataacttaatggcataaaggggatgcagctcatgtgtgtgcactcaattgttaattccttgggttaattagattaatccttacagcaagtaccatactggctactaggctactaccccatgttgatctcgactgaatccatttattcataggctcgtatggttggctgtgattaacactcatcacatgggtgttagttaaagtttctctgaccaatggcatctataattctctacttatgaggctatcagagagtgatttatcatgttctccgaacggttcttgcgccgtagtgcaagggctttggctcgtgtcacacaggcattagcacaattaatctacctgaccgtgcggttgattgcaatgttgttggtcctaggtaggagtgtgctgtgcttgtaccatcagaattcacaattcacaaacgccgttgtaaactgctactgctcatctactggtacaagtgtacaattatccccccgtaaatagcgggattggccattgattcatcttggtaggaaatccgtgtcatgcaattctgtatttgaggccgtacgtactacaactcgtctaataaatcaattcttgaattcatggatcgctttgtactgccaaagtgtcaataacttcaaaaaatatatatatgttggtctatgatgttgtggtgtttttgttagttggtcttagattctagcaacactgttaatatattgtgaaatgaagaaaaaaaaataaaacattggtaattggggatgatctggcaaagcatgtaggttgagttgactacagctctgcaggtgaatgctatggccggactacttactagtctgtctaaatgaatatagccacatgatgctgtaatggagcaaacgtaaccgaataattctaccagtattttctatcagtacacagcttagtaaagttgacgtgtttttgtctcgtaatctctggcatggcctacatcaaagatattgcacagggaaagtacggcggagattaattctgtgtcttaagtttattctggaaggaaattactacgacatcagtatctgtgtatagtgggaagataataatattggcaggcagtgatcatcatcgatctaagaggcaagtaaaaaattcagatttgtgatgcaaattaagcagcctaatttcctgcaagggacaaagactgcaaactgttcatgcgacaacaacagcttgacttccatatgaacagtcttagcttcagaaattcagaaggccactgcagccacaggtgtggatgcacaagcaaacacaccaataccaatagtgattagtgagtgattgcaaggtgatatgggcgtgcgattgtgtgtttgaccgcggtgcggctcacgatatggcacgaaaacaagaaactgtacagtgacagtgacccagtgatcgagctcccatccatgatgctcaatccttcacaatgtctacaaagatgcttttttttttcctttttctgaagaagaaaatattctcctcctcataagtcagattcatgcattaatttgaggcactcttaagtgtaatttttttggggttataaaagaatgaatccaaagggcagctatcatcaaacagcattatccatgttgttatgatggaacacaattctggcaaaaaaaaaaaaacctattcgataaaaacggccgatgcatggctgacagaagacacacgggccaaacaatgcacagaagaagtacagaacaagtgttgcttcatccactactagatcattaataaaacaaaatataatttatacgaaaaggaaacaggaaaagaaatgcagataaagtgaaaccaaagtcaagagaaatcgcaggaaatcagccacattcttctcccaaaagcctaagaataagatcaatcactaccttactactccagctacaacttcagtcacagtccacgccttaaaaacggcataaaaaaagtgatttgatcgaacatttttactagcatttaaaaaaattataaattaacgatgtggtgatcgatcgatgccacagaaatcgagcagttcacaaaattgtttcaaaaaagaaatcatttcatctgggtgagtgaatgcgtgcacaagacaagcggtggtggtgtacctgacggcggactcggagaagcggcggtgaggctggcgctggcggaggacgtggaggtcgccgccggggcagaactcggtgaggaggcaggaccagcgatccccctcggcgacgcccaaaagccgggggaggaaggggtggtcgacgccctcaaggatctcccgctccgtgcgggcgcggccctccttgttcctcccctccagctccttcctgtccatcaccttgcgggcgaccagcgccgtcgccgcgcccctgacctgggcgaggtagaccctgccgatgtcccccgccccgacccgcttgaggaagcgaatgtcgaagagcgcgacggccccaagccgggccggcgtggtggtggtggtgttggtgaaggtggtggtgccggtgaacccggtgaaggcgaaccgggagcgggagcggtcggaggaggcgaagctgaggctctgcagctcgtcggccgccggatcgggctcgccgccgggaggcattgcaatgtgctgtggtgtggtgggtggtgttggaaatggcggaggcagaggaggagatggatgggttggtgcgttgcgtttttaatttgaagcggagaggtgaggaggcggaggttgacgacgatgggctgggccggatcatccgcgtccgttccgcgcttgattttttttttattttgtttttctggatttccgggcccctgttctccgggatgtgatcaaggaacaccaacattgctaatttgcagcttgatccgattattaaatagatatttaactatctttactcttatacgcgtggtatttaacaatttaccatcagacccacatgtcataaatacataaggatccacttgtcattgacatatgagcagtgacaaatgcagctttaaaatatagatgggacggagaatagagatgttcactccataagagcaggtataatagctctattaagttggcttcaaaacctgataatcagcctaatctgagattagggaaagaaattcaccaagaatgaaacaaggcgcttgttttagcgccggcgcttgcatagcgccccacaccatatagctcgcatgcagccaggagagacaataaaaaatatgttatgtgggtcccaacagctgatgtatccatacaagtatttaatgtatgtatgctttaaccaaggcagctcataactaacttgtagttagcttgttgtataagttagctctacttgacatgacaaaattttagagcttgctgctagctgcactattaatcttgctctaagagcaatcgaacaaaacacatatcgtatttatagtcaatcgcataattatctcgatcattgtttgtggcgtgtgtatgttttgaagaaacaaactaatttgttggacgttcacaccttgttatacctaattttgatagcccatgactgctataaaggggtagggggtcttggggtgtagagcgatacgggttgtagctgggtcggtcgatctactctgcctaatgggtagatccgcccctgcatatgagtagcaaattgttaaacgtcaaattaaaaagtgataaatagttaaatgctcaattattaaatccttgctcaacgatgaggagtttttcttccaaatacactcatctcatcaaaataaaattctatacatacaccatattcctattaacgttttttattggtttggatatgtctgttttaaatgtctccctatcgatgtgtatgttacatttcataaaaaagaaaaattagctgtaaacgcgctgagtcgaaaactcgaactcggataggaatgttttaccataagaaagatatccaattgagctcgctcagcgcgtgaacgctgcggaagtttttgatacgtaattgcaaatccaataacgattcatggctcaagagaatggaaggtttaaggttgacgtcgatgagttcaatcaaatcaaccggaagaacattgtgcaaaaatcaaataaacaagcagaagcagcagccgcggcgaatgcacggaatctggcaaataaaggcgaaattatttgaggttggcagtttgcgtttgaaatcagacgtagcagggtacgcagccagggaggctactggctatagcaatggctgcagtttgtgaatggattggcctgcattgcgtggttggtgtggaatggattcgaaggcgtgagtccaagtgtagccgggacaaccgactggaccaaaggaagggtttgcttgagaagcatgtgatatctgcagcttcactcaaaatttaaaattcatttaaacagtgtaataatatgcagactaaaaaaatggcagtttataaatctagaaaataaactaaaaatcagaaattgcgtttttccatttttcagtttctccagattcttataagtctttttttttgaactaaaggcaaagcttgcctattcattgaatatagatggcaaatttacaggtaaggaaaaagtaatattagattcttataagttacttcctccgtcccataatataagggattttgagtttttatttacactgtttgaccactcgtcttattcaaaaaaattatacaaatataaaaaacgaaaagttgtgcttaaagtactttagagtaagtaaaaaaaaaaataaataataattccaaaattttttgaataagacgggtggtcaaacagtacaagtaaaatctcaaaatctcttatattatgagacagagggagtagctaccaactagctatttatcataattttaaactatttcaaacatgatcgaagaaaagtcctttatgatcgattgagctacgattgataaaccatagaaacataagcaaagcaaccaaaaaaaatagtttataagtaaaaatttttacatttatattcttaatggtttaaaaaccaaggctgaaaaattgaatatgatggaaaaactaatgttagattcaattttaaattttggttacgaagataagccagcaagaaaacgataaaagccgatgagctcctccccattgcagaccttttttctcttacttttcttttaaacagagtgttctaaaaatctcaaggtcccatgttaggattggcgtatcatatatttttaaaacaatgatgattggatggatgtgtcgggggttcagttcaggagttggtgtgatagtctgatactctgaaatggggtcggtttcttcaagacaaggccatatgttttacaattcagaggttcatcgatcatcgaccgatatgcaagcctcagaggacccctcgcacaaagtctgagaggatcaattaaatcgaagtcaatctattattgtctgattgtctcggtgagagtagtcttgagacatcgaagacaaaaatgttgggcaacttgcattgggctaagccacgcaggagacaggcagaatcaactggtaacaagtttgaggctgcaaattatacctgcaatgttggatgatgcttctacagtgtttgtgggggaggttgttacactccatggccgatcaggatccggtgtagttgcagtctgtaactgaactagcaccacatgatagcaaatcaagggttcaggttgatgcataactgtagcacctattcattgtagtaaaatttattaggccattttggatactaccaaaataatgtgccctaccaatttattggtagcttgaatagtaatgttggatgtttggattgtagccaataatttggggtctgttcactttgttgccaaaaaaaaaaaccttaccaaattttgacattgctaaaattttggcaacttaccaaaattttgacaggatatcttatatagttaccaaaatttggcagcaaactaaatgtagccacttttttgacaactttaccaaaatttagtaaggttgaaaatgacatcaaagtgaacaggtccttggtaatgcctcaattgaacttgacagttggcactaatctagaactttctcctctgtaacatcaaattttggcttcatgttggtagtaatccaaacatatgcattgcaaccttatcataccaaaatttaccaaagatttgatacggtagcaaaccaaacctatccattattttacgtttcttgttgcaacgaatctggactgttggatcaaaacacaaatggccgagcggtatgtagttcagacattttgtacttgaggttaggggctgtaataggcccaatacaaagcaactctgaactcgcagaacccaacccagtagtaaaataggctgaaaatgaacactacaagaacaggcaccacaagaagcccaaaagaaagatcctgcaaatttgtggccccaaaacaccaaggaaaaagtacaccgaaggtccctcaacttgtcatcgggataaaaaacgtcctcgaaccgcaaaaccatacatgcgagatcccttaactatacaaaaccggtcacccgaggtccctcggtggttttgaccccggttttggtctacgtggcggctgagtcagcgtgggacccacgtgggccccacatgtcagttggccacgtcatcactctctcccctcctctccctttctcctctctctctcactcttctcctgtctgggtaggcagctggggaggacgtcggtgggttgctgccttcggtggggcgaggagggagagggcgagggcgtcggcggccggcgacgggcgacacgacgacggcggctggcgactggcgacgcgccgccgccattgctctcgtccgccattgcagaagccacaggcacggaggcggaccgccatcgagggatgaggtaggcaagcaaggggggcggggaggccggcgtcgacctcctcaccggccgtgacgtcgccatcaagtccttccccaaccggcgacgtggcggccagcgaggggagcaaggcatcggcgggggagcaaggcgtcggcggcggtgaggcggttcttggccgcggccagcttgacccggagtttgaggttagaaatcaacacgaagaatcaatcaagaagcattcagattagcacattccaattggcaacctataaacgaaagagtgctcctaataatcaagcaaaaaatgtgagaggttcaacctctgaggttagaaatcaacatgaagaaagaagcattcggattagcacattccaatttgcaacctaaatgaaattgtactaataatcaagcaaaaaaaaaaggaagtgagaaaccaaatgggatggatggatggagtactgactcggtctggcggatcttgtcgaagaaatgggcgtcgtagacaccggcggcgtcggcgaagtggacgacgccggagaagtagtgcttgtcgacgtgggcgagcgcggcgttgcgccgccgccgctcccggccgcccgaccgcatcgtcgtcaccactatcagcatccacctcgacacgctgccctcctactcctcgtcgctcacgtccaccaccgcgccgttcccgaccccggccgccttcgccgccgccgcatccggcacaaggctcacctgctggttcacggcgacgtgggacgcggcaagctggtggtgcggctggaataggagaagaacaagtagcgcgaagaaggagaacagcgggcagcgtgacgcggcgacgaggacgacggcgcccaagcccgctcgccctgcgggcgccgcgaagaacttcatggtgccaacgatctccgcggcggcggcaagccaggcgcatcgtcgggaggcacgaatcctacggggacgacggcttcccaatcttcaccgagaccaagtgcacatcggcgccgcgtcgtcgccgccgccgccgccttgctcccctgctctcgtgtcgtcgccgtcgccgtcgccgccgccgccggccgccggacctcctctcccgtctcgccccgtcggtctcctccccacccgtcggccggcggcgccggcctacccacagcaccagagagaagagtgagagagagaagaggaagggagaggaggggaaagagagaggaactgacgtggacaggctgacatgtggggcccacgtgggtcccacgctgactcagcgtcacgtcgggctaccggttttatatagttaagggactccgcatatctggttttgcggtttgagtactttttttttttatcccgatgacaagttgagggaccttcggtgtaatttttccaaacaccaatggatattatggacttttggcctttcaacagttaattattgcttttataaactttgttttgaatctcacaaacacttcgggggtgtagctcagatggtagagcgctcgcttagcatgcgagaggtacggggatcgataccccgcatctccaacgtttttaaacaaatttatatttttttcctgaaatttcttaaatccattttccccccgaatcatattatctgctaagctggaattaaatttcatgactccatttttttcctcctgaattggggagttgaattgcattaattttctttattttttttctcttactagaaaaaatacttgtgcgttgcaacggacgaatgctattttaatcttattattgttatataatttagatatggtaaaattcactgtggaaattcgcttggatttttctttttttgaaaatcatgagctgcaattaggagtctggcattcatctcaagttagcatgcaagttttttaaaaaagatttcttatacgacttcttttgtatttacaaaaacaaacaaacttaaaatccgactcaaacacggatgacattccaaaatactagaaaaacatcttcaatttttataatggtaaataattgcattacgtgctaagctagaattaactacttattactagttccttttctcctggaattgtttttaaaaatttcttaactcctttttctgaactgtgaagttgaattgcattatcagttaagctggtatgcctttaacagttaaaagtaaatttcacaaaacatagattttagaacactcgtaacacaaaacccatgtattatgatttgttttgaaaaccccaaggttttagggaaaatttttaagaaaaccttatgtttaagtttatatcatttttttgttaacccatatatttgtgcataataattggaaaaaataatatgagatatttctaagtatatatacatgttagtcttattttaacgagcgtcatttattggtaatatgattaatgtttatatgtataagttaccagttaatatgttattgttagtggggttatgttgtgttttttcaatcttccaatgtaagaggaaaatgttaaagtacatgggagggatatgtattttgtgcctactaatgcagacatatactactaaaaatatcatatacaatgatgaaattatgagtatttgagataaacataagttttttaaaaacatttttaaaccagggttccttgaaacaaaccataatatctggaattatgcactacatgtgtctcaaattattttgtgaaattactctttaattaccttattactagttttcaaaaaattatataatctgtctttaattcaattaattagactgcttataatttatagggactagttttttttcacacgcaccaaactctatctaacccattccactttgatatatataaaaaaataaattctacaaaactattcgatcaaaactatcgctttactatactttaactaggcgcttcacaatactagaaacaacaacaaaaaatataaaacaaaacaacaattttattccctacatgtctatgatatgtgaacctaatttggatagcacaagtatctcatatgcgtatgacagatggacccaatgacgttggagatataaaattgtagttttatgataaaatcatatactattgttgtattgttgcagtagcccagctaaagttaaacataccggcagttttagctttatacaatttactatataaaaaccatactcgaaaaataaaatccaccatctccattctctccttactcccaagtgacacgaattacggctattttttcagtgataggtgtatccactgacatatgagacattcataatgactttattaatataaagatatatcgatctaatcttttggagatactcatactgtcatacatatatggtatactttcttcatcacataaaaagcccaatcactatgtccagaatcatctttaaaattggattcttttttgatgaagagaacatatcctatcttactttaaagctataacccactaattccaaagctcaacgtacaaacataccacctcacaatccactagcaacaattacatacaaaacttatataagcatgcaacatcatctataattcattaaaatcaacatccaatcatcatccttcacattattttcacaatatttttaacatatatatatccattattttttataatatttaatatatattcatctatacaatcaaagtgtgggatatcatattttatttacaatctcatacaaagtctactaattttatttaacaaacgagttttatttgttgttaatagctaatatatttttttacttttagcttaattattaaaagatactaaaaattacttagtaattcccgtaacaaagcgtggggaatcacctattatatacacatttatatatggtattgtgactagtgacttgtgagtgtctgtatttcgaaaaaaaagaaaaaaaaacagaaatggaatccacgcgccccaaaatgcaagtgcgcaacacacaagagcccaaatcgagagagaggagaggagagaggagtccagcgagagtccatccatccacccctcgtgacgtgagggggccgcaccgccgctcgccgctcgccgctaccccatccgccgccgccggccgccgacgaggttcgggggggcgcgatggcgtcgggggtgtcgacgagcatggtgctgacgctgctcggcttctgcggcagcgtcctcttcatcgtcttcgtctgcacccgcttcgcttgctccctcctccgccgccaccgccgccgccgccgcgcccgcctccccgccgcctcctcccacttcctctcctccgtttacgtcgtcgaccaccaccgccacctccccccctccggcctcgaccccgccaccgtcgccgccttccccacccgcgccttcctcggtgctgccccacgcggacacgcctcggcctcctcctcctcctcctcctccgacgccgccgcccagtaagtgctcctccctcttcccccgcaacgatcgcgattccccgcgtcccgtgcaatgccttcgcactgcagcattgcgttgcgtgaaatctaagcttcgaatctacagtgttgttgttgttgttgttgcggtgatgatgcttggcttagagcgcgtgcttttctcgtcggtttggttatccgcattgtggggggttcgaattcgttcttctccgggtgaatcgatcccaacgattgcagttcgaatgtgaacttggatgatattctattgagcacgtttcagttggtaggatcgagtcggtgaccgggggattgaatgcccgctgaattagggcattgtagttgcgggggcgccctcatacgagtgaggaaaaggggatctatcaactattatggattttatattatatgtttgagattttctgtttgagcacatgtcactgtcagtgtttagttgagattctcctggatgtccacttactggatgactactgtttttatgagtttaggtgtttttagatctgtgaagctcttcttcgtagtcgatggatgatactagcatagaagcatgcatctatgttcgttaggtgttcttctatgagcgccgaatcttcacatattatttgaaatttgaattcttctcaacatactagtactgagtatgtcattctccgggcggatatgccaacatgacatgattcagtttctattgttgaatgcaatagtttcttaaacggtatgagcgaatttgggttctacaaatttacatcatttgcaagtatatattgttaatgattataatagatgacctgaactgagaaacaacaattgagacttactcccttttattttcataaaaggtaatattgcctcctgcccaacattttccaatttaatgtttcgcaagcacgtggttgcctccaacccctaatatcttcttggtaaggcagtcatagataactgctacttaaaatcctgaagaaaaaacaccgccttgcaatgaagtttgaagtaccaagacgttgtccttgagtattttgattgattgtttagtatcaaataagttatcatgtggatgttagtgcctaatagaaacagtatgacttttttagtaccatagtgttgattgttgtgtttaattggagattgactattgaatcgtgagatccctgaaaactcgaattattaccaaacagctaagatcattaggtcaatcacataacagaatgcagacattaagttctgttgaataagtcgaggaggaaggatgaggcactgtcatcaagtaggttaaaccctcacctgtgcttgatgggatggaagcttggattaggttggttgtgcgatgtgtatctaaagaagctacagagatgcttctgttaatcatatattcatattggcgctattcgctatagtggttttgctgtatcaaataagaggtttccatgtttggcatcatccattgtgggattgtattttatagttaaagtgttgataaactgttgtcaactctgataaatactactagtatctgaattgtgatttgtgtttctataggtgattgttagcattttcccaattacaccaatattatattctgaatcatttccttccattgttggcaggtgtgttgtctgtcttgcagactatgaagagaaagacgtacttcgtattcttccttactgtggccacaattttcatgcgttgtgcatagatatttggttgatgcagcactcaacatgcccggtttgtagaatttcattgtgtgactaccctgatagcaagcagacaatgtctcctctaccaagtgaagtgataatacctccatgttcccctgaaccatcaaggtcagatcaatgcaattgcctgtttgtcggcacggggcattcaccaaggacatctcaggttcttataaatgaacctgaccagtcgaatcggacattatatagtccatcagtggaaggggataacaacttgccatcatctgaagttaatcctcctggtgaaattaacaaccaaacaatgaaaaagcatgtggagaatcatcgtattcaagacagatcatgatctacctagctaagatcctgcaagtgactgttgtgcagtctgctgtcttcagggtaaactacatgtaaaattataagcagcaatacaggtggattcatggatggctgttataggacataggttactttgaaggatgtaaatatgagaaaattgttcaggtttcttgttagaaaacacatttatttgttaatcatattcaagggctcattgcattaaatagcttgtctcacttattgcatcccgactgatgaattgttgttgtcaacagcagtacatctgcaaaatcacaaagagaagtagctgtcaatacaatcagaaaacaggaggagggcatcttgattagttcatggatcagggtatgagaggaacacaatgtagctgtctcactcatgtagtcatgcaaaaattctccctgaacagcatcaagatcagcgaccgatttgccatcttgtctgtgactgtatctacttggaagcaagttagtcagacatcagcacagtgccattcatacggtaactgcagcagcatgtggctccaatgtcctatttttgttaagagtctgatgctgccatggtaaagtgcctgagattagttggtcaagcactcaaagcatgataatggtgggagccagcacaatgctacataactctgaatctctgatccaagatctgaagattaaagtccagattatgatctctcctctgaaaaccaaatcttgcagggccaggagaacagcctatggttgtccacgcaacgatgtcggctggcccaatcatggcctcctgctagatctaaactgtgtggctgatcaaaccagcaggcagcagcaatggttcatcacttcatcttccctgctgcctttgcaacagtgtgggggctggactgtgcagacatgattcaatcaagtgtactgccatgaaaggccttaataagttttacagtgattcctgtcggtggtggtggccctcaccggagcagatgcagagctcttcactcactcactcactcactcactcactctgcccttaaaatggtggccagcagcatggtgtgatgatcacactctcctgcaaaggcacttcacctggaggtgtagtgtgaggagagctttttctttgcaccttttggttttttggagcttcagcaatgggggaggtcaagcatctttgcctggtgaagttcaaggaagaggtcttggtggatgacatcctgcaaggcatgaccaagcttgtctcggagatggacatggtgaaatccttcgagtggtattgcatcaaccagtgctgttatatttagactatagttttgttttctaaatctgcaggttctgaggcagaatacctcttaactagataacatgcctaagatcacttgtttttagcagctaaatgaacttgtaagtttgtttatccttgagagttcagacaactaattagatttttgacttgttttctgctctaaatctaggttcagcagaaagtgtgacatatgcctaagatcactagttcttttagcaactaaatgagcttgtattttcatttgaggctttaaactgttaagagacattgtgcaaacacattggatctgtaatctcttttttttcagggggaaggatgtgttgaaccaggagatgctgacacagggcttcactcatgtcttctcgctgaccttcgcgagctctgaagatctgacgacctacatgagccacgagagacaccaggagttcgccggcacgttcatggcggcgatcgacaaggtcgtcgtcgtcgacttccccgtcgtcgcctccaagcctgcaccaccggcggcaccggcggcggcggcgtgatgatgacgacatcaactgtccatcaagcatccatccgccatggcatcaaccattgcatcattgttccaagtactttcaggtatccatccatccatctacacacgcagatagctgtgatagatgtaccttaggttccattattgcatgtttctgctgcttcagtgttgagctggtgtagcttagctaaagctgtaatgcagctctatcccgtgcattccgttcaaagcttgttcggttattcttggaataaatttcggtgatcttttggttgctgtgacttaattacttttgccttttttccttttcggtgttaatgatggagtgacagattcctaaatagtttttatgattcacttgtgcttaaacttttgattgagagcaggtttgcaatgacccaggtttggtggttaattactcgtagtacaaaggtaaacagtgagatgttatcagtgctttcatgtgaggccatttacatcggcatttaaattccatctaaagaggagcgatattactactctctttctttctttcccctttttcccttttcatttgagagatgtttggtgctatgtcgatcaaaatcgacaaagttgaccttttgaaatcaaaatatgccctataaaaaaaaaatcaatggagcaagtatccttgtagccttcaaaggaagctatgggcaaattgtcatagcatttacgaatgaaaagggaaaaatagagggcaaaaggggggaccaagttgaagcacttcaccgaatggagatttaacatgagagaaaaaaaatggtgttatatcatatggacatatatacatatggtatttttcatgtttattggtgtgcctaataccaaactgatgtttggcagtaatatataatggccatcctgcgtatggcactatcacaatcgtgatgtaaaattgatggaccatttgcatatttcgatggctcaggatgatgagagcagtgataatatatgccactagctgaaagatgcgtactatataataaattgatatcatgggcggtgattttgatagttttacaactctctaatttcttccatggaatcgatacaaatgtgtaaccagtacattagtgacatgtacacttggaattgacccaagagagaaagcaaaacagaattcagaatttcagatagtgaaagagtgagcccgttgcttttgtttcaaaaaacttgcatgccttaaccttacgagacattagctacccaaacactcaacagacaggagtaaatcatcgagttctcgagacgtgcattaaccttacgagacattagctacccaaacactcaacagacaggagtaaatcatcgagttctcgagacgtgcagcaacgaagattgaatgatgggtctgagattatcttaaaggtaaatgcagaggttaaatcactggaacagtatgatcactgccagaaaaatccagcatatatacattacagtgtcgccatatcatcagcctatacgttgcataccttgaaagcaatgcataataaatcgtgaaagcaacaactgaatttggccaacctccaaccaagccatagtaataaacaaccaaagataaggtcagatggcttgccggcgttgatctaatccagttgataaagatagggattctctcctgcttcattccctgcgcttagattcctaatcagttccggtaaaagttaataattattcagggttattttggtgatcagatggttacaacagaaagccagggagataaattatggttgagcatatgtaagaaatactaataaagacattgtcgtatgctattgtagcaagcgtacaagaagggagaatacagaataagggacaagtttgtcgccatgtaccaacacggttgcttggcaaatatagtttagtgtagagctgatgattgagacaatactatcacatgtgggggtgatatcaccatcaaccctttcctccccccaaaattctgttggcaatttggcatcaaatggaagaacagattaagaaaatccaggggaaaaaacagaaccaccaggggaaggaaggatccaggccaactcattctctcgtgaggagaagcagcagcagcagaaaagcaaaaggtctcatctcacgagttgtaccgtgaagcaaacaccaaacagttgtacacccgatgctagtgtgcagctgggaccaaaggtgaaatctgggaatgccattacgcctacacagtgtagagtgtagaagaccatgtgcttcaccagctatactatgcatacagccttggactctatggtagagcaatacaatataaagtagccaagattagttggaccagagcaacaactgatggaagcagatgagtgttaactggtgaacaacatatgcaagatgtagcaggacatggcaatcataagataaaactgatgtaatcaatatgcaatgtcaggaatcagtaccagagatctcaattgcaacagttaagccgcacagtatgtatgagatgtatcgaccgtgcaagagatttcgatggcacagtgcaagaacttaagctgtggcttccctttgttgaattgcagatttgcagtacacggtatgcggtggtatacacacacacggctcggtagcagtacaaaaataatgcaagtcaccctatcagaaattcagaatcactgcagtgctgcattgcataagggcaataaaagagtaaatgcaatgcgtgattttaaattttacatcaagcataaaccagcgcttcacaatccattttctggctgcaccacctcatgcagcacagcttaattaacagaattaaaacacactctaaattgctttctgttgttgtttgttaactgtacggacacaataccaaactaacaattattcagaaaagatgaagaaataaaagaagaggatcctacactacacacacaccaatctcatcaatgtatatgccctgttcatgatcttgtgttttttttctccccaacatgaaaaatctaacacctaagttgcaataaacaacaaccacacatcattttgcttttgctttgatggtttggtaaagaattgagaccaccaaattctcccaatggagacagacagtaaccagagcagtgaacagatttgacctcttggagaagaagaagatggcgttcgtcagggtggcgacttgaacgcctgcacgatgagggagaatcccggcgcggcggcctcctcctccagccataggcggctctcgagcgcgctcctcgcccggagcatcaccaccgcgcagcccggcggctcccggaaccaccacccgtggaggtcccacatcacgtcgacgggggcgccgtcgacgaacaccgtctggttcccccggaagttccagcgcagccggcacgcctgcaccgcgcgcttgccgtcgacgcacacccacagctcgtcccctccgccgccggagccgggggcggcgggcgcgcagctgacgctgacctcgtgctcgggcccgccctccgcgaaccggacgcgcgcggcgtgcatcgccgccgggtcggacaccacgacgcgctccacgcgcgagacgggcgcgacgcgggcgcgcgggatctggccctcgaacttagccttgacgaactccgccgccaggtcgcccaccgcgagcaccacctccgcgctggccaccgccaccacgtagtacccggacaccggctccggcgacgacgccgcggggtcgtaccgcgcggcggtgagatcccagaacagcgcgagcggcgggggcgggggcggcgtggtagtaccggactcatcaccaccacccccgttctcgtcgccggagctggagcccgaggggagggagcgggagcccctcctccgtcggagctggatggcgcgggcggtgggcgacggcgcgaacgacagcgtggggccgagcggggagtgtccccacgtgaggcggagctgcagcggcggcgcgggggccgcgagcagggtggcgcggtaggagacggtgacggagagcgtcggggaggaggaggaggcggtggtggaggaggaggaggagcaggtggagacgcgggtggaggacggcgcggtgcacgccgcgacgtcggcgacgcggacggctccgtcgccgatgcaggaggcgaagtcccgcacggacgacgggagcagcaggcttgacgcgctcaccattcccgctaccgcggcgagatctgcggcggcggaggcggaggcggcggcggcgaagaggaggaggaggaggtggggctagtagagtagaggttacggtggtggaggagtggaactcataatagcggaggcggagacggcggcgaggctgctcaactggtaactgccggagcagaggttggggaggaggaagcctttaagtctgcctgagacgatgacgaccgttggatcatcaactcgcgcgacgtggaccgtccgatcgaccgtacaggagtgcgagtggagatgtttttttccggaatcacgtgggaaaaaataccccttggatataataataaattaaattcgcgtgaaattcctgtgttgtaatatactaatgacaaaaaaaatgagaaaacaatcttttcacccatttatgcacgacaagtaaacccgatctcgaccgcattctcttctctcttttttttagcgtcattctacctttttcacctctttttaattagctatatgtgatttgattttactcttacgattacacatacacacgtactaacgtgcaaacctttctgtattccatctcttatcacatgtttaaagaaatgaaaactagagaaaaatctttagcttccctgaaatcctatcaaaagaaaaacgatgattctactacgtccttaccgacaataagcaagcctaatcagacgagaaagtaccgtcacccatttatccacaagtaatctagatctcgaccgcacaatcttctttttagcttcgagtaaatcaatttttttttaaaattattatgagggcttttggtgggtccgttcatcctttgggcatgcaggggaggaggggccataccatgatgatggtgccatgatgcatttggcgcacgaagatagatggattagacggcgtcgccatccagctgcagtcacgagtggttgggaggatggggcaggaggggtgacgaggaggaggatgcgatgagatgatgagctgcataacatgggagaacaactgttgaggcaaaatgcatgtgtctccatgcaaccacggaggagaatgggacgctctcggacagagtgttggacgagtcggagtgagagggcaaaaattggttgcaatgaactgagtagcatgtcaatactgactataaatctagacacatgcagcatgtcatgtgtgtccagattcgtagttagggtttacctttttttttggggacggactagtagttaggctaagttcctactctctccgtcccactttaagtgcaaacatgattttacgtgcccaactttgatcgtctgttttatttaaaaaaattttaataaaatttagaaacataagtcgtgcataaaatactattcatattttaacatctcataacaataaaaatactaattataaaaaaatttcaaataaaacaaacgataaaagttggatacggaaactcatggttccacttaaaataggacggatggagtaatttaaaaaggctacatccaaccggaaaatacgtactccctacgtccaaaaaaaaaggcaaaccgtgggttcccgtgccaacgtttgactgtctgtcttatatgaaatttttttataattagtattttcattgttgttgttagatgataaaacatgattaatactttatgcgtgacttattttttttaatttttttcataacttttcaaataagacgaacagtcaaacgttgaacacagaaaccagggtttgtctttttttttttgacggagggagtagactttttaagttcctaattaaaaaaaagaaaagatcatcacctgcttgtgcggcttctcttcaccttcacgagtcactggagtcaggtcatctgggtacagacagaataccgccactgatcctgacatggctgcctctccaatcctgtgggttcaggaaattttccaaggtcagaacttgagctataaaattatactaaaatatttaatataataataggaaatgtagcgatttcagctcttacactttgtgcgcagatgccgctcgttctgacattaaaaaaagaatatggtagaataaaaccggaacgggacaaaccctcacctccctcataacttaaatgaaacaaatactagcatattgaaaactttgaggtcaaatggtctgaggacacatgtattatggcatctttcatctttatttccatgtgctagtagtgttttcttcactgtgagctgacttttgtgcaggcaatgggggcatagtttcagtagtagtaacaaaattagcttaacatgaagatgaaagtagaggcaatatatgttggatgagaccgatcaacctggggagatggaaccggtggatcatgcatttggtcatggtccctggtgacatgtatgatgatgcaaaaggaacggtactacgcatcagtacggtcatacatcaaagcataggccatcaccaccaaccctctcaagattcacaaatccaatggaatactatgccaggtttgtcaccttgttacctacaggttttaatcataaaccaaaaagggtttcacctccccaattattgaggattaactaagtaaccaaacgaacgtcgtggaaagcgtgatggtgaattagaaatgaagcaaaaagaacttgtcccccttgtctcttgggctcaagtctgaatttctctgaaagttgcccgtattgctgttgagagatgattcaacaatgaaggaaccagcacaatcactgtactattcgctcttaaatagcaaaactccaacgcacacatggcagatgggggggggggtgtggggcagcggaaaaaagggttgcacggaaatgtgaccgtaatctcatcaatttgcacccttttcacctgatcattgcgtttaacccactaactgaaagaatacgccagattatagagaacgaatgggctaacctgctgtgcttatgctgaccctgcagagcagatggcccattggtccatgaataatgaatcagtctgatcagagatgcgagaatacaaaatagtatgggttataaaaatgctgaactgaagtatactaaattgagtcatgggaggacaatctgctttggggtgtgagagtgtgattcattcatcgggcacggaaaaccaggcacttgatcccagaggcattagaaaattggagcaaggtttgttgactttgtttttagattcgatgagaaaaaaagggctgtcccttgcattaagttggtaatggagaaatgggacactcacctgaaaataaggaaagcaaaggatccctgaaaatgatagacagcagttctctttagctttcgacaaccggggaagaacaaaaatcaaatgttaacacagcaagttaataggttttttcatctgatacatcagatagggtggctcttcacacaacgatctacatgattcaatccagctggcaagaagataaatgtattgccagaaagtggaagaggcaaatagtctacttgtatgttttaataactgaagatgaccaatgtacactgaacacggtttcttttcttactttcttttttttttctctttttgactaaactaggacaacttgacaatgcaaatattataagtacagaaaacacaaaagaggcatacgtggtaaagctgaaatgagacattcagctgacagcaagggaacaaggaaccctgaaaatcatcgaccgcaatttgttagttttcaaccagcaaaaacaaaataatatacttaagtttataatgtctattttgtgatactccgataatgtgggtcttcacacggaatgatctacagctccagtggatttagtccagttggcaagagcataaacgactgcattgccaactgccaacaaaacgaagaggcaaacagtaatatatcatgctgcatgatatttttagcagcataaccatcaaaccgtgtgtagcggggacagtttcttttgtctttttgttaaactaggaaaagataacgctgcagtttttaaagatacagcaagcacaagttgacgtaggaggcatttatgtttctaatctactgaacaagctgctagataatattatgcagttcgagtgaatatatataactctaactgactgcaacaaggcagttgacgagagagtacaaagccttctctgatcatacctactaaaaataagagagaaatattggataaaaattcagatttccaaataaaggcataccagttgaaaacaaacttgtcttcttctgtgcagttgaagttggaacatccccatgctagctgcaagttgaaattgctcaaaataataatctgctgatcagatcagtgtgagaagtttccattccatgatgggcccattgtttagcttgacattaaagaatccttcaacagtaatatgattccattctatactaccttgccaaaactgaaatcaagttgacgcacccacaattaccgagtaggggagtaacataaactggcattgtcttggaactctacagataagttgtactgcccatacggataggtaaattgttagtgctcatcattatacccttttggggaagccattgatgtatatggcttcatattagtagcctaaagcatgagataaccccatcttgaacagtttacagtacctgcagtaggattaggacctttctggcaacaagaaataggtatccttatgtgcattgaatagggtacatttcccttcatgagtcagttatccaagatcagtaggaaaatatgatggtacactcatcaagagaggcaaagtcaaacaaaaagagacatctagcttacatgctaaaccttaagttaaatatgagactaaactgatgcctattttttggaccgctttaatatggttcattccacagaacaggcaaaactccatctcgtaaatcaagaaaatcaagtgattttggaacctagccatgcatcggtaagccattatgctgcagaaataaatatataactaccatgaaattgagtactgcatgtgcagataaacactccctatttgagcttgactctgatgaactgaagtgttgttggcacaaaaatgatgagtttggtaactacagtacagttagctataaaaatgaaaccatggttgccaacgaaaaggacacagtaggtacatgtttatgagttctgagacagtatatattggatggtccagaactattaatgatgggaatatggttcttctctgcttgatataaacatctaccaactatgcaaaagttcctgcataaaatgtagacacaggaaaagatagcagagaagtcccagcggcccggacagctcacaatacctaggttgcaaattaagcattgtctctgcagttgtttgcatcacttgtattgtactcacaggttgcagatgtacagaagcccgttgggactcgtatgcaaccttactgtgattaatagtcaatacaaacttcatagtagatcacaaaccgactcttcaggatcgtcaatcacctcgccagtcgccaccattgctcacacttcaagttcgaacccgatgtgaatctgagctccagcatgcatctttttacgttcaaagttgtgcccacctctttcttatcctctccatatgcttcaccataacacctcaagataattccttgtttgagctctcacctaaatctcttctatccaaatgagaaatatcttcgcatatgatagtcatataatctcctgccccttgcaggcgcagataacaccaagggccgaacccaacttacagaaagaacaaggcagacaatgtagatagaggaagacacctacaaacatagtgatagtgtccatttcatgctgcgtaccaggccctttgtccatggaagattgtctgcaccgacgcagctcttgactgcagaagcagtctaatgagccctgttttcttatgacacaatgacagccatggccttccctgtagtacaacagatttatggttacagtatggcttgcccatggtgagggtgacacacacatcattgcggtttacagtactgagtctactgactgaaccggaaaacttttgtaccttaatcatataggtctgtgcagttgatgcaatggtgatttcattaacagagaccgcttctgctctaatctaagaaatgtaaatttaaaaattaaaacttacgattcagtttgtaagaaaatatgaattactgtttatgttaacaaaattgtgtatcaggaatgaagtagtgaacacgcccacatacctggaacacgccaacctcgtggttgtgacagaaattaggcagcagcaacaccattcaccatggactcaatcacccaatgcctgacgcgagcagcagagagaactgcaatcatgcccgctgcagcgagtagtccaaaggtggcacactggatgagggaaacggcagccgcagggatcagcatagaggacgccaatgagcgtggtgacaggatggacgaggcgaaggcaacatgctcccgtggaaggcagccagccggctgggccggcgaggaagatactcaaacagcggtaacacaatggtggtggatatgaaatgatgtttacatataaacagtatgatacttttactgtttagcttcagaaaaaaaggttatttacatattccttttgtttgaaagaaggatgctatttacatatcagatctacagatattaatcaagatgccagtatgtacatcagtataagatattgacatacttagctttcctgaaggatgttacaccagaacattaccttgcaggaagttagaactcttcatcagtttccatggtcctggtaataggtattgaccatcttcctagatgggctgtgtaatttgtgcatctgacaacacctcttccttttggtccatctgggaaatcgatcacactgatgctgccatcgtctagatgaaaagatgacatgtagtccatcgttaaatccagacacctgcaaatcaatgctagatttatacccggatgtcctacgaccaccagaattctttctgaagtatcatcttgcaactcatttagcaaggcttgccatgcagctttcgactggttccatagcccctccagagttttgtattccatgctgcccagccacccagactgagctatttctccaaagctctacagaagaaaaccaagtgttatttgaacaccccacgaaatgcagggagctattaaaatttccaggtaaccaagcaaccagccagtatgtacataagatgggatagctttagcaagaagaatatggtggctggcaagcactcattatagatctgatcactaaatgttgtgctttgcattatctttgcaaatattgatctccaaaaagtgttttcaatctttcccaggctagggtgccttgcgtgggggtgatggtgtgttttgggttcctttgtgggtgtcaacttggtgtgtctgcctggtagaggcgctattagtatagtgtaaaacactactctctttaatgaataggcagatagccctgccatctattgcaagtgtggattttcaaggcatgtacaggatcttcaaatattctatgcactagtaaagctactgtgacagaagccatggaacgtggaaatggtctaaccttttgctttgtttggaaggcatcatcaatttctagttctagcagtttcttcatttccacataacgaggcacacagtcagcacctaagcaatctgcagcctcttgaacctacaattcactctactatggttagatcaagcaggtaataacaataaaacgataatgcattggactaaactttgcaaattgttcagacttcagaatgtagttacctcgcatatagtagtagcagtatcaaatgctgcaacttgtgggctacagagaataccatttaccttttgatctaaaagtagttctgcagtcttctgagactgaaaacatttggccagtaatgagcttaggttttagttagaataatgaaatatacagtttgcaatacaaagaagaaaattacctgtataatcccaagcatgttaagcggtgcataccccattccactgacaccaatctgtaatagaaacagtgtaattacatacataagcagcaaagctcaacaggtaaatattgtctacctgggggtactctttacagaaatataataaaaacctttccttatacaacttatactcgaatttttaatttagttttttagtacaatacttgaacaaatgagattgattcacttaatttcccaaattaaatttaaagaactacaaagcagacctccaggaaaatagtaggtggctcgtattgatccataaaaggtgcataaatttagccagttttagagcacaggttaagatagttaaggtcatgggttcaaatcccttcattaccgttttaaggatttcttaaggtatcccttctatacttgaaatcaatgtacacagtttctccagtgaattatctttgctttcacattttgatccatagaaaaagcgctttttttttcatgcaagcatggatgcacaaatgagaatatatacctctgcactgttctgtgtagctccttgacatgctaggataatcctcttgcttgtctttctccctgcagaacttcctgaggcaacaggagaatttggcgtctgcaaacatggaaacacaattaaatcctatatttactggttttccacctgtagttctgttttgacacaaaattattttattttacttatccagaagatggtacgaaacttgcattaggcaaggcatactactaaaaggaaaaaaaaaacatccatccaactgaaagttacacacatgcacacacacacctgatttaagcggttaaggcatacagctggaggccctccaccagcctgaggggtgaaatccagcacactagcaccacaattgctctgaagtagaatccgaaagtactctgtgccaagtcctaaatgcgaaaaccagtaaaccagagatcaattgggcacaaccttggaactatagaatcaacagcaaagcctagtggcaccaacccaacgaagaggcaacaagagcctggttcactgcattatgtgcaacaacaagcaccgacttgccctcatgtgccaggatcctctcccagcagttctgtgcgcggtcccagagctcccgcactgggtagtgcccatcaatgctgaagttggccgcgttcttctgccactgccggtagataactccatacctctccttcccttcattcttcaacaatccctgcaaatattcagacagtgataccaaccaagcatacatccgttcaggcatttgcacgaacatcctgtgagcaacctaatacccgagaagtatcccaacctggaaggagtagagatcgatctcgcggaggtcagagtccgggatgaggtcgtcgtcgcggtcggcccagatgatctcggcggtgcggcgggagcgggcgagcgggctggtgaagcaggcgtcgaaggagtcggagaggagcatgaggcgggaggtctccgcctgcgactcgcccttgggcgttagcacggagatgtcggagctcccctggatccgcccctccgcgttccaggtgctctgcccgtgccgcaccagcaccacccgcttcgcctcccgcagcggcggcagccgctcccccggacgagggttcggggatctctccagttcccgcacgctcgagcagcggacgcggagggctgatccaccgaccttcctccggcgagcggcggccgccgccgccgctggtgagggagcgaggaggagcatgggtgaagcgagatgggattttttttgttgttagactcggaaaagggttgtgtggtttgggttgggtttcccgcgaagatttttggcattttgccataggaagaggtggaagcgtactaaccaaattacgcgtttggactcattaggcgtacagtggtaacaaattcaggccatgtttagtttcatgcccaaattttttttatcgtatacggacatacatttgaaatattaaatgtagacaaataataaaacagattatagatttcgtctgtaaactgcgagacgaatctattaaacctaattaatccgtcatagcaaatgtttactgtagcaccatattatcaaattatggcgtaattaggcttaaaagattcgtctcgcaatttacatgcaaattgtgcaattttttttcgtccacatttaatgctccatgcatatatccaaacatttgatgtgacggaatttttggatgtttgaagggaactaaacacagcctcaattgatgtcttctgcactacaaactctgcatttctgaaggataagagattcagagcagggttcgacttaccgccggtaaccgcgcggttaccgcggttactgggcttactgcgggggtacggtaatataaaataccgcggtaacctcctcaaattcaaataaatttaaaaaataatttgaatttttgataaattttgcgcggtttcatacggtttttcacggttaccgcgcggtaaccttgcttaccgctggggcgcgataaccccggccccggcggtttgggaaaccctgattcagagtactcattcaattccaatgacctacatgctcatgctcattgttttttttaaaaaaatattgtttttcgttctggctttacaaccaattattataaaggttgtgctatgaataactgcgaaaaatttacagcttcattaaaaacaataaaaactacttggtatacctatatcactcataaggacatcattctttcggatacactcaacctcaagttgctatgcaaggtataatagctcacatccgacaattaaatttacaggtaacctcattactaagtacttcttaatgtgattttgaaactatgccgatgaccagatagcacttaaacagaggctaggagatggacaaggctgtcataagcattcaatttaagatggaggctgaacttatatcaagttcaagtccacctcggactacaggaacaatctgcattagaatcatcgcccggatttcattcggactctgctcttgacgttttacatatgtatggaaagctaatgagatcatctttccaatgaatatggtctcacataaaaattccttccaagtcaacggtaatcatcaaaacaaaacgacgtccagaatctatcatagtgacgcgtcatagtctttggacccgttggggcttgtatcgtgtcgaagtccaataggaatgcatatagggatccaaggtcaaccctagaatcaatattgtcgacgtttgatgtcgtgactacggtatttggacagtatggggatcgttggtactagggtatacgcgagactgaggtaaaagagatggggataaggatttttatacaggttcgggcccctgaattgtcaggtaataaccctacatcctgttggccgaagccggtattgctcttattcaccataatcacaccagtataatatttggggtagtctatctaactgttgtcgacatggcgatctgaaggtctgactcgtagtcgacaacagggtagtcttcctcctcgaatctgtgtccggcgagatcagagatagcgctttcgtctctcctgacagtatccggagacaccgtaggggactagccgtgcttatccctgaaatcgatatccggcgtcttgtcttggtgtatgttggcttgtattggctttgtggtgtctatgttgcccgtgtcttctatggtgggtgtgttgattgtctcttctatggtgggtatgtggattgtctcttctcctcctagggggccttgtatttatacccataggtgtccccttgtccaagtagaactagggaaaccaatatggatacaatccgagtagtccttgtcgtttccatgtagaactctggttgtcttcccttatccggaactcttcatatatccgcaggttgtttccgtatagtacatagtatgtggtgggttctgccgagatttagtcaactactattatgtatgtggtatccataaccctgacagtagcccccgacttcaatgcaaatgagcgagttcatattctcaaccgcagaccttggaggaactgttatcgagctcacatgaccgttctcgatgagtccagagataacgttagacttcctttatcagcctcgtgcgggcacctaaagggtttgtctgagtcaatctctgacgtcaaccaagaaagtacagagcatgcgactaagtctcttgtcttgctgtaatcgagaatttggattgaatttaagaaattttatctcggcaggttcaccatcttttcattccgtattccttgtcgagatccaccaaccgttctcgagtaatcgagtaggcgtagagtctgtaacggggccttgtcaacatttgtcgtactcgccttagtcgatcttgatgtagaatcatagagacatggagtcttcgataatgtcgaatagaattttcctgaaatcaatactcaggaaagaatattagatagaaatagccccccagcgaatgctcaaaggatgacatgttataatatgtatggaaaaccgaaaatgaattaaacttacagaccaatgttttgtgtatgagcgtctactcttttaccgacttcgatcagtcagtttgttgagttatacactctccctagcccccagccttgtcgtcggagaatcgttctcggaggataaggctcttggacctttgacctgcatcggttgaacaagcactgatcctagcccccacccgtgaagttggaaaatccatttccgattacatggcttggttaatacgcacggcgagaactcttacacgaccagatcttacatggtctttcatctttgaaggatccgacaaggccttatctgctctgggcgtccccagccgaagttcccttaggttcctcggaggccttgtcaagacggcgtaaagggacattaggataggtttcaacgctaggtgtctttgtggtaagggatctctgggtaaaacacttggcgatattgtgtacctgatatcaactttgttgaagtagaggtaatgggagaatcgctacacctctggtcaagaaccaggtaatagtcgtaactcaaccattagaagtaaatgtacgagagatcgctacgattgactagttgagaaccaatgagtaggtgtctctcgatcatttgaagttgtggtacgaggaccgctgcgttattgctgtagtcgtacctcgaccatctgaggttgcggtgcgagagattgctacgtactggttcgaggaccagcgaacgtgtagaatcatctctcgaacaccaatggaggttgcggtgcgagagattgctacgtactggttcgagaaccagcgagcgagtagaatcatctctcgaacaccaatggaagtttgcggtgcgagagattgctacgtactggttcgagaaccagcgagcgagtagaatcatctctcgaacaccaatggaagtttgcggtgcgagagattgctacgtactggtttgagaaccagcgagcgagtagaatcatctctcgaacaccaatagaagtttgcgtctcgaacaccaatagaagtttgcggtgcgggagattgctacgtactggttcgagaacagcgagcgagtagaatcatctctcgaacaccaatggaagttgcggtgcgagagattgctacgtactggttcgagaaccagcgagcgagtagaatcatctctcgaacaccaatggaagtgctagagttggtttattacatgtgcgtctcatgtggccagcatgactcacacacccaacttgtagcatatccggatgtccgttcgcaatcatgtcgggtgatcaagctgaccgcgttcgcgaggaattgtccgttaacaaccttttctcgagtagtccagccatggccggtgctatgagataggtcgtcggtcttcgttggcaggttgggcgcgacgactctgcattcgtcgagatcgttctcgataatgcggtgtacttgaccacaacctactcgagtgctcaattgttcctgaaaaatattttctagaagacaagatatatagcagataatatcgagtattctctgctagcattatcaggatataaagagcagatgtaaatattaggtattatgtaaaccgtaaacaagcatgatttatacagaagaaaatagagcgagcctccagcattaaaccgttgtcggcctaacaccggaaacactcgcataatagatattgtataaaaaacatgctctaggtaaacataataaattatagatctaacaatattgtatgatctgaaaaataggtacgataaattgcatataaaataatgcgtacctgtgtagatatatgctggatatatctacgaaattagtagattaacttgaaaattaacctactaaatacctttggtttgcccagatggcatatacacatataactaaagtcaccatgcatgtatgccgtatggatgtgtgttgtctgatctttgaatctgagttgagccacgtgtgcatgtgcagttggtaggaaatcggtaattttgttgaccgtgtatcccttgacttacgtggcctcgcaagtctcttgtcacggcaagggataattagagtccgattcccacacagcatacgagcacacgtagtcgtctaggattcaggggatgagtcgtccgatttcctcggtgatggcgttgatctggcggctagatggtcaaccgatcggctctagtgaattttcagagcagacactgtgacccgaagatatagctggcgccgacgaagtagtgaactattgtcctccacggtcagctcaagtactccgattggtgaggtagatcaatttgttgacgatgatgatctcgatctcgtcgggggaacgtacttcgttcgggttagatctcccagagccgaagttgtcgagtaacttgttgtcggagaatccatctcttaaacccatctcgtcgaaaacctgaagcaccaaaatcccactacctggcgcgccactgtcgacgtttaatgttgcgactacggtatttggacagtatggggatcgttggtactagggtatacgcgagactgaggtaaaagagatggggatgatgatttttatataggttcgggcccctgaattgtcaggtaataaccctacatcctgttggccgaagccggtattgctcttattcaccataatcacaccagtacaatatttgaggtagcctatctaactgttgtcgacatggcggtctgaaggtctgactcgtagtcgacaacagggtagtcttcctcctcgaatccatgcccggcgagatcagagatagcgctttcgtctctcctgacagtatccggagacaccgtaggggactagccgtgcttatccctgaaatcgatatccggcgtcttgtcttggcgtatgttggcttgtattggctttgtggcgtctatgttgcccgtgtcttctatggtgggtgtgttgattgtctcttctatggtgggtatgtggattgtctcttctcctcctagggggccttgtatttatacctataggtgtcccttgtccaagtagaactagggaaaccaatatggatacaatccgagtagtccttgtcgtttccatgtagaactctggttgtcttcccttatccgaaactcctcatatatccgcaggttgtttccgtatagtatatggtatgtggtgggtcatgccgagatttagtcaactactattaggtatgtggtatccataaccctgacaaatatattaagtagtgatcattgagtgaaggttgagttttgtttagtatttctaccattgcagtttcaccgttcatcggtttatggaattccaatttcaagtttttgattaatcattcatctgcaattgagttgttgtctttcttgttattgcttgtgttattcgaatctgcacgcagggattagcttttctagcaaggctgatcgggttttggcataaccagatgagacatgatactatgattgcatagtttggatcgtgtcgattggaaaccgaatcgtgtgcgccaagttttcgccaaatcgatagttgtcctcacttgacagaagatcaggcatcccgtggcaatcaaccacctaaggtagatattttcatttatggttggccggcgtatatataatctctgtaccaacaacttataagttatatacagtttttatctttctcaaatcagaaaatcaaaatccctgaaattagcggacgattctcgtcgatcgaatttcatagattttggtctctttggtcatgttaatagattgatcattctattgtattttctctttgcgagtatacaggtgataacaatacattttggtctgtactttttgcagaagcagaactacgtgttggcatccatataatggtaaaattcgaacagaaaaaacaaaatctgtacaagcaatcacaaatcctaacccaaaataaaccctatccaaaactacagtgcagctattttcttcaagaaacacacactgggcaagaattcacaagccatacaagctgttcgtctgatccatggatggatcacgacttgaacgagctgtttgagcttcccatggacttgaggtccttgtacggccccgacgacgtcagctcctgctccatccccccggcgcgccgccgccgccgccgtctctgccacagccggtgacccacgtacgctccggcgacggccaggctcgccaggatcagcgacagcgccgccgtcacggccttcgcgccgggcgacatgccccgccgcgtcgagctccgcggcggcctcctgaccttgaagtagcccaccttccggtcgtcggcctcgtacaccatcgtctccacggggaagtcgaggaggtagcagtagccgctcgcgccgctgtgcaccgcgccccagcagctgcagttgccggcgcacgcctgctcgcactgctccgccgtcgcgttcgcctcgaacggcagccgctccttgtacgccacggacacccgcttcagccggacctcgtcgaacacctggccgccgtcgctgtcgccgtcgccgcagaggtcggtggtttcctcggcgctgcacggtggggaggtcgcggtgctgttggtgaggcactggcacttggcctcgccgccgccggggacgcacaggccgtacgcgccgcacgaggtcggcagctcgcacggcgccgtgatggccttgtagtcggcggtccatgccttggcgtcgtcggtccagtagtacgcgcggaggttgccgtcgtcctccagcgtcatccgccggaacgcgccggtgaggttctgcacgaacgtgtcgaacgacagcacgtcgaccttctcgccgctgccctggaggtacagcccgaagaagccccggccgtcgaggcagccgtacaccggcggctgcgtggcgttctccggctgcgcctcgagcgccgtgtgctgccagtacatcggcgtcgccctcccgccgtagaactccatgtgcagcgacatgtacgtcttggcgagccgcagcgcgaagcggcggttcccggagatgagcggcggcgacgacacggtgaggttctggtccaggacgagcgtgtccgacgggttgtcgaagctctgccacgccggcgcgtctccgcgaaccgccggacgacgaggttggacgagttgagcagcacgacggtgtcgccgatggcgttcagcgtctgccacagcacgccggcggcgtcgtcggcgccggcgaggacgaggccggtgtcgaaggtgagcgtcgccgggcgcgaccagtccccgacgcgcgccggcgtggcgcgccagaccgggaatgacgaggcgaggtgcaccacggcgaggtccagcgacgccgcgccgacgcggaggaacccgaaggcgaaggcgccgttggccgcgtacagcaccggctcgaacggcgccggcgcgtccggcgaatgcctcgccgtgaagccattcgacagctgcgtgacgcgcccatctcccttggcgccgtcgacgacggcaaccatcaccggcgacgccacgcagagcgccgccactactccggcgatcgccggatcacctttgtctaacctcatttcatcgacacgacaaaagaaacctcaaacgactcggatttcggacagagtagcgcacactacatacatagtcatatataagcatcacaagaagaaggtcaacggccggtgagaaatgagaatgcacctccatttggaataaatccacggccaaattaattaaagaatgagaattaacatgccaatggaaacctttgcatcatctgcaagctgtagttaagttgggactaatctagtggcagccatgcatgcagtgtgtgtatgaactgtccaaaagtcaacccttcgtttctctgcctaccattatctgattctctctccgttgaatggcccattaggatcagtagtaaacgtggtaaaagatttgatattgcttggtggattgctgcttgttcatacttcacatatgtgcagcaactagcaattgttaaacattcaggtgtcgacatcattcagttcatcagacaaagtgattaaccggtgagatctcttgtttgtgcaggcgtttacttagtttagcttgcttgcagatgcatatcggtgtgccgagtatttgttaaatctgaatgtccagttgacctcgaacggcttgaaaagaactcaaataatgtaaaatatattcctcagattgtttattgagcaaatcagtcacctgtcatataaggatatgtaatattcaccgtatggcatttgcagatttcttttctctgttggaaatctcaaccaagacttgtatatgaatgaagattgaagagtcctgtgtgccatttcaattcctcggttttcgaataattatcgctattcagtattactctctctctctttgacgtaccgtagagaaattagggatatggtttttctacacctaggtgtacactaggttacaatgaacgtaaattctagtatgattgtattcataacgctgcacacttcaataatataacatttttctaagtttttttttcccaagagaataaacagtcaaagtttgagattgaataataacattgagttactattcgagaacggaggtggtaataagacaagccaaaattttctgcaaagaaatgatcaaatgaagtactagaagtacatggtttctagagaagtccttactggaattgctttaagttgactttccaaagttgggaaattgcaccctttttttttctaaggaagaacatatgctgagctttatttggatattggaatctaatggttctccccatgttataagatatggaatcactttggaaaatgaagagctacagctttggggtcaacttcatgtcttcaatcccctcttgccggccgtatgtacaaggtgcttaaacttcatgtctatgatccaagttagattaggtgcttaaactctaaggttgcagtgtattgcaggattgaaagaatgccaattccattagattctacaacgggtacaaatttacaagctgttactgcagcatgtaagtataattgttgccatattaatttgttctgtggtctgaagtctaaacagttctgtagtatagtgaaagagcacacgaagcatgtagtagaaaaagagcacacaaaattcatcagagcttcagatgaccaatacatgtaacaatcagttccaattttatttctttcatgtcaaatttcaaactctcatattcaaataacccatataaaccaataatcaggcgaagtaaaaaagaagtatcgaatcagttcaagaaaaaataattatggccttttcacatttcctttttatttttgagaaacacatttcaattttttaggaaggccagatggctcgacttgtattgaaactctgagagccagactgccagatagggctaaaataaataatagtatatcacatggtagaagagaattaatttataatggagagggaggaaaaaaaactctcatatattaaatattagtattcatcgcgctgtattttcacaaaaaaaaacagtttcttcttttttctacattgtactgtcaataaaaattgcgtttgattaacaactaaggtgcttgtccgtcgggcgcgtcgtcttggtcgtcgtcgtcggcggcgggcagcttatggcggcacagcgggcagaagcggctccgcgccagccagtcggcgaggcacgcatggtggaagctgtgcccgtacgagcacggcatcacgctgatgtcatcgcccacctcgtaatcctcgatgcatatcacgcattgcgccgcagccccgccgccgcccccgcagccgtgctt

SEQ ID NO: 64062 - DNA, 5040 bp, Oryza sativa
ccccccccccccccccccgcgtctgccataggggtggtgaagaagcctgcctgcgcccgcgccctcactgaaaagagaagagagaaaagagaatagaaggagaagaaaaaaaatgtgcagcttacatgtgggccctatgtattttttaaaaatattttgctgactaggatgccacgtcagcgaaaacacccatatatactgccatagaaccttgagtgcacgatttgtgtgaatttaggggtacatagaaatttctggttttgtggttaaggaacctcaaaaaaaatctcgctgttaagttgagggacctccggtaaacttattccacgtgaaaatgccggtatggtaatattgataattgagcccacaatattctgttttttttaaaacaatcttttagacgcgcgcacatcacacttaattacacacacctaggtttacaaatacgaccataactgctcgggtttagaaactatcgataaattggccaagttcaaaaaagaattcaaaatttagtaaattttgttcaagtttcactgtttttgtccccccaaaaaaaacactagggagcggttttcgttgacgaattgcccttgtatgaaccgttctcactcaagcacgctggtttttgctttgcggcgagccgccggtggtgttgctcctagctaggccctagctagttaatcttcttctccagcggattgtgtcgatcgaattcaattcgaatctcatctcacccctacatagtggatcatgtacgtatcacgtactcatctcctacacatcatctccaattaatctaattcagattttctcagaaagctcagccattacatcatccaattgcatatttgcattctcatctccatgaaaagatcgaatccggttccttcggccaactcatgtcccttcttctccacgtcgtggccgacgccgcaaaagctactccctccatcctatataaaatatttgacgccgttgattttttttaaaatatttgaccgtttattttatttataaaatttaagtaattattaattcttttcctatcctttgatgtattgttaaatatacttttatgtatacatatagttttacacatttcacaaaaatttttaaataagacgaacggtcaaacatgtttaaaaaaatctaacagcatcgaacatttaagtaaataagggagtaattttcagctgtttgatctcgattgccgattaattagttgacctcttcgcttatcctctacacccgtctcgatctttcgctcaattccgctttaatttggtgacttggcgatcgatcgagcgagcgcgccgccggttcgccgccacgtcgccgcggaactagaaacgccggcgccgggagggaatccggtaaagccgtaaattaaaggtgagtgcatgcatggaatcttggaaaattggaatcaaagctaagctagctaagctaggagagattgtgcgaatcatctagctcaaaattaatctctctctctctatatatatagcttcatggctgggcgatcgagctgcaacgacacctgcaggctagctagctaacaaccagctgagaggttaattaattatgatttgtatgagagatcgatcgagaagaggagtagcgagggagaggatggcggcggtgagcgtgggcggcggcgggaggaacatcggggtggcgatggacttctcggcgtgcagcaaggcggcgctgcggtgggcggcggcgagcctggcacgccccggcgaccggctggtgcttgtccacgtcaagccctcgttccagtacgagcagggcgtcgcccacctctgggagcagcaaggctcacgtaagcttactgctaccactgtcctatactacctccgtcccaaatatgggtaaccgtggatatccgcgtctagtatttaactgtctgttttatttaaaaaagaattatgaattttttttaaaaaaatactattcatattttatcatctaataacaataaaaatacaaattaaagatttttcaaataagacgaacggtcaaacgtcatgaacagggtaaaactatacttattttgagatggaaggagtattataaattgctttaattttttttatagctaatttttaaaacatttgattaagtttatatataaaaaaaatactaacatacgaaacaaacgtatcactaaaacatatttaatggaactaatttagtgctatagatatagcaatatattttttttataaacttagttaaatccaataattaattagaaacaaatttaaaacgactttgtaataccaaacggagagagagcagagagagggagtatttaatttctttcttctagcgcgtgctaatggcgattcctcaccggccggagtgcagcgatgatcccgctggtggagctggccgacccgcgggtgagcaggatctacggcgtcgcgccggacgcggagacgatcggaatcctcaccagcgccgccaaccagaaaggggtatatatactgaatggtttactgttcgatcgtctgttaatccttgtgtggtagtagtatatattgaatgcccattggtgatcgatcgatgatcactggagaaatgaatggatggatgcaggtggaggtggtggcgaaggtgtactggggcgagccggcgaagaagctgacggaggcggcgcaggggattcccctgcactggctcgtcgtcgggaacagaggcctcggcgccgtcaagaggcaagcacatccatgcatctctatctctctctgtatggtggtgtttgtttctattaaagagaagataaaattaggacataaaaaatgaaaatatattagcgtataattaattaagttttagttattatatattttaaaattgaatttatctaatattttaaatcaacttttttatataaaaagttttcaactagagtatttagcaagttaaaaggtgtgttagcggaaacttaattaggaaataatgggacatatatctatcatgagtatcaatcatctcatgatagtacctactccttccgtttctaaatatttgacaccgttaaatttttttaaatatgtttgaccattcatcttatttaaaaaaaataagtaattattaattcttttcctatcatttgattaattgttaaatatacttatatgtatacatataattttacatattgtattttacaaaagtttttgaataagacgaacggttaaacatgtgctaaaatattaacaatgtcaaatatttagaaatggaggaagtactactaataaagtactagtacgtagccgatcggtaagctgaattacacggcgaggaatttgtttaatttgtttggttaattaatttgttgcttgatatatatgtagggttctgatggggagcgtgagcacgtacgtcgccaaccacgccacctgccccgtcaccgtcgtcagggagaacctgccgcctccgccgccgccgccgcagccaccgcagcccgtcgcaacggcggcgagctactactgatggctgatcagctgcgatttccccacgtatgtctcggtcagctgtaaagtcggttgctgtgtgactgggagtctgggactgtctctgcttgactgcttgtgcatagtaaaaaaaaaaaaaaagggattcctaaaactgtacttttgtaataattttgtaaagcaaaattaatgttgtaccatcttcgtcccaaattataagaatatatatgttacaaatattgtaacactagaccattctgattttaagtttttatattttgaaagggatggatagttatgtgtgaaagtattggatcgatcagtcgttgaacaaaaaattctagctagtgtgtgtgatggtgcagctgtagatatacacgaatctatcattcggtttaaaattctgatatccataattaaacgatgtgcgtgcttaattataatcggtgtagaagctagaagatgctttcagctttctctatcctaagaaagcgaaaaatacttctattactatttcctacgaaagtatatagacttttgtgtctttgagatggattcaggctcatccgaacaaggacaaagtcatttacccgttccatcatttcgtttatgtttacgtttgtaaactaaatttaaattttaaaatttaattttatagttaattttatgttttttcatcatagtttattttatataatttgctttataatcactaacatggcgtatataaaaattttactataagctattttttaagttaataataaatggacacgtatataaaaaatttactataaattattttttaagttagtaataagtggttcgtaaaagcatagacctatatatttgtcaacaaattttctcctaaaaatttaatagatgtaattatagtataatcatgatgtaattacactgtaacttattacactataattataatgtaattacatcaaacaaatttttagaagaaaattttgtcgacaaatgtataacaaaatgaaagcgtatgcataagtgagtgagtatgataatccccagatcaaccctacatatgacgggctgaattctgacctacgtgttatacagcccagtcagatgagcttcgacttgtgagtgcgtctggctgggccgaatcaaagtaatataaggaacaagttcatctgaggtgtcttaacttgttaacgaatccgattttcgttcttcaataaaaaaaaacagatacaaacggatcccttaactgccaaaaccggtacaaaataagtctcaagacgatttggacggcaatttaagctgacgtggcgcctacgtggcaatttaatttggaaaacaataaaaactatggcccccacaagtcagctacaccaaaaagattaattaaaatggtgaggcccacgtgggcctcatatgtcattctcacccctcctcttcttcctcctctctccgcatcgcccctctcttcttctctcttcacgtcgaggattcgtggactacccagacccgccggcgttgaacctagaggtgtctccattcctcggcctaccttcct

SEQ ID NO: 64063 - DNA, 17479 bp, Oryza sativa
ctccacataatcagtaacacttctccattgttagaggagctgctttcgctcatttttctcacgtcttctatcattcatgctagcaaaacaagtgcatcgtatagctaagaaacgtctttgttgctgttgtacatgttgtaaggaaccttatatcttttctaatgtaaaatttaatgtctcatcaagatcgtaaattcctttcctttcttgaataaaaccggtttgagatatctcctgagcatacaaccataaaaatgtggtctttgtcaaacatggaagatcagaaaaccacatatgcatgtaggcctaaacagtaaaaaaaattattagaatctttcactcatgcaacaccaattgagtccactgtattcacttaagttgtctatactatcatcaagagacttttaaaaatttgctatatacaaaatgataatagagtgagtaggttatttaatatcatatctctctatcttttactcaattgtctcttagtgaagacacagcacagtgatgaggcatcagaggggcatgtgggcccatagaaagtgggccccacaaaatcagtaacacacgtctgtctttagaggagttgtaaggaaccttatatcttttctctataccaagtcatcaaggttatagtttggttgtttctttaaaaaaaggttattgtatttttttggtaaaatttgctccaagacatcatagttttgatgttataaattgtcgcaagctatggtattggatatggaggttaataatacatgtaagaaactttctaggtatggattattttttttcatgtggtttatgctaagatgatacccggagtgtcaactgtgggtcaattgaatgaatctaccgattattgaaggggaaaaaaggtgcactttttttgggaaaagcaaaaccacatgcaaaaggaaagtttacgtatacacatgtgtgcaaacggtttaatgatgatttgaaatggttcagttggtaagcatagctattcttaaggctaaacacaacaacttgaaattcgataataaacagatataaaaagcactattttaaactatttgaattgatccgtttgagaactttcacaaatttcgtcattttgcaacaggcaatggctaacaaaaataaactgatcagttgctctgaactttgttcatatctggccctgagcataatcatgctgttgagacaaatttaaggccaacctggttgaatttatgaagacaaaagtgccagagccaagctactgctttgaccagtaaatcctagcgcaatatatttatgaaactataacattacaaaatcattttttcgagataatacaagagttccatgcagcttatactctcaacaagctctatatagttctatgctgtacattcaaaagttagatgacacacaagtccatcatatacctcaatttacagtagtgtagtttttttttgtgtgtgtgtctaaattaactctaatatttcaccaaaccatgttttgcctgtctgatactctgatcttgaactttggtaccttcccaattcacagctagcttaacaaaaatttgcattcgcaggagtttccagtagagaactctagccacatcactaacagcactactcgtgtttgtgtattatgcaaattccttgctggtgacatcatcttattcaaactcattctgatacccaatcacatttagaggagaacatcatcgttgtcatctccaaggattgacagagagaatggtgcaattgcgacattgaatgtagacgacccagctttgtcgatgtgcttcatctcaaaatcaccttcctaaatccaaaagagaattcaggtaagtttgctttgcagacatgcaacacgcaaacaacctaaacaataaataaattgcaggatataactagtctttcttaattgaacattactatttcttctttcagcttcaatcaaaacaattgatctagataccatgttaattattgggcataaattgatgccagctatatgcaatcaagagatattagaaccatacgaatctcttgcacagctagaatctaaaaattactttacaataacctatttacaagtgtgacaacataggttgtggaagatttagatgttaccattctcccatttggtgtgtttaatgggcatgcagatgagtactcaaaaccagtccttggaaatatgacaggttgctctcccacaacacctacacccctggcatggcaatggagcaagtctttattagctttaacatacggttcttttggtaaggtgagagtacaatagagacttaccaaatgttctccgtccttccatttgcatcagtgacaatccaatgtcttctgagaagctgaacagggcgctgagaattatttgtgattctgattctgtaggcaaagaagaactggcccttcaaaggctggctccggctttcaatataaacactcctgacttgaactctaatcccctaaattcaacattaaaaaatatcaggaaatctagttaagctcaatgaagaatctgagaaaatatttgatctacattaactaaagaattattacagaacaggtgacgaaaccaacggaggtggttcatctgtagtgcatgagattttcgtggaaaaaaagaatggggcgcctgaacatatgaaagaaatgaagtggtgcccaagggccaacgcacacagttataaccaactcaaatagattcttgatgaccttcacgtattaatctcttattttccatatcctgccttagctatttttttaggtcactacttgatacccaagttccctggtgaaattgcgtgaccagctgggggttttaaacactaatatactgccatagacaatgataatgtttcatagcctcaagttttcaaatgaccaaaccatttcattcaaaactatgatactttatcgagtgaaagaaacatgccagagttgtagtataacatcactaaatcattggattgtaagataccagggtagtagcatcactagaacattttaggagggcgtgtggagccaaaatcttcagttcatctctgtacttagcagcatcctggaaagcatgaaaacagagaaaaatcataaacatggtgaataaaagatgaagaaagaatgccttctagactgacaaccagggggtatgaaaatatctacacaaatcactattggcatatgattagcgtaaggagcccaaattcagcactatgtaatgatgaattcaaagttctggtcatgaaaacacaactccaactattacaagtagaaaagtcaacagtgaaggaagtaagtgaaacatgtgtattgagatgatttcttgacacttgagatttcctctcattttccgatgttatcatacaatatacagcacggagagaaaagaatcaagcatacaacaaaattgttgcatgtgcagtcgacaaaaggacacatcaggcatcactataaagcggcttttggcattttcggcagagacattgcagcaactaactgaggctgcacgtctttggattaatcgtcaatccacaaacatcgttagcaaggatggattgggacagtctcacaatccaactttgctaatgcctaatggggatatcacaatttacaggattctttttttagactacaattcacaagattcttgtatggaaatgtatcaactgaaacaagcaaatatggtaaggaaacaattgctatggatgtccaatacctcgaacctctcctcctcaaccgccttcttgagcgatcggcggagacgaagaactggctcctcctcctcgaatgacttgagcgaatccctcagcctcgccgcctccttgtaatcctgcaaccaaattattccaattcgcagtaaaccccaattcggatggattcgattgcaagttcgcttgttgaaagaatccaatggagctcgtctcgtctcgttacctcgaactgggcggccacggcgagctgctgcttgagcatggcgtacttctggctccgcatcaggaaggccgccgccttctccatccgcgccgcgtcctccctctcctcctccacctcctcgccgccgccaccactccccggcgagttcgagttcgagctcgagttcgcatccggcgacggcgacgacgacgacgccgcggcggccagcaccacccggcgcggccccggcgacggcaacctcgcggttcttgccctccgccccatccacaccgccgccggcgccgccggtgccggcggcgagctcagcgccgcccactgcatcccaagaaatccgaatcgaccccccaagaaatcgaattgagcgcctcacgcagagagatcagcgaggattcttggagagggtggcttggccaagattggctcctcttccctcgccgtggctgactaaaaatgggcgccgctcttggcccccatttctgtggctctctccatctccatcgccgccaagaaacgagagggagaggagtagaaaaaaaaaagaaaagaaaagaaatgtttgggcttaactggtgcggattagcgattggcgcgtcattattggatcagataagaacgatcgacatgttggaatcgcacgaaaaagatcccggattttgggtgtgggcacaggggcagccacgactccgcgattgcgatcgacggagaaaaacaacaggaaatgttttgtatgctgttagtgttaggtttaatagtatagcccactactggcatcaaatcatctatagccaacgtaatggtcaattcatataatagttgcttactatcctattaatagctggttccacctgtcatacacacattacgtcttggagtccgtactgcagctagctacagatctgtagtccgctgctcttctctctcttactttatctctttaaagtatgtttatagctagcttatagcctgctattgtacctgctcttagcttctttttgtgtgtttgattatgtggctagatttagggtgtgttggtaagttgggattggaaacccatctcctccgcacgaaaaacgaagcagtccgttagcgcatgattaattaagtattagctatatcaatatgattttttaagcaactttcatatagaaatttcttttgtaaaaaaacgcaccgtttaatattttaaaaagcgtgcgcgcggaaaacgagggagaggggttgggaacttagagcaccgaacacagccggcatgttcttcccactcatttctcaactaacatccctcgttttcggcgttcacgttttttaactgctaaacgatgtgtgttttaaaaaaaattacataagaaagttgcttgaaaatcatattaatatattttttaagtttttttactaatacttaattaatgttgcgccaatcttttactttgtgtttccatgtgaggaggcaaggttaactcaaccttatcagtctagttaccccgcacgcagtcaaactaatttaagtttaaaatatatatgattatactagtaaaatataggaagtacatttgcccttaagcgtaacacaatttttgtgaatgtccatgataaaaaaaagataataaaattgtccaatagattggactcatgaaggtcacaactatccgcccctgcttgtagaccagatgacacactactaccaaataaccaaagtggaggtctgcatcatagagaaggttctcttctcagttctcaccatggccatgaactagaatgccactaaggctgtgtttagtttaccgtaaagtttagattttgtttgaaattgaagatgatgtgactgaaaagttgtgtatgtatgacatgttgatgtgatggaaaaggacttaagtttggatctaaactttagatctaaacacagcctaagttttggttggctcatgatttagatgatcaagtgaatacttgttacagtgggtttaagatttggtttaagaaatagaatgagtttatccatcatcacttcttaaaaccacacacttaggttaaaagaaaggtatattgcatattgggctacttattgttgccaatattgtatattagatcaagaatattcgatctttagactttgaactagataattgtacatatgttttacgttggactgttcttatcttctttgttgatctgaaagctgttgacaccttctaagttctaacttgaggtttgcccctttcctactctcaagctcaggcacgtatgtgttaattagccccaaactcaagttctgcccttggccccgccaccatgttcgacctcaagcacaatctttatttattaacctgagcttaaccttgagtagatttggaggggagtaaaataaaagaagtatattagtcatgcgacctaacttgagtgatatgattgactcatagatatactcctactcaagcaagtcagcaacgcctattagagcaggtacaataacagactataagccagctgcaaatatattttaaggagataaatcaggagagagaagagcagcgggctacagatttgtaaccagctgtagcacggacttcaagacgcagtgtgtctatgacaggtgggactaggtattaatagtatagtatgtaactattgtataaataagctattagattagctatagattaattggagctagtagttggctatactattgaacttgctcttagtgcatagctcaaggcatcataaatatgttaccactatcagtgctaaaatgtggtggtggtgggtgtatagctcaacttacgacatcataaatacgtggggaggcaaccgatgaggagtgagaactgagaacattaatacttattactcacctgatggcatcttttcctccatgaagaggaaagaatgtaagcacagagaagagccgtagaaaagcaggatgggatcaatattatgattgaaattgaaccttttatgaaattaactaatctaaaataaaaatattctataagaataagtagcctaaaataaatttactaaaaataaaacgttccatcatattattttgtttcaaaacagacaactcttttgtcttgcttgaaaaggctcaagatgatggcctcatgttgatgaaaaaaatacacacactgatctaagagatttgcttagcttcagtgcaggtccaaggaccaaatttcactgttaacaccccatccattttttcaatgccaaccaaaaatgatttactcctaccttaatgcgtttagtctgagttaaaaccttcgatgaatttcagaatttgaataagtactcttctaaagtgtacaactcagaatttagaattcttttaatgcaatgccaaaacacgccatctattttagaaaaaaattaatttttaataatgaatttggatgagcacttatccggattcctcctcaatatttgtaatttccctttttttcttaatggagtactcctgcagagatcccggtataggtgtacaactccatacataaatgccacgtcgcattcagtatgtggggcccacaacgccatagccgccgggcccattccctgccactctgccagtgcccaccacgaaaaaagaattgaaaaaaaacactgtaaaaaaagaagcctttttcccctcataaaacaagtttttttccctctctctttagtctcagaagaaaaaaagaagtttttttcccctctctctgagtctcaaaaaaaaaaaaagaagtgttttttttcctctctctctgagtctcagaggctccccgcgcgcggagccggagaggcggagagcgagacggccaggtcgccgtcgccctctctcctcccgcggcttccagtggcctctcactcgcgccctcgcctcgccgcccactcgcgccgcagccgcagccgcagccactcctcctccataagtagcagatggcgtctcctccaccgcgctctcgcgtccgtgtccgcgcgcgcgttccgcgactccagggcggcgttcgatcgatttgatttgatttgaggcggcgccattgttgtgaccaagaaaccgtggacgcgtggttgtggaacgcggcgtggcgaggcgagatgcaggccgtggcggcggcgacctctagagcctgggcggcctccccgcggcggcggcggcatgtcgcctcgtgttcttctcctcctcctccgacgacgacggcgacgacgactacgtcgtctctcaatcgatgcccggtcgccggcgcgggcgcgccggtgctgccgctcggcattcgcggggggcgcatgctgctcgcgcccccacttctgtggaacagcggcgccgcggcgaggaaggcggcggtggcgacggccgcggcggcctcgccaccggcggaaggcggcgggaaggcgaacggcggcgccgtcgccggcggcatttcgcggacggtgcagctcggcgccatgatcctcgtctggtacctcctcaacatctacttcaacatcttcaacaagctggtctgcacatatatttttttcccccaattcgtcaatttccttctccttctcgacatgttctttttcgtctctaatttgttcatggcggatcttgttggaatccatggcttgcaggttctgaaatcggtgcccttcccgtacaccatcaccaccttccaattcgcgtccggatcattcttcatcaccctcatgtggttgcttaatcttcaccccaagccaaggctctcccttggacaggtaacccactgttcttgtcaaaaaaaactggaataatggaatcttctattatatactaaaagtccatgagactttctacaaacgctctcaagccgccaagtggcgctctaataaaatagagaaaatcctagaaattctaagaaaaaagaaaaacaactaccctttgattttcacttaaattggtgagtccaatattatacaccgttagataaaatcgatcttaaaacaaactaaatatcatgggtcccacctatcttcctcctgcacgttggcaggtggcaggtggagtatatacgtacgtatacattatacgtacgcttccttcctttttttcttttttttttctttttttcttttccatttatatatatatatatatatatatatatagtgcatatattttttaaataatcataattttacaaaacaaagaatctaccatcatataacaaaaaatcttcctttcaaataatgcactattttaaaataaattttacacaattatattatgtacctattaaataaacaatatctatattaactaatttatacgtgcacttaaactgatggccccattatataaatcatcggatctattttttattacattggtatattattctcaagtaatgcactgtttcaaaataaggtctacaccattatattgtgtacccattaaattaacaatttaaaatatatattaactaatgtacacttacactagaactggtggacttattattataatcatcgtatctattgtttgctaataaataaagcgtccgaaattcttttttttttgcccgctgcacaatgcacatttgcacctttgcctttcgcatgggtgacaaggtgtagtgtttgagacatataaggtgatcacaaccaccgtagagctaccgctttgccatatatcaaatcatatatggagatgattaattttgttaataacatgaaaagaaaattaaaggtgtgatgcagcgagagaataattaagcaccatgggttatgtttttctcaacactaattagctctgtttaagttgaaaccgagagttgattatataataattataatgtatttgtgttatgtcgtatttggattttgtactatttgttcgtaaaggtgaaagggatcattatgttataaatgtgagcgtaatattgacgaatattaatagaactcttactatgataagggtgataaagggagtttaaggccctttatttttttcccgattccatattttggatttttgtttgcacactttccaagtttctaaatagtgtcttctttaaacaatattctaactttttagaagtcaattcatttgttatacccttaaatagctatcacataaattatataattcattaatttcagctatcctgaaccttaagtactacatattttttttcatgcgagtcatggtgataaatcattaaagtcgtaaaattaatatgtaagagttactctgaacaattgtaaataggtgtcaaaattaattgctattaattagacatctaatggcttgcaagccacaaaattaatttcactctacatgtatataaagatggacgaagttggaacaaatattaccatatgtcccatacatatatattgcacagttaatattctaattacatgtgttaagtcatttaaaattcatgaaaatgctctcaagctgcgacgtggtgctctaataaattagggcaaatattagaaattctaaggaaaaaaaaatcaaagtatctatttcttgattttcacttaaatcgttaggtctaatattataaaccattacattaaattgatcctagaacaaactaaatactacgaggtcccacctctcctcccgcggcatacgtacgcacctacttacatgggtacgtacgtttcccctcccttttttcattttttctccttcttttttttttaccatgcatatgcttccctccctttattcctatatcatacgtcttcatgagacgatttaatcaaaagaattttgagtatcttgcactcgcatttttcatttgtggccatactacacggtatatatatagatggactatatgataattaactagcaatacctttcaataatataagtgcccgtgcatacgcgcgggccaccttcctagttattagaaatgtcttatattgtggcaaaagtttgtgtattggaatactacaatacaattctagaaatgtaatgaattgtggtaaaaaaaaatgttgttagtgcagtatgcaaagatcctgccattggcattggtgcacacgatgggcaatgtgttcaccaacatgagcttgggcaaggtcgccgtttccttcacgcacaccatcaaggccatggagcccttcttctctgtccttctctccgtgttgttccttggggaggtacatgctttgttcatgatttttatattttgtcttaaaaagaggagacatataaccaaagagactgatcggtttatgctttgaaacaaatcgtgtgtttcggcagacaccctctttcttggtcttaggttccctcgtgccaattgttggtggcgtcgtgctagcatcgatgaccgaagtttctttcaactggtcagtggtatctattatctttaattccaatgcctaagaactgaggagtccttgatgctttgacttctgtcttcgtatttgtttaagcaatacaatgcattttgttgtaatgtagtatcgtgcaaaacttttgataaaacaggataggattttggagtgccatggcttccaatcttaccaatcaatcgcgaaatgttttcagcaagaaacttctggctgataaagaggtgattttcccaacccatgaagttgtgtagttcctcctacaagaatatttttcagcacaaaatgtatattcggacatttacagtatggtaaataccgtgaagcactgtatacctttacgcaatttgttcatatcgcaggaaacattggatgatataaacctcttctcgataatgactgttatgtcatttttattatctgccccactgatgctgtctgtggaaggcatcaagttttccccatcgtacctgcagagcaacgtgagtgtttgggctgttctgtattatctttgctaaccaatgttttattcaaacactgtctttttgggcatgtagggagttaatctacaggaactatgtatgaaagctgctcttgctggcacttgttttcatttttaccaacaggtgggctaaattccagtataaaaatagtttttatggttgtccaacggttcttagaattttgtagtaatttttatggtttgtctgcatggatccaaattttctagtggtggctagtaatacatgagtgtatctgcaagtttttttaattaccatggtcaatctctttcggattttgtttaattaccttaaccaaaattatttttgtttctgaggcaggtttcttatagtttattggctagagtatcacctgtgacccattctgttgccaactgtgtcaaacgagttgtggtcatcgtctcatccgttctcttcttcagaactccgatttcacctattaatgcccttggtaacctcacaaccaaattcaactgatcctaacagctcgcttttcaatttacccgtactgaattttgtccttttttctgcattcaggaactggcgttgctctagctggagttttcctgtactctaggttcaaaaaagctaaaccaaaggctaagactgcatgagtcaacatacacagctgcaatttaactagaagattcaggtttatctcttcttgaggtgaaatgggccgccaagcaatcacttggcttctctccaatttgtcttttgccagcttgtctgggtcttagaagcttgtgtataagatttttctcaggaaggtagtgatggaccggcaccaaaataacaaaataacattgtcagaagatttctcaagagaaatgaattttggcacatacttttgaaattcctgtccaagaatattgcctccttttttactggttcacttaaaatgtgagtagggatttttattcattccttttgaatttggctgaatgctcaccagatcagactacagtttgcatcacacaaaaagaaagtttagaagcttctatcttccgcctgttcttttttgtaggccatgaaactgtagaaccttctctctctgttttttttccttggtaatgggtgaaccagactggattgatactctagctggtaattgacagccatactagccagtcaacagaagatgactcctttgtggatgagaagttgggaatacattcaccataaaaaagatcaaagttgaaaggaaaatgttgaaaagagaacatgaagcaaagaagctgaggaggtccttgtcctacttcttgttgagagaaggatggcgcttcaatgattggtctatccaactattcaacctagcaccactagatgtttattttattttcttttcttttttgaaaccaaataaaatgtttattgttatagtgaataaaatcccaatttcaagggtgctactattactatctggtgtagaaactgttcctggattgaatttttgcagtctaattgatgatatgacagacaacaatacagtctcaaaaatatgtaacgccgttaactttttacgtgatgtctaatcgttcgtctaatttttttttaaaaaaatataaatttcatttattttgttgtgacttgttttataaaaaaaactataatcttaacttatacttttacatgtttatactaaattttggaataagaggaattatcaaatgttatgaaaaaaaatcaacagcatcatacatttagggacggatggagtatatagcagaaatgcaacaaaatcaacaaagttcaaatccatagtgtgaaactagcaaatctgtcataacaaatagcaactcatcatgatgtttcactgcattaatgcagttgttattgtccaaaataaatacagaagccataaactagtgtggtgttcttattcaaaagtaaaaaaaaccaaaataaatctcttctcattgacgataaagcgcacagagaggttaatttagctcttctttaagtggtcaaaattggcgggaggtagtcggatttggcgccaaggatccgcgcctgggtgtccgggaagaactccacgccggggagctgcgtgatggtgccgtcgccggcgacgccgacggggtaggtgagcaggtggccggggaggtcgcgctccggcccgtcgccggcgtagaggtcccagcacctgtccgccatggcgttcaccttgcgcacgcagtcgaggctctccggccgctggaacgcctcgtcgacggtaccgaggtgctcgtaccacagcgccatcctgaacccgtgcacctgccccctcgccggccgccccgccgccgccaggtggtgcggctggtacgctcccatggcgatctccgagtccctcgccccgtccatcgacctctggttgatgttcgccgacccgacgatgatgtactcgtcgtccactgatgaacacacaaccaaatcgatcaagaaatgcatccaaaaacaatcgtggtaagatcaatcaggagatatatacgaaccgatcatcatcttggtgtggacgtagatcatgaagcggcgattctgctgcgcgtggaagtagccggtgtcgggctcggcctgctccggtggctcgtactcgccggcggacttggcctcgcggttgccgaggcagaagaaggtgaggtagtccttggggtcggcgtcgatgcccttggcctggatggcgtgggcgatgtcggtgtacatcatctccatagtgcggcgctgccagtcaaggatggcctggacggagccgctctccgggatgccctccggccacatcggcacgacgacgtagacggtgaagcgctcgccggcctcgatcttgctcaccaccttcatggagagctccttggggatgaggtggagcgcgccgacatcttccggcttgacgccgtcgttgggcttccagcagtaggagctcccgaggaagtactggttctcgatgtagatgaagctccgcgccctcctaatggcggcgatgtaggcgtcctggatgctccggtcgatgatctggtccttgccgctgacgaggccggcgcgggcggcgtcctcgggggtgtccgggaagccgaacgcggcgccgccgtcgatggagcggaacagctgcacgttccacgactcggcgtcctccgggaacatcgccggcgacggcgggatgaccgtctcggcgaggtcccggagctggacgaggaggtccttgccgccctgcttgcgccaccgctgctcgaagttgtagagcacgtcccacgccacggggccctcgaggcggcagtggatgtcgtgccacggctcgcgcggcccgcccttggccaccgtcgccgtcgcgaagttcggctggtggaagtcgtcgtggtgcgccgtccccagcgtccggaacagcgagtggaacggcgtgtcgtacctcccgtcgcagaggtccagcccgccgacgaagctcaccaccctccgccgcccgccgccattgccgccgccgtggcgcgacgacggcatgtcgtggtcgacgacgacgatcttctggtggtgcgtgaacatggtggagatctgcaggtcctgcacgatgctgccggagtcgtccgggttgcgcgggcacagcacgcagttcacctccgtgccctggaagtagttcatcgtctcctcgtcgtgcgtcgccatgagcccgtccttcttgagcatccccaccgacgtccggtcgtcccacaccagcatcagcaccctcacgccctcgccggccttcttcttcagcagctcgccgagcgtcacgccgccgccgggcttcggccggtcggcgtccctgatcagcgcgatctccgtgtacaccgaccaaccagtgatatagataaaatgcctcgcgccattgatggcgtcgaagatgtcctcccagcaccggtgcggctcgtagctccggccgccgtcgagcgggatccgggggatgaacccgtcggggacatgggcgtcctggtacaacgtcaccttgcatccttgccgctgcgagaagaaggtgtagggcacgccggggtacttgccgctgcggacgccgcggccccagctccgatccttggagatgtcgaagtactggagcttgacgtggaccttgccgccgccgtcgccgatgggggtgcgcgcgtcggtgtcgtcgcagagggggagccagcggtcgacctcgtcgccggcgaggacgtcccggacggggaggtagccgacgccgaggagggaggcgccgatggggttcttggccttgagggtgaaggcgacgtgggtggcgaggtgggcgcagtagacgtggaaggactcgtaccagcgcggcgcggcggtgtcgtcggcgagcgtgcgggtgcggccgacgcgggccttgtcgaggccgatggtggcgtacaccttgctcgtccccttgcccacgcccaccgtgtcctcgatcccctccaccagctgcgtcacattcgcgcaaatgcaaatgcagcttcatcagtactcctacagttttctaaatatttgacgccgttgacttttttaaatatgttttatagtttatcttatttaaaaaaattaagtaattattaattcttttcctatcacttgattcattgttaaatatagttatatatatgcatatagttttacatatttcataaaagtttttgaataagacgaacggtcaaacatatgctaaaaagtcaatggtgtcaaatatttagaaatggagggagtaacagattctgagtgaggatatttaaatttgaccctttttttatatctcagtttgtaagttgattttgtgaagtgttgtatatatgctgtatgaatgttgtcaaaagaatttttcataattatttgaatgggtttttgacaaacaagagacatcatctcgagggatcaaaagagtttaccgaggcaaagcattgcaagctattttttgatttgatttgaaaaatataaatttcaacaaaacactagtactccctccgtcccatccctccgtcccaaaaaaagacaaaccctggtttccgtgcccaatgtttgaccgttcgtcttatttgaaaaaattatgaaaaaaattaaaaagacaagtcacgcacaaagtattaatcatgttttatcatctaacaataataaaaataataattataaaaaaatttcatataagacggacagtcaaagttggacacgcaaacctagggtttgcctttttttaggacggatggagtatgtttgtagactagctcgtcctatagattgaaaatgtatgcacatgatgatgctactgatggtaatttcaatatgattatgactcgaatatcgccgcacacatttccattggatagaagagagaagagaggattagcaaaaaaaaaaggaatagaattggactgtagcaaaaggagcaaatcacgttcatgcatgaatggatggcaagaaccacttccggttatgactgttaaaacaggcaccagctaaaatctaaattataaaacgttgatttcagtttttattccattatagtctattttccagcattgctttctaaaacacaaacaacacacatatataaaataaaatcatcaccataaattatattcggttgctttcgctcatttttccatgacttatcagccatgtctcaaacgatcagggtaaaacactagacaactcgttcgttgtacacgacttgaaagttgaaatcaatacggcaaataatatactccctccttacttaaatatttgacgccg

SEQ ID NO: 64064 - DNA, 1283 bp, Oryza sativa
cgttcttcgacaaactacaggttgtgccaacacagacgttgcccattagaatggtgctgttgtggtcatgctggtggttaaggttaccctcatcgatgtcctcttaagttttttttttcttgtgatcaagaaactttaaggagttgggtatatgcgtagttgcagttgatttcgtacaacttggctggtagtatagtcatcattttcttaatgccccttgttcacatcacattcttggaacatataactaagctctatggaattattggctactctgttaattaatcctagcaggaaagacttgcatccctttagggatgtcctctcatttttgcatcctatccaaattaacttgtatagaagggctgcgtttgacaaagtaagctagagtgacatactgtgtctatttttagcagtaaagtatccatcgtttgtttgcactctcagcatcatatacttaaaagtaatgacagatggtctaagatatttttcacacattaaatgtacattattaaacagcaggacagacaaagatttgtcacaaggaaggaaagaacaaggacatccaatttgaactttgttttccacgacacatgaaaacagaaactaaaaacaagtgatgacttgcaacaattgggatatggatcctatattcccaaggaaagatgatatatcctaggtagtgcaacatacttatttatagtataatatactattgtctggacctcaacctgtcgttccgtatgtaaatacactgtaaacaagtactatatctagtaatctgcagcagtgacatagctagaaaaatcttaaagcccgggcaaatattactatgttgaatattttctatataatttatattgtcaattcctatcttatataatatcaaatttctacagcatgttcatcgacaagccagccactgatagaatttcgtttgaaaatcctagattccaaacagggcctacatggaccagccagtatgttagtcccagttttggcagttgcaagaagtgtatgcaagaaattttctgttacttggaaaacttatgttccatgtatagacattggttgctgctagaaagcccctacattatcttgaaaaggtaaaaagctataaatttagcacatctattttctattatatttatatactaaaagtcgattaaacctcctacaaacgctcataagacgcatgtggcatcttacaaacgcccctaagacttcccagtatacacctaggaagcctagcaggttaacgcacaagttcttagtgaggtgca

SEQ ID NO: 64065 - DNA, 1857 bp, Oryza sativa
catctccccctccctccccggctccctctctctctctctctctctccccgctctgcccgtgagccgcgtcgagctctccttctccactctcgcggccgttcccgccgatgccgcccaaatcgccgcgccgcccgcgcgcgcgcgcgccgtggtggccgaccggccagtcgccgccgccgtcagcgcctgccgcgccttgccccgcgtctgccgcccgtgtcgccgctccactccaaaccgccccgccgtcatcgccgtcgtcatcgactcggccccgcctctccccgcgcatgcctccaagggacggaggcagagctccccccctcttccgcgtcgccctctctccctcctccttttccccaaagcggcaaggaggcaagccctctttctctccccctttttcccttttcccttccgccggcgtcatcctccccccctcctgtcgccgttttggccgcgagcgccgagcgccagctcgctcccttgacgcccaaggtcggtttccaaaccgacatcgccgccctataaacccaagcgcctcccttcctctttcccctcccaatcttccccgtttcttgctcgcgccattgctgtctctcccgccggccaccgctgtcgcgtgtgccggaggagccgtgcgcgttaggacgcggaaggggactccgggcgcttgccttcttcctcttccccggcccgaggccggagagatcactcccgtgccgtcggcctcttgtcacagcgccccgcctcatctcggtagtgcttttccccgttctccctcctcgatccatctcctccccttagttttcagtagtagcatgtgtagccttcccgtagctagctggcgccgccccgaccgttgccgccgctcgctgtgtgctcgccgccgtcgccgcccgtgctccgtagcgcccgctcgtcgccggcctcgctcggcgtagctccgcccaatccgacgctagcaacggattcccgtagccgcgtagatgcactcaccgccgggaatcggcccctcgtgacctcatcgccgtttcccccttccctcgccgccggttgccgccgccgcaatccgccgccgtcgagctccctccggcgaatccgagccgttggctcgtctgccctcgtcctgtgcaacatcccggtgtgctcgccttcgcctgtatcgccatggatcgctccgccgctcgccgccgtcgtccgccgtccgttccggccggagtcgttgtctacctcccgccgggccgcgtggcagccacgtaggcgccacgtcggcgccacctcggccgcgactggattggctgacccggccagccgctccctccgttttccccctatgcgcatggtccgcggtgagccgtgaggctgcgcgtgggcccgccgcaccgcgtcctccgcgaaccgcgcgcatgcgccgcgcctccctccccaaaccctagcacgccccgcgtgcacctcgctcatggtgagccgagtcgccgacaagcgggtcccacccgggaccacgcgggatggacccggcccaccggctctctctcctccccgcccgcatgagcgccttgggccgccttcttgggccggccggcccattaagctcggccgagccgccccattctctcgggccgcgccctagccgcccgagggaagtctaatttccctccctccttcttttcttttcttttctttttcaaaaaggatttaaataaatccttttcctttagaccaaaaatccagtaatcttagaaattcaatatcttcccaaccgtaagtccgtttgactccgttcaacttccaaaattcctcaaatctcgagatctatctaatggcacgcttagaggtcaagggtaccgagctcgaatt

SEQ ID NO: 64066 - DNA, 609 bp, Oryza sativa
tgagccattctacgggtaatgcaagacatgcggcagcttgactatggcaacaacatataattcccggagctatcattccagggggggaaagacacaacaggtctatccatcgactactacggctgtacggctctggcacgtactaaactacaccccaaggaagagccatgagctctcactaatcctggcgcgcaggtcaactatgtgaacgacccgattaactagcggatggacattactgttccgcgtacgcaacacaagtgtgacattgatatcactaaggacgcgtctaactacaaacaatgcgacgacaatccattattcacagatctacctaaccggatcaagcgagtttggacaaccatcgacgaacagacactattgcctagtggaatgatgggtgcggcaaaatgcaaaacattcgtgcatatgaacatatgggtatacactcatatgtatatgaatatacatatatatgctgactggcgggcggaccgcactagatgaatgaatataccgagcggtcgagataaatagaccgtacgggataattaggtatcccgtgcggtcctaatatattgacctcacgagataatggataatcccagt

SEQ ID NO: 64067 - DNA, 4198 bp, Oryza sativa
ccaaggatatatttatatgcgggatccttgtagtgcagtttgtttaaatatcaattactcattggatggaaataatgtagtgaggaagccaggaagttaaaaaccatttcacaaatagcatgcaatattaccaacggtctaatagatgccgctctggcccagatgtatcctgcccatttgcttcgagcatgttccttagttcagcagttgacacatgcttcttaagttcatccttcaatttccaaagtgtgtcactctgctctttaagcttttcttgaagatcagaagaattagcattggaatcatgtgatacaacagctttccctttatcttctgctgtgccttctgatatactcctgattatcttgggagctttgcagtcgtgtatatcattctgattattcttgcgcttggaacccttagaagatgtttgcccttgagaaacaacaatacaaaatatcaagtcagattacgaagtggcgcgaagaaaatttgatgcccatgtttcattacctgagctgggggcatctttcttaacaagatcaagaacagctcttttatcctcatgcgacaggatctcccagcctgagaaattctcaacagttgcagctggggacatctccagaaaacagctggcgtgataccaaccttgcccttcaagcttagatgaaacacgaacctagacaaacaaataataatactattacagaaacaacttagagtgaagacaaagaccatgtttttacattacaagttgccatatcacagttacaattcatatgttttcaaaacatacattattagctaagtgcatgactaatagtacttctggatcatcaaacattttcctgtatataattctccacggtaattattgtaattcattaggagtactcaactaggagtgtggatgaataagaaatatgaacataataaatactcttccaattaatacatttgcaggttacttcatttgataaagtaaacttaacacaaaattcagagttctaatgcttgctagtggcacgtagcagagtaactacaaaataaatgggaaactgtggcctttaggctttctggtcacttggaattccagtgcaaaagcttgggcattatatgcaacatgatgcaggccacagggaatagggtacagaaaagaacctatggtgtccctgcgtatcagaaccatacatttcccagatgcaagttcagaaaataaaagaacatgccaatggcatagtggtagggaagctatttaacctccccagctacaagtgttcaagtgctaggaccaagtcgggtatccatttcatccttagtgagcgctaaagttcatgttctaaataaataaagtatagaacaacaaagtaacatgcagaattttggacaatacagtatttttcccagggagtaactataaggaataggaaacatgttatgattaattattcttacatgctgcatcaaggttcattcaagaatgtgaaacttctgattatctatgattgttagctgaatgctcatataagactgtaaggtgttaatcatcaagaggaggttattttcatgactataatttgaaaagcaacaaagtacaaacataaaattttcatggcataaaacttcctatcctcaagggacgaattagaaagcatataaaaaattaatagatcaaaagatacagaccgttcccttttttatcttttcaccacaccgtctacaggaagtacgggcagatttagcaacctcaatggtgcatttatctgaaatagcagctgcagaacttgcagtagctggtgcacttccaacataatttcttatcttctcttggtcatcccatctgagtgtgtctattccttcaacatcatcaacactaatttgaaatgaagaatcgacactttgagttaggtcagatttccaatagatgcaataaagattaataaaccataatactatagcgtgaaactcatgcaaacagtaaaagataaagttgcatacgattttatctggtttttcttactgaggatgcaactggcatggttccacatctgaaaaagagaaaagggcactaaaattaattggaagtggtcaattcgtaaaattgatatggaaagatatgtcatataaccatcgagttttctcttctgcaccatcgagaatctaccatgaccaaaaaaaagttccaaacagttatagttcttgaataaaacaattactataaacatagaaaaggtacaacgttataaacactccatattaaagaacatggtcaggtaaaaaataagggccatcacagaaaataaaaagatatggtcaggtgaaaaatggcatgcagatccaaaagtaccccctaagttgccctaaacgatcctacatttcccagtgaaataatttgagtgtctagtccacataaccacatgagtactgagttgatccgaccaaaagaaataaagattcattatccaaatgtgcaatataaaaaatgaaaaatagaataaggactcccctccaagttttatcttgcctaatacaggtaagcacttataatacacatgcacccacaaaacaattacaagaggcaaactagaaaataaagcgggcaaacgaatacctagattataatttgcaaactacacatcagataagaacaaaaacagattagcgaacacactagattactaacattgtcattggttgccccattgccatgctaaaagcctaaaacagcacaaccaactggcaggtccgcataataactaatatatcaaacaacttaggaccattgccatgctaaaagcctaaaacagcacaaccaactggcaggtccgcataataactaatatatcaaacaacttaggagaaataccagttaaattgcatatgtcaaagttggtgcccacaaaagcacctctatctattcttgcgttacacatatagattgcataatggattagaaacagcaataaacccaatgctggaattgacggatcatcgacaaatcgacagagcaccaaaccaaatgcatcaagaactccgcattcgaagaagattggttcgatcataccccacaaaatcatgcgaaattaccctcagaaacatatttttttcgggcatcaagatttaaaaccaaccacccaccaaagcagaagattcttatggcaaatgcccgcaaaacccacattagcaatgcacatcaagatgaaaaccaaccacccatgaaagcagaagattcttgtggcagatgaccacaaaacccacacccgcaatgcaaatcaggatgaaaaccgatcacccatcaatccagaaaattctcagaatccaaaccaacctacaaaaaaccctcaagaacacgatgcctgccacaccaaaaccctaccctcccagaccctaaagatcaaagcaagattcatcaactgaacggagaaagatcgtcggcgaggagagcgggtggagggagaggatacggacgggcattaatccgtcgaactgcgtggcctggaccatcttgccgagccggagctggtccttcccgatgggggacctgcacgacttgcacgaggaccgcccggacttggcgtactccgccttccaggccttgggcggcgccgccattccgccggccggtgcggctggtgccctcttcctcccttcccctccgccgcttcttggcttgtcctagggcctagaaagaacccacacaacgagaaaggagaaagggaagggaaaggcctgatgatgatgaggtgtaaaaacgttaaaaaggaaaaaaaaaatctcccctcgaaaatttggggcgagttgagttaatttgatggtttttcttttaaaaccctgtgccatatcctccccgaatgtgtattctcatatgccatttttcttacgggctttacggactgtttggatgggttaactgtatgatttctcacgttttgccacgaaaattactaagtatttctcaatatttttttcgacaattaagctaaaagtaaaagaaaaaaaataataaaacatcagagtttatcagtacttatcataaaacaaacagatgatacctgcgttttaatgtgaaacatattgataactatatgtttaatactataaaaatgatagatagatttgtgagaggtgataactggatatgattgcatgttgatttgtagaattaaataaattgtaaatgatgttgtatatttgcatg

SEQ ID NO: 64068 - DNA, 2754 bp, Oryza sativa
cctgcagcccgcctgcttactgtctccttctttcccgaagaagtctatttcttgtccctcgcctcttttcttttagcccagacaaaagtctgtttcaccttcctatcgctacagtactccttctatctctggacagaacccgagctcctgtgcccactgcccatgcaactcgacgcccccgcttcctctgtagaatccgttgcatcccgtgactcgtttcccaaattggttgaagggatttcttcccttatcctcctctttctttcccctcaagaatcggagcaaatcccatcgtatatcgcttggattcgaagcggagttcatctcctattttcccggcgaaccttaaccaatccgccgccaaatcctcacgggtccgagcctatttcctccacctttgcctataaatagcagtatcaatacctcctcttccgtttctatctttttccagagcttttccctaaccttagccgcctgcccgcgctcgtctcctcgctccgccgccggccgccgctccagtcggtcgtagccgtcgactccgacatctccggtcagcgccgtcgcctccaatgggaccaaagcgaagagtggaagaccggccaccatctgcccgaagccgaagaccccgggaagcccttcgtcgccgttaaggccgagttcgccgtcgcgttttgatcttcggcgaagccccgctgctcctcccgtcgtcgcccagcttcgtcgccacctccgttgggttcgaaaggaggagctgcaccccggccacccctccgttgccgccgctcgttgtcggaaagccgccgtcgccgccgtcccgatctcatcgccgcctctacctcgccgccggccgtcttccgttgtcgttcgtcgtcgtgccgcccctcggtgagctcccgtcgtcgtgctctttcttccggtatcctcgatttgcgccgccgagccctagatcgccggcgatcgttggaagcccctgtccgtgatgacatcatcgctgacgtcagcgcccgttttccttttctaagataaatcgtaaatccttttctgtatataaggctaaaatcagattaatcttgtaaaattcataactaaatcatatgaagtcagaataaggctgtttaagtctctaaattcatctaaaatcatgatctacatgtttatttagtttatatgtactgtttatttggagtttcttagtctttttcctcgttttgtgtattagctcatcgtttccgttgttgcgaagattcgtgagtgcgtcggaagtgttcaagaagattaattgaagaccgattattgcaaggcaagtcacatagatcccaaacacaactcctttgagcatgttgatcctatatttaaattctctatttatttcaactgtgtatttattttcgaatgtcaccggtggtgtgaacttatacctttgctacggccaatttgcattgattaccttattccttgataccttgggatacaatttgactagttggcctcatataatggttcaattagatatattagtatagttacttagatatgcttagaaacattagtgtggctgtgtttgcaaccccatgttcccagcccctctccatcgttttccgttttccgagcgcacgtttttcaaactactaaacaatgtgttttttgcaaaaagtttctatacgaaagttgcttaaaaaaatcaaattaatccatttttgaaaaaaaatagctaatacttaattaatcatacgctaatggatcgctccattttccgtgcggaggcactatgttcccaagctgaacatgcgaacacagcctaaagcttcactattacctaaagctggatatttaaaggtagctcacgatgataaatcgtgttatgataatcaattgataattaaaacttgataatggtgggttgtgagcgtatagttttgatggtcgtgctcatgacaattaaggatcggttcgcgagctactgttgtgaaacattaaccatgccaaccacaagctagcatgggtaacggcatttccttttgtatagtataattcattatggggcgccagactgtgaagtggcgagaagtccgtgggggtcgctggggagtccatgcctctggtaattgagggggtgattatgatccaggaacggtgcgttgtggtggattgtgttatgcgaggggtactgtcacagctcctttccgaggtatcgtggtggtattgaggcgcatggcaacgtgttgtggggctgtcttgtgggtacagtgatacattggcaacgtgttgtggggctgtcttgtgggtacagtgatacattgatacatctctggccagagtaaaactattcgaatagccttgcccgtagttatgggcgggtctaacaatgttttcgtgattagtctcacactgatgctataactggtaataatttgcttagatcctggtttggaatggtacattcctggtttggagttagatctgtacagccgggtatggttgttaaggatggttgggcctgtgcagcatgggtgtgctgtacagtgttgattaatattgatgattaattactctactgttttactattctcaaatatttgctaaatgctgcttttgcaaataagccctatattatgccatcctttggtatccttgtgcacttgcatatttgctgtgtggcatgcggagtattccatgtactcaccttgcaataatcaatcaaacctcaattgaggaagttgcgaaggagaagacgtttggcttataccccagttg

SEQ ID NO: 64069 - DNA, 6462 bp, Oryza sativa
  unsure (1)..(6462): unsure at all n locations
catacaagtatggagcatgatgatgaaaaaaagagaaaaagaaaaaaaaagagatagccatgcactctcccaaatttcaaaagagaaaataaatggaggagatatacaaaaggagttattgttattagtatttccccttttccacccacaaatttaccatacacatacacatgcacattcttgacggccagaaagtatgtcttgtatttccgtggatccattatttgacttttgcaatatatgtgatacaagtaatgctctactcttttccacaccctgagctccacataaacattattagatagtaggaaaagaaaaggcacaatcatatgcctttgtgaggaatcatacacttagagcgatcgagagaatcaatggaggagcacggcaaagttataattttgtgttacttgaaaaaccccaattcgttcttcatgaaaagttaaggtgacttgagtcaagattttttcatttctcaattgcccagtatcgcatggtagacactagaaagacccacaagtacatgtatggctttgaataatttgtttgcatgattattagtaaggaagtcataactctattgtagagtccatagccttcactccggacgagcaaaggttaagtgtgtgggtgttttgacggtccttaaatcataatatctgactgtcaataccttcatataatgaactaaaatatggtatccaacttagtggtagggattattactaatcatttccactagtgttggtgaaatatgtgtatgcaggtatttaaggagaaaacagactcgtcatgcgacaaaatgaacctttgcacattccggacgtgtttacactgattggagggcccatatgtcaatgaaaactgcttagaattgggccaaaacatagtatatgatgttgggggcccattaagctacctcccagccgaagaggcggccgggaggagggttttccggttcggccgaaccaccagttcggctgaacccattttatggccgttgatcgccatcttccacgtgtacgctcctgatcacttcccaatggctgttgtggggcatttccgacaattcccatcaatgtaaccttcatttggagcctataaaaggaggagctcactctcatttccaacacacaactttgagctgaattacaagaggctctattgtatcttttgtgcattagaataagagtaaattgcatcactggtacacgaacttattaggtgggtgcaatctagtgcacgaacttgttaaatgctcgttttggtgcatgaacttgtctggtgtgtgtggagaaaggcgaaaagaatactatatggctaatcttattgatttaggggccgattaggatactatgtaaacatatatctgagaaggtttctattagacatacacctctttagtaaaaatagaatggatatactgatcgtagaaaaagattaaagaaaccgagcaatgatataagggttagaaatatatgaaattcatcgtttccatggtgaaggataaagtagagatcaaatttataaatattgcatgtcttatgaatactcactacacgtctgtatgtcacatcctaatcaacatctgcttcataaaattaacattgccaagctattttagtctcattcgcacaaactagacaagttcgtgtgccgaaacgagcattttacaagtttatgtactaaataagctctggaggggtgcccggaagtttggcgctccctccaacttctttctcgacgagtgtagctttctaggaggaattctggaggagtaccggagctgtcggtacactctgctccgggttcggagaaacttctattaagtaagcattcgtgttcctttcttatgttatttaattacttagtctaaataagatatatttcccctttgcgggttcattgtttagtattcgtactaagtgctctagtactaggactctaaataaagaaggaagttcctgtacaagtactatagtagtaattaataacttagatgtggtgtctaggttagagattacctttgtttgttgtgtaacccacggatttgttagaggtaggcggcaggtggtgacagccctgaatctcatcccagtaatcctccatgttcggatacatcataaagctatagctgaaaccacactggcagactagcaggggtcggtgcccgaagcagcagataggaaattacctttaacttagcgtagataattaaaacacatagaaagtcttctctagcctagctagcaaagtagcagataggaaattacctttaacttagcgtagataattaaaacacatagaaagtcttctctagcctagccagcaacctatagttattgtccttggatagtcttagccttaggtagattacacatgttccctgagttcaatatccttttggggtcatccgaaggtgaagtgctatagcggtattccatgcgctttcggatttatctatagtcataagaaataccaacactcggttaggtccgatcatctatcttagtcaatatacctatacaatcacaatgttgtttagatacatttgttatatccatcactttatacatgatttatcgacattattgggtttactcgttgctataaacttaatgctgtatcggtttagtctgatctagccaggtaactcatgtatactgttttatcggtgtgctagtcgataagttatctttacaacggattttccagccaatgtatgctttaaccatggagcttacatttaatattttgtatcaatatcggccgattggttcattagacatctacttcatcatattatcatcggccgattggattgtttgttcaagttcttccattgtatttatctaagtgtcagaatctacatcgactagtgtcgacattggctattatcgctacatcggcttattggccgatcggctctatgatcatcaatttatttatctaactgacacgctcgcatctcatcaaaaatttaggacctgcactgaagctaaacagatttcccaggccttcgtgtttttggcatcaacagtgcctgaagcatttggtagagttttagctttaacttaagttagctagttgaatccataggaatcctctctagcctatcctatcattagttgttgtccttggttgaatcccattcttatatatacacgcatgttccttgcaattcaatacccttagaatactctgaggtgaagtgctacagtgatatacgtgcgcttgcggatttatatgtgactgtatcaagtaccaataaggagacagcnnnnnnnnnnnnnnnnnnnnnnnnnnnttaagccctcggcaggcacacgaccgagccacccgacgcgtcgtcgccacacggcaccgatgctcgcgcttcgccgctgcacggccacgtgctcaccgttaccacatggccgcaccgcacagccctgtcgtgacatcctgtccatccaccgtccgtcaccccgccgcatggctgcgccgccattatttggccacgctaccggctctgcaccactctagccgctgcgcctccccggccatgtgtcgagccaacaggaagaagaagaaaaggaaagagaaccggaaaagaaaggaaagaaaggggaaaaaaatgaaagaatcttctggttttgcaaaaaggtcgtggcagttttgggaaattaagcgcatatttttcagcagtggaaattttgcgattaaaacccaagagctttatgaaaatgtatatacaccctagaaatttgcaaaatcaatgaaaaagcatattatcgcataatagagccacgtgattttgaatttgatcccgaccttgcaagttgaggcacttttattgttgatgtttatgattaagaaatttatttattgtatttatgattattgattatttgtaatgcttttattacctttaattaatatttttaaggtaaaatgtatagatttgcatagaatatattggaattatttgcgggaattgatgtcgtaggctctccagatcttacattatatttcagagatgaagtgaataaatcaattcatcaaacaagcataataaagtatttgatgcctcaagagaagaatattagagacattgctgggcctttagcctaccagtcaacttcagcctgagatgtgctcgtcaaaccactcgaaggcggcgaccagatgtgttacacattcagtagacttgacaaaatggctaaagatctacaacatgtcaaatattcttaactcatactcatgtgaatctagttcccaggatgtgcactagattcacactttcatcttaagcatggaaatacatagcaagatacatttaagacgaaagtgatcacaaattacaactacttaatagatacatgggccgaccgaccaaatatagatatatcagagaacagcggaagcttgactacccaaacacaagcacaccgactaggggtttacccccaataagttcaagtcctagaagaagcagtcgaaaaacccgcattactcaacttaatctaaacatacaacctgcacaaatagatatttcaacatagcaggagtcagtacattatttctattcaaaggagcgcaatatgcagttcaattttagcataaatcaagttttgtttcacaatacttttgtaaaggagttgatgattcaattaatcaaaacatttttgtaagttcataataaatatcattatatcatcataagcatactcttgttgtcttccttgacaacaagtcatataatcatcatcacactcacacaactcaatacatttcacccattccaaatccaagtttcataacacattttaaaacataagtctatactcatgacactttaccaagcactcatgaccgtgagcatggctaattgattagtttttagactctgcagagtttgtatagctttatccacatgaggtgaatcgctctagtttgtctggtagccatcggtaccaccacactttacatattgagtgggtttacaggtcacaacgaggcttttacattaagtattgtataatccttgcataagcatgatgactgttgtttcacactaagttgtcacagcctgattttccgtatcaggatttataaattatttaataaattattaatagaatttatattaaatgttcattaatttacaagtgaagttaaatgtgggaaataaaatttcctaaatgttgtcgaatggacaacaatgccacatcgaaaggcgtgattctctcaacagtagttggaatgtaaaagcaattgtattgattcgtaaatttttttggggatccccccattacatggccctagaggtctatttatagccttagcacaagcctggaccttctagggtttagggttacagaggatttaacatggttgcccttatgaaacagacatttacatgggtatgcagtgtcatttgcacatatgggcctttaatgggctgataggctgctggtctatagcaaacaggcctaaaaggccgggggcggcctgttgggcctccttgatgccgaacttgtcatggcaaagtctttgtagttcgcccgagatgcctttactttcggagtaccgatgcggctttccagccttcgccatcttcgcttattgctttcaccataaggcttgcctgaatggtcttgacggctttggcttgaatccttgctggtactatggtttcggcaggtccggccgaagggcttcatggcatgcctccaacaagcccctcacgggcaagggtgagtaaggagcttcggccgagaccgtgcaaactatacggtatggcttgaggctccccctttcggccgatgttcctgtcgaaacctctttttagactcctgcagaaaaaatatgaacactggtgttcgcctttcgagaatggtgaagctgtattatgacactgggtgattatattttgccaagtttgtctgctttgcgtgattcttaacttgtattttttttctttcccttttttccctattgttttagcggggatttcgccgaaagtcatgtgttcagccccctttcggggattggcgaaaagatttgttgacttttcagctttcgacttccattttcgactcgtagcattttgcgctgggaaaaacgcttatgttttgcgtaagttgaatgtaacggtgtttggtatctttattccgaaacaagctgtcgcggtttcaaagttcggcgagcgatgcttctgccgattcgtttcgccccccctggtgttttcatcgatcaagcgttcgccttttatgtagctatgtggttgtcaaaatggcgaattggaggtgaagacatcctggtcgaaccttagaggattacgaccggtgccacatccagcgccgcgatgacattgccacactttggttagacttcgaaatgactaatcgtcaagctgctttcgcttgacgtcggtgtgtatttcgcctccttccccccttaaagtcgtgtatagtatag

SEQ ID NO: 64070 - DNA, 5579 bp, Oryza sativa
tgaaaatggtggtagaaatacatgaagggctgtgcggagcccatcaagcaccaagatcagttgcatcgaaggtgataagacaatgagtatattggcctacgatcatcaaagacatagagaagtacattaagacatgtaaggcatgccaaaaatttggtgcaacgtcaaaagcaccaccaagagagttgcaaccaattccaccagtttggccaattccaccaagagcaaaaggagatttacgttttgtcattgtggcaattgagtatttcacaaggtggattgaagcagaggcagtagcacgaatcacatctgcttcggtacaaagattcgtttggaagaatatcatatgccgatttggaatacccaaggataatggaaaacgatccgagtcaggaaagttcaaagatatgtgtaaatgtcttaacctgcaaatcaactttgcttctgtgggtcatcctcgaacaaatggtgccgttgaaagagcaaatgagaaatagtagaagccataaagaaaaggctggaaggttctgccaaaggaaaatggccagaagatctgttgtcaatcctttgggctttaagaacaacagttgttcgatcaactggcatgactccattcaggctaatatatggagatgaggcaatgacaccaagcgaggtgggagcgaattcacctcgaattgtgtttgatcaaaaagacgaagaaggaagggaaatcaccttggaaatgttgcacgagataagagtggaagcattagacaaaatggcaaaaaacacagaagaaaccaaaagctattacaacaaaaaagtgaaaatcaggcaaatagaagaaggtgatttggccctcaagaaaacactaaatgaagtggctgttggaaggaccattcatagtaaaaagaaagttaaaacaggagcatacaagctggcacacctcgatggagaagaattaaagcatacttgggaatgctgtttccttgaagaagttctatgtgtaaaaaataagaaaaggaggaggaaaaaaaggagaaaaaaaaagggggaaacatgttgctcgaaatgtacaataccgaaccaccttgtaaaatctcttttcttctcggtgttatacatataaacaggacgtagggtgtatcaataatggatggtatatggtgttgcgaatcaagaaaatcctccgcacgcttcggagaagaaaagccaactcgataacaaatcgagaaaatactccgcacgctacggagaggaaaatccaacttgataacaaatcgagaaaatcatccgcacgcttcggagaagaaaagccaactcgataacaaatcgagaaaatcctccgcacgctttggagaggaaaatccaactagataacaaatcgagaaaatcctccgcacgcttcggagaggaaaatccaacacgataacaaatcgagaaaatcctccgcacgcttcggagaagaaaagccaacttgacaacaggtcaaaaagcactccacgcagttcgacaagttttaccttcgcccaaaaacctaacgataaaacgctcgaacacccttatccgattcgagcaaacagtggaaaattccacgcgatgaggtaaagcgtgatttcgacctcgtcactccttcgaaaggtaagaaggacggcggttttcgaacaagttttaccttcgtccaaaaacctaacgataaagcgttcgaacacccttatctgattcgagcaaaaagtggaaaattccacgcaacgaggtaaagcgtgattttaacctcgtcgctccttcgaaaggtaaggaggacggcggttttcgaacaagttttaccttcgtccaaaaacctagcgataaagcgctcgaacactcatatccgattcgagcggaaagtggaaaattccacgcgacgaggtaaagcgtgatttcgacctcgtcgctccttcgaaaggtaaggaggacggcggttttcgaacaagttttaccttcgtccaaaaacctaacgatgaagtgcttaaacactcatatccgattcgagcggaaagtggaaaattccacgcaacgaggtaaaacgtgatttcgacctcgtcgctccttcgaaaggtaaggaggacggcggttttcgaacaagttttaccttcgtccaaaaacctaatgataaagcgcccgaacactcatatccgattcgagtggaaagtggaaaattccatgcgacgaggtaaagtgcgatttcgacctcgtcactccttcgaaaggtaaggaggacggcggttttcgaacaagttttaccatcgtccaaaaaccaaaaaaacgatgaaacactcaaacactcataaccgattcgagcagaaagtggaaattccatgcgacaagataaagtgcgatttcgacctcgtcactccttcgaaaggaaagggggacggcggttttcaaaaaccaaagctaaacgctcgaattcttttctgattcgagtctttgcggaataaaaggaaaagaaaaaggaaaaatgacattgagaggagaaggcattcccgtgtaagggacaattgagtagcgccttttccatattctaagttgacgctcagatggtctaaaagtttgccaaaagttaatgctgctcgaagcattattcgaacgctgttttctaaactcgacaacgaagtcacgcaaactaccatctcgatgttctctttgccattggaaaaattttaaagaaaaaatacaagtgtcatcgtaatgtatttccttctcttcatcatcacatttagttgctttagaaaagagcaacttctcgtgtgttcgaaatgcaacgagcttcatgtttcgagttgaatgatacttgttgcgtcgaaccacaacttttcggttcaaataaacctgcttccccgacaaaaacgaaatgatgatgaagcacaggcatacagagaaaatagcaaatggtacccaaccacagaaaatatacataattaagttcccaaccacaataggttcgacggagcaaaagaacaagcgttttcgaccatatccaaaaagttttccaagttagttttccctaaaataacttcacacctgtgaatcagatttgtgagcgtcaccaccgttgtctggttgactcgaagaggattgtgcggtgtgtgagctcgaagccaacgatgcttagagagaagcaagggtatcttcatagcctttctttttccagtaccaaacttgaaaagctttgactacagatcaaactgccgcatggtgttgagcaaactttgacataaatgtgcatattcaatacataaagaatatgtatacatataacaatatatatatatatatatatataataaacaaataaatgcataatgactgacaagaataaccgctttcgaacttcaaaattttctatcctagtgtttttcgactgaataggaggacggcggttctcccctagcttttgattcgaacacggtttcggccgaaaacacacttcgcccttacccgtgaggggcttgttgtagctaggggtcaccaccgttcctctctattcggcccaaaacactgtagaggaagagattgggtaagattgagtttttattctaagtatccgagtggcaaatggtcattcgaacaaggaaatggtaaaatgttgttcgagttggaaaacactattcgagtcggaaaataccgttcgagtgagtccttgtcactaagtctcattatccgttttgcgtatttcctgagttaataacaggtcagctgtcacgcccagaaattaactagcaatttccgaacttatttgtgcattaaatcctcgtccaggaatcagccgaggtacacaaactgacaattaatatacagattcatcataataataacgtaaatacttacaaaagaaaagaaaaatagcagcggaattacagtctagcgaagctccggctccactcccacaggcagctcaactgaggtataagccaaacgtcttctccttcgcaacttgtcttcaactgaggtttgattgattattgcaaggtgagcatatgacatactcagcaagccacacagcaaatatgcaagtgcacaaggataccaaaggatggcataatatagggttcatttgcaaaagcagcatttagaaaatatttaagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaaccaggagctaaattaattaccatcaattaccacattattattaatgagtagtgtaggactaatcacgaaagacattgttcgacccgcccataaccgcgggcacggctattcgaatagttttactctggccagaggtgtaccactgtacccacaagacacaactccacaatatgtcaccatatcatcatgtgcccatgctaaacatgtcaccatttgtgtagttgtgacaagacccctcgcatatgtcaactcaaagcagtgcaccgttcctagatcgtagtcaccccctcaaaaaccagaggcatggactccccagcgacccccgtgggcttatctccgccacttctcagtctggcactccacgatgagccttgctatgcaaagtgtccagccgttgcccattctggcttgtggttgacacggttaatgtttcacaaccgaaactcgtgaaccggtccttaattgtcatgagcactaccatcaaaaccatgtgctcacaacccaccattatcaagttttagttggcacattaattaattcaccaatcacgattaaccatcgtgagctatcattaaatctctaccattaagtaatagtgaaacattagttatcccaattatgtgctaatgtttctaagcatggctaagcaattatatctaacatctagctgaaccaatatataaagctcaactagtcaaattataataacccaatgtatcaaggaatagtgtaatcaatgcaaattggccatacaaaggaataagttcacaccacccggtgacattcgaaaataaatgcacagttgaaataaataaagaatttaaatatacgatcaacatggtcaaaggaattgtgtttgggatctgtgtgacttgccttgcaataacgggtcttcaattagtcttcttgaacacttccggcgcactcgagaaccttcgaaacgacggaaacgacaagctaacacgcaaaacgaggaaaaagactaataaaaaccaaataaacaatacataagaagtaaacaaacatgtagataatagttttagatgaattaggagacttgaacggcctcactctgacttcatatgaattaattatgaattttacaagatttaatctaattaaagcccatttaaaaaaattaaataaatttaattcaatttatggataattttaatatgtagatctttattttatacaacttttgcaacttgaaccacattaaactgagttacaatgaattagttatgaatttttaaagattaaaccggattaaagcatttatatagattttaattgaattatgacgcaataatgaattatttttgaaaa

SEQ ID NO: 64071 - DNA, 619 bp, Oryza sativa
tgcttaaatgatgatgcggaagagagaagagaagagagaggagaagccacccctcacgcaaggggcaacctccacacaaacttcaagaacaagagaaaattagaggagttgattggtggcaagtgtactgggactagggtattaaatgcaatacatctatataggctagggatggataattggataaaattggaggtgaccaccacatcttttataaaacttgcccttagttctgaggagacgtactacggtacatataacttcaagtcatataaaagtttcaaaaccttaccttcattatttctagctctccaagggtgagtaattaatggtacaaaaagtctatgtagaaatcatagcacatttattttcactatttaattcagatcaacccaagaagttgatgatactatatgagagaaatttaattatgaccaccttgtatatataacatagaagggcaataaccgcatcatatttcctggtccttctatataccaccccttctttcagtattcagttcactatgcatcacaaattcacttcctgtcaaatgtcaatagacataataggtaagtactgtagcaagtgaaaagcaagacagtatgtggtaagagga

SEQ ID NO: 64072 - DNA, 1099 bp, Oryza sativa
cattcatatattagagggtttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcaaaatagcgggaaaagatatttactcccggttggtaataccaaccgggactaaagatcatctttagtcccggttgttctcaacaaccgggagtaaatatcttttctttactcccggttgttctcaacaaccgggactaaagatatctttagtcccggttgttctcaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatctcgatctctccgatctcgatctctctccgtcgcgccgcccgccacgagacgccacgccacgacgacgacgcgccacgccgacgccgcgccaagccgccgccggcacgccacgccgccgtcttcgccgccgcgcgcgcaagggtaccgagctcgaattcgccctata

SEQ ID NO: 64073 - DNA, 537 bp, Oryza sativa
ttggtggcaagtgtactgggactagggtattaaatgcaatacatctatataggctagggatggataattggataaaattggaggtgaccaccacatcttttataaaacttgcccttagttctgaggagacgtactacggtacatataacttcaagtcatataaaagtttcaaaaccttaccttcattatttctagctctccaagggtgagtaattaatggtacaaaaagtctatgtagaaatcatagcacatttattttcactatttaattcagatcaacccaagaagttgatgatactatatgagagaaatttaattatgaccaccttgtatatataacataaaagggcaataaccgcatcatatttcctggcccttctatataccaccccttctttcagtattcagttcactatgcatcacaaatccacttccttgcaaatgtcaatagacataataagtaagtactgtagcaagtgaaaaagcaagaaagtatgtggtcagaggaggaggattaaagaaatcaatagagatcga

SEQ ID NO: 64074 - DNA, 21899 bp, Oryza sativa
agcttacaaaagagaagaaaaaagctactagagccatacccgaactcttccgaagacttccgaactcctgatttctactctattcctattccaccagctagatactactaaactaaacttgagagaaatgagagagctattgcttgaggtgtgtgttgaagtgaagagagtgaactccttaaataggcaggtaatgatggttatggcggttggaaaggtcggtaataccctccaatggccatagggagtgaatctccaccgttccctcaaaaccctacatccatcggcgctggcataggttcggccgaaccctaggctggcccaaccagcccacaagttggctggtggcctccttaggtgttcctcttcatagacttggcccagtgtgtcgtgtcatttttgagttcttggcccattcatacataagtctggttctcgacatcgtccgattgatttatcgtttgtgttgatgtcgattctcctccactttattgtcattctctacaaaaggttattaaacctaatactagtggaatattattgttctaacatatttatgcattgcaagcatcactagttctcctctattttggtaatattgacggtcgaaattgattgataacgaccgtcaacaaaaccccccaagcttaaacctttgctcgtcccgagtgaaggacgaaaggaaacaaggacttgcttgttgatcaggagttgcaactatgctgcatatctcaaagacacaggtgcaaggtatatatactctctctcagattaaataatctttggcacggtggcttacccttacccctgattcccacgagacgctgcttctccttgccttgagaagttgaaagatagaatagcaagttagagtaccaatcacccaatctttattcaactcttattccggaagttttcaaatgattttgcaaaagaaagccaagttcctcaaatgattcactcagtctctccaagtgtatcaatttgaattcctcaccaaattgttgccttttttattcctactctaaggttttatatgtggagctcggtagggatcaaacatggcatacttgcattcacatttattactaagtcaaaaacttagactaaagcagataactaaacatactcaagatcaagatcgtgcaaaatgtgtgtgtggtatatggtggaaatggtacatgaagaaaaataaagaaaatgcttctcctttgtgcttactttcttctcccaaaaatccttcttttattgcttaggagagggcatggctacattttttttatttcaacatcatgctcatgcttgatggagcataactttatttctcataaccatgcctttccctccattttttttaggagaagaaagcacatgaaagcgtggagagtttattttggtggtaaaatggaaatggaatattgcttagctccttgtgtaggagtttagcatgtgcatatgtgtgggtgtatgatcttgatcatagagcatgagaagtacctacacgagtcacaagagtttgacaaagttcaatggaatgacaagtaaccaaaatgtatatggtttaatcatgatagcacatttttggctttagtaggaatttatatcaaatgaggaattctcaatttatcattttgaaaaacaaaacatctggaattcaagtcaaactagtatcagggtcatagcaactcatatttactatctcatatctcgcaacaacctagacttagatcagcaagtgcagcccatttacctcaggttcccggataattgttggctacttatatttaacctttgagagagcatttaccaagaaaccatatataagagatataaaatagagcaactattcatcatctcaacaaagagaactagcttgtcttacctagcatgactcaaacctatcctatctttttggtatattctattttgcaaatttttatattgtttttatttttataagatgcaattggaaagggaaatatgcaatgtgatacaagttaccttagtagggggagcgatgtctcccccctaagcttggctttcgctcagggtacttgataaggattgaatccctgaaaacgaaagtacgcctgaaggtcatcgtgctgttgctgcatcatgttgttgatgttggcaaactgagcatcagcagattgttgccattcttgtgtttgagctatgtgttccgtgaggttgtactgaatctcccccgtctgcatatcaagggtgtccattctcctagttatttcacccaagtcccaacgagaggaactcgagcgacattcacttggagatggaggcgcaccacttgacctgggaggttgattgtccccccattggatatcatgaggcgcatgccacaggtcctcactggcagttgcccaggttgagactccgatgctatggcgtggagcttgggtccatccgggtgcatccccagttggtgcccaacctgcctcatacatctgcacgggtgttgaggatgatgaactctctcgttcgttccttgtcatgctgcgcgtctccctgtatgttccacctgcacgagattcttctatggtctgcaggggaatggttagttcacgacagtgtaggattatggatatcattcgttctaggtttcttgcaaattggagcaccagaaatatctttccaaaacctatttttctcgaacccagaaattcctttctggtgatcgattttacaggaatcgtgaaaaccaagaagtgtacttaagcctttccatgtgagtgtgaactcattacggaaaaagtgaaaagaaataccatctactatttctttcaaagtgcacagaaattgcaaagtaagcaaacaagaaccaagctcatctaccatagcaaatctctgccaaccaaaagctttccaaatagaacaaaattcaacatccatacctatcattttcagcaactccggtgagtattctcgcgtgtgagcatactcccggtcgctcagcatgtagtaggcttgtctctcccgatcactgacaagatcgaggtcggtgtcgttccggagtcgtcacggagcttcggcgtcttccatcgagacatcggctgatgaacgagtactagactcgtcatgatgacttgatgaagagccggaccctttgaacagacgagacaatcgcctcctcatactgcacaatggggcaagaatggactaactcggcgggggttaggaatgacaagagtttcacccgccggttagattcaccaaagcaacttgtatgtatgcaactaaatatttgaatttgagggaaactatcaaagcttgaatgaacttgagagcaaactttggagagggaatgaaaatgtgttgaaatggggtggaattccctctctcagccggctggcttttatagggtacccacaacagtcagaaatgacatgtgggacccactagccgttaccctgccaaaagcggcaggtagccgttgcctggctggttcgactgaaccagggtgttcggccgaacccctggtgggcccaaccggccccacttttagccgttggattccaacggtcagtgtagtcatggcatagcgaattttcgttggaaatattattttggtttgctctgaaaaattcatttgaagaatttcctcaaaattcaaaaatcctaaatgcaattttgaaattcaaatatgtgatgatgcaaaaattcaaattgttgaaagtaaatatgcggatacataccaatttacttgttggtgaaggttgcgtcgtttaaagtccaacgtgcaagactgtacctcctttcggttcagtgcccggattttccacccgtctccggaggtgatggagcggacatctttggcttttccttccacaccttctttggttttggtgcggaagacggcttcttttgagccagctgctctaacttcttggccagtataggtgattttaccggcgtcttccaataacggttcctgggcatcgttgtttccttttccaggaaattctacatgaatttcaccaggctgttctccgttcccacgtcaatgttggctcctgcggtgctaaggaacggacgccccaggatgagtggtgtctccttccccgtgtccatgtccagcaccacaaaatcaaccgggatgaagaaatcccgtatcttgactggcacaatctccgctacccctgccgggtaacggactaatgaatcagccagttggaggcgcatcggtgttggtgccaacaccgtgaagttgagtttgtcgaagacgtcttttggcatgacgctgacactggctccaaggtcacacaaggcctggtcgaattgttgtgccacgatcgagcaggtgatcgtaggacaccccgggtctttcatcttctccaggaggttgtggagtatcaggttgctgcattgttccgtcagcttgaccacctccgttgttgggagcggtctcttgttgttgagtatatctttgagataacaggcgtatgtcggtacttgcattgcgtccaacaatggcacgttgatgtggatcttctggattacttcaacaaaacgagcgaactgttcgtctacatacggtttcctaatccgttaaggaaatggcagcaactatgtgtcgcagtactcttgcggcacggtcttttctggctgaacctccttgtcagccgtgtcattagatggtgcttcgtttgataatccattagttcctgcagggttaggatacgacggatcacgagtggacttacctcccctcgtcgtgatcgccttgacattttcaatgtaggagtcgggttgccccggaatcctcccagtttcagttgcagggactaaggatgccagctgagctaactggatttctatcattttattaaagctcagctgattttgaaaagcagaagcaaagccctctagtttgacattgatgttttctaggtccttgtcattggcagcaagccttttgcttaatgcatcagtagttctagcttgcacgaaaacgagattgtaacaccccaggtaaccacgtacctagagtgccacaccataaatcactcaaaccactaacttccaaaattattagaaatttcggcagagcctccccttcaacaactaaaagtctatctttgattgccaattatttagaggtaataaacaatatctacgaagtcaatctcatggaccataggccacacttgttccacttataataaactttctgagtaactagaacgaaagcattatcctcaaaaactgccctgaacatcaatagatcctgaattttctaagaaactcaaacattcaaagtaaatgaattaaatccactcaataaaaaatcaatgtgttgggtgcgtgtaattgaaaagaaataattcgaatatggaaggtcaagcaacaaaacaaacaacatgataatatgggcgtggttggtcaaggagggctggttagaaaagttaccgttattgttacctccttgataatatgggcgtggttggttccacccctaacctccatgtggacggtacccgttgttgttgcccatgtacatcgcctcctcacgggtttccgggctgtcattcccagaatgacctatgttgccacagacctcacacgtgacgtgagagtccaaggccttgacggtgccttgtggccatttctcatggtcgtccaagcgtttcatgaggaggtccagcttggcagcaagtaattccatctccttgacggtgtgcatgcctcactgacgggtctggagtcgttcctcgctccaacccatattggagaccatcttctctattagttcaaaggctccttgaactgttttagagaagaaggcccctccagctgccgcgtccaggtgatcgcgggacattggggtgagtccattgtaaaaattctgcaggatcagccagtcgtccatcccatgatgaggacaggcggccacgtactcctgcagtcgttcccatgtttctagaatagactcgtcccttgtctgctagaaactagaaatccttccacgaagggcattggttttgtccatcgggaagaatttcaagaggaatgatgtagagcatttgttccaggtgttgacagcagcacggttggcataaaaccactgcttcgctctcccgagaagggagaacggaaacagtcgcagcctgacggcgtcgggactgatgcccttgatggtgtacgtgctacaaatctctaggaactgttgcagatgagcattggcatcctcattaggcttgccacagaacgggctagcctgcgccatcatgataaggctggacttcaagtcgaaatccacgtcccctatgttgacctgtggcccaatggccacatagtcagcagagagagcagcgaactcgcgaagagtcttgttggccatagtcttgaaggtcggtggcgctggtacggctggtttctctgtcggtagagttttctgcggagcaacaactcgcggcttgacgctccggatgaaagcttctgcattttctttgaagttttccggcaggttgaaaccagtcatgcactaccctgttttcacaacaaacagtgaaaacaaccaaggttagcctgcaaaggaaaatgattatacagaggtaaatataaagtattagttcaagtaatctctattatgaatcttctcgggcaacggcgccagaaatgcttgttggtatttcttaacgacattactagaaatataattcccagcaatggcgcagaaatactcctggtatattatggttacagaattcatccgcaagcgcacagatataccattgtagcatttcacccgagagtattccaagggtatcgtatttattttatcccgtgggaagatcatgtagagagagcttgactaataatttatatgttacttatgataatcatattctaagcaggggttaagataatccaagggtagaatgacacacaagcattattactcattctcataatatattatcttatcttagtggaaagaaaagagaaagaaaatctattcctatacttctaatacacatagtatacatacattctagttaactggtatactagctaataccctctatccgatgccctcctggtacttcgagaagccacccctgactgccgagttccttacgacagcccatcatgaccatacaaccagggctaaatacggaggaataccctccctaggaaattaacttaggattatataccggcgcggaggaatacccgtactgagctatcaccatcagcggcccacctctcatccgcaatatataaccccaaataatgatatcccgtaatctagacaccacgcctaaactatcagatacttctctaatatcatcgtcatgacatagaggaattgcataagcaaacattatacccgcaccaaagcatcttccagataagctagccgtatattcagtataacatgaacataatgtaaagtaggtactcatatactcggaaagtatttcaataccataaatgtatttagaagagtattctaataaaagtacaaagcttacaaaagagaagagaaaagctactagagccatacccgaactcttccgaagacttccgaactcctgatttctactctattcctattccaccagctagatactactaaactaaacttgagagaaatgagagagctatttcttgaggtgtgtgttgaagtgaagagagtgaactccttaaataggcaggtaatgacggttatggtggttggaaaggtcggtaataccctccaacagccatagggagtgaatctccaccgttccctcaaaaccctgcatccatcggcgctggcataggttcggccgaaccctgggctgtcccaaccagcccacaagttggctggtggcctcctctggtgttcctcttcgtagacttgtgaattttggcccagtgtgtcgtgtcatttttgagttctcggcccattcatacataagtctggttctcgacatcgtccgattgatttatcgtttgtgttgatgtcgattctcctccactttattgtcattctctgcaaaaggttagtaaacctactactagtggaatattattattctaacatatttattcattgcaagcatcactagttctcctctattttggtaatatcaacagatacgtctggtgaaaacagaggaagaggtactatcatactcaaagtcactaaaagtacccaactgaataaaaagggaggcagttgagatctggcaagtggtatggagcctcataataaacacttcccatcaaggaagaaaatcagcagttagagtacacacaacgctggtacactaagaggatcatgcccacatcaaaaagcattaagcaagaagaagaaacatatgaaaaatgcatatcctcgtatatctatggatactcgcatagagtctcatacaaccaatagaagttaacaatgagacctattatgggcaatgtttcctttagacagtaaaacttattggcaatcaaccaggagttgaatggaattaatcaactagaagttcaaaaaaaaaacaacctgaatatagacaacactgaagataaaatctggatgcttttcaggagcttggattggacacttgcataacagtacataaaaaagtacttagtcctaaaccaatatgtaatgtatataataatctataaagaattgaagaagcgaactcgttcattttgaatttgaatttgatttgaaattgaaatgtttggctgaatctaaatcacgcttagacttgcagctaaaaaatatgatagatggaagcttagtacatcagtccaaccacacttagaaagtgatcaaggtgcatggctttggagtagtcaattatagctaaaattgggacgaaattccaaacacgagtgtgtgatagcagcactcgaatacttggctaatcgggactaaaccgaattaagtatcattgaactatacatagccttggcatggctttgagagatggttacatcgctccagcaatcgtggttcgaaaattatctcaaccccattattttatttgaaaataatgtagcgtatgacacacaatgcaaatgagttcacatgaacaaactcactcaaagcatatgaacctcccaagttcttctatgcacatgaattgcatataaacaacgaaatattgcatgctaagttatgtgaaaatcttgctgattttatcactggtcattgttgacatcttctcgaatagatgtgtccaaggaaccagaacaatgagacttgtaagaatgtaaaatttaaggggagaatttcactgattcattcagaatcttaatatagaaaattcaaatacccaacaaatcaatttagaaagattgaacgaagaattggatgaattgtactctttttcccttgataagttattactggagtttcttatcaaggtttttaatgagacaattcgtgtgacaccgcatgaattttttgtagagttttgatgcacaagcatcacacaatgagagcacggagggagtgttagggaaccagcggcccatgaagagcggatcactaaatatgaaaggtggatgaggctatacctataaatagtggggaagagatgatagattgtacacttaaaaggatgaaagaatgaatgaaaagctgcccctccatatatcttgtgtctcagcacctctgaactatgcatgtagcaagactacgcatataacagatgggttgtataatacacacaacgggttacactaatattaatttccccaaacaccatagggaacagctgaagatcagcttgccatgtcatcaatttttgcataaacgcctctagttttcaggtgataatacgtacgtccgcagtctcttgtcatgcatttcgaccgttatcatatactcttgcagttaattgatttaacttagcatttatatcatgtaaatgcgaaagaaaaatagagtaagggcacgtacaacggcattaattagccggctctctccagtgccacataggcaaatcagatgacgtggaagagagatgatcgatgagagagaaacaacgatgctatctgtgacatcgttgaagcatcggctcctctcgcgcaaaaaacgagcagacttgaggagagccctccgttgtagaatcggtttccagcagagccgtgcctccagatccaacgtaaaaattgcgcgcggaagaaatttggcgcgggtgagggatcgggatacgggagggcgggaatcggaccagagatgcgcgccatccaatttcttcgaccccaaatatggcgctgaaatcggcagatcgggttccagtccaatacgtcgccgctacgctcctccacctcgctgctgccttggatcctccacctcgccaccaacctttcccctccacctcgccgccgacgttgctcctcaatcactcactccatcggcgttggctgtatggctgggagacggacaaaggtggcatcggtgcctgagacatcctccgtcggtaccaacacctccggcttctgcttcacctcaactgatgcccccgccgcctttggtacctttcctccctatcttggaatacctcccttctctgcatctaggataagcgcggctgcgacgggtggccatatttccccatctccttcatggatacagacagacaaaagctcagataaagctgctacgccggatttgtcctcgccacatgcaaatatgcagagctggtaaccacaaatcccagcaataatctctactatcttacgaagattcagttctgcaagttttttgttctctgaatgaaattattaaacggttgccatgttctaaacttgatatattttctgaaaatacaatgagtaaatcagtccaagattttctgaaatacatcgttcaaagcagtccatataaattgacagataaatattggtatataatccataaggttactgtttgttcatataggtctgtacagattaagttattgtacatctttggccatgctgaaactgaagagacctatagttgccatgttatgttatttctctgtacaaactaaggtttctatattttttgggagtatgtcacaccttaaaaatcctaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttttaaaatcctcttttggctttgggccgaaagtcggcccaaaaccttctctctctctctcctggcccaatccggcccgcagccgagccgcccgctcgcgctcgtgtccgcccgctgataggtggggcccacctgtcagggctgtcgtcttcctccggccgcccgccgcccgaaccctagcgtcgcgccgccgccgtctccttccaaatccggccacccctttccgtttccgatgaaattagtagaggggaaatgatcttcggaatccactctaccttttcccttttggaaacatcgtctaaatcgctttggaaatccgtggattcgagtttgattcggatcgatctctctcctccgaaccctagactttccatcgcgtcgccggtcgccgtgggccttcgccgccgcctccttgcccctttaaaaggacccccaagcccgccgctacctgccgccacccttgcctttgcccgccgccgtcggtagcgccctagcaccgtgcagccgtgcgctgccgtcgccgccgttcgtccagccgtgcgccgccgccgctccggtcgtcgtcgtcactcgggaaggccgccgtcgtgatcgccaagccatcgccgacctcgtccgcccctccgtcgtcgccgtaggccgccggaacaccgtcgccgttgtgaagccgaaggtcgccgccgcttcttcctcaacgccgtcgccgttcgttgatcttccgccgttgttttggtcaccggtgagttcgccgcgtcgccctctacgtgttggtgtcttccgttcgcgtcgtcgcgccgtcgttcgccgacgagcttgcgcgcccgagccgccgccggtgatgacgtcatcgccgacgtcatcgttgccgtccgtcgtagaccggtcatagaccgttggatcttggccatccgttttggataggatcgatctcggccgtttgtttccgtgagccgccgccgtgcacccggtccaccgcgaaccctagccgctgacgcaataattcccttttccttttcaaaaataattcattattgcgtcataattcaattaaaatccatataagtgttttaatccgatttaacctttaaaaattcataactaattcatcttagctcggatttagttggttcaagtctctaaatttttctaaaatagagatctacatgttaaaaatatccacatgcactgttcatgcttgtttatgtgctgttttggtgtttttgctcttttctgtttagattccaacgtttccggagagttcgttttcgcaggagaagaatttgaagagttccaaggccagcaaggcaagtcacacagatcccaaacaaccttttgagcatgttgatcccgtttaaagctattgtttctattcaactattgcatttattttcgaatgtcattgggtggaattaacctattgtttgttatagcccttttgttcttgattattttattccttgataccttgggttattataacttgactagttgggctttatatattggttcaactagatattagatacgattgcttagcaatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagctagcgtgggcaacggctttaccttttgtatagcatggttcattgcggagcaccagtctgagaagtggcggagataagcccacgggggtcgctggggagtccatgccttgtttataagggggtgattatgatccaggaaaggtgcgctgtggtggattgtgttgtgcgggggtactgtcacagctcctttccgaggtaccgtggtggtattgaggcacatggtgacatgttgtggggctgtgtcttgtgggtacagtggtacatctctggccagagtaaaactattcgaatagtcgtgctcgcggttatgggcaggtctaacaatgtctttcgtgattagtttcacacttctcaccataataaaagatgctataactggtaataatttgtttagctcctggtttgaaatggtatattcctggtttggagatagaactgtgcagccgggatggttgttcagaatggttgggcctatgcaacagggtatgttgtatagcgttggattaatattgtttaattattacttaactattttattaaattctgaaatgtttattaaatgctgtttatgcaaatgaaaccctactatgccatcctttgttatcctgtgcactttcatatttgctgcgtggcttgctgagtatgtcatatactcaccttgcaatcattcatcagaggaagagttctacagtggtgctgatggtgtggaggattaggtgtagccctggtcaagctgcctgtggagtggagtcgtctgcgctgtttatcttattttttccgctgcttagatctttattgattgagaggaactatctacctctgtaatgacattttattcgcttattaattagagtaataattgtactctattatcaatttgttctaagcacgacttagtagatcaaacttaactgatgcagcactaagtatgaaaagaaacataatatctagacaatcaagccgttgactgagttttcatggtggtagatgtctaagctaatctaatctagcaacgcgatttagccgataccggcagaaaccctaaaacgagaagcagccgatagagctaaattgatatgctaagactagattaacaaagacatatgataaataggtaggcgaatatatcatccaaaccagagcaatccaagaggtcgaatgtactgatgcagccttgaacgacgccgacgtagacgatacaattgcctaggccgacggaacattggacttaccccttcgccggagatcgaacaccgatgcagccccgcgtcaggtgccaagtcccgccggatgataaaataaagtagaaaaggtaaaaggtggcgatgcgccgaattgtattgatctgtggagatagattacatataccccgggtgtacatatttatacccattggttgatacaagtccttgtcggacaagaaagaaactttcctaaagataaaaggaaaagataaagtccttataggacactaaacacactttcctaaagataaaaggaaactaacaaactattcctaattaatagataacttaccatgccgcattctctttgaactcggtctcttctggataagcttcctttagtagatcaatttccttaaccgaatatagcaagaatccgacaactgacgacttgaaaactctcattggctaatctcaggacttcgaagccgatgctgactctaagccgatgactactccgggcttaccaaatttcactgttaacattaaggcactgaaattgtgagcttcttgcaggggaaatggtacacaccgacctggaggattcatgagtttttttcacaatcagccaaatatatctcaacattacaattttgccggcacgccttcacactacacaccattacatgctaatggttcttcaccaccacttgctaatggtggttcttctatgccgcttgcaacacccactccacccccatttactgggaatcaggaccatgtcaatgttgatagtgatgatgacactagtgtcgctcggaccaaattgaagctaaattggacccaagaggaggatgttagactggtgagaatgatgcagattttacttgatttgcattgtgaatatgtgtgcataattacactttcttttgttatctttgtagatgatcttggttgaacaattcaatggacccaattaatgggaatgataagaaggctgaaaaatattggggagatgttgctacagaatacaataaaaccacaccacagaatagatggagaagcccaaagcaagccaaggagcgttggcacaaactcaacacacggacggatctgttccaaggctgttggttgaaggctaagcgcacatatactagtggttactctgaccaaatgtggattgacatggcccataagttcaatgaggccgataacaaaaaattaggatggttcgttctaatagatgtatggtacgcatgccgtgatcagcctaagtggaatgcatataatgatgcactcaagagagatctaaaaggaagtcgtctaataacagatgttgaagaaaccccacggccaatcggacaaaaagctgctaaaagagctgcacgtgaaagcaagggaaagtccaacgatatttctgatgctgaagagatatacaagttagaccaagtccaatctgatattcacacaagacgcatgaagatgatggaaatgcaagagaagttatctagtcgtcaggttcaatcatcaaagctttctcaacttgctgcacgagaaaatagattagcaacaaaggaaactaagtgtttacacccaaatttggcacctaggattaaaataggaaggattgccaaaatttggaagtctaccggtttcctccgagtgggccggtctgaccgccgtgtgttgggcggtcagaccgccggttgagggccggtcagaccggcggtgtgtggccggtctgaccggcagggccgagtccgattgtgtttcgtctagtctcgaggtttccttgctcgggaaggcatgtttcgggtttcctttggtttctaccccgagttggacatggaggagggcctgtatagggcaagaccaacccctatataagggacatggccggttcattgtaaaaaaatctaatctactatcaatcaatcgaatcgttttttcatattactttttagttttctcttagtttgtccatctttgtcggtttgcaccgtacaccgtacgccgacactgcgagagtgcgacacctctttgtaggtttgtcctgaaaaccttccttttgcccacgagacgggtagtaatctagaaatctgctccgctagctggtttagttatcaaaacccatcttaatttggccctttggctagatcgagttggttggcgactccatatcaccgcaaggcgtttaggtgttgcgatcgtgcttgtcgacttgtcacaaaaagttaccaacacgatttttggcgactccgctagggaagtcctatggccggtaattggattatcgccctgagataacatgttttatgcttttaggttcatgtatgttcaccaaaaaggcaggggggcatgtgtttacacccaaatttggcacctatggacgaaataggggaaaattgccaaagtttggaaagtgacgggtttccttcacagggccggtcagaccataggtgtgtgggcggtctgaccggctagtagggccggtctgaccgcaggtatgtgggcggtcagaccggcagggcccgagtccgagtctgttttcgtagggtctcgggtttccttgctcaggaaggcatgtttcgtgtttcctttggtttttatcccgagttggacgtggagaagggcctgtagagggcaagaccaacccctatataagggacaaggccggttcattgtaaaaaatctaatctactatcaatcaatcgaatcgttttttcatattgcttttagttttctcttagtttgtccatctttgtcggtttgcgccgtaaaccgtccgccgacgttgcgagagtgcgacacctctttgtaggtttgtcctgaaaaccttccgttttgcccacgagacgggtagttatctagaaatcggctccgctagccggtttagttatcaaaacccatctaggtttagctctttgctagatcgaggtggttggcgactctaggatcaccgcaaggctttaggtgctgcgatcgtgcttgtcaacttgtcacaaaaagttgccaacatgatttttggcgactccactggggacgggatccgttcatcgtcaactgaacttcgacttcgccatgacgaagccgccatccaagacagaggtggagccatccaatatgatcccggtcacattggatgacttcgaaggagaagatcgtaaagctatgtaggagtacatcaacgagctcacacgggaggcgttgatgagggcaagcactaggacccgtcaaggcgtaatcatcaagcccggaccacgtcctaagctcgctcccggctcggtaagcaatgatgaggtatcacaatctatccaacaacaaattgaatctacaatagattcatctatgattatttttaaagatcagttagatgcaacttttgagggtaaatttgatgagtttttaagggttaaattcggccctcttttggccgatcacatggtgaaaaataaagcctcttccactgctaaccaacctcctataggtcaaaccgaaggaacggtgtatacggccggtccgaccggccagacggccggtcagaccgggtattaccccggcagtcagaccgggactcaggccggtccgaccgcgcctcttgacgccggtcagatcgggcattgggccggtcagaccagcgcaattattcctatacaggggatagatcctatgactaatgctagttatttgtatcatcttagaacatttgattcccctgtatctactgctacgagtagtccccaagttcccccacatgttcccaatgcttataacgatgttgctaggggatatcctcccgatactagacaaggccaatataataatattgcgccacaaacacaacctattaggccaccaaatccaccgccaaatcaacaagggcctaataatatggaggatataattagtgatattatgaggaatagattcgggatcaaaactaggaatcgtgctagaacttacaaaaagccgtatcctgattattatgataatgtgccgtttcctcgtaattatagagttcccgaatttgccaagtttaatggtgaggatggtaagaccacatgggagcatgtaggtcaatttttggcgcaatgtggtgaggctaatagtgatacttttaaattgcgcttgttttctttatctttgtccggtaatgcttttacatggtttacttctttaccggcaaaatctattcatacttgggctcaattagaagaaaaatttcatgattatttctatactggagaaactgagcttaggttatgtgatttgacatcggttaagcaaaaatacaatgaatctgtcattgattatattaagagatttagggatgttagaaaccgatgttatactttgaatataactgatagagatttggctggtcttgcttttaatggtttaattgctcctcttagagaaagactagatggccaagaatttcttgatgttagtcaactcatgcaaagggctctggctcaagaaagtcgggttaaggataataaaaaatttgctagaccatttgacaaaaagcctaatgttaatgtagttgattaccctgaggctagtgatagtgaggaagagggtgatcatgatatttatgttgccgaatggtcatggactaataaaaataagccttttgtttgttctaacttaatgccgactccacgaaagatcggcaaagtgaggttaaatatagttttgatgtggccaagtgtgataagatctttgattatcttttgcaagaaaaacaaattagattacctaaaggccatgtcataccatctcaagaagagttgaaacgtcgagcatattgtaaatggcatgattctcattctcactctactaatgattgcaatgtgtttcgacgacaggttcaatcggccatagatgaaggacgattgaagttcaccaatggttccaagatgaagcttgatgatgatccttttccggtgaacacaattaatttcaatgataagaaggtgttgattcggccggagcaagccgaatctactaagggaaaggaagtggtcattggtgaaccgaggcctaagatgatagtgccaaagaagccggaggtgggtgtttggaaagaaaataagagtggagcttcgacttctaaggcccctaggaagaccaaggtgacttttgatatgctcttggagaaatatgagaggcaaggtggtgagaagattcgcaacagagggaaaagaccaagatcacctcctagggagcgatttggtcattcaccaagacggtcgcattcaccttcatatcatcatccacaagacatgtcatggggtccctatccaaagccgccgccgggttatccttatccctacttcaagccatggggggcaacgccgccaatgtacaattatatgcctccaatgcaattcaaccaagggtggggaggaccaaggaggccaatccatgagcgtctgtcttcaccaaacaatagccggttttatggtaagaatcgggctaatgaagaaaagagggaaggaaagcgcgtcaagatggaggaaaggacttcggaggtgattactatcaaagtggggtctcatgatgtgccaataccttctggagatggagttggagtgtccccgaacaagaaatccgaagccggtaccagctcctcgcagtcggccggtctgaccaggccttctggctggtctgaccgcggccatacggccggtctgaccgccgacctgacgacggtccgaccgacgcctcaggccggtctgaccacgcgccacatgtcggtctgaccggcgcgtctggccggtctgaccggtggtctacggccggtctgaccgggctccagcgccggtttgatgagagggctgcaataggcgatgtgagggcttcatcgtcttcaaacaagattaatagagggcattatttacctcctggaacagagccgaatcctaggtggatgcctaaggatttgacggctacgcaaaagagaaggttgcaacgtcttcgggcccaagaactaagagagaaaaaggccgaagaacaaagagataaaaggttcaatgagttgcgaccaccactggtatggaggcctaaatccatagagaaggaaaaaccgattgatgtagaggagaaggaagaacaatcggttaacaagggtgaatcgtctccaaaagaagacatggatatcaacatggtatgtatgttgtctatggtgttttatgctatggataaagccgaggttgctcaactttcattaggtcctaaagatgtggtttttgagaagcccgatgagtcaaaccgtcacatgaagcctctctatctcaaaggccatgttgatgggaagccggtctctaggatgctagtggatggaggtgccgccgtgaacttgatgccgtactcgttattcaagaagttggagcgtgaggatgatgagttgaagaagaccaacatgattctcaatggcttcaacggtgaaccaacggaggcgaagggtatcttttcggcggagcttaccgtggggaacaagacgctaccaaccgctttcttcatcgtcgatgtgcaaggtaactacaatgttattttgggtcgttgttggatccatgccaattgttgtgtgccttctaccttggatcaatgtttaattcaatggaacggcgatgatgttgagattgttcaagtggatacatcggccgaggttgcaatggccgatgctacttttgaatggcgtcatgggaatatccaatgcctatcggggagggatctttctagctatgattttcttagcatctccgatggccaatttgtacctatctctgtaaagccggctagtgtagcacggctaagccatataaatttgtataatgagtaaagaggctaatttagagtggttacaaaagagggtgcaagaatatcggtctacaaagaacgatattggtgaaaccgttgaggattttgaggaaatagagaagcttggaaaagggtttacatcggccgatcctttggaagaagtagacataggtgatggaactaaaccaaggccgacttttgtaaacaaaaatatgagagccgattataaggttaaagtaatcgagctacttaaagagtatgttgattgctttgcatgggagtaccatgagatgccgggtcttagccgtgagcttgttgagcatcggcttccaattaaaccgggttttaggccttataagcaaccacctcgtcgttttaatcatttactatatgaccgggtcaaaaaggagattgatcggttgttgaaggcggggtttattaggccatgtcgttatgcggagtgggtatctagcatagtcccggtggagaagaaggggagtggtaagattagagtttgcatagattttagagatttaaataaagctactcccaaagatgaatatcctatgcctatagccgacatgatgattaatgatgcctcgggtcataaggtgattagctttttagatggtaatgccggctacaatcaaatctttatggcggaagaggatatgtacaagacagcttttaggtgcccgggatttgttggtttgtttgagtgggttctcatgacttttgggttgaagaatgccggtgcaacatatcaaagggcaatgaatttgatctttcatgatttgttaggtattatcctagagatctatattgatgatattgttgtcaaatcggatggtat

SEQ ID NO: 64075 - DNA, 10009 bp, Oryza sativa
atatgcgtccagaaacgcttaagtatttgcataagtcaagtgtagcgatgatcggtatgttttccaaaaacgagctgtcgcggtttcaacgttcggcgagttgtgcttcggccgattcgtatcgcccccgtggcgtttttgtcgatcaaacgtttaccttggggtttttccaaaaatatcatacacaaaaaaggcgaagacacccatgaattttatatgactgagcgtcagtttgcaattgcccagcctcgacgcagcataatcctcgtttttccttcttcaccgctttaaattttttttgtgttgatctaacaactagcgatgaagaagatgctcaagggggtagtcctttgccattgaggactgcttttgctgatgaatcggatgtaaagtccgaatccattttggcgggcaatggaatttatctataacttgtgctttttggcaaataaatggggtgtggtgcgtgttgcggctgttcggctcgtactttcccctttttgcctttggcaaaggtatttttaggtactttaatcgttttgaccgttgccgcctttcggtctttttagtactttgacctttttaattgttaccggctttcggtcttttctttagtgctgctagggttttgcctttcatccctttcggctgccccgtttgtctacgggtgtgcaaccgatgcgaactcgatttcaagttttagcccctcgcacatttcattggacttctcggagtcaaaccgcttgttattgccggtaatgaactctttcggaacactgaatcggcagaaaatgtttttccgaacagatttttacactagtgccgaaggtactgccttagcccatcgaaggcggcttgacactcaggtgtccaattgagtttgccggccccttggaccatcttgaaaaatgataaatctctttcggctactcttgggagcaactccttatctcattttcgcccccagcccttgtcgccgtaactcgctggtactgtggcgaaaggcgtgggtgtggcgaaacctcttcgcccgcagcccttgacgccgtgccttattggcactatggcgaagggcgtgggtgggcgaaacctcttcgcccgcagcccttgacgccgtgccttattggcactatggcgaagggcgtgggtgtggcgaaacctcttcgcccacagcccttgacgccgtgccttattggcactatggcgaagggcgtggcgtgtggcgaaaggtgtccagagccttgggcggcttcgaagccccccagcttggacttaactcactttcgcctctagcccttgtcgccgtacctcgcgggtactgtgacgaaagggtgtgagtgtggcgaaaggtgtcccatttcgccgtttcggcctggattccccacggacggcgccagctgttgtcgaatggacaacaatgccacgtcgaaaggcgtggttctctcaacagtagttggaatgtaaaagcaattgtattgattcgtaaaattttttggggatccccccattacatggccctagaggtctatttatagccttagcataagcttggaccttctagggtttagggttacaaaggattttacatggttgcccttatgaaagggacatttacatgggtatgcagtgtcatttgcacatatgggcctttaatgggctgataggctgggcctggtctatagcaaacgggcctaaaaggggcggcctattgggcctccttgatgccgaacttgtcatggcgaagtctttgtagttcgcccgagatgccttcgcccgagatgcctttactttcggagtaccgacgcggctttcctgcctacgccatcttcgcttatggctttcgccataaggcttcgcctaaatggtcttgacggctttggcttgaatccttgctggtactatggtttcggcaggtccggtcgaagggcttcatggcatgcctccaacactaaacataaagcatggctggatttaatttttattaaattctccatgattaattatactctctgaaattttctcgaatttttcagagctcaattcctaattttaataatacaaagaacagttcagtaattagttaatcgataaattaatcattaatgatctagttataattatgttaaatgcttttcttgtttaaaaatccttaaattataaattgttgtttaaaaggaattattagaaataatcttaaaagcctaaaagagaagatctaattttaatttgctaaatctcaatataaaagtgagctaaataaaattttgttaagtacttctcttgtttctatagttcctatatgtttctaggatttatttgagcaaaggaagtatttttaataaacggaatatcatttcatgaataatttaaatagaaaaaggttttaaatctctcttttggctttgggccgaaagtcagcctaagtctctctctcccttccccttggcctgctcgtgctcggcccaagccggcccataccgccgcgcccctccctcctctctccctttcactgacaggtggggcccacctgtcagtcgtcttcaacctccggccgctcctagccgcgccgcaagccgccgcctccttccaaattcggccgcttccttccttctccggccgaattgatagaggggaaattatccacgggatctcctctttcctttctctttaggaatcttcggctaattttgtttggaaatcattggattcgagctcgattcggatcatctctctccccctaaccctagaccttccatctacttgccgccggccatgggcctccatcgccgcctcttagcccctataaaaggacccccgggacctcctcttttcgccgccaccttcgccctagcccgccatcgcttgtagcgctgcctccgcgtcaacccttgcgccgccattgccgccgcaagtccagccaagcgccgccgctgctccagtcgtcgccgtcgctcaggaaggccgtcgccaggttcgcaaggtcgccgtcgtccttgtcccgtcctccgtttccgccgaagactaccggagcgctgccaccatcgacgacccgaagaccgccgccgcctcgacctcgccgccgtcatcaatcgtcgccgtccgtcgtcatccaaaccgctggtgagttcgccgagccgagctttacgcgtagatgccctccgtttgcaccgccgcgccatcgtttgccgacgagcatagtgtgccgagccgccgccggcgatgacatcatctctgatgtcagcgctttgtcagccgtagaccgtggtagaccggatcgatctcggccgttcgattcggtcaagtttaggtcaattagatcttggccgttggtttcgtggaccgcttctgtgaacctggtttaccgtggacggtctttgatgatgcaataaatcctttttcttttcaaaataattctttattgcgtcataattcaattaaaacccatataaatgctttaatgcggtttaatctttagaaattcataactaattcattgtaactcggtttaatgtggttcaagttgcaaaagttgtataaaataaagatctacatattaaagttatccataaattgtgttaaatttatttaatcctttttaaataagctttaattaggttaaatcttgtaaaatttgtaattaatttatatgaaatcggaatgaggccgttcaagtctctaaattcatctaaaatcatgatctacatgtttgtttactttatgtgtactgtttatttggtttttattagtcttttttctcgttttgcgtgttagcttgtcgtttccgtcgtttcgaaagttcacgagtgcgtcagaagtattcaagaagattaactgaagaccctttattgcaaggcaagtcacacagattccaaacacaattcctttgagcatgttgatcctatatttaaattctctatttatttcaactgtgcatttattttcgaatgtcaccgggtggtgtgaacctgtttctttgttatggccaatttgcattgattaccctatttcttgattacctcgggttataagttgactagttggatttatatattggttcaactagatatattagatgtaattgcttagccatgcttagaaacattagcacacgattgggataactaatatttcactattacttaatgatggatatttaatgatagctcacgatggttaatcgtgattggttaattaattaattaacttgccaactaaaacttgataaaagtgggttgtgagcacatggttttgatggtcgtgctcatgataattaaggaccggttcacgagtttcggttgtgaaacattaaccgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaacagtgcgctgtggtggattgtgttatgcgaggggtactgtcacagttcctttccgaggtaccgtggtggtattgaggcgcatggtggcatgtcgtggggctgtatcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtacattcctagtttggagatagatctgtacagccgggtatggttgttcaggatggttgggcctgtgcagcatgggtgtgctgttcagtgttgattaatattgatgattaattaatttactgttttataattctcaaatgttggtcattctaactgaagaggtcagtgacaataatcaaaattagtatctctttcgttgctattaccatatgagaatgtgtatctcaacctttgcgaatgttgctatttcagttcatagatttcatcctatagaaatagttgtttgcagaaaaaaattaccgtttccaatggctactattacatttatctctaacgccttcatgtgtagctctccatttctacctagataatcccgcagcaacgcgcagggtattatctagttacttataattgtcagagcccaagcaggggttaaatataatataatatctagcatttcaatctctctttggtatctctatgttactctcagaaatgagtactctaaacgaatgagcacattgacactctttttactacacgaaagattatggtgcacaccatacctctcatagagcaagaatgggtattttcaactatgattcacttataaaaatgacctagagagtacagtaatacggtgcaccaaatttgcaccgaatattgtggaaactcttgatgttctatctaaacatgacgaaagtcgcacgcaagtatcattagtacgcatgcaagaagtatgcctagctagttgataataaaattgtgtaacatataggatagtgtttactagaagagtattgtcttcccaaaccacctagtgtatttacctcaacgaaagaaaaggaaaagtgggagtattacatagttcaaggtgaacaatccacaaccatgtactcatgaatacaaaaagaaaatgatgatcctaatagcatacccatcatgaattgagggggataactcctaccctatttgcatggctaaggatgtagaatctctcatactagaccgcatacgtcctaaaaatttatatcagaatagaaaatctttgccatagttgccaagcaagaagctcgctatgaagttaattaaatgcgacgtatcggaatactttgttgaatcaatctactttgtcatcatttgttgtaattttttagtagaatattgaattgaataaatggttttatccaagtagagcatacacttttccctacaacgaacggttatttctagtataaattagcatatttaaggtatttactattttgttgctattttctagcacatggttataatgctttgaattttgtgtagcactcaaacataaaaaaaaggaatgaattgtggaacgcataaccacaaatagcactttaagataaaaaggtatttccagaagcataaaactggaaatataatgactattgctagaagcaacaactaaatttgttggcctagaaagcatcacagtcatattacctatggagcaattatgcactttgtagaagaattgattgtacaattaaccctcttgaactctctaaaagtgtgacgatttgggctacactatcttttagcaatagatttttggtcatattggtcttagaattataagaatagacattacaactcgtatagttatagcacatatatgcataatttcctaaatcatgaatatttatgtgccagtatgccccaacaggagattaatgcatagaccacataccatgaatgtataattataacatcgaattggattgcatggaatacttaccatcctatttttggtactatatggatagagacgcttctcaagtagtgaacatccaatgcctattcgacaccatatatttgccaagattgatccatcaagagcatataaatttgaacaaatttcactaatcatctttagaagtacacaaggacaatgctagaatagcatttgatgattagtgaactagcagcatgaagtaccaaatatctgcatgaacggactaaatataaactatgaattgtaatacttgctatgtcattgttataatacctgcagtatgaatggacatgtagtcttgaaatcagcggattctgaaagaaaattcagaccattagcatgaacatctgctctgcaactagtactattgcatttactttatttgtgtgcatattccactatcatagtgcattgcaaaagactctctccgaaagtcaaaaactttgaatgaaaatagttatgaagcctaaattccttaactatatgtatcattgatggtggacccaaatcacacggatgaaatgcatggagatcgagctatatgtatcacttgttctctccatgcacatattgatatattcatatataatattttcatgtgattgacatatgcatgtgagactaatgttttgtttgagtcttatcgcttgtttagtctatttacgttgaggacgtggagatgatgaaggtatgcatttattttaatatctatatttgataaatgccttctatttttgtataggaaaagctcccaatgtttcatctctatttatgcatactcttgcttcacacaaatattccgtatgcatacatttagggggagcaaatcctataccttagttatgcatgtatttgatctaagttattcactttaatttaattgggatctttatatttgagtatatgacacttgtggtgttgattaatactcatcacttatccatattcttttatatacgtgattggttggtcaacatgtgaaggttgacaaccagatcattgggactaataattttattgagttgaataagagaaataggtcccaaggattacaaaggtgttgatgctcatgtgatatcattacacctaaaattaacaagaatgacaaagtggagatattgaagatgtgggatacgaaatggctactatggcaagacggtgaagggcaagcgatgctcggtcacgatggaccatgcggcggtgaagggcaagcaaggggcttggcgccgaagaaccaaatccggtggtgaagggcgagtgacggctttgtcatgatggatcgtgcgaggccatttgaagctacaagtaaccgcatcaatcatttgaagactatatggtgaaacggtttcggcattgcgtcccttaagacaatgaaagaaagatggaaagaaggcatttctattggtataatttttttcatatttacatttgagtttaggaatgctgtactattaaaagggatgcaacgtcgaggtgtttgtgtatgtctcggtactcaaagtgacctatcatagtgctaccttgagagaaacccaagctttaacctatccttttgagtggttttagaccttgttcttggttgagttgcgtagtcctctaagtgagctttgcatagagtctaagatcatcaaaaacggactcccgagcaaaaagttatggtcattttactctgtgctttccggaagttccgaaaaattattggaagttccgaaaattccagtctttgcctccaacagctagttttttaggggctcgggtatataaactcctccatccctcctttgagtggctgctgttcttgtacagtattagacacatccaaagccaaatagccatccccatttccctacctttatggtgtctctttgtgagagggatttgagaaggggagagagttggattgagagattgagaagttgagagctagtgagcttcactctatactttgagcactcaagttcatagcaagcaaatcttcgattgtatttgttactcttggtaaggtctcctagacggctaggcatcgccggtgagcacccaaggttgtggtgtgccacggaaagtttgtgaaggcttcgatttcgcctccgcaagggaagaaatcaagagtgaaaccgaggagtgcatttgtgcaacctcatgaggaaagggttgaaataggcccggcccttgtggctcctcaacggagacgtaggattcgtggatctgaactttgggaagcaaatcatgcgtctcctctcttggtttgcccattcttgcattctcttatattgtgcttgagcttgcttttacccgatctacttgcatacttaattgatttagttggtgaacttatatcttgcttagatatcttatttgtcaccttttgattcatatacattttgtttgtttgaggtacaagttcatagctagtgttttattccgttgtccgcctaacttttcggttgagaccggaacttcgaatcccataccggaagttccgatttgaatcgaaagttctcatcattccaatatgctattaagttgtgataatttttaggaacgcctattcacccctctctaggcgacatcaaggtcctttcaattacaccagaagtgtacgaaaagaattgaaactactaaatcactttatgattacttttgtgattgtgaagagtttgactagttgcataattgaaatgcaccgaaggagggtgaaataccgaagaaagtaaagctatccctcatcttgtctagaggccccaggtaaaaataataggacaagaaactccgactcttcacaccacctaagtaacttgagactgttggtatttcttaacgacattactagaaatataattcccagcaatggtgcagaaatactcctggtatattatggttacagaattcatccgcaagcgcacggatataccattgtagcatttcaccccgagagtattccaagggtatcgtatttattttatcccgtgggaagatcatgtagagagagcttgactaataatttatatgttacttgtgataatcatattctaagcaggggttaagataatccaatggtagaatgacacacaagcattattactcattctcataatatattatcttagcttagtggaaagaaaagagaaagaaaatctattcctatacgtctaatacacatagcatatatacattctagttaactggtatactagctaataccctctatctgatgccctcctggtacttcaagaagccacccctgactgccgagttccttacgaaagcccatcatgaccatacaaccggggctaaatacggaggaataccctccccaagaaattaacttaggattatataccggcgcggaggaatacccgtactgagttgtcaccatcagcggcccacctctcatccgcaatatataaccccaaataatgatatcccgtaatctagacaccacgcctaaactaccagatacttctctaatatcatcgtcatgacatagaggaattgcataagcaaa

SEQ ID NO: 64076 - DNA, 21520 bp, Oryza sativa
attatgcaatcaataatgtttgtcttccttgaattatacataaaaaattcagacctaaatactattgaacaatttttgcctgaaaacaaatatcttaagtgctgcctgactttgaaatttctctgcacacatcaaatttttaaaatgtgttttttagaaagaaaaggtatagccacttttaaggaaataataattgtatacatgaaccagattacaaaagaaccaaagcaaatagtgtgcaatcattaggttacggtgacaattctgaattccactaagcgatcagtatcacaaaccctataaccaggatgttacaactgggatttgggatccagaaagcaagcagaaaataaatctagcgacaaaaaattacatagatgaccaattggggtcttggggaacaactatcctgacaaatttcgtacactagtaccattcatcatcagttataatcgtaccctcctctatcaagtagcatcggccaactggccaaggatatatttatatgcgggatccttgtagtgcagtttgtttaaatatcaattactcattggatggaaataatgtagtgcaggaagccaggaagttaaaaaccatttcacaaatagcatgcaatattaccaacggtctaatagatgccgctctggcccagatgtatcctgcccatttgcttcgagcatgttccttagttcagcagttgacacatgcttcttaagttcatccttcaatttccaaagtgtgtcactctgctctttaagcttttcttgaagatcagaagaattagcattggaatcatgtgatacaacagctttccctttatcttctgctgtgccttctgatatactcctgattatcttgggagctttgcagtcgtgtatatcattctgattattcttgcgcttggaacccttagaagatgtttgtccttgagaaacaacaatacaaaatatcaagtcagattacgaagtggcgcgaagaaaatttgatgcccatgtttcattacctgagctgggggcatctttcttaacaagatcaagaacagctcttttatcctcatgcgacaggatctcccagcctgagaaattctcaacagttgcagctggggacatctccagaaaacagctggcgtgataccaaccttgcccttcaagcttagatgaaacacgaacctagacaaacaaataataatactattacagaaacaacttagagtgaagacaaagaccatgtttttacattacaagttgccatatcacagttacaattcatatgttttcaaaacatacattattagctaagtgcatgactaatagtacttctggatcatcaaacattttcctgtatataattctccacggtaattattgtaattcattaggagtactcaactaggagtgtggatgaataagaaatatgaacataataaatactcttccaattaatacatttgcaggttacttcatttgataaagtaaacttaacacaaaattcagagttctaatgcttgctagtggcacgtagcagagtaactacaaaataaatgggaaactgtggcctttaggctttctggtcacttggaattccagtgcaaaagcttgggcattatatgcaacatgatgcaggccacagggaatagggtacagaaaagaacctatggtgtccctgcgtatcagaaccatacatttcccagatgcaagttcagaaaataaaagaacatgccaatggcatagtggtagggaagctatttaacctccccagctacaagtgttcaagtgctaggaccaagtcgggtatccatttcatccttagtgagcgctaaagttcatgttctaaataaataaagtatagaacaacaaagtaacatgcagaattttggacaatacagtatttttcccagggagtaactataaggaataggaaacatgttatgattaattattcttacatgctgcatcaaggttcattcaagaatgtgaaacttctgattatctatgattgttagctgaatgctcatataagactgtaaggtgttaatcatcaagaggaggttattttcatgactataatttgaaaagcaacaaagtacaaacataaaattttcatggcataaaacttcctatcctcaagggacgaattagaaagcatataaaaaattaatagatcaaaagatacagaccgttcccttttttatcttttcaccacaccgtctacaggaagtacgggcagatttagcaacctcaatggtgcatttatctgaaatagcagctgcagaacttgcagtagctggtgcacttccaacataatttcttatcttctcttggtcatcccatctgagtgtgtctattccttcaacatcatcaacactaatttgaaatgaagaatcgacactttgagttaggtcagatttccaatagatgcaataaagattaataaaccataatactatagcgtgaaactcatgcaaacagtaaaagataaagttgcatacgattttatctggtttttcttactgaggatgcaactggcatggttccacatctgaaaaagagaaaagggcactaaaattaattggaagtggtcaattcgtaaaattgatatggaaagatatgtcatataaccatcgagttttctcttctgcaccatcgagaatctaccatgaccaaaaaaaagttccaaacagttatagttcttgaataaaacaattactataaacatagaaaaggtacaacgttataaacactccatattaaagaacatggtcaggtaaaaaataagggccatcacagaaaataaaaagatatggtcaggtgaaaaatggcatgcagatccaaaagtaccccctaagttgccctaaacgatcctacatttcccagtgaaataatttgagtgtctagtccacataaccacatgagtactgagttgatccgaccaaaagaaataaagattcattatccaaatgtgcaatataaaaaatgaaaaatagaataaggactcccctccaagttttatcttgcctaatacaggtaagcacttataatacacatgcacccacaaaacaattacaagaggcaaactagaaaataaagcgggcaaacgaatacctagattataatttgcaaactacacatcagataagaacaaaaacagattagcgaacacactagattactaacattgtcattggtatgccccattgccatgctaaaagcctaaaacagcacaaccaactggcaggtccgcataataactaatatatcaaacaacttaggagaaataccagttaaattgcatatgtcaaagttggtgcccacaaaagcacctctatctattcttgcgttacacatatagattgcataatggattagaaacagcaataaacccaatgctggaattgacggatcatcgacaaatcgacagagcaccaaaccaaatgcatcaagaactccgcattcgaagaagattggttcgatcataccccacaaaatcatgcgaaattaccctcagaaacatatttttttcgggcatcaagatttaaaaccaaccacccaccaaagcagaagattcttatggcaaatgcccgcaaaacccacattagcaatgcacatcaagatgaaaaccaaccacccatgaaagcagaagattcttgtggcagatgaccacaaaacccacacccgcaatgcaaatcaggatgaaaaccgatcacccatcaatccagaaaattctcagaatccaaaccaacctacaaaaaaccctcaagaacacgatgcctgccacaccaaaaccctaccctcccagaccctaaagatcaaagcaagattcatcaactgaacggagaaagatcgtcggcgaggagagcgggtggagggagaggatacggacgggcattaatccgtcgaactgcgtggcctggaccatcttgccgagccggagctggtccttcccgatgggggacctgcacgacttgcacgaggaccgcccggacttggcgtactccgccttccaggccttgggcggcgccgccattccgccggccggtgcggctggtgccctcttcctcccttcccctccgccgcttcttggcttgtcctagggcctagaaagaacccacacaacgagaaaggagaaagggaagggaaaggcctgatgatgatgaggtgtaaaaacgttaaaaaggaaaaaaaaaatctcccctcgaaaatttggggcgagttgagttaatttgatggtttttcttttaaaaccctgtgccatatcctccccgaatgtgtattctcatatgccatttttcttacgggctttacggactgtttggatgggttaactgtatgatttctcacgttttgccacgaaaattactaagtatttctcaatatttttttcgacaattaagctaaaagtaaaagaaaaaaaataataaaacattagagtttatcagtacttatcataaaacaaacagatgatacctgcgttttaatgtgaaacatattgataactatatgtttaatactataaaaatgatagatagatttgtgagaggtgataactggatatgattgcatgttgatttgtagaattaaataaattgtaaatgatgttgtatatttgcatgaggttgaatatgtaatttttggtagtgggtaatgatgtggcgtggtagcatgttgaacttagtggactataactttaactttataaaaagtatagattggatccatatcatcgtaaattttctatattagaaaaataccactactattcgtgatattggctgggtgccactgaaattttgtaaaattagatctatgacatcaccgtcacatttttctaattcacatagaaggatgacaactcgtagatccgttttgcattcgctgatctaattacgaaaatgaaatactctctccatcccgttttgtttttgccgttcctggtgaacaccgcaactgtcgacttggagtcgccggcgcaagccgattggggtatctccacacaagatgtgtcgtatcgttccagacagggacaggcaaaagagcaagccatcacgcactagcagtcggcctccacgctcgtcttgtggcctcgtcgttcgcgagacacaagcccgtgcgagctcatcccatcatggtcgagtgcaccttcgtgcatcgagccatcggtcgtcacgctgtcattggccgaccgagccactttttggcatcagccatggagggagagagaagaaaagaaagaaggaagaaagaagaaagaaggaagaagaagaagaagaagaagaaaggaaaggagctatggcttgtagttgcggctgcacccgtgccgttcgcaatgcatgcgtcaagtccgtcgttcaacgcggcaaattcatgttggcagctacgcccattatgcgtcgacatcactgccccttccactagttttggtaaatatacgtatgcaggccatttacggataaaaatgcacccgacatgcgataaaatgaacctcctgctaatcatacatgtgtacaaggattggaaggtgttgatgtgaaaaacacacactggcgaggtttgctttactctagtgcaggtccaaagatttgccttcaggttcagggcgtgctagttagtttgatcctgcaaccaacaagaaacaaagaatccaaagttaaatccataaacgatagcccatcggctggactgccgatgacatatcatttagcaccaagccgatgtaacgcaggtcagatcggcaatgaagtaagtaacgagaaaagagttagatccactcgatcggctgtagatatcaatgatatataatctatattccaagaatatatttaagctaagcgattgggatagatcgggcagtgtgccgagacagtataaattacttgcgcttaaaagtgctttggagtaaagattatacatattcatagcatagctgatagggtaaatctaatgcgtatcgactaatactccgataccactcgttactcattagaataaaccaacaaatttaatatatttcattcaaaagagatcttaatataaagggtagattcagtatgtcgagtaagcatataagtaacgagacaactaaatcaggcaagatcggctgaaaccccaatagtatctctagtagcagtcatgaaacaagctagatattacgattccaggtaatgctttaatggatcaaacttaactgatacaacattaaacatagaaagaagcataaaatttaaacaagtcgatggcaaccttttgaagatggtagatgcactatgtaatctaattcgaagtcagtatctaaccatgtcgactgttttcgatgatagaggctagccgctgaggttaggtagcaagatcgacctagattacatagcatatatgataactcgacgatttatataaacaggattagagtgtcatgaagatgtaagcactaatcccgagaacgcaagccgctataacaagctttacctttttgtcgaaacaagattttggcaatactaaaagggggtggctatcaagctagaaaagtggatgggttcagagacaagggattttatacaggttcaggccttcttaatcaagaagtaataccctactcctgtccggggattgatccgccgagtgtattattgatcgtatgatctgggagaaaatcgtgcccctagaggcacccggacccctccttatataggggaaggggtccgtattacaaagtacaaaccatatccctaacggaataggtaattacagataaaatacaatcgtaaccgactaggatcccgggtatttccttgacatacaagtttggtaattaacccgagtccttttaaagatattctatctatacatgacaccccatacccagtcggatatacatgccgtgtaggaatggggtatccataatctccacagtagcccctgagacctttacagtcgacggaataatcttctctcataatccgaaaagacaatccgagtgctttagcttcatctgttttgatctcccgagtaatataatcaaagactgtgaagggctgaaaaatagaaaaaatcaggtgcatcgactagatgcacctaattaggtgtagccctcgactatatggttagttgaacaaactaagcatatagtcaaggaataaataatccaaccaaccgagtggtttttgataattgttatcaaccaagtgacttgatatcaatatatagcatatgcagtgtgaatcccccaaataatatgatccaagtgatataccgactgctttgcagaatatgatgcgtgcaacctaaagttgacaacatttttggaaattcacatagcaaaacagctataaagaagagcttgatgttgtgaataaagaaatttccaaagtattgggcatacaccatgagcacacttctttaacagatgtgcttaagtccctaaaagacacatgatttcaccacacctgaaaatatatggcatatgtggtgtaacatccgagtaaataaactcgtaaacgatttaccaaccgcctggaaaatgaccacaatatataatcagccaaagccataatattagttaataaaaatgcacacttacgtggcaaaaagcaatgatattatatccaatcaactgctttataaacccaaacaacaccttgactatataaaaaagtcagtagggcagctatgtaaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgataggccacacctgaaaatatgggctgcagacatattaggcctaggccaaaaaatatgccttcgacaccctttaaaggattccaggataaatatctcaaggccaagcatatgcagcatctggtaaacctcccgccgactgctttaatgtgccaaagaaatataaagaaaaacccaagtgagaagcactccaaaggttcataaatcagcacagatgataaaagtccgagtaaaaactctcaaaagacctatcaaatgtggcataaaatctgataaaagacgagtctaaatagcctaggctatgactcatgacataatcaaaataagcatataacatgccgagtggatgactgtattaaaaccagtcatctcaagaaaacccaaacaacctttgcagcctaaaaaggcctacaaaattagtataacacttttatgttatgcacctttttatttgcatcgtagtaattccaaagaattatctaactgcgtcaaaaaggattttaacagcattgggctatactgttgtgagcaagtgttgacgaaacaaaaacaaatgcctaagtccctatggatcacaacttaatcacgctgatagcaaaactgggctgaagtactgtttaggcctaggcccattagtactcccgataccctagcgaaataaacgccaaaatcggagcgtcgtttcgtcttccccgccgagactctcgccactttccccatttcccgctacagtgcaaaaccacaccggcggaagcaagcacaccggcggaagcaagggttaacaaatccactccaatccatcctcctgagctccacaaaaaccctccacgcaaccaccgcaccgaatccccatccatttccagccatatctcggaccaaatcggcatgggacgactggatgttttcttcttcggattggtttgccttggttgtttcccggtcacctctttattgccagattttctagcattatcgccttcatcatcactcagaaccaatttcctcttgcgggagtccgactgactggttgatttcgaggtgtttgtttgagtgtcagactgaatttttggtcctccactcgcctgaccagttcgccagcggggtgatcggcgttgagcaattggaggatccgacttcatcaaagcgaattcctgggtataacatttcgagttttcaattagcttaacagtagataaaggcatgcttttgagaaaggctgaaatgtttgaatacataccggtggagaaggattgaaggcgttgtatggcaccactggcagcaagtgcgaataactaactacaattgcattcgagaagattttatacattctttccttcataaccttgaattcaagagattcaggatcttcacggttggtgtcatgtttgccatcaaatttgaaggctgtacaggatctctctttaattggagctagccggctcttgataaaatgccgggtgatctgttctccttgcagaccttgctccttcagcttcagcatacggtccatcagggcaagcgcctgagcggcttcctctcccattggaagtgagttccaagagtcctgataaactggagggagacaggagtactcggggagtgcaggctcggggttttgtacatagaaccaatttgcatgccagcctttgtttgaggttttgaagggcatggagaaatacttttggctcagagttcccctcaattgaaatccagcccccccaactacgcatggtttactcttgtttggttggggcttgaggaagaagatgcgacggaataaggcaaaatgtggcctgacgtccaaaaaagcttcgcaggcgtgtatgaagttggcgatgtgaactatggagttcgggtttaagtgatgcaaactaatcccatagaaatcaaaaatcccccggaagaatctcgaggttggaagagaaaatccgccatagaagaaatgagaaaataccacgacttcatgtgtgtcgggggtcgggaatgcttcgccgaatgctggacgccatccaatgatctccttcgccagaagaacgccgtgcgccaccatctctttcaaattctcctctgttacatcggagggcgcccactgactctcgaagctttctctctcttccgtcatgaatacgaactggatggtgtgatttggtccgagatatggctggaaatggatggggattcggtgcggtggttgcgtggagggtttttgtggagctcaggaggatggattggagtggatttgttaaccctagcttccgccggtgtggttttgcactgtagcgggaaatggggaaagtggcgagagtctcggcggggaagacgaaacgacgctccgatttgtactgatagcataactcaaactcgtaggaagccatctgacatagatctttctggaaaagactctgaaccgactgacatggagacgggttcttcaaaagaagatcacccgactgcagaagatcacccgagtgacaatcaaccggcgaccgacaatgtagaacccagcaacgagcccccgactgggaaccagtcggccgaaactggggttggtgctaatcaggagcccccgactggaaaccagtcgggtacagaaccaaacaaagatattcctgaagtagaaactcaagctgacagccctcctaaaaaggatgccagcgtcgatctagggtccggctctcttgttaaattacaagggcctactcgtccccgaccggaaataatcacaagtaaacacatcctccgaacccattttgatctgacagactttcttcaattgtttcacctttattcataaatgcctaaggcccaatggtcggcgacgaagaagaagtcctccggatacagtcagctgaggattctcgtccacctattttagtcaaatggtgggacgatgatatgcaaccttagggaatcgtgataaacaagcaaaaggaagatgaggaagtatgcttgctgaaaaaggcactcagccaggctactcgcatcgtaaatataagtctccttatacatagcttcaactatcctgtttcccactttgctcaaatgccgataaattcgcattgcagagaatccatctcaggaacgaggcgaagaccgcgactcttgagaatttagttcctcatcttggaacccttgagaccaccagaaaccagctgcacaaggctaaggagcttgccaggaaaactgagcatgatctgagggatcggatcgccgagcttcaagaatccaactttgaactgagcggttcgtcaaaaggtaaatacaatctatgtctaacttacttatgctgccatccttgtaatatcaattaatcaagaagcaatacagtgcaagccgccaagatatctgaactagaaaagcggatccaaactctggagaatgacaaggccaaattggcgaaacagagggattcggctctgaaagatgttgaaggtactggtgactaatacctcttatctttatgcctactcgttgatataaatctatttacgcagatcgcaaaatcaagtctcaggctcaattcgatgtcttggtcaataaaatcaaaaggcttgaaggggctagggatgaagtcgccaacgctgctaccccactcgtccaagccatgttcttcaataacaatggtccgagtacatttgatgcttccgaaatcttcgacaagctgagaatcgctccggatacatactttaagaatatcaaagaggccggaagtatgggagcaagcctggcgttggcaatgaccaagtctttataaccgaagattgatgttgacaccattgatggatttgcagacgggacgagcgaagaagccgcccttgacctcatcaacgatgcgtagaaagccgccgacaagatagccattgatgtagttgagagattccaggacaacgacctccggccgactggatctaataattccgatgatgagaaaactgatactgattgatattatactgtaacagtgattctgatgatgatgatgatgatggaggcacaatttgtacaatactgatgaatttatgttgtgcttgatatttcaaacttagctcccgatttcttaaaagtttttgtcaaacctttttgagcctaaaacccacaaaagttgttaaaaaactttcagtcctcattgactaagccaaaaaatcaaacaaggcaatgataaatcaagtaagcaaattgaattgataaaagtcacactccattattattatagtagcccccgactgataactcaaggaaaagcttgatgttagcagtcaaagctgaagatacaaaagtaatgcctaagcataaaaacgacgaagatgttcaatattccaagagttgtcgatatgagtaccgtcctcacgcttgagtcgataagaacctggccgagtgacttcagaaattatgaacggtccttcccacaagggagataacttgtgccgatcccgtgtagtttgaatttttctcagaactaggtcgccgactaaaaaagctcgtgagcgaacattgcgattgtgataatgacgcaccccttgcaagtaccgagccgactgaattaaggctgcttcacgggcctcttccagtcggttgatatcatctactcggtcttctccgtagcgctcctcgctgaagttgcgaaatcgtagagattcaaattccacctcactcggaaacattgcttctgctccatagactaggaaaaacggcgactggcccgtagctcgactgggagtggtgcgcagggaccaaagtacggacgacagctgttctacccacttgccggcataaggatgcagtcggtcgaaaactcgcgcttttattccttgaagtaccataccattggcacgttcgacctgtccattgctcatggggtgcgctacggaggcataacaaattttaatgccgaagtcttcacaaaagtctttaaatactccgccggtgaattaagtgccattatcagtgatgatacgattaggtaccccaaaccggtgcacaatgttgatgaagaaatctctagccttgtctgccatgattgtaatgaccggtttagcttcaatccacttggaaaatttgtcaacagccacaaagaggtgagtataaccaccgactgcctttttgaatgggccgaccatgtcaagcccccaaaccgcaaacggccaagacaacaggatggtttgcaactcctgagctggtaaatgagtttgtcgggcgaaaaattgacaaccctcacatgttcacacaattttgtcagtgtcggacacagctgtgggctagaaaaaaccctgccgataagccttgccaacgatggttcgtgcagcagcgtgattaccacagatgcctgaatgtatatcttttagcaattgccttccctcctccaaagacacacagcgttgcaggattcctgatggacttttcttgtacaactcggtctcatgaataacatagagtttgctgcgcctggaaatccgctcggcttcatctttatcttgggggagttcttgtttgatcagaaatcttatgaggggctctctctagtcggcttcaatcatacttacgtcttgagtatccgtggcttcaattgtttctttccttggcacggttggttcgtaaagatgttcaacgaacacgtcggaaggagctacttctcgttttgaaccaaaattagccagtctgtcggctgcctcgttattgtgccgaagaacatgagtgagttcaagtctatcgaatttgtcttccaacttacgtacctcctgccgataagcggtcatgttatcatcaaggcaggaccactctttcatgacttgatcaacaaccaactgagaatctccacgaactatcagacgccgaatgcccaaggagatcgcgatccttaatccgtgaagcagcgactcatattctgccacgttatgggacgcggaaaaatgtatccacaatacgtagctcaatcttttctccagtcggggagattaaaacaaccccggctccagtgcctgaaagcctcttcgacctgtcaaaatgcatggtccaatactccatcttctcctcgggcatgtcttcttggcactcagtccactcggcgacaaattcggctaaagcttgggacttgatcgaagttcgcggcttgaaggatatatctaaagacatcaattctaaggcccactttgcgattcatccatttgcttcgcgattatgaagtatatccccgagtggaaacgatgtgaccaccgtgaccgagtgaccttagaagtagtgagataatttccggacggtaattaaaacaccatataatagcttctgaacccgaggatatcttgtcttggaattagccaaaacctcgctaacgaagtagattggtcgttggactttttgaacatggccttcttcttcacgctcaacaaccaggactgtgcttacaacctgggaagttgccgacatgtataacaacagcggctcttgcggatgtggtgaagctaggactggtggagtagtgagaagttttttgaagtcttcaaaggctttctgtgcttcgagtccccactggaaattgtctgtcttcttcaacagcttgaaaaagggcatcccccgctcgtcgagtcgcgaaacaaacctgctaagcgccgccatgcaaccagtcagcttttggacatctttttgtgagctcggcggtttcatgttgaggatggcgttgattttctccgggttggcttgtatgcctctatgggacaccataaatccaagcagcttccctgacggtactccgaagatgcactttttagggtttagtttcatcctgaaggcgcggatgcttgcaaaggtctcttctagatccgcgatcaaatcatccttctgtttggtcttcacgattacatcatccacataagcttcatcattgcggccgatctgagttgaaaaacatctctggatcatgcgttgataagttgctcctgcgttctttaatccaaagggcatggtgatgtagcagtaggccccgaagggcgtaatgaatgaagtcttcaagcagtaggattcttttagtcggatctgatgatatcctgagtagcaatccaaaaaaactgagtagctcgcagccggccgttgagtcaactacctggtcaatgcgaggtaacccaaaagggtctttgggactagacttgttgaggtcggtataatcgacacacatgcgccattgccccgtcttcttccgaaccaggactgggttagccagccagtcgggatgaaggacttctttgatgaagcccgctgctaacagcttagtcaattcttccttgatcgcatccttcctatcctgtgcgaaacggtggagttgttgcttgataggtttagcgtcttccttaacatgtaaagagtgctcaatcacctctctgggaataccaggcatatcagatggtttccacgcaaagatatctttattattttgaagaaaggtgatgagcgcgctttcctatttacaatctaactcagcgcctattacagcagtcttagtaggatcagagggatctagaggaattttcttggtcttggcgtcgctttctccgctctttggcaccttggttgcaggcacttctccttcgcttgctgtggacgcagccagtcggatttcttctcgagcgagggtgatctcgcgggtctgggccatcttgcagctttccttgtcgcatgtgacggcttatttaatgtcgctccgcagggatatgactcctcgaggaccaggcatcttcatcatcatgtaggtatagtgcgggacagccataaacttggctaacgccgggcgtccgagtatggcatgagacgctgtctcgaaatcagcaacttcaaaacaaacgttttctgtgcggaagttctcccgagtgccgaaagtaaccggaagagtgatctggccaagtggtgtagcagatagccctgggatgactccgtgaaagggcgcattactcggttttaattccgtgcgagggatctgcatgttgtccagagtcttggcgaaaaggatgctgagcgcactgccaccatcgatgagggatctgcgaagcttgacgttgcgaaccacagggtctagtaccagggggtaccgccccgggtggaccactcggtcaggatgatccgagcggtcaaacttgattgtcgtctctgaccaccgaagatattggggcgtgtcgggctggacagcattgatctcccgttcagtcaacttttgctttctcttggattcataagccaggggtccgccaaagatgtggtttagttccttgcgatggtcttgaaaaccagtcggggcatcgtcttcatcatccttcttctttgacgtgctttgatctccgtcagcggtcttgcgtgcgttcttggcgtattgctctgcaaactgtttgtagacgaagcaatctttggccgcgtgattggaatttggatgatgcggatattgggagttcatgatcttatcaaaagtattgacgcgcgaacgttgtcgggaggatggtgtagtggttgccacaagttcctcgggcttacgcttgcgatccttgtgattggtacttccactcccccctgtgttcggcatatttttcttcagcttccaagtggtgcccgactgcttggacgcggtaatagcatcttcggctttggcatactcgttggctttctcgaacatctgcttgaccgtcctgggaggcttgcgcccgaacttgccgactaggtcgtcgtggcgaatgcccttggtgaaggcggcgatgatgacgtcgtcggtgatgtcggagatcttgttgcgttgctcggaaaaacgccggatgtaatctcgaagggattctccggacttctggacaacgttgtagagatcgtctgagtgccagggcgttcaaaggtgccctggaaattggcaatgaagtggtcgcgaagttccgcccaagatccgattgtgccacggggtagcctgtgaagctaggaccgggcagaatctgctagggccataggcaaataattcatcatggctttgctacctcctcctgctgcgcggattgcgagaccgtagacggtgagccaagactccgggttagtggtgccgtcatacttctcgattccactcggcttgaagccggctggccaatccactcgacgcaggttggtcgtgaaggcagcaactccatccacgtcgtcgtcgtagcggtctggtgaatggttgggagcacagcctcttgccgcgcggcgctggttgatggtatcgcgaagatcgatggggtgcctgcgaggtcgttcaactcgacgctccctgtgtcgttcgggaggcgaatggacagatcgctcgtcgtgacccctgctcctgcgactggatcccgcgccgatgacgctgaggcttggttggtgatagtcttgagatcgaagagggggaactcggctgccagtcggcgtgcgggtgcttgcggagttagccgggaccgaggcggcgatcatggtctttgtctggtttaagatgttgacgacgtgatcagcctgattgagcgcgtcttccttgaggagggtgtcgaggagggtgatcgctgcaaccgcgttctgttagggtgtgcggaaaaccgctgtcccgtcgacgacttgttgcccgatgagatctcgtgctcgtcgcccggattccaaggcgcgctgtcgtcgatcctcagcctcctttgcagcccgttcgcgatcttgttgttcacgctgtagtcgttctcgctcttgtcgttgtcattcttcctccagtcggcgacattcagcttcttgtcgtgtgcgttcttcttccgcttctcgggctcagcactgttctgccgtctcgttgttggccatgaatacaccgaaaaagagaggcgtgtagtcgtcctcgtagctgtcgtcgaagttaccgtagtcgtagcgatagccgaagtcgtcgtactcgaggatctccgttggtcgagaactgacgccgggggagctgaggtagcaatccaattcttccgtcgagaccgtcccgagaggctgaaatataacgcctacctccctagaactagattggatcgaagccgaagccggatcccgtctaggtcttcgggtgggagatgccttggtcgtgaagacagcagccagatcatcgggaagtctcatcaggattgggggataggacccatcatcttgatctggtcgtgtccgagtagattggatctcgtacgagtggtttgaagccaactcggcagagatgatcttggggtagacctcggccgagttcggggtaccgaacggggcggagatctgacctcttcccgactggttcgaatccgagtcgaggagagaaatcttgccgaagtcgttggtgatgaagtcgaggctgccgaaccggaacgcctgtccgggagggaagacgaagtcgtcgatgccggagacggaacccatcacactagtcggcgaagaacttgacgctgcccctacctggcgcgccaactgtcgaaacaagatttcggcaatactaaaagggggtggctatcaagctggaaaagtggatgggttcagagacaagagattttatacaggttcaggccttcttaaccaagaagtaataccctactcctgtccggggattgatccgcagagtgtattattgatcgtatgatctgggagaaaatcgtgcccctagaggcacccggacccctccttatataggggaaggggtccgtattacaaagtacaaaccatatccctaacggaatagataattacagataaaatacaatcgtaaccgactaggatcccgggtatttccttgacatacaagtttggtaattaacccgagtccttttaaagatattctatctatacagggcaccccatacccagtcggatatacatgccgtgtaggtatggggtatccataatctccacacttttcgtcggagatcgaaaactatgcagcccaactcgaaagcaagaactcgtcgaaacaatgaaaaaagggtggcgatgcgccgaaagtgttatcgaactgatgttgtttgtttacagggtcctgggttatatttatacccaaaatacatgatatgtccttgccgaacacgactctatctctattacaactcaaaaatacgaacaagtcctgcggactcttaccgaaaatatctataaggaaactattagaatatcctaattaataggtacaattgccttctccggactcaatccacacttggcaatactggtgtagcacttgaaccgatctagacaacaatctcctgatcgccttgccgggatcagttatatcggctcctccttgcccgatttggtagcagccgatgcaacccgtagctgatgtgggttctgtttctgaggctacagatttccaccaaatccactttggttctgacttcggatccaatctttgatttaccaattttgatcattaacacatgcccctcaagtccgtgatatttgcgatgttgcggatgtgctcgattttgtttccgcttgcatctagggtttcttttctgtttcggccgtcaacgcgcccttttaaatagtgtcaaccaccttgaaaatttcacggcgtctcccccgcttcaattgccttggccaaaaacttcccccaatcactccagtaattcgctcagcgactctgcaggcgatcccttgtttcggcggcggcccgacttcggcaatgtcttctgccaatccctcaagcgctccggtggtcgagttccccgaggtaagcaccatcggctaggccctttctgtctctttaccactttgtgctcccttccctgatctcttcttcattctattgtagcacctatcccgtcaagttgcagttcctagcttgcaaaaccagcaccaattctttttggacccaatcagtgacacagatcctactcagtttatcaatgccaagaccaacaaagtcctctttagacggactaaccctattttaggccattggactggtaccttcaagacttggccttcctccaatgtcaaaacttgaccggattggtataggaggatattggctagcgaacagactcactgggatgagcttgggatttcacaatgcctagcccctcaccatagccgatatgaaaaatgatgagcccatgctgtaggcagccgcttacttctggtccaataccttgaatgccttcttgttcggccagggaccgatgactccaactctcttggacgttgtcatgattacgagtttggatgtcacgtcgtcagccaacccaatcagtttgagcaccaaaagctagttttcctataaaaccaagagcattggaggctggtctggctttgttacttcgaacatggggtctggtcttgtaacccctagggaacatgtggccttcctgatgatgtggttacaaaagttcctgttttgtggtccaagttgtgggcctacctccaactggcagcatctggtgtggctctagtggacaagaagcaacttcctttgggcaagtacctcctggtggctctgtatcaaactcttggttctgcatcagctaagactgttgtcgataccgtcatcggcactggtggtccctggtggcttttcgaagtttgtttgaatttgcataccatcaaggtatcaaaaaggtcagccctgactgaagcaagatttccttctgccgacgatccaactgaagatgatgacggaaataaagtttccaccagtcgatgcatgtcctttggagaggcggcatcttatgctggatcacagttgtcggctgagcttttttctgatcggttcggtaatttttgtgatgggtatccaagggactccagaatatggtttgcttatgatcattccgaaaattttgagcttccggctaattttagatttgacaaaatcaatcatgaagttcttacagcagccatttccccctgcatactccctgtcggcatccatcaaggcaggaatatttaggtttcatacgagttctatcatccaacgagcgctgccaggcagcttggaataggccaattgccgattagcttattttttgtagacaagatccaaaccagcggggaaattacatcagctctcatgatggacatgctcttgagcatcccaggaccccctttaggctgtatcaatgatatcgagctagctctgatgaggagctgtcacatcctgattttcgtttcaggttttataaattatttaataaattattttcagaatttatattaaatgttcattaatttacaagtgaatttaaatgtgagaaataaaatttcctaaatataaagcatggctggatttaatttttattaaactctttgtggttaattatactctctagaattttctcgggattttcaggatttttcttgaaattatgttgtagctaggggtcaccaccgttcctctctatttggcccaaaacactgtagaggaagagattgggtaagattgagtttttattctaagtatccgagtggcaaatggtcattcgaacaaggaaacggtaaaatgttgttcgagttggaaaacactattcgagtcggaaaataccgttcgagtgagtccttgtcactaagtctcattatccgttttgagtttttcatgagttaataacaggtcagctatcggataagtcggaaagggtggtcgagatggtaaagactatttgccatggaaaagacccatagtggtggaaaagacccttggtcgaggagaagatccatgttggtgaaaaagactcttggccatgaagaag

SEQ ID NO: 64077 - DNA, 647 bp, Oryza sativa
tccaaacatccgatgtgggttttagtccgatctaaacagggtctagtgctatggctccttcatgcattccacgtttcattgctctctttctatcgttaccctctctacccagtgaccaactcaccatagctctctatatcgcctatcgtttgggaagtttccacactcccagccatagtgatagcggcatacacggatgcatctagcgcagccgccgctccctcatctcgatcgcccgacggagacctggaccgaggaggtgatcgttggcggcgcatccccgcacgagtgccgactgcgcccgtgcatctcccgactcggctgtattctcctgtccctccacggatccactcccgaagatgcttgcttgctgttgctgaagatacatgctggttggtgctgctaatgcattcttgatgttcttgtgtacctgtatagtgtgtcgtccgtggatccggaagagggaagcattgatgccgttttattttacttttgcaatcactatttttttgttcccctggccttttccttataaactattctgcatttatatttttattcaactgaaattgaaaactaaagaatgtaaattctttgattataaagacgacagatagtttgaagtttttgaatctggatgtggtgct

SEQ ID NO: 64078 - DNA, 1170 bp, Oryza sativa
gtcggacccatcgtctaccttcggccgccgccgcccgaaaccctagcgcgccgccgccgccgttcctttccaaatccggccgttcctttccttctccggccgaattgtttgaggcgaaacaatctccgggatctcctctaccttttctcctttggaatctttggctaaatcgttttggaagttcgtggaatcgagttcgtttcggatcggtttccctctctccaagccgagctttccttcgccgttgccgccgccatgggccttcgccgccgcctctgagcccctttaaaaggacccccggtgtctcctctacccgtcgccaccttcgccttcgcctctcgtcgtccgaaaagccctagcgccgtgtgccctagctttgccgtcgccgccgtcgctccagccgtgcgccgccgtcgttttagccgtcgccgtcgctcgggaagaccaccgtcgtgctcgccaagtcgtcgccgtcctcgtccgccctttcgccgtcgccggagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcatcttggtgccctccgtttgcgtcctcgcgccgccgttcgccggcgagcgtgcgccgttcgagccgtctcctccaccgagccgccgccgctgtcggtgacgtcaccgctgacgtcatcggggtcgtccgccgtgagccgccgtggacccgatcgatctcggccgtccattttggattggttcgatctcggccgtccgttcgtgtgaaccgccgcccgtgcgcccggtccaccaaaccctagcccgctgacgcaataaaccctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttg

SEQ ID NO: 64079 - DNA, 2667 bp, Oryza sativa
tcggtaccctacccctgggattaaacttccaaaatgtggacaaaaattccgaaataccgtattataaacataagattgtaaacattcaaaatttgtccaaaaacttaaagtctgacatttcagaatttttatccaaaatttgaaagtttttgtctcaggggtattttggtcatttggatgaaagtgtacagtactaacggagactaaccggatggcggtggtaaatcgtagaagttaagcaaaaatcgatggcatattatagaacgtgacaaagtcagtggcaaattgtagacctatgacaaactcagtggcatacaatggattatctctaggttaattataccactacatgggtctgccttcaccagaagatatgctccctacctagctaccctcgatacgatgtcatgcattgaggacctcattttttttttcatgttttagagcatatttcttccacgtgagcaaaatgttcttttctcagggctaggcggctagcaaagttgatggatggaaccttgacgacaatagcatttcttagacaaataagcgtatacgatggcatctcctggaactggtatcaggcacttatcaatggtcagagataattgaggtgtgcttcatgccttttagtggaaatccgcgtagtaataatatcctattatgtgtattaatatacctatctttgtgtgtatatatatatatatggggaaaatatattatatgtattcatatgactttaaattgtatttgtttttgtttttctccagagttgaaaaccatccaagctctgttttcgtccctagtagttgcatgtttgtgaattatcaataaatgatctgctgtggctggtgtttactttcagaagggctagtcatgtttgtttgaacttgttatatctcgtttgtgctgctagttgctgtcaacaacggaaagggcaaattaattgcattggtagttcaattgtagaattggtaagacaacctgcatctctgatcgaggtgagttgtgcattgaagactttaagccataccaagggcattaatataattgtttctgccaatataaaatgcgtagggcttgaagtaaagcagtttaacaaaaggttcaagaaagacagggcaaaatgatcatactggaatttagaacagcaagcacctgcccaacaatctcaggaagacgatttagtcatagagaacagaccagcaattctctgttgcccaatgcataaaatccacaccttccgttctgaagaaatgctcacagcctgtgctgaaaaatggggcattatctcatatattaagccgacattcaggcagatcttacagtcgtagatacagacgccagtgctctgagaataaaccgaacccaagaaaaattacatcatcccaagtcgcggctagcaaatacacccatctaagaatttgtggtatgcatctggaggaataaacatgctcatggtagtacagaagtattgctggcaattagggcatacaaacgatacaggttttaactggtgatcgccgatacaaattgtagtaatcgcatgcctgattcttcttcaggtaaggcttcatggttggaggagtgcagcaatcagttcggtggtacacagaatcacgaggtcgcagctcgagtccatcccagttcactacccaactgtgtttctttctctatatattccattgccagcatgcgcagaagaattagacctgtgaccagactgaggagttgaaagaaaactttagtctggggatatccaagaagacaattataatccaagcacataggaaactaaaaaagatacccgtgaatcagtagacgagcagtaacatatgttatttacttgttttgttacagaaacacaaaattactggtaagaaaaagaaaaattatgcttccaaaggtggtgttttgatccgcatagacattttatcgatcttctattgctctacagttggaatcaggagaggatagaatagggttgcttagcagaattaaatagtctgaccgctattgtggcaaaaaaatgcacattcacaagagttggttggagcagaaagtcagcttgcaactcagtaatcaatgttagcattgacacacttcaacatagaattgccacattccccaaatacttcagtcaaggtgatacagtcaatcaaggagtaaaacaacaccaattcttcaaccaaaacataaatcaagctgaaggcaacaagtatattctttcaatcttaaggccatgacagcatcaacatgattataatttatatgtcatagataactgggcatatgtgcacagcagattaatacagcatgaacagattctgcatagtttacatacagaactcatatttttagactacccatgcacctagtagatttaagctaaggtttacttaatgatacccaacaaaataaatgataatgctgcttgtctcaaaccaaattaattgcaactcaaatattaagaactcttcgcaatatttattacatgatactcaaatattaagatcttatagctgaccaatagaatagacactgaaaagcatttcaatatgagacatcataaagcatggaaatacgggaacaccatagcaaagttctttatcagaagagtataatgataacagattgcaataccttatcaaaagtaaaagtgagaca

SEQ ID NO: 64080 - DNA, 977 bp, Oryza sativa
ggagaggcatgcaccagacatgaagatcacctatatccctgaagggagccattttgtgcaggagcaattccctgactatgtgaatgagctccttcttgcattcttgaaagatcatcccgtggataaatagatgttattgtagactcaattgtgcttcacccgtagtacaagttggcgatggaaacattgtgctatatcatgatatgaattgtcaacaaataaaggatatattatggatggtttgttactttcagtaatgcatgtttgagcttgtgttgcgtttagtttctcctgctaatgttgtcagcaatgcaaaggccaaaatgttattatattttaacctagtattgcacttataccatcattttagcaagccaatgatgtgaacttataccatgatgttagcaagtcaatgatgtaaaagatggagtacggagttatttcttatatgtgtttgtgatgagcccatttgtggccgtgatgaccaagacctctggtcgttgctaggatcggccgagtgtgaagtttaggacgatttttttgtgaagtcgtcaaggatcaatgatggattccctctttatcaccgaatccgtcagggaagtctaaatctagtgttggtagggaagtgataactcgaatttgcttttttttttgtgtcgtattaaaaaggggaaaatttggtaaggtataaacttattgtagtattgcaaaacataacctagtttcttggttagacttatccttcagagcctagcaacttaggttaatgagacaatccattatatgccactgagtttgtcatagctctacgatttaccactgtctttgtcacgttctataatataccatcgacttttacttaacttctatgatttaccatcgccgtccagttagtctccgttagtactgtacaattttgtccaaatgaccaaaatacccctgggataaaacttccaaaatgtggacaaaaattccga

SEQ ID NO: 64081 - DNA, 8799 bp, Oryza sativa
gctgctgctggcgtcggtggcgctgctcctcctcgtggcgctcggcgcgctctcgctgccctcgggcggcggcgtcggcgtcggccacgccggcatcggcctcccccgcccgcgcccgcgcttccgcagatccgccgcgttcgagtcgtgcgtcgtctctcgcgcgttccttttgaattcctcccccgcccgcccccccgtgattgattgatcccctctctccgtgggatcccccgcgtgtggctgacgtgcgtgcgtgcgtgcgtgtgtgcagggggctggagatgcgcgggggcgagaagggggagccgtggacggaggtgctgtcgtgggagccccgggcgttcttgtatcacaatttcctcgtgagttttttctttgccttgttccttgttctcttttggtttttggggggaacaaaccgcgcatgttggatgatatgttcattctacgacgccatttcactccattgcttgatgagatcttcagttttttttcaggttcaaataaccctctaattaggtgtttttcttttctttttttggttgatatgatcgatttccgtccgtcctttgggagattcgcttgttccttattggagtaaagaatctggatggggtgggtaaatttggaaattgtcttgctttagatgtaggaatgccaggtgagatttagtggtgttgtgaatcagagacgggcagagtgggattgctttccagatctgagcagctgcaccattggcattgcactttttacagagggagttgttgtacatggatgtgttgttcttgtctcgatgtttgagctgcgccgaataatttgtcgtcttctatttatttctttttgaggttagagagtattcttgtagcaatactcactggcattcttagtcagtttcaatctttgtttttttaagtttcaagcaataaaattgaagttcatgttgattgttgatgagcttgcgtggagcccaacttttgttttactgcaactactcatatactcttgtttggtttattactgatcaagaaatgactaacttctcttccttctcagtcgaaggaagaatgtgagtatctgatttcattggcaaagcctcacatgaagaaatctactgttgttgatgcatcaactggagggagtaaagatagcaggtttggatatcgtagattattctcttgaaaacatgttacctcaattacaactcgtttaggcttaatggcatgtcacatgttcagggttcgaacgagttcaggaatgttccttggaagagggcaggacaaaattatccgtacgatcgagaaaaggatatcagactacaccttcatacctgtaggtatggcacctttaacacagtcaacttatcgacctcctgaaaaatagaataagtagtgcagttttccttttgctaaagtgcagaactttagtcattgtagaaaccatacatttaaacttcgttccttggccctaatacagataattgatatccctatatcatgaaacagtgcaaggttttgaatctttctttatcttgcaataccttatgtcactgaatcaccaaaacttacactttatagtgatgcatttgaacacttagctacctgctgtggaaccaaatatgaaaaagcattgcctttacagagtgcaattgtactgctcttgctctctccttttgatctgatattagcagagcaacgcccatagagaaatgttaaatccagatcacttgccagtaatggtttaacactttaactattgttttataaatccagatcaataagcagaaccaccaagaaaaacacaataagcacaataatccagatttactgagttactatggcctggtttagttcccaacttttccatcacatcaaaactttcctacacacacaaacttccaacttttccatcacatcgttccaatttcaatcaaacttccaattttggtgtgaactaaacacaccctatattgagagcatattagagctagaaagtctctgttatcagatttttttattacccctgagccctgtcattccttgaattctgttcggcagctgacatttgtgaccaataacacaaggcctttgcaagtacaatggtacataatgagcatgttgtagtacatgtgaaagtcaaacttctcatatttacaaaaaagggccagtgcatacttgaacagaaacccagaaagatctacacaccaatttctgaaatgtcctgtacttattatgtactcaaatttctttaggcttttcaaacattacatataccttttgagttattaaacgtgggtggtttgacactggcgcacttcaataaatagtcagtaaggtacacaaccaacaagatgcaatgtacatggccggtattgattttttttttcttttttgcagtcaggaataataatattattattacaaccaaatctgatggatagtcctaataattcctaaatatattcaactatcatcaagtgcaacaaattttttatcatagaaatcacattatttttttatttcaagtttgttgcaaatgttgttgttgttcctttctgttcatactcataatttcgcagagaacggagagggtcttcaagtcctccactatgaagttggacagaagtatgaacctcacttcgattacttccatgatgaattcaacaccaaaaacggggggcagcgtatagcaactcttcttatgtatctgtatgtactataatattggtaattcttatataatgcaacgccgctgattcatttgacatttgtttttgtcttatttgaaatttattagttctgatgttgaagagggtggtgagactattttcccctcttctaaagctaacagcagctcatcaccattttataatgagctgtctgaatgtgctaagaagggtttggctgtcaaacccaagatgggagatgctttgcttttctggagcatgaggcctgatgggtctttggatgccacaagccttcatggtgagattccaatactttggtacaatgtcaaattgttttgtagtgaatggttatgccacaacatgatgacatttctatttaccttcaacttcctctaggtggatgtccagtgataaaaggtaacaaatggtcatcgacaaagtggatgcgtgttcatgagtacaagatatagacatcagaaactagagattcagaggtacgagtgagctgctctgcaatttcctccacgtagcactgtctgttcacttggtttttttcttcacgcaattcaaatgtctgtgatcaacccttctgattcatttaaaatttgtttgatttatatttattttcaactctttgcaggttactcacgaattcaaatttgtcgatgttgttgcttaaagaaagaaaagaaaagcggtcatttttggcgcatgttgaggacttcaatttttccatagagaagcattacaattttttttagctgtaaccaacatgttgtacactaacttcttaggcttatgaacaatgatcatcgctttgcttatgaacaatgatcgtttcaaagcgatggatgtgtcgaatgtataaataataattgccctcctaaagtcgtaatgaaattcatgatataatgcctgatggactcattgacaaaaatagtctcaataatatgtgtaattttttcctaaaaagtaatatgtgcaattcctgcagagatctggtagtactccatctatcctaaaatatagcaatctacttcttccgtttcatattataaaactttctaacatgtccacatttatatatatatatatatatatatatatatatatatatatatatatatatatatatatatatatatatatatatatatatatatatatatatatattaatgaatctagatatatatgtgtgcttagattcattagcatctactatatgaatgtggcaatgctagaaagttttgtttcagaggtactccctctgtttcacaatgtaagtcattctagcattttctacattcatattgatgtatatgtctagattcattaacatcaatatgaatgtggaaaatgtctagattcattaacatcaatatgaatgtggaaaatggtagaatgacttatattctgaaacggaggaagtaggggctgtttggatggttgcctcaacctgccaagccacatattaggcatgccacacctgcttagcctaccgtttgtttagagaccagatttttggctgctacaaatagtctgccacaactcagttgctttgccattggttttttgggcaaagacgcggcgagcaaattattcgccacgcttgcggcacgactgttgcgtgcggagagagagcgcgctacactcaccttcgtgaagaacggcgtgaaaatccttttgtgaatagcgcgaaacatttgacgttttggcgcgaacaatctggaaaaaaacgcgcgaagctcggtatctccgaggctcccatgtttattatcctctcttgttcctcttttctctctccaattcattctcccgtgcagctccaagcaacaggcaactattcccctctttattccattagcttttttcatcttctgctccatccctttcagatcctcttttttttctttaaatcacacaagtaatctgtttcactgatgagtgctcaagccatggagcaatctgtttttttcctaaatcatctccatccccttcatcttatttagatccatatgttccttcctttccttcaaatccagattctaattaatttgttcctttcgtcagggcttgagtcatggagtaggctggtgaagaggagtaagtagtgtggctagagcaaagatctggccgtgattcctcgagcgtccgccatcgaatccaacgagccagcaagtttcatcacggtaagcacactgcacacagccgtatttgtttttttgggatttggggtttggatacttgaactttattttgacttctgaaaaaaaaacttatcatccaactgacaaacttaaaattttcgtaaaattatttagtaaaaaaggaagtgtacaagaaaacagtagccgttgaggctacgaactccatgtgttacgtgtagctctcaactctgacatatagtacacgtgcgcgtgccaccgtgtcatcgcccagcgccgcggcgactccagcaaattcgcgagcattttttatacaaagccccagccgcggcggccatgggaaacggtggtggtgggaacaagaaggggaggagagactcgccgtcgccgccgctcgagacccccccgcgcggcgagttgccgtcgacgtcgtcgtcctcctcctcgcgcgccaccaagcgtcaccgcgtggcgggcatggcggaccgctacttccccaacgacctcccggacttcgtcgccgaggcccccgacggcggccgcggcttgctgtcgctcccttactccagcctctccgaaaggctcctccgcgccgcgctccggatcaaggacaaggttaggcatgcgtgtgcctcggtttgggtttgggtttgggtttgggtggcgcgcgcgcgcacgcacgcaaggtgttcggctgatttcccccgaccgctccctgccccccccgcaggtcatggaggagacgtggacagggcgcggcgacaggtgacggactacacgctctacacgggcgcgctcggcacggcgctcctgctgttcaagtccttccaggtcaccggcaaccgcgccgacctcgccctcgccggcgacatcgtcaaggagtgcgacgccgcgtcgcgtggcctgccgtaagacgacgagccttttttttgttttcgttctgtacttctgttggttagataatcttgtactaccagttgatgagttgatacacctgggtgtcatggcctccttggtgttaaattaagacgcaggttcttgacattcatctgtgggagggctggggtttgcgctcttggtgcagtgattgcaaaacattgcaatgaccagctgctactcacacactacctgagctcatttgatgaggtgaggagccaatgcatgtgttcacatttctgtcctaatgtgctccatggctgtaaaacagcagatgttatgtctaaattctaacattgtagactgagctatctttgtttgtacttctgtagataatagtcactgagaaagttcccaatgagttgttatatggaagagcagggtatttgtgggcttgcttgttcttgaatacgcatctcggcgagaagacaattccccatgagcacattgtatgtctgtactgcgattctgttattttctttcatattgtcagttccatagtgctatagaaagcatcttacctaattttgtgaaattactgcaactgtgtagacttctgtggcaaaggacatcatcgatgagggaagaaagctggctaaaaaggggaactgccccctgatgtatgaatggcatggaaagaagtactggggtgctgctcatgggcttgctggcattatgcatgtcctcatgcacactgaactcaagctagatgagaaggatgatgttaagaacactctgctatacatgatcaggaacaggtatcctactggcaactatccatcgagtgaaggcagtgaatctgaccgcttggtgcattggtgccatggtgcccctggtgttgctcttacactcgctaaagcttatcaggtgactgcctacatcacatcattaaagtgtgtacacatgtttatccaaagcatctatgtgtacttatcttggtggttgtgcaatatgcatacatggtgtagctttgttttctgcatcaacaaaaatgtcagcgatttgacatcttgtgaaattcttggttgaagattagattccgcgtgtgatccaacatagataactgaatgtttctacttcaggtcttccatgatgaacatttcaagcagacggctgcagaggctgcagaagttgtctggaaccggggacttctcaagagagttggaatatgccatggtgtaagtgggaacgcctatgtatttctctcactctaccggctaactggcaatgttgagtacctgtaccgggctaaggcttttgcttgctttctgcttgagaaagctgatcagttgattgctgatggggccatgcatgggggtgatcacccattttcattgtttgaagggagggctgggatggcttacctccttctagacatggttagcccatcagaatcaaagttcccggcctatgagctttgaagggcatcataaatatatgtatcctgttaggatcaaatgctcagtgatccatccatccaaagtagctgtattgtgttttcttgcgtacccagtaatgtgtgcattgtaatttgttgtctttgtaaagttcagtatccagatggtgcaagcttgaacctttgtaaaatacatgtttgagggagttccttgaaatatgataatatttatgttggttgttgcctctatttgtttactgaataaaatatagttttgcctccatggataagttcagcaaacaccaaatttttgccatgctaaagtcatgagattaaaaggagtttgtattttcttagcaagtcagtatatggttgatgtttcagtatggtgtttagctgaaaacaatagatgtacatacatgccagagcaggctcacccaggttattagaacctttcatgtatatctagcatggcacaccaattagtttttagtagtttgtggttgaagtttccaggtttttgattttcttttgccccatgcgttgacataatgtacaagagagttattctactggaagttgaaatagctcttgcatcacatcctgctaggtggtacaaatttgtagtattaaacctgaaaaaaagaggataattttcttcagttgcacatttatttatacaacactaaaatagtttgcgataccatcatgagcacgacgttacaacgtcaactctttagtggtgcacatcagtgaacgcagtgctcaactgttaccttttgcagtctggggatttgtcaaattgcaccttgtttttgttgctatctcatgcatgtttactgacgaagtctatcacaagctgattcaccaggtcagggaattgctcctgaacaaaatgggatccttctgggatgtaagtgatcccgtagtctggagcaatttctttcagtttttcacttgacatatattccttcagtgctggaaacttgaggatgtagtctttctgacccataatcacaaacattggcatttcaaaccttggattagcaccttctgcttttgcagccttggtcctattaaatcaacacaagtgttagtaacatccttaggtttgtacaagtatcaaagtaattgtaatagcatcatatcaggacactgagaattgcttgtcatattttgttgtgttttttgcatgtgctcacctatatggaatttggatagcagtcatgagacctgatttctcatacaggtcggtgtaagctgagaggtcttcttcggtgaaccactgaggcatcggtgttgattcatctgcaaggtccatgatctcttgtccttgcttggcaactggaatctcactcctggagaagaggatgtagattgtgcgcaagatcctcctcgtgtcgaatcggccaaaatccgcctctgctctcccaggttcctactcaggtaacatagttgcatcacaacatcaatcagaattgcaaaacctatgttcagtataaatgtattgactgtaaactgtgtttaccaaatagtcagaaagaataaaaacttgatcgatgagtgtttaattaatttaccctccatctgtgtatgtaaaatccctcaggaagt

SEQ ID NO: 64082 - DNA, 11998 bp, Oryza sativa
taagagcgaattcaaggtggactggtgttttttcataattcgtaagagctggtaattatcacctcaaatttgttcatttttatgttggtttcttaatcgtattgaaatagttaaattttacttataccttcacactatcatctgagtcactttgtctcatgtgaccatgacctttgattatagaaggtcaccaacggtcaatggtggcctgattgagtttgcagttttatgtatatgtatatatcaccaacaaaaatgtcgttacaatgaaacagatggatggttggttcagtatatttctttttttttaacaaagaattaatagttcagttttacccgagtgtcagatttattactcaatacaattcttataaaaaaaaatcctttagttaattgtcttgcgcactgcacatactaccaacatttggcaatttatattggtatttcctttgtattcacaccacaataattcgtgtagttgctactgtctaatttgttatactccgatgcagagttcttttattactttcagttcagtctaggaccaataataagttcagaacttcatattactgacttggtcttttctacaatgaaatgcacactatgggatattttgattatcagattatggacataattttttatctaatgttatattttattttcctattactatttactagaatatgcaagggaaagaggaatcaataattaaaatattgatatggcaacttgcttcttgctggtgaataaacacttgaacaattctagcagctaacttaggtgcggtcaatcacagaatctttgttattgatcctatagtttcttgcaaatattcctaattgattgtgttgtaagcctaaagattgtatttactttttatttaattcagtatgcctttcatgctatactgcgcaaattgtgttgtaagcctaaaattctattcactttttttttaattcagtatgcctttcatgctatactgtgcaccactaaaaagcacgtcatagtttagattttaatagtaccgtgacgagcagaactgttgcacgttgcattcgttttgcatagcaacaaaacaagcatgtggtttctgttagtctattgatttattttttttgtcttttgtctctgctaatgttttatttgttgctctcatgtctcaaaatagatgtcctcttatagtaggttcgatcaagtgatgctcacgcaactaatatttttatttcctaattctctatatctgtacaatttcactctttttcgatatgatttaaattatgttctccagttaaattggatggtttatgggtcgcatttaactttgtccatattttcagtattatgcatcacacgaatgcaatatatactgatgtatgctatatatgatatctaactgatatagttcttaaaggtacaaatatgatttatctttatatttttctcaatgaatcctttgcaatcccgtagcaacgcgcggggtatcatctagttatgttaatatgaaacgccttttgttgtttactatcttctcattaaaatataatgcattaactaaaggtcagaacctaaagagtggcaataagatagcaatacaaaacaatacatacataacttacagattaatataagagtaaaatactgccagcattctattcatattgcaatctgatgtcagcggttcactgctgctgacatttaaaattctctttcaatcatagcaagttctccagaaatgatatgaatcatgattcttctcaacccagaaaacgctaaatttattgtcatttagcctaatcattagttcaagctcaacttgagtgatgtgtgccaaggaaaatcaggcatctcatgaaagcaaaaggcaaaatggccaaatgctaaacatcatggatcataccactattgcataatttcaaataaccatacgagaagacaaatccacacagcaccaagacgccatgacatgcatagaagaacgcaagttcctatataagcagttatgtagcgatctatagacaaatactcaaatccatgagccagttggtttgcacttgcttgacacaaggacaatgaaagaaattggtcagtaatacgcgttatgcaatcctacgtacctagtggacttctccagcaaggatcttatctgtttcttcatcagcctcgatgccatcttttttcatacgatcaagcaagtctgacgctggttctcctgcattgacatatgtcttcagtaacccatggtaaacatcccttgtcagaggaaccaatctctgtaataagcttgccatctcctcagctgcttctacattcttttgctctgcgaaatagtttatgctcatcagcacatttgccaggtcaggtttccattcattacttgcagaagcaagtgccttctttgtgagatctgctgccttcgacacctgaccaaccttgaaatatccaccagccaacttataccaagtattggaaaaaagtgtcctccctttcttgatgaattgatcaacaagagcttctgccttctccataagaccttctttgcagtaagcagtaagcagtatgttgattaatcgggaatcatggtaaacatgcttactttcccactcttcatatgctttctcagccccaacaatgtcattcatcttaagtaggacacttatcctgcacatgtacattgtgttgcatgccgatgccggaactttggatctatagacatcccagatacggtccacctcactgtccatctgtagatcggcatacatggttagcaaaaacccataagcgaccctaccatccttcctcgcagtaatcctcttttctgattcttgaaaagcctgcaaggccctttcttgcatcccagctttcatgaaaaccttgcctacaatggcaaatgagtgccaactcataagattattacacgatgccttctcgagaaccttttcaatcgcctcaacatcttccacatccgcgtatgctgacaccagattgtcaatagtgaaaatatcaggcacaataccaccctcttccatagccttatacatggagtccaccctctcaacctgcccgatttgcgaataaagattcatcatcgcattgtaagcataagaattggccatccccatgccccgcatattctcgaagagctcctccgccttctcgacgcgctcggcctccgcgtagcatctcagaagggagccgtagcactgcagttccctcagctgattcggcacagcgtcgaagtactccacggccttgtcgaggccatggaccttgctgatcagctccagccggtacgcgacgtcgccgggggataggtggaggtgccgccgctcggtcatccacatggaaagctgcaaaaaaaaaaaaaaaagccaccaaattgcatgatcagatgcggcgatgggggtgggcatcaaggatgaggagttcgtcgcgcacctcgagcgcctgggagaagcggcagcgacggcgcaggtacttgacgagggactggagctcgggcttcgagacggggcgttcctcggcgagccaccactgctccaggacgggggccagcgggatgcgcgggtcggcgcccgcgacccgccggaagagggagtcctcgccctgaaggcgcggcggcggcggaggaggaggaggtggaggcgagggggagacggtctcctcggcggacacggagaggccgcggcgacggcggaggaggccgccacggaggtggaggaggagtccccgccggtgcagcagcatggtggtcgccgccggcgatcgcgcggcggcggaggcgagggttttggggggaggaaggagagagtggcccgaaatgagcgtctcgtgatgtgtaaagaatgggctgaagattcgcagaagtagatcagcaaggcccattcaacagtcctgtttcggcccaatatttatgggccatacgtggatcacactagcgttttggcccatattaaatgggcttggaacaggccgcattggatgacaatcccattttggcccaaataaaatgggccaaacgtgaatcgttataacgttccggaccaacttaaagaaacagtacagtttttgcttagacagagccaaacgaacagtacgtacattcttttagctttagattttttttttatcacaatgccactacgaaccatcagaatcaaatgtcattctgccactgaaaagataaaaggtaatttgctgttgtgccactgaatgaacgaccgtgacaactcatccaccatttgcagcagcaatgggttcccaatttcccaaatccattacgcgaccgtggcaatcaggaaggtttacaaaaccgtgcggttatcacacggtaatcttattagtctttaaaataacgctatacctcatggtaaccatacagtttttacaataaccacatggttatcacggtaactgttaaaccgtaaaaccacgtggttatagtggtaaatgccaaaccagtttctacaataaccacgtggttatcgtggtaaatgccaaattgggaagtaatcataaccctttccaaaatggtttgataaacccgatcaggatatagcggccacggaaatgaagggctgataactgcgggcccaccaccggagtccaagaagcgaggatcaccggtgagctcgtttgcctcgaggtgcacgcgcgttttccaccattgctatgcacaagcgtttttgctagtaacaagtacaaaaatactagcagtattcatattaaaaaaaaatcttcatctgatatcagcgctgctgccatttaatttttttctttctaacttagcaaatcgttcagaaaatgatacgtatcatgattctacccagggctcccttcgtcccataaaaaaccaacctagtactagatgtgacacattctaatactacgaatctggacatacatctgtccagattcattgtattagaatgtgtcacatccagtcatatgttcgttttttttttggaacggatggaatagactctgaactgaactgattgacattttagactgatcattcattcaagctaatgatgagtgatgcgtgccaaggaaaaccaggccttctctaaaaacaaaaggtaaaatgctaaacatctcagatcctaccactactgcataattttacataaccatacgacaaagacatatccgcacagcacaatgacaccatcacatcacatgcatagaagaatggcaagttcctatataagcagttgtacagaggtttataatcaaatactcaaatccacgggccagtgggtttgcacttgcttgccccagaaacaagaaaaaagacacaaaataagtaactaaaaggaataattggtcagtgatatgttttatccaatcctgcgtacctagtggacttctccggcaaggattttctctgtttcctcatcagcctccatgccatcttttttcatacgatcaagcaagtctgacactggttttcctgcattgacatatgtcttcagtaacccatggtaaatgtcccttgttggagtaatcaatctctgtaataagcttgccatctcctcagctgcttcgacattcttttgctccgcgaaatagttcaggctcatcagcacattcgtcaggtcaggtgtccattcattactaccagaagcaagtgctttctttgtgagatctgctgccttcgacgcctgaccaaccttgaaatatccaccagccaacttataccaagtattgccaaaaggcgtcctccctttcttgacgaattgatctacaagagcttctgccttctccataagaccttctttgcagtaagcagtgagcagtaagttgattaaccgggaatcatggtaaacatgcttactttcccactcttcatatgctttctcagccccaacaatgtcattcatcttaagtaggacacttatcctgcacatgtacattgagttgcaagccgatgctggcactttggatttatagacatcccagattcggtccacctcactattcatccctagatcggcatacatggtgagcaaaaacccatatgcgaccctattactcttcttagcaatcttcttctctgattcttgaaaagcctgcaaggccctctcttccatcccagattgcatgagaaccttgcctatagtggcgtatgagtgccaggtcataagatcattgcacgtatcggccttctcgagaaccttttcaatcgcctcaatatcttcagcaaccacatacgctgccactagagtatcagtagtgaacacatcagcaacaataccactctcttccatagtacgatgcatggagtgcaccctctcaacctgcccatcctgcaaataaagcctcatcatcacattgtaagcataagaactggccatccccatgccccgcatcttctcgaagagctcctctgccttctccacgcacttggcctcggcgtagcatttgagcagcgagccatagcactgctgctgcttcagctgatccggcatgctgtcgaagtactccacggccctgtctaggccatggaccttggtgatcagctccagccgatacgcgacgtcgccgggggatagatggaggtgcagccgctcggtcatccacatggaaagctgcaagagaaaagaaaacaaaacaaaatcgaatgatgcggcgacggaagtggtgaacaaggggattcgtagattcgtcgttcgtcccgcacctggagcgcctgagagaagcggcggcggcggcagagatacttgatgatggactggatctcgggcttcgcgatagggcgttcctcggcgaggcaccactgctccaggacgggggaaagcgggaggcgcgggtccgcggcggccgcgacccggcggaagagggagtccttcttgcgccgcggcggaggaggcgagggagaggctctctcctcggcggccacggagccctcctgcggtttccccggcgagggcgaggccgtttcctcgtcatccacggagtcctcctgcggttgccgcggcggcggaggaggcggcgacggggagacggattcctcgaccgccactgataggcggcggaggaggccgccgccgccgcggaggaggagaccacggcggtgcagcagcatggtgggggggcggcgtcggcgctccggcgaagtcggggcgagggttttgggaggggagaggggaaggaaatcgcaaaaaaaataataaaataaaaaaaatgaaagggcgtctatagcaacgcgtaatgggcaagcccagctgcggtagcagcggatcagcgaggcccatctagcccaatcaaatatagctcgcgcgtgaaccgcaatccccctgtctcctcccctgcgcgcggcacaaggcatcaccgccaccacctactcttcttctcctcacaagggctgcgtacgttgacaggagaaaggggagactgactcgttttccgcacgcacttttttcaaactactaaacggtttgttttttataaaaattttctatagaaaaattgttttaaaaaatcatattaatctatttttaaagtttaaaatagttaatactcaattaattatacgctaatgactcacctcgttttgcgtatcttcccaatcccttctccctcgaacacagccaaggtcaccataggaatcctagcggctagattctcccggatccaaaacggcggcggagcatgggctgcagctttaacggcgctgaccgcggccactgcatcaccggcgactgcccaaaacacgatggcccacgctgtcactggcacgacgttggccaggtacacgctcgcaagtcgcaaccccggcgtcatcgacggcttcaacgtgccggtgagctttcagccaaccaaaaatgtcgctcgctgcactaagatacgctgactgacgtgcgccgtcgagatcagccggagacggggggttgcgacagcacatgctacaagtttagcaacgtacgacacctactatagctggcctgccaggggcagtgcgagcacccaccgaccaaatactcgaggttcttcagggacaagttccctatacgtaaaaattcacatcctctaccataatggtactaccactacaaccactgacgtgtggagtaataagaggatagaacccccatgtcagtgactataatggtagtgacattatggtaaaggattcccacccctgcaaggagggatgatcagagcagcatcttcacctccactgccggaaccaactgccatatcagttgcccatctccaaggttagacattactacatcacagctccttctctggagcaaaacatgggtattcttgaatgatgttttgaatattagttatgctgcaaagtacaacttgcttcctaaatcgaaattttaattggatattgaaacttttgctgctgtttaatgtaataaaacttgtaaatcatgttaaactatatacttttcaacatgtacaattaaaagcattcctttgctgatgcatgatttcagttcagttcataacataattttacattttgttggtggtttatgaatgcaaagcatattaagagagcacaaatgagattgtcaggcaacagggtaagtatgtgcttggtgctcctaaattgcatcagaaaatatattaggaagtatgattgtatgaatctttcatcctcattaagagaaagtactacttccattttcaacatgagtcattttttctgctcatttcaacgatttcaccattgaatgattgaaatcagttgatgatgtacaaaaataatattccccaactacagaaggagtaacctgaaatcatgcccttactccaggtgtttaaaaaatcagaaaatttacgaaaaaaatattaacacataaacaaaagattaatggcgccactgcaaacggtttattacttatgaactcacggtgttcaccccattagcatttcaaaggaatctgcaccatgagcacactggtactaattgtgtgcacctagaaggtcctgtaacaaggcagcagctgattgcacttatacatatctcaaactgcattttcttaaatatgaagtgttcctggagtttagtgaatctgggcaaagtaatattctcataagaatatccaaggcaacgatatgcatcataatgcgtcaaattgctaaaaaaattttctaactcagattgtctatggagacatgcatttagtgaaaatccagtgtatattcttgtagaactattaaacatgagaaaatctaagcggtagaagttcgcccgtagacactaacttcctgtattgcaatgaattatttctcatgtttaatagttcttcttggattccatcacaaccaaatgaaagagcttggcatttctgaaatctgtacatcttttgtcaggattgaggtcctctgcagtcaaatgcatagtgcctttatcactgacatatgggtccaagaatcattgggcccatatgtcaatgacaaagtcacgtgacttcgactgcagaggatcctgatcccttttttcaatgagcaatgcaataagttagtttctctaatttttattctttgtatgaaccgtttgttgatttacgcgcatggccaattttatctatatttttatggttgtacatttatatcctggcaaagttttaccccaatgtaagattgtacatactgaattattcataaaagaatttattgttggcaaatatataaccgaaaaacaataaccacttgattattcaaattaacgtggacttcctgtgaagagagaatagtgacagttcaccaccagctgcaaccgataatttaaagttttaaactgttgtaaattaacattctgaccataaaagaactaaaaatcatgtcagtttaaaagtataatcatgtaattaattttaattctcacaattgacatttctatacaacttatttaaataaatggccttttgtgtaaaataaaaaaaagacatactaggtttcctgctaaatatgttctctgaacatctatgtagaatagaattgaatttactaaaattatatctattacaagggaagtataaacaaattatattataaaaggagaaaatactaatttatgttattaaatattattttaaaaaaatagttaattattatacatctttatagagaaggaggttataatcgtgtaaacacgcaacactagtttagattgatcatttgatcattcattcaagctcatgatgagtgatgcgtgccaaggaaaaccaggccttccatgaaaacaaaaggtaaaatactaaacatctcagatcctaccactactgcaaaatttcacatagccatacggcaaagacatagacatatccgcacagcacaatgacaccatcacatgcatagaagaatggcgagttcctatataagcagttgtatagtggtttattatcaaatactcaaatccacgggctagtgggtttgaacttcattgccccagaaacaagaaaaaggacagcaaaataagcaaagaaaaggaattggtcagtgatatgttttattcaatcctgtgtacctagtggacttctcccgcaaggattttctctgtctcctcatcagcctccataccatcttttttcatacgatgaagcaagtctgacactggttttcctgcattgacatatgtcttcagtaacccatggtaaatgtcccttgttggagtaaccaatctctgtaataagctcatcatctcctcagctgcttcgacattcttttgctccgcgaaatagttcaggctcatcagcacattcgtcaggtcaggtatccattcattactcgcagaagcaagtgccttctttgtgagatctgctgccttcgacacctgaccaaccttgaaatatccaccagccaacttataacaagtattggcaaaaggcatcctccctttcttgatgaattgatctacaagagcttctgccttatccataagaccttctttgcagtaagcatccaccaataagttgattaaccgggaatcatggtaaacatgcttactttcccactcttcatatgctttctcagccccaaccatgtcattcatcttaagtaggacaccaatcctgcacatgtacattgagttgcacgaattggccttctcgagaacattttcaatcgccttaatatcttcagcaaccacgtacgctgccaccagagtctttttttttcttagaactgccaccagagtgtgagtagtggatacatcaggaacaataccactctcttccatagcctgatgcatggagtgcaccctctcaacctgcccattctgcaaataaagcctcatcatcacattgtaagcgtaagaactggccatccccatgccccgcatcttctcgaagagctcctccgccttctccacgcaattggcctcggcgtagcatttaagcagggagccatagcactgctgttgcttcagctgatccggcatgctgtcgaagtactccacggccctatcgaggccatagaccttggtgatcagctccagccgattcgcgacgtcgccgggggatagatggaggtgcagccgctcagtcatccacatggaaagctgcaaagaaaatcaaatcaaatcaaaacaaataggaatcggtggcatgatgagatgcggcgatggaagtggtggccaacaagggggattcgtagattcgtcccgcacctggagcgcctgagagaagcggcggcggcggcagaggtacttgatgatggactggacctcgggcttcgcgacatggcgttcctcggcgaggcaccactgctccaggacgggggacagcgggaggcgcgggtccgcggcggccgcgacccggcggaagagggagtccttcttgcgccgcggcggatgaggcgagggagaggctctctcctcggcggccacggagcgagggggaggcggtttccccggcggtggaggaggtggcgacggggagacggcttcctcgaccgccacgcggcggatgaggccgccgccgcggaggaagacaccacggatgtgctgcagcgtcgtggtggtgtt

SEQ ID NO: 64083 - DNA, 34490 bp, Oryza sativa
  unsure (1)..(34490): unsure at all n locations
acattatttaatatcagatgacataacgatactgtcagcatacccgataggagaggtattgacaaataaggaggtagcaagaaggattacaaaatgggcaatggaacttctaccatttgatttgaagtatacctcgagaacagctataaagtctcaagttctggcagatttttttggcagaatggactcccaatgaggtggaggaaaaggaagaagatgaaaaactatggataatatactctgatggagcatgcaatgccactggcgtaggggcagcagtggttgtaaaaacgccgatgaagcaaacactaaaatattttgcaaagctagttttcccatcaacaaacaacacggcagaatatgaaggggttttattagccatgagaaaggcaagagcactaggggctcgtcgattgataatcaaaactgattcaaagctggtggcaggtcacctttccaaaacatttaaagcaaaagaagagacaatggcaaagtacttggaagaagcaaggctgaatgaaaaacacttccttgggataacagtaaaaactataacaagagaagaaaatggggaagctgatgagcttgcaaaagcagctgccacaggccaaccattggagaattcattcttcgatgtgttaattcaaccaagttatgagaaaagagaagtggcaaacatacatggcgagatagattggagagagtcaattctgaagtatttggttagtgaacaacttccagaaaaagaagaagaagcaagaagaatacagttaatgtcaagaaaatacaaagtgatagaagggcagttgtacaagagtggagtcactacccctttgctaaaatgtgtaacaagagaagaaggaatgaaaatggtggtagaaatacatgaagggctgtgcggagcccatcaagcaccaagatcagttgcatcgaaggtgataagacaatgagtatattggcctactatcatcaaagacatagagaagtacattaagacatgtaaggcatgccaaaaatttggtgcaacgtcaaaagcaccaccaagagagttgcaaccaattccaccagtttggccaattccaccaagagcaaaaggagatttacgttttgtcattgtggcaattgagtatttcacaaggtggattgaagcagaggcagtagcacgaatcacatctgcttcggtacaaagattcgtttggaagaatatcatatgccgatttggaatacccaaggataatggaaaacgatccgagtcaggaaagttcaaagatatgtgtaaatgtcttaacctgcaaatcaactttgcttctgtgggtcatcctcgaacaaatggtgccgttgaaagagccaatgagaaaatagtagaagccataaagaaaaggctggaaggttctgccaaaggaaaatggccagaagatctggtgtcaatcctttgggctttaagaacaacagttgtccaacaactggcatgactccattcaggctaatatatggagatgaggcaatgacaccaagcgaggtgggagcgaattcacctcgaattgtgtttgatcaaaaagacgaagaaggaagggaaatcaccttggaaatgttgcacgagataagagtggaagcattagacaaaatggcaaaaaacacagaagaaaccaaaagctattacaacaaaaaagtgaaaatcaggcaaatagaagaaggtgatttggccctcaagaaaacactaaatgaagtggctgttggaaggaccattcatagtaaaaagaaagttaaaacaggagcatacaagctggcacacctcgatggagaagaattaaagcatacttggaatgctgtttccttgaagaagttctatgtgtaaaaaaaagaaaaggaagaagaaaaaaaagagaaaaaaaaaagggggaaacatgttgctcgaagtgtacaataccgaccaccttgtaagattctcttttcttctcggtgttaatacatataaacaggacgtagggtgttatcaataatggattgtatatgtgtttgcgaatcaagaaaatcctccgcacgcttcggagaagaaaagccaactcgataacaaatcgagaaaatactccgcacgctacggagaggaaaatccaacttgataacaaatcgagaaaatcatccgcacgcttcggagaagaaaagccaactcgataacaaatcgagaaaatcctccgcacgctttggagaggaaaatccaactagataacaaatcgagaaaatcctccgcacgcttcggagaggaaaatccaacacgataacaaatcgagaaaatcctccgcacgcttcggagaagaaaagccaacttgacaacaggttaaaaagcactccacgcagttcgacaagttttaccttcgcccaaaaacctaacgataaaacgctcgaacacccttatccgattcgagcaaacagtggaaaattccacgcgatgaggtaaagcgtgatttcgacctcgtcactccttcgaaaggtaagaaggacggcggttttcgaacaagttttaccttcgtccaaaaacctaacgataaagcgttcgaacacccttatctgattcgagcaaaaagtggaaaattccacgcaacgaggtaaagcgtgattttaacctcgtcgctccttcgaaaggtaaggaggacggcggttttcgaacaagttttaccttcgtccaaaaacctagcgataaagcgctcgaacactcatatccgattcgagcggaaagtggaaaattccacgcgacgaggtaaagcgtgatttcgacctcgtcgctccttcgaaaggtaaggaggacggcggttttcgaacaagttttaccatcgtccaaaaaccaaaataacgatgaaacactcaaacactcataaccgattcgagcagaaagtggaaattccatgcgacaagataaagtgcgattttgacctcgtcactccttcgaaaggaaagggggacggcggttttcaaaaaccaaagctaaacgctcgaattcttttctgattcgagtctttgcggaataaaaggaaaagaaaaaggaaaaatgacattgagaggagaaggcattcccgtgtaagggacaattgagtagcgccttttccatattctaagttgacgctcagatggtctaaaagtttgccaaaagttaatgctgctcgaagcattattcgaacgccgttttctaaactcgacaacgaagtcacgcaaactaccatctcgatgttctctttgccattggaaaaattttaaagaaaaaatacaagtgtcatcgtaatgtatttccttctcttcatcatcacatttagttgctttagaaaagagcaacttctcgtgtgttcgaaatgcaacgagcttcatgtttcgagttgaatgatacttgttgcgtcgaaccacaacttttcggttcaaataaacctgcttccccgacaaaaacgaaatgatgatgaagcacaggcatacagagaaaatagcaaatggtacccaaccacagaaaatatacataattaagttcccaaccacaataggttcgacggagcaaaagaacaagcgttttcgaccatatccaaaaagttttccaagttagttttccctaaaataacttcacacctgtgaatcagatttgtgagcgtcaccaccgttgtctggttgactcgaagaggattgtgcggtgtgtgagctcgaagccaacgatgcttagagagaagcaagggtatcttcatagcctttctttttccagtaccaaacttgaaaagctttgactacagatcaaactgccgcatggtgttgagcaaactttgacataaatgtgcatattcaatacataaagaatatgtatacatataacaatatatatatatatatatatatatatatatatatatatatatatatatatataataaacaaataaatgcataatgactgacaagaataaccgctttcgaacttcaaaattttctatcctagtgtttttcgactgaataggaggacggcggttctcccctagcttttgattcgaacacggtttcggccgaaaacacacttcgcccttacccgtgaggggcttgttgtagctaggggtcaccaccgttcctctctattcggcccaaaacactgtagaggaagagattgggtaagattgagtttttattctaagtatccgagtggcaaatggtcattcgaacaaggaaatggtaaaatgttgttcgagttggaaaacactattcgagtcggaaaataccgttcgagtgagtccttgtcactaagtctcattatccgttttgcgtatttcctgagttaataacaggtcagctgtcacgcccagaaattaactagcaatttccgaacttatttgtgcattaaatcctcgtccaggaatcagccgaggtacacaaactgacaattaatatacagattcatcataataataacgtaaatacttacaaaagaaaagaaaaatagcagcggaattacagtctagcgaagctccggctccactcccacaggcagctcaactgaggtataagccaaacgtcttctccttcgcaacttgtcttcaactgaggtttgattgattattgcaaggtgagcatatgacatactcagcaagccacacagcaaatatgcaagtgcacaagaataccaaaggatggcataatatagggttcatttgcaaaagcagcatttagaaaatatttaagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaaccaggagctaaattaattaccatcaattaccacattattattaatgagtagtgtaggactaatcacgaaagacattgttcgacccgcccataaccgcgggcacggctattcgaatagttttactctggccagaggtgtaccactgtacccacaagacacaactccacaatatgtcaccatatcatcatgtgcccatgctaaacatgtcaccatttgtgtagttgtgacaagacccctcgcatatgtcaactcaaagcagtgcaccgttcctagatcgtagtcaccccctcaaaaaccagaggcatggactccccagcgacccccgtgggcttatctctgccacttctcagtctggcactccacgatgagccttgctatgcaaagtgtccagccgttgcccattctggcttgtggttgacacggttaatgtttcacaaccgaaactcgtgaaccggtccttaattgtcatgagcactaccatcaaaaccatgtgctcacaacccaccattatcaagttttagttggcacattaattaattcaccaatcacgattaaccatcgtgagctatcattaaatctctaccattaagtaatagtgaaacattagttatcccaattatgtgctaatgtttctaagcatggctaagcaattatatctaacatctagctgaaccaatatataaagctcaactagtcaaattataataacccaatgtatcaaggaacagtgtaatcaatgcaaattggccatacaaaggaataagttcacaccacccggtgacattcgaaaataaatgcacagttgaaataaataaagaatttaaatatacgatcaacatggtcaaaggaattgtgtttgggatctgtgtgacttgccttgcaataacgggtcttcaattagtcttcttgaacacttccggcgcactcgagaaccttcgaaacgacggaaacgacaagctaacacgcaaaacgaggaaaaagactaataaaaaccaaataaacaatacataagaagtaaacaaacatgtagataataattttagatgaattaggagacttgaacggcctcactctgacttcatatgaattaattatgaattttacaagatttaatctaattaaagcccatttaaaaaaattaaataaatttaattcaatttatggataattttaatatgtagatctttattttatacaacttttgcaacttgaaccacattaaactgagttacaatgaattagttatgaatttttaaagattaaaccggattaaagcatttatatagattttaattgaattatgacgcaataatgaattatttttgaaaagcaaaagggatttattgcgtcatcaaagatggtccacggtagaccgggtgcatagaggcggtctacgaaaccaacggccgagatctaatctaaacaaaatggacggccaagatcgatctaatccaccacgggtctacggctgacgtcgacgatgacgtcatcgccggtggcggctcggcacctcgtgctcgccggcaatcgatggcgcggcgacgcaaacggagggcaccaacgggtagagggcgacgcggcgaactcaccgagctcttggatgacggcaaacgacgacggatgacgacggcggcgaggtcgaagcggcggcgatgattgggtcaacgacgacggtggtgttccagcgatcttcggcggaaacggaggggtggacgaggtgctgctcctcctcgcgatcccgacggtggcgacgacgaccgaaggtggtggctggaccaacggcgcggcgtggctggaccaacggcagcggtggagagcttcggggcgacggagtcggcggcgctccgatgatctgcggcggaaacggaggacgggacaaggacggcggcgaccttgcgaacctggcgacggccttcccgagtgacggcggcgactagagcagcggcgcggcacggccggactcacggcgacgacggcgacacacgagctaacgcggaggcggcgctacaagcgttggcgggctaaggcgaaggtgacggtggattgaggaggtctcagggatccttttataggggctaggaggcggcgacggaggcccacggcgaccggcagcgagatggaaggttttagggtttggaaagagatgctaaccaaatcggcattgaatccgacgatttccaaacgaattagctcgggtttcctaaagagaaaaggaagaggagatcgaggagattatttcccctcaattgatttggccggagaaggaaggaggcggccggatttggaaggagatcggcggcggcttgcggctacagtcggcggttggtggctggaggaggaagacgacctgacaggtgggtcccacctgtcagcggctgagagagaggagggagggcgcggcggactgggccgaacgggccgggcacgcgcaggccgggggaagggagagagagacttgggccgactttcggcccaaagccaaaagggagattttaaaacctttttctatttaaattattcatgaaatgatattccattgattaaaaatacttccttggctcaaataaattccagaaaaatctaggaactatagaagcaagagaagtatttaacaaaattttatctagcccacttttatattgagatttaacaaattaaaattagatcttctcttttaggcttttaagatcatttctaataattccttttaaacaacaatttataatttaaggatttttaaacaagaaaagcacttaacataattataattagatcattaattgattaactaattactgaactgttctttgtatcatttaggaattgagctctgaaaaatccgagaaaatttcagagggtataattaatcatggagaatttaataaaaattaaatccagccatgctttatatttaggaaattttatttcccacatttaacttcacttgtaaattaatgaacatttaatataaattctaataataatttattaaataatttataaatcctgaaacggaaatcaggctgtgacatcagctaccggataagtcggaaatggtggtcgagatggaaaagactatttgccatggaaaagacccgtagtggtggaaaagacccttagtcgaggagaagatccatgttggtggaaaagactcttggccatgaagaaggcgacttggacaataaagatgccaagagaatattcccagggaccactcaaccactccatctagctggcaccaaaagactataatgacccccataatgtaccaaaatgcccttagggtctgttgatatgcaggggcacgattgtaatttcatgtgggcccaacaaagagcacaattgtaatctcacatgtaaagctgtgtactatatagagcagacaaaaagcctgtagcagacaggacatcttggaatactaaaaatcttgtcactcagggtgtgatcatttggtattcgggctcatttctcaggataggcaggaaaagggtgttttcctgtctatccccaatcttgtccgtgaccttgtgtcacgacaaattattttcaggatttttcttgaaattatttgagcattgtaattatttttaacaattcaaagatcatttccatgattaatttaaatggaaaagtaaataaaattcccttttccttttcgggccagtcttcagcccattcttcctctttgcctgcttactgtctccttctttcccgaagaagtctatttcttgtccctcgcctcttttcttttagcccagacaaaagtctgtttcaccttcctatcgctacagtactccttctatctctggacagaacccgagctcctgtgcccactgcccatgcaactcgacgcccccgcttcctctgtagaatccgttgcatcccgtgactcgtttcccaaattggttgaagggatttcttcccttatcctcctctttctttcccctcaagaatcggagcaaatcccatcgtatatcgcttggattcgaagcggagttcatctcctattttcccggcgaaccttaaccaatccgccgccaaatcctcacgggtccgagcctatttcctccacctttgcctataaatagcagtatcaatacctcctcttccgtttctatctttttccagagcttttccctaaccttagccgcctgcccgcgctcgtctcctcgctccgccgccggccgccgctccagtcggtcgtagccgtcgactccgacatctccggtcagcgccgtcgcctccaatgggaccaaagcgaagagtggaagaccggccaccatctgcccgaagccgaagaccccgggaagcccttcgtcgccgttaaggccgagttcgccgtcgcgttttgatcttcggcgaagccccgctgctcctcccgtcgtcgcccagcttcgtcgccacctccgttgggttcgaaaggaggagctgcaccccggccacccctccgttgccgccgctcgttgtcggaaagccgccgtcgccgccgtcccgatctcatcgccgcctctacctcgccgccggccgtcttccgttgtcgttcgtcgtcgtgccgcccctcggtgagctcccgtcgtcgtgctctttcttccggtatcctcgatttgcgccgccgagccctagatcgccggcgatcgttggaagccgagccgcctgtccgtgatgacatcatcgctgacgtcagcgcccgttttccttttctaagataaatcgtaaatccttttctgtatataaggctaaaatcagattaatcttgtaaaattcataactaaatcatatgaagtcagaataaggctgtttaagtctctaaattcatctaaaatcatgatctacatgtttatttagtttatatgtactgtttatttggagtttcttagtctttttcctcgttttgtgtattagctcatcgtttccgttgttgcgaagattcgtgagtgcgtcggaagtgttcaagaagattaattgaagaccgattattgcaaggcaagtcacatagatcccaaacacaactcctttgagcatgttgatcctatatttaaattctctatttatttcaactgtgtatttattttcgaatgtcaccggtggtgtgaacttatacctttgctacggccaatttgcattgattaccttattccttgataccttgggatacaatttgactagttggcctcatataatggttcaattagatatattagtatagttacttagatatgcttagaaacattagtgtggctgtgtttgcaaccccatgttcccagcccctctccatcgttttccgttttccgagcgcacgtttttcaaactactaaacaatgtgttttttgcaaaaagtttctatacgaaagttgcttaaaaaaatcaaattaatccatttttgaaaaaaaatagctaatacttaattaatcatacgctaatggatcgctccattttccgtgcggaggcactatgttcccaagctgaacatgcgaacacagcctaaagcttcactattacctaaagctggatatttaaaggtagctcacgatgatgaatcgtgttatgataatcaattgataattaaaacttgataatggtgggttgtgagcgtatagttttgatggtcgtgctcatgacaattaaggatcggttcgcgagctactgttgtgaaacattaaccatgccaaccacaagctagcatgggtaacggcatttccttttgtatagtataattcattatggggcgccagactgtgaagtggcgagaagtccgtgggggtcgctggggagtccatgcctctggtaattgagggggtgattatgatccaggaacggtgcgttgtggtggattgtgttatgcgaggggtactgtcacagctcctttccgagatatcgtggtggtattgaggcgcatggcaacgtgttgtggggctgtcttgtgggtacagtgatacattgatacatctctggccagagtaaaactattcgaatagccttgcccgtagttatgggcgggtctaacaatgttttcgtgattagtctcacactgatgctataactggtaataatttgcttagatcctggtttggaatggtacattcctggtttggagttagatctgtacagccgggtatggttgttcaggatggttgggcctgtgcagcatgggtgtgctgtacagtgttgattaatattgatgattaattactctactgttttactattctcaaatatttgctaaatgctgcttttgcaaataagccctatattatgccatcctttggtatccttgtgcacttgcatatttgctgtgtggcatgcggagtattccatgtactcaccttgcaataatcaatcaaacctcaattgaggaagttgcgaaggagaagacgtttggcttataccccagttgagctgcctgtgggagtggagctaaagccatcgctagaccgttaatccgctgctgttttcttttcttttgtaagtatgtaatgttattattacgatggatttgtatattaaattatcagtttgtgcacgtcagctgattcctatacgaggattttatgcacaaataagtttagaaattactagtgaattttcgggcgtgacaggagcacactcttcgatcgatggtgggctgagtggaagaagcatttattccatctatcagcctcaatgttcttcacgataatcttcccggactcgatgcctcaggtacacttttctttttgaaaaattctaaccttgagcaaatgtttaatcgatacttgatctcttttccttgttcgcagaccacagactcctcactgccttacactagccaaagtgggaagccgattaactatgctgcagggattatcccaaatggtggtggactagctccttcagtgatcggctatattgcccccaagacaactaatttactatatggacaaactcatgaaccgattccagttgaaacttgtaaaaggaaaagcactaagcaatcggatgtcaagccatcggctgctaaacctcctgccgcctcgaaaaaggtagcaaagaagcaaaagtttgctgccgatgatctacctcctttggatcgtgatgtagaggaggtcctggagaatgaagaaatagaggaggccattgataatgctgctgctggcatgagtgacaccagggccttatccgcaagccctacgggtcgagctgggacacctccagctggtacaccaagtcccaacaagacgccagatgctccaacaccggcccctaaaagtggtggtatgcatctttcttcacattatcatccgattaagtgtgcatcatatgaatttattgccatttttccagcagacgaagaagccaagggctgctaagaagaagaaatccactccgcctccattggtaaccttaaacttgtgttcttactcctattagttgccacaaaaacttaatctcctcccctttttgcctcagcctcctcgatctccatctcctcgtcggctagcatctagtgagcacaccccgtcggctgtggacagtcatcacttgggaacaccagaacatccacctcttgttgtgcctgttagtactattaaatcttctcatatcggctgcgatattttctttgccaataatcccgatttatcttttctccaggtcttggccaatatgttttcctttgacgttaaacagttcctagatgaagaagaagaggaaaccaccagtggagccttggtccctcttgatgatgatctcaagaccaaactcatggatattgctcaacggctagggagttccttggattccttggttactggctgcgggtcaatcagggccaggtttgaagagatccaccaccagatcccagaagatgaagccgacatcatttccctggctgtatatctagagcaacatcgtttcaagctggaaagggcacaacaaagaatagcagacatgcgcgagagagctaaactggaagcaacaatcgaagctaatcggctcttcattaatgaaaaaaaagtcaagcttgatgagatgatcgtcgggctaggctctactcaagtgaacatagatcggctaaaaaccagggaggccgaactagtagctgagcttgaagcgtgccgatttccctagggctattgaagaacaaacgtctaaattgaggaaatccgtcaagcatctctctgaattgagcaagtccttgaaggtgattcctagtgtcacgcccggaaattcactaataatttccgaacttatttgtacaaaaaaccttcgtctaggaatcagccgaggtacacaaactgacaatttaatatacaaatccatcataataataacgttacatacttacaaaagaaaagaaaacagtagcggaattaatggtctagcgatggcttcagctccactcccacaggcagctcaactggggtataagccaaacgtcttctccttcgcaacttgtcttcaactgaggtttgattgattattgtaaagtgagtacatggaatactccgcaagccacacagcaaatatgcaagtgcacaaggataccaaatgatggcataatatagggctcatttgcaaaagcagcatttagcaaacatttaggggtattaaaacagaagagtaattaatcaataacttttaatcaacactgaacagcacacccatgctgctcaggcccaaccatcctgaacaaccatacctggctatacagatctatctccaaaccaggaatgtaccattccaaaccaggagctaatcaaattattaccagttatagcatcatttattatagtgagaagtgtgagactaatcacgaaagacattgttagacccgcccataaccgcgggcacggctattcgaatagttttactctggccagaggtataccactgtacccacaagacacagccccacaacatgtcaccatgcgcctcaataccaccatggtacctcggaaaggagctgtgacagtacccttcgcacaacacaatccaccacagcgcaccattcctggatcataatcacccccttataaacaaggcatggacttcccagcgacccccgtgggcttatctccgtcacttctcagtctggtgccccgcaatgaaccatgctatacaaaggtaaagtcgttgcccatgctggcttgtggttggtacggttaatgtttcacaaccgaaattcgtgaaccggtccttaattgtcatgagcacgaccatcaaaaccatgtgctcacaacccaccattatcaagttttatttggcagttaattaattcacaatcacgattgaccatcgtgagctagcattaaatatccatcattaagtaatagtgaaacattagttatcccaattgtgtgctaatgtttctaagcatggctaagcaattatatctaatatctagctgaacaaatatataagtccaactagtcaaattatcacccaaggtatcaaagaatagagtaagcaatgcagagtggtcataaaaaaggaataggttcacaccacccggtgacattccaaaataaatgcacagttgaaataaatagagaatttaaatataggatcaacatgctcaaaggaattgtgtttaggatctgtgtgacttgccttgcaataatcggtcttcaattaatcttcttggacacttccgacgcactcgcgaacctttgaaacgacggaaacgacaagctaacacgcaaaatgaggaaaaagactaataaaaaccaaataaatagtacataaaagtaaacaaacgtgtagatcataattttagatgaattatgagacttggacggcctcattctgacttcatatgaattagttatgaattttacaagatttaattccaattaaacctattaaacggagactattccaaattaattaaatcatttacaaatgatttataacggagataaaagattaaagcaacctccggaaaagattggatcatatttggtagatgatatatattaaaaagaaataatatgccactgaaaagaggagaggatttatattgattttggacagctgagattaatcttgaccgagtcgactaagatcggatggcttggattgatctggcaagcgagcctcacgagataccgactcaacgagtcaactccacgtgacacgagatcacccaaatgatcaaccgaaaccggcgaacagaaccggcggctctgaacggctctaaactaaaggacgactcaacacagacgaatgaacgaagcacggggaacacctcgttcgaacgaacgagcgaacgactcaacaacggctgcggctaaaccggtcggctagacacgattcacggtaaagccctagtacgacaaacgataggccggtaggaacctagggttgcacctacggctacacaactcgactaaaagcagcggctaagtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagtgatgcatgatagcagcgcggtgacggactgcggctgcgctaagtctaggcctctagggcaacaacgcggcaaagcggcaagcagctgcagctaagcggcttagccggcacacgcgcagcagcggcatggcaagcagctgcggggcaacgcggcaaggcgcgacgccgtagcgactaagcagcggtggctaagaggctcggtagagcgacggcaaaccgcaaccgcacggcgtgcagcagctacgacacagcgacgacgacacacacgtggcttacataaacatctaccctaggaatcggagaggaggcctcaccgggaaacggtagcgaacggagaggaagaggtgacggctacggtccgacgacaacacacggagacgatgacgacgctagagccaaacaagattagattagatggaattaagaccttagggataaactacaccggtgaacgacataggagcggcggttactggcgaaccacggcacaataatgcaaacggagggcaccgggaggtagagaaggcgacggcgattcttaccaacacttacacgatgacgggcagcgacggaagatggccagcgatgagctccgaagggcggcgaggtactgatcaacggtggcgacggcgtttcagcgacgggagacgacaactgaggggtggacgggcttcaccttgctcctgcgaacccaatggagtcgacggcgaccgaaggcgacgacggacgacgacgaacagtgcggctggagacacggcgacgacggcggcgctcgggttcacgacgacgggcaacctccggtgggatttggcgcaaaaaaaccggtggccgaggtagctctcacccttgcgaagccgagggaggcgacggctcaaggcggcactgaccaaaggggcggcgcggctcggctggagatggtggcggcggtggagagagaagacaagcgtggggagagcgattccggcgaccgcggaggacgggacttgaggggataggtagaggacgacgagggggtcctttatataggcacgggagctcgggatcaagcccacatcgacgggaaaaactcgggaaagtttaggatcctcgccggaaaaaggaaagattgatccgcgaaattggaaaggatttccatagaaacttttggggatttcttagggaaattatagaggagattgagaggattccattcccgcaactaatttggaaagaggagcaacgaggaggccggatttggaaggaggagcggcacggctgcacaggctcgggacggctcggctctgtccaggggttgaagacaacactgtagcgagagggaggataaacagacttctatgcgggctgagaggaagggagagaataggagggaatgggctgaatagggcccaagactaggaagaagattttattgcttttccaaataaattaaccaatgagatgatctctcaattgttaaaaatacttccaatgctcaaataattccaagaaaaatcttgaatatacttgaacactctaagtatttaacaatattgaaaccagaccatttaatgattaattcattagttaaataattactgaaatgttctttgtattgttaaaattaggaattgagctccgaaaaatccgagaaaatttcagagagtataattaatcatggagaatttaataaaaattaaattcagccatgatttatatttaggaaattttatttcccacattaacttcacttgtaaattaatgaacatttaatataaattctattaataatatattaaataatttataaatcctgaaacgaaaattcaggctgtgacacctagtaccgatgcagctgacatgcgagttatagacgaaatagaacaaattaggcagcgagctgtatcggccatttataggctcgtatctgggtgaatattcttgtaataggacgacttgggtgacatcattttgctgaatttcctttatatattcgattgtaatgatttccatattcgtcttaactcaaaaagcttcgaaaacccatacgtaaaatttttcaaagatctcagtcccatctgtgtacatatgcccccttaattttgcagtgttgaaaaaaattggcaaaattacattggtctaagggcaatatattcatatatcggccatctaaaggcgatgtaaaaacatcagtatcttatattggcttaaaccaactgatccatagtcctgaaatcttccaagggcgataacacacatatcggccatctagaggtgatgctccacacatcggctatcatgagtcggcacaaacccgccaatcatgcattgacccaaatacttggtaaatatttcttcaagtattttccgttgagtgctcttccgtaaacttctccttcgagaccttgtaacatgtaagctcctttagaaacagacttgtagatccagaaaggtccttcctaattcgatgaccacttgccaaatttattgtcgtgagttcctatcggcaaaatcaacttccaaaccaacttgccttctgtaaaagaattgggcacaactttcttcttataatgacgagcaattatctccttatcctttgttactttttccacaacacgcatcctagactgaaccaactcttttgactcgtccaccatgagattgtgataatcatcggctgttaactcatcttggatagcaatccttctcgagccgatggtactttcccacggtaaaacaacctcatgcccataaacaagcttgtaagtagggacttgaattgatctatgacaagccatccgataagaccacaatgcttcagctaatctggtatgccactgcttaggaaaatcagaaatcttcctcttgatcaacttaatcaaacttttgttagaggcttctgcttacccattagcttgtgcatggtgaggaattgaacaatttaaaccccatgctttttgcaaagatagatccttgatcggttgtaattgtctgtggcacactaaatctatatataatatgttctcaaacaaattggattgcgtccccagaatcaactttcttcaacggaactgcctcaacttattttctaaaatagtcagtagccaccaatataaacttatgtcctttactcgagggtggattaatttagcctatcatatcaatccatcaacctctgaatggccatggtttgattattgtattcattgccgatgctggcgctctctgaatagctccaaatttttgacagccttggcagcctttataatatctgaagcaatcttccaacattgtcggccaaaaatacccaactcaccgaagcagccacttcatcttatgaggcgattggtgagtaccacatataccttcatgtacttcccccatcacaaccttggcttgatcggcactcaacatttgagcaatactctatcaatcgtccgataatacaactcatcatccaatagaacatatttcaaagctttatattgtaatttcctcgaaaccggttgagagggatccttcaaataatcaaatacatgatacctccaatcatcgaccgtaattgtagagacttctatctcaatatctttcaccatcggcttgtatcccgatgcccccctgagccaaatcattagcttctgcattttgctctcgggaaacatgcttcattgtcaccatccgaaaactacccatcaactcttgacacttttcattgtagatcatcaaagtatcgctcttccattcatattccccagccaattggctagtgaccaacaaagaatcgcccatgatttcaacagcatcgacttcaacctcttttagcaactgtaatcccttaagaactgcttcgtacttggcctgattattagttgcataaggtttaatagtataggcaagctcgaaactagccccctaggcgatatgactaccaagccgataccacaaccatgagtgcaaaccgatccatcaaaaaacaatgtccaaggccctatatcaaccaggctgtttgaatcattacgatgctcaacaatgaaatcggctatagcttgccccttaattgccttaggtgattcatctatgagatcaaactctgtcaagtcaaaaatccattttccaactccccccttcaacactggggccgatagcatgtattttacaacatcggccttgcaaactatagtgcattcattggataacaaataatgcctcaatttcgccacttagtttttaatcaagtgctctagtattaggactctggataaagaaagaagtttctacgcgatgatagagtagtaattaataacttagacgtggtgtctaggttagtctgttaccttcgtttgttgtgtgctccacagaaagtgaggtaggtagcgggtggtgacagccatgtccgtcctttgtatccctccatgtttggatacatcaaatagctcaacgccaattttttgtaagattctttagtggatttggtaaggaaagaaattgatcactcgatggaagcctatccagaaaagaccgagtttaagaaggaatcatgaagactatggtatgacaatttagttctatctattaattagacaggatttaataattttccgctacaatctttaggaagttttgtctagtgtccgatcaggacttgtattgttccttctatctttaggaaacttgtgtcgtgcccgatatagaacttgtatctacccgtgggtataaatatgtccacccagggtcattgtaatttatctcacaaatcaatgcaactactctcggcgcatcgccaccctcttttctatggtttttatcaccagcgtaacttgtcacctgacgcacggctacatcacttcgatctccatcgaaggggtgagccctaagttccactggccaggcaattgatctgctatattggcgttgtttaaggctacatcgttttgctctcttggattgctttggtttggttggtatacttgtctatccgacatttcaattctatctttaattgcattgtgtctagagaggcatcgatttagttgggattatctcggtgttgacggtccttaaatcataatatctgaccgtcaatacctgcatataatgaactaaaatatggtattcaacttagtggtagggattattattaatcatttccactagtattggtgaaatatgtgtatgcaggtattttaaggagaaaacagacccgtcatgcgacaaaatgaacctccgcacattcaggagtttacatggactggagggcccatatgtcaatgaaaaccatttaggggccaaaacatagtatatgatgttgggggcccattaagctacctcccagccgcctctgggaggagggttttctgagttcggccgaacccattttgtggtcattgatcgtcatcttccacgtgtacgctcctgatcacttcccactggcggttgcggggcatttccgacaattcccatcaatgtaaccatcatttggagcctataaaaggaggagctcactctcatttccaacacacaactttgagctgaactacaagatgctctattgtatcttttgttcattagaataaggtagagagtgaggggaagctctggaggggtgcccggaagaagttttccttctaggagtaattctggaggagtaccggagctgtcgatacactctgctctgggttcggagaaacttcttctgttaagtaagcatttgtgttcatttttatgttatttaattacttagtctaagtaaaatatatttcactctttgcgggttcattgtttagtattcttactaagttctctagtaccaggactccggataaagaaggaagttcatgtacaagtactagagtagtaattaataacttagacgtgatgtctagcttagagattagcttttttaattgtgtatcccatggatttgtcagaggtaggcggcaggtggcgacagccctgaatcccgtcccagtaatcctccacgtttggatacatcatagagctatagccggaactacgctggcagaccagtaggggtcggtgcccgaagcaacagataggaaattacctttaacttagcgtagataattaaaatacatagaaagtcatctctagcctagctagcctacctatagttgttgtccttagatagtcttagtcttaggtagattacacacattctttgagtttgatatccttttggagtcatccgaaggtgaactgctatagcggtattccgtgcgcttgcggatttatctgtggtcataagaaataccaacaagcatttctggcgccgttgccggggaacggttgctaatttgttcgagtctaggtcatcctcgtatctttatttttatttcttcttctcttatttctttccttgatggagcaacccacaattcaaaccctttctgctccttgggctgatctttgtgagccgtcctgttcttcaaaaccaatcctttcggatggctacgaaatcggtcctggctttatagccatgatttgagagcaaaccttctctggtagtattggtgaaaacccgtacttccatcttcgggactttgagctagtgtgttcatgtctatccatcataggcatgacacatggaactctcaagtggaagttgtttcctttttctcatagagataaagcgaagcaatggtacattatttctgtcaataatgtgaatggtacattaaattccacggtgaatgggaggagctaaagtgcaaattctgccttgctttctttccattaacccgtgtaattaatcttcgattagacatcctctctttccgacagaatgagaaggaatctctcggtttagcctgggccagattctcattgttaactcaatctggcccagacttgtctttaccagaccatgtgttgttataacattttcggtacgggttagacaaggagtctgccgcaaatctctgtatttccgccgcaggatcgttcgcacacaagagaaccgccgaaggaagagaactcctagatctcatcttagagagcgattctttctgccgcagcgaagtcgtcctggaggtcgagattacccatgaggaacgtctgcacgtggagtcggaacccgactcaactgtcgaatcctcattccagttgctggagccggaagaagaagaaattcatcctccgaaaattccattctaattcagggataatctttatgaagatcatggaaacaccctgaattattccagcaatacaaaggctcatcccaagcatgagccgttcgagggggtgatgtttgtatcttcgtttgtttcttctgaacctattgtccgtcttcatgaaactgaacgacccttatcaccttcgatcaagcctaaccttgtccctctggccctcagaacgttgttcttgtttatcatcaagacataacccagttcttgcacgatgcatctcttgagaaggaaaaccttcaggccgcggataagcttgagacatcgactctggaggacgagagaaaacattccacatatgagcatgagagtttctctttcaaaatcccccaggattcatgctcacataaagaatccccagagtcctgtttggttagtaccacttccctgtgcgaggaccactccacctttcggtcctcatttctaacgtgtttagaaggatggttgtggatgcttatatttatcataaatactacaaatatcgtatttgtggcactaatcttgcagcataatgtccccatggtcaagcttgtgaccataaacaaagcactgtggggaggtaacccggattgctatggtaagtttcccttctaataaaagcaagaaccaatttttaggataatatgcaccttcgggtattcttggtcgctaaacattgcaagttgagattaagaacgagagtcatcagatgcctaagaacacggtagctacatcaattacacactttggtgatccttggtattggaacaaactctataggagactccaacattacacacttggtttttgatgtcttgtgacacacaagtccaagtgtgggggtgaatgtcgatgagcttgtcataacgagttccatcaaccaaggccaccttggtttgaagttggggttagtcctagcttgataaaaaaaagaaaaaaaagaaaaaaaaagaggagaaatgagagacggaaggagaaaaaaaaagatgggagaagaggaagagagctgatgagctatatctatctacacccagtccctctcttgagctcatgtgccgccttggctaagcctttatccactcctagccatgcgcaatttctcgctcccgcagcacatacgggcatacaagcaggaggagattcttcttcatttctaggcgtttgcgtttgctgccccactctagttgacacttgcacatttgctcgaaaagagatgcatcctacgcattgtgccaacggatcatgccttcaagaaacaaggttcttgcacacgagctgtgtgcataactagaccgctcgctggagttggagtgatcaaagtgccttcctccactacaatccgcattgagatggaggagaaatcgacaatcatatgtgaccatgccactgccccagagatttcaaaatatccatcatgctggcggtaagtacactcaggtatgcgaaagataaaacaaggttcaccaaacctttactcaatagtaccaccatgtgaatatggcttgatcatacatgattatgtttcctttgtctattttcatatactcaggtttgggtgttttcgtgagacatcgataggctttttaaattaagcatggtgcttaggttaaactagtctgctttaatcgaattagacatggagtcgagtttgattaatgaactcttagagttaatatgttcatggacattagatatatatcttccatagactaacccctttaggaaagttttcaaattcattggtaattcgtcaagttcaattcacactggaggaaagtcaggctcgggaaacaaatcagtaaattgctacatgtaaaggatgaacacagtgcacgataagtatattgtcaaatgttcctttgtcatgttcgtgcaattttatcttaagccttgtatgagttttgcttaaacgaaaatttggtgaataataaaaattttgaaaaaaaatgtgtttttagaataaaaaagagagtgtctcttgaaaaataaaataaaaagttgacaaacttatgggatccacgcttcttaagttttgaatccaatttccttttagcgtggatgtgaacaactaaactcgaggctacgataaaatctttgcaattcttatagtccctcgggtatttcttgttcactaaccttttgcagataataaaatgacaatcaaggagcagtgtacaataacttcaaacacttatatcacgctccttggtccatgggaaagagatgcacagggaaccaaacagaacaaatgcaaaacattttacattcagttgaggtttaagcttggtaaatatctatctggtaagaatcttcaacaccttgtgcatcctcatccaatgttttcattctgccatgatacccaccatatccatcgttcccataaaaaaagagacaaaataaaacaaaataaatgtggttccttggtcttccaaccaagtgagtcatttttgctttactcgtgtctttgtttttctttttgtgtccaataaagagtcccaagtacaaaaacaagtgtgggggtgatcttgcacatcaatgccgtaaccaaagcaagatcaccccaaaagtgatgagccatgacaaaccacacaaggggaattgatgtagtcagatccaatgaggggtcaaccaaacctccagttcggctgaaccacctctaccatgaatcgtcttctgtttcatacagagcgcaggtttgcacaatttttcctttggacatccattctatcctgagttcaatttgattatcaattctaaaatattgaagataattgaactcaagctagggacagtacaattagagtttatggtctccctgaaaataacatgcatgcctattattcttagctcgttacttgttgcttgtggtgacatatccaatagggaccccatgttatctaggtaattgatgaatgagatatagtctgatgatagaaatcctactctttatattgcacacttgggaattttatgaaaaggaaaaaaatatataacgatgctaaactcctcattgatatttttattcccattagagccataggttgatcattcatgattagcttgctatatacgctgcttgtcattacattgagcattgtcaagttttgtgactcgtgcgaaatgcttttcatactttcatggtcaagatcgcatacactccacatacatgtacctatgcttgacttctacactggaagttagtattcttcatttgtcattcatttcatccatcatccacaaaataaatacttcatgtcatttatgcctcttcctccaaagttcttttaaaaaaaacaagagagagagagagaggggcatggctatgaataaaaaaatgctcatacaagtatggagcatgatgatgaaaaaaagagaaaaagaaaaaaaaagagatagccatgcactctcccaaatttcaaaagagaaaataaatggaggagatatacaaaaggagttattgttattagtatttccccttttccacccacaaatttaccatacacatacacatgcacattcttgacggccagaaagtatgtcttgtatttccgtggatccattatttgacttttgcaatatatgtgatacaagtaatgctctactcttttccacaccctgagctccacataaacattattagatagtaggaaaagaaaaggcacaatcatatgcctttgtgaggaatcatacacttagagcgatcgagagaatcaatggaggagcacggcaaagttataattttgtgttacttgaaaaaccccaattcgttcttcatgaaaagttaaggtgacttgagtcaagattttttcatttctcaattgcccagtatcgcatggtagacactagaaagacccacaagtacatgtatggctttgaataatttgtttgcatgattattagtaaggaagtcataactctattgtagagtccatagccttcactccggacgagcaaaggttaagtgtgtgggtgttttgacggtccttaaatcataatatctgactgtcaataccttcatataatgaactaaaatatggtatccaacttagtggtagggattattactaatcatttccactagtgttggtgaaatatgtgtatgcaggtattttaaggagaaaacagactcgtcatgcgacaaaatgaacctttgcacattccggacgtgtttacactgattggagggcccatatgtcaatgaaaactgcttagaattgggccaaaacatagtatatgatgttgggggcccattaagctacctcccagccgaagaggcggccgggaggagggttttccggttcggccgaaccaccagttcggctgaacccattttatggccgttgatcgccatcttccacgtgtacgctcctgatcacttcccaatggctgttgtggggcatttccgacaattcccatcaatgtaaccttcatttggagcctataaaaggaggagctcactctcatttccaacacacaactttgagctgaattacaagaggctctattgtatcttttgtgcattagaataagagtaaattgcatcactggtacacgaacttattaggtgggtgcaatctagtgcacgaacttgttaaatgctcgttttggtgcatgaacttgtctggtgtgtgtggagaaaggcgaaaagaatactatatggctaatcttattgatttaggggccgattaggatactatgtaaacatatatctgagaaggtttctattagacatacacctctttagtaaaaatagaatggatatactgatcgtagaaaaagattaaagaaaccgagcaatgatataagggttagaaatatatgaaattcatcgtttccatggtgaaggataaagtagagatcaaatttataaatattgcatgtcttatgcatactcactacacgtctgtatgtcacatcctaatcaacatctgcttcataaaattaacattgccaagctattttagtctcattcgcacaaactagacaagttcgtgtgccgaaacgagcattttacaagtttatgtactaaataagctctggaggggtgcccggaagtttggcgctccctccaacttctttctcgacgagtgtagctttctaggaggaattctggaggagtaccggagctgtcggtacactctgctccgggttcggagaaacttctattaagtaagcattcgtgttcctttcttatgttatttaattacttagtctaaataagatatatttcccctttgcgggttcattgtttagtattcgtactaagtgctctagtactaggactctaaataaagaaggaagttcctgtacaagtactatagtagtaattaataacttagatgtggtgtctaggttagagattacctttgtttgttgtgtaacccacggatttgttagaggtaggcggcaggtggtgacagccctgaatctcatcccagtaatcctccatgttcggatacatcataaagctatagctgaaaccacactggcagactagcaggggtcggtgcccgaagcagcagataggaaattacctttaacttagcgtagataattaaaacacatagaaagtcttctctagcctagctagcaaagtagcagataggaaattacctttaacttagcgtagataattaaaacacatagaaagtcttctctagcctagctagcaacctatagttattgtccttggatagtcttagccttaggtagattacacatgttccctgagttcaatatccttttggggtcatccgaaggtgaagtgctatagcggtattccatgcgctttcggatttatctatagtcataagaaataccaacactcggttaggtccgatcatctatcttagtcaatatacctatacaatcacaatgttgtttagatacatttgttatatccatcactttatacatgatttatcgacattattgggtttactcgttgctataaacttaatgctgtatcggtttagtctgatctagccaggtaactcatgtatactgttttatcggtgtgctagtcgataagttatctttacaacggattttccagccaatgtatgctttaaccatggagcttacatttaatattttgtatcaatatcggccgattggttcattagacatctacttcatcatattatcatcggccgattggattgtttgttcaagttcttccattgtatttatctaagtgtcagaatctacatcgactagtgtcgacattggctattatcgctacatcggcttattggccgatcggctctatgatcatcaatttatttatctaactgacacgctcgcatctcatcaaaaattaggacctgcactgaagctaaacagatttcccaggccttcgtgtttttggcatcaacagtgcctgaagcatttggtagagttttagctttaacttaagttagctagttgaatccataggaatcctctctagcctatcctatcattagttgttgtccttggttgaatcccattcttatatatacacgcatgttccttgcaattcaatacccttagaatactctgaggtgaagtgctacagtgatatacgtgcgcttgcggatttatatgtgactgtatcaagtaccaataaggagacagcnnnnnnnnnnnnnnnnnnnnnnnnnnnttaagccctcggcaggcacacgaccgagccacccgacgcgtcgtcgccacacggcaccgatgctcgcgcttcgccgctgcacggccacgtgctcaccgttaccacatggccgcaccgcacagccctgtcgtgacatcctgtccatccaccgtccgtccaccccgccgcatggctgcgccgcgcattatttggccacgctaccggctctgcaccactctagccgctgcgcctccccggccatgtgtcgagtcaacaggaagaagaagaaaaggaaagagaaccggaaaagaaaggaaagaaaggggaaaaaatgaaagaatcttctggttttgcaaaaaggtcgtggcagttttgggaaattaagcgcatatttttcagcagtggaaattttgcgattaaaacccaagagctttatgaaaatgtatatacaccctagaaatttgcaaaatcaatgaaaaagcatattatcgcataatagagccacgtgattttgaatttgatcccgaccttgcaagttgaggcacttttattgttgatgtttatgattaagaaatttatttattgtatttatgattattgattatttgtaatgcttttattacctttaattaatatttttaaggtaaaatgtatagatttgcatagaatatattggaattatttgcgggaattgatgtcgtaggctctccagatcttccattatatttcagagatgaagtgaataaatcaattcatcaaacaagcataataaagtatttgatgcctcaagagaagaatattagagacattgctgggcctttagcctaccagtcaacttcagcctgagatgtgctcgtcaaaccactcgaaggcggcgaccagatgtgttacacattcagtagacttgacaaaatggctaaagatctacaacatgtcaaatattcttaactcatactcatgtgaatctagttcccaggatgtgcactagattcacactttcatcttaagcatggaaatacatagcaagatacatttaagacgaaagtgatcacaaattacaactacttaatagatacatgggccgaccgaccaaatatagatatatcagagaacagcggaagcttgactacccaaacacaagcacaccgactaggggtttacccccaataagttcaagtcctagaagaagcagtcgaaaaacccgcattactcaacttaatctaaacatacaacctgcacaaatagatatttcaacatagcaggagtcagtacattatttctattcaaaggagcgcaatatgcagttcaattttagcataaatcaagttttgtttcacaatacttttgtaaaggagttgatgattcaattaatcaaaacatttttgtaagttcataataaatatcattatatcatcataagcatactcttgttgtcttccttgacaacaagtcatataatcatcatcacactcacacaactcaatacatttcacccattccaaatccaagtttcataacacattttaaaacataagtctatactcatgacactttaccaagcactcatgaccgtgagcatggctaattgattagtttttagactctgcagagtttgtatagctttatccacatgaggtgaatcgctctagtttgtctggtagccatcggtaccaccacactttacatattgagtgggtttacaggtcacaacgaggcttttacattaagtattgtataatccttgcataagcatgatgactgttgtttcacactaagttgtcacagcctgattttccgtatcaggatttataaattatttaataaattattaatagaatttatattaaatgttcattaatttacaagtgaagttaaatgtgggaaataaaatttcctaaatgttgtcgaatggacaacaatgccacatcgaaaggcgtgattctctcaacagtagttggaatgtaaaagcaattgtattgattcgtaaatttttttggggatccccccattacatggccctagaggtctatttatagccttagcacaagcctggaccttctagggtttagggttacagaggatttaacatggttgcccttatgaaacggacatttacatgggtatgcagtgtcatttgcacatatgggcctttaatgggctgataggctgctggtctatagcaaacaggcctaaaaggccgggggcggcctgttgggcctccttgatgccgaacttgtcatggcaaagtctttgtagttcgcccgagatgccttcgcccgagatgcctttactttcggagtaccgatgcggctttccagccttcgccatcttcgcttattgctttcaccataaggcttgcctgaatggtcttgacggctttggcttgaatccttgctggtactatggtttcggcaggtccggccgaagggcttcatggcatgcctccaacaagcccctcacgggcaagggtgagtaaggagcttcggccgagaccgtgcaaactatacggtatggcttgaggctccccctttcggccgatgttcctgtcgaaacctctttttagactcctgcagaaaaaatatgaacactggtgttcgcctttcgagaatggtgaagctgtattatgacactgggtgattatattttccaagtttgtctgctttgcgtgattcttaacttgtattttttttctttcccttttttccctattgttttagcggggatttcgccgaaagtcatgtgttcggccccctttcggggattggcgaaaagatttgttgacttttcagctttcgacttccattttcgactcgtagcattttgcgctgggaaaaacgcttatgttttgcgtaagttgaatgtaacggtgtttggtatctttattccgaaacaagctgtcgcggtttcaaagttcggcgagcgatgcttctgccgattcgtttcgccccccctggtgttttcatcgatcaagcgttcgccttttatgtagctatgtggttgtcaaaatggcgaattggaggtgaagacatcctggtcgaaccttagaggattacgaccggtgccacatccagcgccgcgatgacattgccacactttggttagacttcgaaatgactaatcgtcaagctgctttcgcttgacgtcggtgtgtatttcgcctccttccccccttaaagtcgtgtatagtatagatgacgaaccgtgttcgccggacttagtaggggcgaggcgaaaatgttctgaaacggatgatgtaattttttgctcctttgtgtaacacgtatgtgcttttgcctgatggagcttgtgcgtgtttttatgtttcttttcgctatcatcgcatttggtaacttgtatgttcggaagggcgaagcatgtcggcccccttgcgtattagcgaaaggaattcacattgacttttcagccctcatcattcactctcgacttttggcatatgcgtccagaaacgcttaagtatttgcataagtcaagtgtagcgatgatcggtatgttttccaaaaacgagctgtcgcggtttcaacgttcggcgagttgtgcttcggccgattcgtatcgcccccgtggcgtttttgtcgatcaaacgtttaccttggggtttttccaaaaatatcatacacaaaaaaggcgaagacacccatgaattttatatgactgagcgtcagtttgcaattgcccagcctcgacgcagcataatcctcgtttttccttcttcaccgctttaaattttttttgtgttgatctaacaactagcgatgaagaagatgctcaagggggtagtcctttgccattgaggactgcttttgctgatgaatcggatgtaaagtccgaatccattttggcgggcaatggaatttatctgtaacttgtgctttttggcaaataaatggggtgtggtgcgtgttgcggctgttcggctcgtactttcccctttttgcctttggcaaaggtatttttaggtactttaatcgttttgaccgttgccgcctttcggtctttttagtactttgacctttttaactgttaccggctttcggtcttttctttagtgctgctagggttttgcctttcatccctttcggctgccccgtttgtctacgggtgtgcaaccgatgcgaactcgatttcaagttttagcccctcgcacatttcattggacttctcggagtcaaaccgcttgttattgccggtaatgaactctttcggaacactgaatcggcagaaaatgtttttccgaacagatttttacactagtgccgaaggtactgccttagcccatcgaaggcggcttgacactcaggtgtccaattgagtttgccggccccttggaccatcttgaaaaatgataaatctctttcggctactcttgggagcaactccttatctcattttcgcccccagcccttgtcgccgtaactcgctggtactgtggcgaagggcgtgggtgtggcgaaacctgttcgcctacagcccttgatgccataccttattggcattatggcgaagggcgtgggtgtggcgaaaccacttcgcccgcagccctttacgccgtgcctcattagcactatggcgaagggcgtgggtgggcgaaacctcttcgcccgctgcccctgacgccgtaccttattggcactatggcgaaagacgtgggtgggcgaaacctgttcgcccgcagcccttgatgccgtaccttattggtactatggcgaagggcttggcatgtggcgaaacctcttcgcccgtaacccttgacgccgtgccttatgggcactatggcgaagggcgtgggtgtggcgaaacctcttcgcccacagcccttgacgccgtaccttattggtactatggcgaagggcgtgggtgtggcgaaacctcttcgcccgcagcccttggcaccgtaccttattggtaccatggcaaagggcgtgggtgggcgaaacctcttcgcccgcagcccctgacgccgtaccttattggcactatggcgaaaggcgtgggtgggcgaaacctgttcgcccgcagcccttgacgtcgtaccttattggtactctggcgaagggcgtggcgtgtagcgaaaggtgtccagaggcttgggcggcttcgtagccccccagcttggacttaacatactttcgcccccagcccttgtcgccgtacctcgcgggtactgtggcgaagggtgtgagtgtggcgaaaggtgtccagaggcttgggcggcctcatagcccccccagcttggacttaactcactttcgcccccag

SEQ ID NO: 64084 - DNA, 25065 bp, Oryza sativa
agcggcactagggaatgtgataacgctgttggtctgcaaggtacatgctaatgcagattgagatctgcattattccatcaaaggggtgtcgaatctttaagaggcaagagcaaactggaattgagaaatgaacaacagtgatactaacagtagtaggatgcatccatctgatagctgatagccaagaggaaggataggtcccattaagcttgttgactcaagagggtggaacattggtttgccaagctagtctgggtagcagccagcaagaaagccttggtcagcaccatcagagttgtcacggccaatctctcatgaagaatgcccttgaatacatccatccatagaagattgcaaatcggaaatgttacccgatgtcaaattacttgtttggcaccacagatgtgtgagcagaaaatattttcaggtgtgttaacattgaacgattatttaataatgatctgctattgcttcaataaaaaatgatctgctattgcatatttcctgtcagataggattattgtactattgtattctaatgaatatggaaggaaatatccagcctgtgacctgccaatgattattcgagtaatcacattcactatacagattggcagaatacaactcatatttcattaaaccatccaaatagtcaattgataatcaatccattggtaatggctcaactgtcatattaccaatccaatgccaccatcaacgcgactgtagtagtatgttcaaattttagcaatggacccttttactctaaagaacactatgtaaactcgcagaggtaccgtatttttaatcatcaacacaagagaatttcaaacagcatactgcttaagcgtaaaaaaaaaggacatgggacaggtggtattgtctacgtactgcttaatagggcttgcacttatttatgattgtcatgaaattcaccaatctgtatgagtttggagttatgtatacttttcacaggatgaatttcatgtgcagaagaagcttttttgctgttgaatactgtacacttgcagtcttggatttgaagttctgtatcaactatcaagaaaattgtttgtaaagcttctatattatgaaatcctcatgtgttcctaatctaggcagaaggcaccaattacctagtattatttgcttgtcgtgtatgcttcctgctattatgtccatattatttgtctattaagagaaattttaggtgggggattccttagcaatgatgtatgagttatttttttatgtgtatgccaggtaccctgcatatgaaaaattagcttctcttgaacaatgcaagaggtaattgactttattagcttctccaggaacttagacttttcccatcggtaatatagctcatgttgtgtttgctaagagtgtttgtggggtagttgggctgggctatggtagaaagctctgagaaatgtttgtaagtagtaactagtaaagacttgggggtccaggcaagctagaactaacatgcgacattgcaggaaatccaacgctgtaatttggtctcgatgaaaaagttgaaatggtgcactactcaaagaatgtccatcccttttctttggaagaacattatttcagatttcagaaaaaccaacttttcagaaggttgtaatgcaattgtttatcttttcttatatgaaaaggattgaattgctttgtgtatactgattattgcatcctggataattagaactgtagagttaagaacttgaataacacagcaacactgggacaacttaaagccgctacagtcagggactcagggataaattggtatctggattcttgaggctggtgcaaactcaaggaagaggtatgtcagctattttgaatctcactgtccttgatcgtttaaattattttattcatccattttgtgggcagtttcttaggcgaaagagatcatgaactgctataactgttataactgttgttactacagtaatatgccgtgctttgcaacgagccagaaccatataattggggatcagctgggtgggtggattgagaataaattactggatcgattgctacgcacacatgaagcagaccttctacggtgggaagggaacaaatggaggatatgactccgtttttaaagttgtagagaaaaaccttctgctactacagggtcttctccatcgaagtggttctctcatctgttggtgacttggtgtaatggtgtactatgtgtagatggtcatctttttgccgggccggccaagaaaggccaaccaaatttacttaggattgaagaatatatacaaatatacaaagttataacttcaacgagaagctgtcgaagtaatggaaattgtcaccggagcaacttcccaaaagcaaaagattacactaacaacttcccaaagtgtagatggtcatcttactttagtcagatgcatgaacctgaattgtagtgtcgcctgtcaacccagtgcgacagggggctgccaatcaattttgaacatgcgaacttgtaataaagttgttcagaagtgttttaacagcaactgcaagttttgattcgaaatgagtcattttcatagcatttttgttcattatctagtgcttggtgtctactgtggagtcctctgcttatcaccctgaaagaggaagatgaattcaaggacaaatctgttcttccatcgtgtgccatttctccacgccttctaatactaaaaaacatgtcgatcagtggagtcggcctgtgtgcgcattcatgaccatgtttttcacctccctggaactggaaggatggtaattcccaaggcctggtaattgtccctcatttgataataacattgtcacatactctgtcagaaaaaaaaaactaatcctagggatgtatctgaacaacgtgtatgtccaaatacattctcaggattgaattttttttatgagatggaaggagtagtcactgactgtgcttgccgccagactataaacaacaccacagaagttggagacaggcaatcaagcaatgcagccacgcagtcacctagtcgtcaccatcaggggcagatcaccgtgagtatcagaggctcaagctcttattacctaataggagcttcattggttgacttaataaaagcacatattaaaatttgaattttcaactgaattttagagttgattttaagatattttcagcataatttctttttagcgtcgacttttaagtcgatacgaataaacatataaaaattttatctataaatcaatttttatttcctaataaatcgttttgtcgtattaggaaatataggcaatcgatgatgccctaaatccttgtggagagacgaagaaagggaatttggaagaataaggccctaaaaaacttttgcgtgtcacatcgaacgtttgaccagatatcgtaagtggtttttagacacggatgaaaaaactaatttcataactcacctgaaaaccgcgagataaatttattaagcctaattaatccgtcattagcacatatgggttactgtatcacttatggctaatcatggacaaattagactcaaaagattcatctcacgatttccatgcaaactgtacaaatagtttttctttttatctatgtttaatgttccatgtatgtgtctaaaaatttaatgtgacgtttttaggaaaaaaatatgggaactaaacaaggcctaatatgagatatacacggtttatttttgcccctagtcagtgtttatttttgcttttttttttccctgagatatacacggtggaatgacgtggatgatcactcatgtcatggcctcatggggtccaggcctgaaccccacaactcgctgaactcgctatacggcaaggcgacgctgcccacctaacgtgccagataccacgaaccgtctcgcccaacctcccccacggggatacgtatgatatgtgtgcgccccctcctcctgccggctgacgcgacggaacgtgagtccgtcacgcgtggcgaactagtagagcgttgatgtcatttttaaactatactacctctctcatacacttttagctaatttatgacaaaataacaggattgaaaaataaccacagcgatcttatttaatgaacacaataaattcacacatttcatatataaaattaattaaaaggaagtttgagataattaaggaaacatttttagattaaaaggaagattatgggatggaaggcttggagatcataaggaaagatatttagattaatcaatttgttaggtcacacgtgattagaattataatttttgtgggataaaacctgagagccaaaattgtaatttatatgggacggaggtagtatcatcgtttattaagattgataaatatatgataatatttagtttgttatcaattattggttatgtttaaagaattttaacaatatcacatttagcctagagtaaattacagttgggccaccttttattgccaaagtttcactttggaccatccctaaactaatattttcactttggatcgggtaactttgccatatttccagtttgaaccacccaactctctttactattcatgtttaccctccattctggtgaagatatggcctgcatatagacggtgaagttcaccgatgtatcgaaaccgatttgattgagattgttgatgggcgctgaagaaattgtttaggatgatctaaaccaaaaaaatggtgaaattacccggtccaaaatgaaaagattggtttaagggtggtacagagtgaaacttggataataaaatatatggcccatattgcaattcactccaccttttcattaccaaagtttcactttggtccaccctttacctaatatttttactttggactagatatttttgccttctttgcattttggaccacccaaactttcttcgcgagcatattaacagcctcaagctcatcggcaccttcatgccgatgatctcccctgtttaggtgtaggtcacatcttctgccggaggagaggttggacatggctagacaaaagaattatggtgatccaaagtacaacaaaggaaaaaatacctagtctaaaatgaaaagattggttaaagggtggtctgaagtgaaacttcggtaataaaaggtggtccaaagtgcaactcactctttagcctattatattaaacttggtaatgttaccaatttgctaaatttttaacaatatcaattttttaaaaaattaaaaatgactacaaaagtgacaaaacttaagggtgtgttcgctgttccaggttggggaattggaatagtacgcacggaaaatagagcggttcattatcgcgtgattaattaagtacttcctccatttcataatgtaaatcgttttatcatttcctacattcatattgatgttaattaatctagacatatatatctatctagattcattaacatcattatgaatgtggaaaatactagaatgacttaccttatgaaacggagaaagtattagctaatttttttaaaaaaaggattaatttgatttttttaaataattttcatatatatatatatatttttaaaaaaaacacagtttagccgtttgtaaaaaaacatgcgtgagagaggttgggaaaatttggtgccgaacacaccctcagtttttctagccgcgcgcggggcggcaacgacgaacgaacggctcgcgcgcggtgggtgggtgaggcggtggcccgcgagacacggcgccggcagctgccgcgtgcccgcgtataggcgcggcccccttccgtgcgagagggcgcgcggcgtgatcgcgtcaaacctctcgtgtgccgcgcctttgccgccgccgtcgcgatcgaagccaagccgagcgcgaggggagccgcacggcagcaagggcacaccgcacacggctccaccatgctcgcccagccaccactgtcacgcacgcgcggcgttttgttctacgtacgtgttccatacgcgcgcagagacagagacggagggaaactacggccctgttttgattccaatttttccgtcacatcaaatttttctacacacataaatttttaaatttttcgtcacatcgttctaaattcttcagactttcaattttagtatagaattaaacacaacctacattgatcttagttctccgtaaagttccataaagtttgtagtcctgttacaaactttacgagtacgcaggaactacattgatgtgtgatatgcgtgttaacgtgagcaccacaaatttagaagtttttggttgacattcacactctaccgcagctaatcacttgttgtggcgacattatttctacttgtgaacaatgctaaaaagttttacattataaaacggggaaagtacgagtaggaagaggactgcaggaactacattgatgtgtgacatccgtgttaacgtgagcaccacaaatttaggagtttttggttgacattcacactctatcgcagctaatcacttgttgtgacgatattttttctacttatggagaatgctagaaagtctaataaattaggtctaacctgttattgtctcggaaagatgttactaccaaatgaactagatatttggccgaaaaccaaacagaaaacaatcacttaaaacaccgatgaacagtaaaacaaaccaacgaggaaattttggcacgtcgctttctgcaagggcgagacaatccatcgaccagtcctgcgtggcgacgtgctgtactgcgctgttcggcggccaacatgcgtagggaggacagcacgccacaagtccacaaccaaaacactactactcttacctctatcaactttttcttatatttatcggccaaaatttaaatttttaatcttaaatttagagctgatttagattttttttcatgaaagtttatttttcagcctttatttttaaatcgctaaaaacatgtatataaaaattttattcataaattatttttggtttgtaaatataccgttttggtttatttcatgaataaataagcaaaacaatggagccgactactactctatcaacgctagctgagcaaatggacggacggtcacgaggaaaagtatctctatcaatctcagccccaccaaccttgtgaggaggtgacatgggccaaacggtcagcaactaaaggacaggtgaaaaagccagctttaacgctgacgcctgtggctggctggctgctgctgctgccctcaacctcaagtggcgtagccgttcaagatgcttttctttttcctagtggagtagtatatcttttctttttttagggaaaatccaagagagccggtataatagtaagctataagctaattataaatatatttttaagagataaaggaagagagagtagcagcaggttacatatctataaccagctgcagcacggacttcaagacgtaatgtgtgtataacaaataagaccaagttagtaagcaattattatatgaatttgctattacattggttatagatgatttagagctagcagtggattatactattatacttgctctacgaagaagaaaaaaaaagaaaagatcaagtggatttttcagaaacctcgaaaggaaaatgtgaatgaatgccagtccagttggatcgtaatggggtaaagaaatttcataggcaggggccaaggaagggtaatgatgccgtaaagagcacgctcacatcgttccaatgaaaaatctcttcgacgatttcgttgttgacccatgctccgctcgagagatatttaaccatttaccatatttagatgtggcaattaactttttgtcactgaactcacatgtcatagacatatgtggacccacatatcattgagatagggatggtaaatagttatttatcaaatctaaaagtggcaaatagttaaaagcccctttgctggagcaatatgtttttcgctgtcaaatttgtacaacctaaaatgaagtctactagtggtggctttcagtcatctgcaatcactctcacacacacacacatcaggatttttttttctcacctccaggttttcaagctaaaatctgccttgtcatctcttcaacaaactatgctttgcatcgcatcatccgcacatcagaacgatacaatggagaagctagcttaacccccataaactgggcatgaaaaaaattctgacaatagaacagaacagcacaaagatcattggcaatggcagtaagaatggcaatggctctcctgcgtcgaagacgacgacgacgacgacggtctgcaggggctcgtcggagtccgaaccaccggcaggccacaggctcgccggagctcgtcataccggcggagatcgaaatcccgggcgtgcatcaaccgcttctgcttcgccgcaaaccggctctcgaagaagccctcgaaggagggctccttcttggtccggaggaagaaggtgtagccggccatgaagtacatggaggtcacatagaagcagatgggttccatgacatcccatgagagctcccagaatgtgagcctcatgaagccggcagtctggacgacgaggtatgccagccccagccaaagctcacggcgcacctggagcgccgcggtgcggtcgatctcgaccttctgcgcctccatggccttcagctcttcccttgctgggccatccaaggcaatgggttgcgctctcggaatcggtatggccttctcgatggctttgacaacctgcaatggtgaatagaaagaacaaaaaaacatttcgaaaatttacttggttgctcttcttctcaacagagaaccatcaaagaaagagcgatgttcgcaagagaagattacagccatgaaatgcgaatcagttttcaaatgattaaatttccaaaaggaagtgcaagatataattgtgtttccaacacattgcaaatgtgttttcaaaagtaaaagaattatttgatactgaaagaaaaaccaatattgtgtatattgttaggacaataatgttaaattgcttaaagaaaagaatccccacgccgagccaagaggatcagtctgtgcaggataagattgtttagttggacaaggaacatatgccgcaaaagcctcaacctctatttttatacttatatgaacagcaaaaaagactgtaaaataagaacagtttacttccaagactaaaacatgcaaaaaagattttcccaaaaacatctatgccatgcccaccaccaccacttgcatggggtaaattgccaaattgtctgactaaccgcacttgcatggaacaaaacaaacagtaaatagtacaaattatgctgcctacgaatgctgtgacctactctagatcagatggcatgtgacagtgtccccctttactttggctaggtcaggacataagaaagtagatgtgtcataacctgttagccgtccattaatcttctagtattattctaatgtgataaagatgtagcttatgtattcaacagatattaaaaaaaaagggcttctttactcatgatagtgttgattacttgatttccaactagtaaagtgaacggtagcagcaatagaagcaagcatgtaagaatgtcaaaaagtaagaacagaagtaagaatttgattctgaaaagtctgcaacactgctaattatctatgctcctaggtccttgaattcactcttaagaatttccaattaattcacattttatggttgtctattctctaacttcaggtgattctcatttgctgaaccaaaactagaaattcttccaaagcaacttttaccaaatagtaagccaataacaaggacaccactatgagctatcctgcgttataaaccagaaggagctgatctaaaaataacatacaattctagcaaatgcacagaaaaggttatggagcaaaaagggaaccacctagtagcacaaaattgtttgatatgtaactaactttcagttttggccctcaaatttgttgggaggtatcacaaagttaaaaggtactacatcaatactccaccaccactggcatgtgatggggaatgcaatggcatcttagatactgaatcctctgccatgcaattcaaacatcatttttatactatcagttgtgcagcccatgccctgtaagagagaccaaatatgtctccaattgttgtcctcatgacatggcatttaaattgcatggtagaaaatccaatagaatactaactatgaacatttccataaatgatataatatcagggaacataaaagttttgagtatgtgctggatgatgactattaatatgcatccttcctccaaaaattttggctgccacaggttaattctcctcatgttcattcatcggagatcaagattaaaattatcactaatgtcaattaagttctctccttttctttcttgctccctcaggtataagatttgaggggctaaagaatagtttttttttttagttttgtttttagtcgatctggttttgtgagaagaaaagacactcccatgtcggacggagtaaaaatccccaaactttgtgtgtcaacaactgctcttactaccgtttaagaacagcgccctttctttcattcttttcctgttgggaaacatacaaagaaacacgcggaaaatctcatcagatctcgacacttctgaattctcaacccggtcacccggaaacaaaaaaaaaagaaaaaaaataactgcaaggagagagaaaagatacgagaaaccagcgtgtatttctctcatgacatgctaactgcaaaatcaaaaaaaaaaaaactagaacaaaattgggagaagagacggatcaagcaagcggcattaaattaaggtggtggatttgaagctgatgagatgggggggtggatcgtaccatctcgggcctgaggaagacggtcttgccgaggacgatgacggatccggactcgtcgagcgcgcgcgcgacggaggcgccggactccgcgccggcggcgtcgcagcagagccggaggaactcggcgtacggcacggtgcccgcgcccgacgcccgcagcctcgcccgcgccgcctccatctgcgtcgcccgcagcaccttcctcgcctcctccaccgtcagccccgccaccgccgacgccgacgcccgctcctccctcgccaccgtcggatgcgtctgcggcggcgccggggggacgaggccgtcgaggttgatgcgcgggaacgcggcgccgaggtcgcggatccggtcggcgagggggatgaacccgcgtcgctcgggcggcaccaccggcaccgccgcgggccggaacgccgtctgctcctgcatgaagcggcggagcccgcacgccgccggcggcgcccgcgccgccctcctcatcagcgccgccgccattgcaacctctctcttcctctctcctcacggagctcggaaatcgagggaagcaatggcaacaaaaaatggggggaagaagaaatcgaaacgcacccggttcacgcagctcgtttggtgatttgtgggggaagacgaagtgaggggggtggaggctatttatactccccgcgattcggacgcggcccggtcggtcggagtcggagtctggcccggtcgcatccggtcggaaggtttgggtttttggatgagtacgaaagtttgttcgaaattttgccaaatttcggcagggcccttcgtaccgtcggtgacgacggacatgttcacattactgccacttttaacattaccaatttttgagtaacaaactaaacataattaaatattggtgattctgggtttttcctcttcccaaaagctttttcaaatttgcgtaaggctttaaaccaaagggtccaacatgactaaatctggtaacactaaaatgttgctaaattttagtaaggttttcagcaaggaagtgaacaagcccaacatctcgctcaattcgtcgaagttcgtacggtgatattttgacacaggaaacatggggaagtcatgtgttatactccattgtagccagcaatttttgaaagcctttaattgagtattactaggggattataacacctatttttcttgtattgattacttgctttgaatgaaatttggtagtcgtagtacattccagataggccggagcggaacgtgtttcttgcttgttctgccagttatacatgacttgtattattgcggtacgttttggcatcgtgtttttgttggtctagtactcctatatgattactgatttttttttggtatgtttccacttggaaataagaaatttcctcatggatatgtgcttggtttttttttctaaaaaaaatgtcactattgagccgaggtgaggtaatcgtcatttgtacgagcatccccacattcacacgtgtcagaatttgtgtttatccttttttctagatgaaaatggtttgtgtttatcattacatccttgtttattgacggtaaggtcgatttgaacataggagtttcacactattcatgtttaaatgaattttagttttatttcaaatgctataatttttcaaaatgtatgattgaactagttatccgtgatagttttctccaaattgttcactaaattatttcgttccaaataaggcatttgtaagaaaaacagttcggttttcggaaaatgttgaaattaatccgtcctcgttttaaacgggttctaataagtgggtaggtacgtagcaaaaggccgtgagcttaaaaaaaagtgaaaagcatatacatattaatacatatcctacatagtccaaaagaagctttggattaaaaatatatgcacttagataagtatggattggatcaccagctcccgatgacgatgaagtgtagggaatatttcgtaaaattatgttgcttcttgcagggcgcatgaagagcctcagccccacatgacacaactacacgatgaagaagaaaagtccaacaaaaaaaaagatttgagcatgagcacaccttacgcatatacaaatccaaaaacatccggacgcgcgattgcatgaatcaaaacttcacatcaaaaacattatattgatttatatatagagagatactagaaaaaaaaagtctcgcgcgttgtaataggtaaatgttattttaatcttattttttatacggtttagctaaagtaaaattcactgtataaatttgtttagatattgtttttataagttagtatgagagtttttctaaagagatttctcatacgactcaatctatatttcaaaaaacgaacaaacttaatattcgactcaaatacaaatatgtaatttcaaaaaacgaataaaattaaaaaccgattaaagatggataacataccagagataacataccagagtgcctgtaacaataattttaatttttataacagtagggatatatcactttatgccacgagttaatgtgaacttgtcaataggcatgtgtcctagttgctgcggcacagtgctggctgctttttagcctcatttagccttatcgaacagtattatattgttctaaaaaaagaacagttttattttttgtaaaacatatttttcttaataaaatggatatattcattctagaaacctgacactaacactctgatcttgcaaataaaagagaaaatattataccactcgatgatttcatttgatatgtctagatcataattaattgccaagattgatcgtggttatatacaaaatacacaattataatcataagatagaaatataaatcgcgtattaaatcaaatacagttcgatctgctccacacaattacacaggaaatctagtttgtcactgctccgagctttattgttatcaactgtcacgcagttgcgtgaatcgattcttttgttccgatcagcatatgtgatcgaggcatcaatcctggtcatatcattttatcgagcaagtacgtaagattaacagggagatcgacacaattcattatcacccgtgcaatgctttagaagaatatgtaaacctctattacagccgaagtgtctggcacgcaaaagctggacatctttggtgtgtgcgtagtactaacaagacatgcatgcaccaactcccatctatctatataattcttccaaaaaggctcaaaaggatattggtgtgaggcacagcttgtgccggtgttatctccagctttgaatcgtgttccacataccagcagtaaggaatataatatatatatcaagattaaaacaagtcaaaatattttataaatgagttttaatagtagagtttccaaacatacctctatctataaggaccacttgaatgcgttttctagtgcatgccgatttaccatcaaacacaccgtatgtacttagtatgcctttgctatctcccaaattaacaaacacccatattaaatctagtatttcttttttttcctaaaatataacacatactaagatacaccgtatatgtgattatgtgtactactatctatatactatattattatatattgtagaatggatgtagtattcatacatgttgacaagttcacttgaggagtcttgccattttaactacgcttaggccttgtttagtttacgaaaagaaaatttttgggtgttacattggacgtttgaccggatgtcagaaggggttttcggacacgaattaaaaaactaatttcataactcgcgtggaaaccgcgagacaaatttattaagcctaattaatccattattagcacgtggatgttactatagcacttatagctaattatagataaattaggctcaaaagattcgtcttgcgatttctattcaaatcgtgcaattagttttttattttatctatatttaatgttctatgtatgtatttaaagattcgatgggatgtttttaaaaaaataaatttgaaaactaaataatgccttaattctgaagggatgactgttagtatcaaatttcccccaaaacaagaaaagtgactactacatcgttccagaaagttcttttgggtcgagttgtctaaaaacagagcacgtccaggtccatcacggatccatcaaactagcttgtggagtactatgggctcgttcactttgctatcatttttaatcttaccaagttttggtattaccaaattttagtaaagttgctaaaattttgacaagattgtcaaattttggtaagatttcatatctacttactaaaatttagcaataaactaaacgtagccaaaattttagcaactttatcagaaaatagtatgtttgaaaataacatcaaagcgaacagggcctaagattatcctctcttttcttttttgacacaatccaaagctcaagctcatccacgagatcgttcaccgttcacccaaggtgacaccccgctgtacgcgcggccgcgtacgtgtccgcctcgcccgccgcacagctcaacaccgtctcgcagccatacgagctcgctcgctcgctcgctcgtcgtcaaccgcgtgaccggccccgacttgtcaactcgtcgacaccgcgacgcacgcactctcccaccctccctccctcccgctgaccccgcaccgagtcgcggctgcaccgggcagcgactccccccgtacgcccaccgcttcgcgcagcgcaggtgtcgcgcagcgcggcatccgcgcccacgcccacgccccacgcgcaacacgtactacgtacgtctccccgcgcgcgcggggatggaggagagcgagcgcgagacgctcgtgaccgaccgacctggcgccgtagcgcgcgcgggcgcctcctacccgcgaaaaaaagtcagacgcatgggtggagactggagaggatggggagatgggcgggggcggacgcggcaggccgtcggcgcgcggtaagacgtcgcggtcgccacatttgactggcccgcggccgcggcacaacgcgaggagagaggccagggccacacacgactgcccgaggaaaaggttttcgtgctgcgagtgtgacctcccctggttggcgatcgatgcgtacgtgccgcgcgctgttgcggctgcaccgtacgcgtcaaacagcaaagcgaaccgcttgatctgcacgcacgcacgcacgcacggcctcccccgctcgccgaagccgaacagctcgggttttcaaccgaaagcgtggacgtttcatgagaacgtttcaaccgcggcgtgaacggctggttgctgtggcctgcagtgtcaccttgtgcctgcctggtgctgcgtgcctgcgtttcagccacgggttgatttgatggctcggccgcgacggccggcaggagcaccggctgaaagcctgggactcgcagggagctggatttcatttaacttttggcttttttttaataaaacttacttgtttagattaaaaaattttggcaaaacatcacatcaaatatttggacacatgttatgggagtattaaatgtgaaaaaaaaaccaattacacagttcgcatctaaattgcgagacgaatcttttgagcgtaattacaccataatttgataatgtgatgctacaataaacatttgctaatgacgaattaattaggcttaataaattcgtatcgtagtttacaggctgaatttataatttgttttgttattagtctaagtttaatacttcaaatgtgcatcgtatacttcaaaaactttacacccaaagaactaaacacaaccttattttacaaatagattcctcaaaatacttattttataaatgaacccttttcacagcgctaatgtcattggcgccatgtgacgttagcgccatcccatcatcccccgttaaaagctactccctccgttccaaaatataaaggattttggacagatggaacatttcctagtataacgtatctagacaaagaggaagtgtcacatctatcaaaatcccttatattttagaacggagggagtaagtaaagggggacggtaccaatatcattggcatcgaggatctattcataaaaagaataaataaaaaaagaccaatttgtagtaggaaaagatctatttgtaacaaaaacatttacaaataaatcctcgacgtcggtatcactaatatcaaggaccaattgtaaatattttttattacaaataagtttttttacaaacaagtcattttttacaaaaattacaaataagtccagatatcaatgatattggcgccaccccctttcacattagtaacttagctttcaccggaggtcgaggggaacgacaccaacgtcattagcatgtcaagttagaccacggcaccattgatgttgacactgaaaaagaactatttctaaaataagtttttttttctattagtagaataagttttccaaaatattgaaagatgaaaaaaaaaatcagcgcagagaccttcacgcttttatcgtctcgtgaatctggaaagttcagctttctccgatggatttggaatatgttttgttttttcagaatttctgaatgcccggctttctgtatcaacacaagcttggaatgtgaataactgaatctggatgctagctggctagagcgccgaaaacgtctaggtgtcaactgaatgttagttttcattttacatacagaattacacaggcaggatagatacacattctaaaaaaacacacttctcttcactttttgcccgagaaaacggcttggtttgtgccacagcacaataacttccaactgtatttttacggttaccctgttcctgcaatttttttctacaattgcacggtagatgcatacatccacacaccactacatataacagtaacatatttacacctcacgtatacatcttgtgatcaacggcacctcataatcttactaaaatcatattgaaggccttttacatgtgcatttcaattccgctgataaaaactacactactctctagccagctaaaaatgtacccaaaatatgtttcttcatatagattcagcattcatgaatcccaaaccgatcgaagtgaaacaccgtacgtgttttcgaggaagagcactcccgacatgtcggttcggctttgccggctggtagatgcaaacaaaaataccatacgaaatcatggggaggacaggctaaaacaataaaaaaaagaaaaaaaatggagattttggattgtgtggttgtatagctgatgtatattagtatatgctggcttgatttgatgggaagattccttgtaagatctgtgtaaccttgttgccattttatttcctcagtggaaaaaggaatattccttgtctcatggatatgccctgtggtaaaagcttcatgagagagtgtgtttagcggtggacatcttagtaatgtcaaagccaaattattcttattacgactgtaccatctccatatataattggttgattggttgagttcaataaaacttcttttataaaaaaaatgttttgggatataacacacatatatgtagacacataacatcttgtatatgtgcctaattataatgttttgagagcaggtagaactttttttactaccactccatttcatattaaatttaagttttcaagttgtatataaagattaagaaaatgtgactttagagaaagtgattttttttagagtatttccatttccacacttacagtccgccacgatttacacgcgacgcgttgactatgtaaaaacactgcacggaagaatttgtactacgtactttggtttggcagcatcgtatgaatgtgaagttgggcttgagcttatcgtggcacggaaacatacggtgggtacttagtgtacaattaattaaatattagtatgtttgttttctcaaataaacttctagacagtagttttgcacgagatatattgtttagcaattctgaaaaacatagtaacagaaaatgacggagaagcccaactgaaaagaacgatacacctgataagctggctatggttgcacaactgtagcggccacgcgccgaaccgtgaacttttgctattgggtacctacatccttaggctctgttcttttggttgagttgggaactcatccctccggtacggaaaacgaagcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccagcaaacgaacagagccttagagcacatacagtgagaagaagtggcgagcaccctcaatgcgccacgtccttgccgctgctccacattgattggtcatgtgctctcgcaatgtttgtaccgtaccgccttgcaatgggcacgatagcctggttagggcaaggccacttgttgcggagccacacctcacgagacatgttgagagcatgaatatcctcaacgcgcatccccgttcacgcgcatttagaaagggatgggctcgacattgagatcctgagcatggaggcggtggtggttggagaagaggggaagttctagtagttatgttgccactgcgaaactcatctacatggaaggtcttttaagtgccagttgtacttgcacagaagttttgtgtcctcaactatactaggatgcctctagtagtaacatcataacaagcctcaccatggataactcaataatcttctcgcatcatggacctcgtcaactagagcccccaccagctctgtgcgaggacctacagtctagtgacaaactgacaactcgatttaccaaacgatgtcgcctcaacctactcgtcgccatctcaatatgcgctcgccaacgagggaggacggtagagaggtctactgctaccatgctcattcttcatgcgtagaccaccctgtcaagctcctcgctccatcctgcaacgaggagggtacgatagcagagaggatgacatgatggaaagggaggagaggacacaacagcgtgggaggatgctagagagggcggtggccggataaatcactagagaaggtgggcaggggcaacggcggaatgggatcaagcaatcaattaatggagtagattttatactcatttcaaaattttagggtgtctaatgcaaaattttggacttagatgtgagttttcttaaatatgaggactaaaataaaaaacgataagggttgattagaaaaattaaagccacaccttattgtgggagaggaggtaagcctcaacctatatatcacattatattacctctcctctcggaccggtcgtcagggtggcctccgtccactgttaatgcccttacaaaacgcaacgttgttgcttactgcttagagcaagttcaatagtatagccaactactagctccaattcttctatagtcaatctaatagatcattcatacaatagttacatattacactattaatatctggtcccacctgtcatacacaccccgcgtcttggagtccgtgctacagctgtttataaatctgtagcccgctgctcttctctctcctcatttaacttcttaaaatatatttgtagctgacttatagcctgcttttgtacttgctcttatgaagaggtctgcaggccgggaatcctctgagcagttagcttgggtgcattgcatatgcaacgagttagctaaccacagcctgttggtctcctgacaaaggcacttcctccccatcacttccgtgccgtttccttcaccaagacaccaacaataatgctccatccgagactaggcacaagtctttattaaaatatcggaggttacgatcgagctgacaccgccaagataggtgtgatgagagagatccagagtcatcagacagtgaatcgagcaagcaacgcgaggacacgtacttacgcactccaaatattaaggcgatcaggcgatcagcaactgcactttgcaaattcggccgatgatagcgtatgcgtgatcaattaacgtgtaattcttttacgtgttcgcaaaaaaaactagattgcatatgcatgacacctacacacgtacacggtacacacgatggatggatggatggattgggcggctcaccgaactggcctcctctcgcacgcacgcacgaaggcaggcagccagctagcatcgaggacgtacgtccgagccggcgaacggatctctcccgtgcagcaaaggcgtacgtatctcgtcgcggccggcaagacgtcccgggctctctctctctctctctctcgtctccaggggatcgatcgtcggtggagcacgcacgcacgcactcatgcacaagagtgtgatcacacaatcctcggctcacacatgctaattaacagctggtgcacgcatgcgctagacgaagcggcgtacactaacacacaaggccatgtgtcatgagttggaaactcatctcccatacatgaaaacagaatattaactagttattttttaaaataaattaatataattttttaaatcaactattctatcaattttttttaaaataatattgtttaacagtttaaaaaacgtgcgcgtgaaaaacgtgtagaatgaagttgggaacactgagtaaagaatacatcgtgagagcccgaggtgctatcaagcctaagcgatcaacaaagtttccgagtatatcagtgatcccacgtcgtagtttttgtaaaaatacgttttagagttatcagtaaacatcatttgatagtggagatgctagctgcggagcctaagcaagacaagtttaactgctagttccgttgttagggtgccgcgttctaaataggggttaggccgacctaatctctcgtttactgtgagcacgcttctaaacggtcaaacaatatattttgtaaaagaactttttatataaaatcaaataaacctattttgaagtttataataattaattattaattaattaatcatatactaataatacgatcccttttacggtaccactaactagcttaaaccaacagctatacaaacacaactaagggcctcttcagattatagccaaaataaatcttaccaagttttgtcaatgccaaaaatttggcaagatggcaatattaccaaaattttaatatgatttcttttgtattgattaaatttgacaacaaactaaacgtagacatttttttggctactttaaaaaaaatagtatggttgaaaatgtcatcaaagtgaactggccctaagttagtgagagagtatattgaaggaaacctggttgacatatgagatgatttgtattacagtgttgctagaaaactttcaaaaaaaaattttgcccccaaaacttttagatttgcagcaatcggatcgcctcgagatttatacatgaaagggaaaaaattgctagaaagatttttttcatacatgtcacacgtaagatctcggtgctagccaatcaaactaagctgaatacaaattttatatactccctccgtcctaaaaaaaattcaacctaggagcggatgttaaccctcctaaaacaacgagttatccatattcgttgacggaacgagtaagttatatcgtacttacagtgtatataatataattatactttagttatagttatatttgaaaagttttctaaaaacaactgtaacagttttctagatacctcccatcacggaaagattggcttattgctcttctaaccggtgtggcagccacgtagataattcaatttcctcgatgggattacaccgtttcgccacttccggcaagtgtgggggagggtacaaattaacgtgccgttgccgtgtcatatggacccacctgtcacatgatcactgtgctggacactgatgtctctggagtctagagtctataggcaggtggtggcaatcttttttttttcatttgttttttttttgggcgtggcgtgacaatgcccacgagattttgttaatgggaagatggggtgatgatttcataccactagccttttgtcactaagtccttccactgaatggggagaagttgctgatgaaacagacaaagatgactctaatgagacatcgtagtcaatttctttccaactcaaccgcacatatctattgcctgacgttggagtcgaggacatgaggattgagatatcatctatagtactatatgtgcagcgtatatcacttacatataagttcaatgtaagttagacctatatatcagtcacatctgttacacatatagtactttcttcattttataatataacgatcgggacataccgaggcatgtacatattcatcgtactatgtagcatcccattcgattttagattgtcatattatggatggagactgaagagagtaatactacggatgatgcgtgtccatgttatacacattgtattatttattaagtgattcttgaattatggcttgtttcaatagatggagcaattctttcgaactatagtactctagtgggacgattgaattgaaatccatatccgaaattttcttctcgagcaatcaacggaaggctgagaagaacccctgcttatcatcgattttgtggtactcacacagtggataaacaggcgtcgttagaggttttttctccaaattaaggtcagaagatgtctaaacaatcccttaaaaaaatgataaaatgaaaatggccattagccaatcagtaaggtgtccatgtgttgagctccttgctgggaatcttataattttggtgtaagtacagaaccaactcaacagatttgtacgatgacgctgagattcgttaacatgccaagattctgattctctttaggcagcgagcttagcaattgtactcatatataggcaaagagattcctttcagattcttgctcttgcttaagccaactaaacacgtacccaatggagaaatgcctcaacgagtcagtcgaaagcgatcaacggagaaaccacacactatcagctatacatatcaacgcatggtgatcatgtaactatcaccaaaagagccaaacaaacggcctttgttttctttaccctttttgcagagataattcgccatagatcactcggcgacagcgaaaaacgatgtccatgaatgtgtgagttttcttctgaaatttcttcatgtccatgccacgccggcctctgcacgagtgaagaccaagggcagcaaaaagaacaactcattcaggatgtgatgccacatggtgttgatgggaagaatatgggtgattagtcgctgactggacggacagaccgctttgtcaacaacaaatcaaccaaaagcttcacatggctttgaatcgaagcggaccatggcgtagggagagaaaacaaagaacttaaacccgcgcggcctcatgtatcatgcatgattgttacaaaaatgatctaaaaactactaaaaacaatgacatatggtgtcaagagcaaccaccatcatgtaaaaagacgacagctacttctaagaggagttgcaaacgtatgttttggcaaggagctaggattgatggaaaaaaaaatcaatcaatcaatcaaacaagctgaagattcaggtttgcataccagattgcttgcaatttcaaaatcaagtctgaacagctctgcaagatggtaatcctatatacctatacaagtgatccccactaactgcagttattaccaattctctgcactgtggttgatccacgtcatccaaaaagatagcagccgttggatgaaatctcaatggtatgatatcaatgcatatgttatcctggtgagaacacccaagtattacacacgaaaagccaagctgttcgctccccttccccacgtagatgcggcgccgcatggttccccttcccctgcgctgcttcccctccacccgctcaactccctccctccctccctcactccctccccgtgcgtcggttcccttacctggccagcagtacaccagggagctcctcactcccataggctgtggctccctggtgagtattttactgctaatccgttttttaattcctgtaattgacggttaaggtgagaggccaaacttcttggatttcttttaaggtgtgcatctgccctcaacccttccctctcctcttttgtaccaccgatcatgtccttctttgcaggtgccctcccccctttctctctctcatacgttgctttgtttacactttacactgctcgatttgatagtttgtttcaattttctta

SEQ ID NO: 64085 - DNA, 4336 bp, Oryza sativa
caactggggtataaagcaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgaacagatctaactccaaaccaggagctaagcaaattattaccagttattacatccataattattgtgaaaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcaaccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcgatcttcaattaaccttcttgatcacttccgacgcactcacgaaccttcgcaacgacggaaacgacaagctaacacgcaaaacgaagaaaaagactaataaaaaccaaataaacagtacataaaaagtaaaaaaacatgtagatcataattttagatgaattatgagacttgaacggcctcattccgacttcaaatgaatttattatgaattttacaagattaaatctaattaaagtccatttaaaaagacttaaataaatttaattcaatttatggacaattttaatatgtagatctttattttagaaaaatttagcaacttgaaccacctgaaacggatctatggttatttagttatgattttccgaagatttcatctattagaaaaaaggaaaaaaaaagaaaggatgatgatgtcagcatgacatcacccacggaggccggctagggttggcgacctcgccggagctagggaccttggccgggtgattggaggacacctacgcgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttctcctcaccacggcgcacctaacggcggcggcggcaagcggcggcgacgacgcaagcgacggcgcggcgtggctgaagacggccggcggcggcggcgaactaagtgcgcgcggcggcgactctacggagcacgggagaccacgggagatggggcaaacgaaagaggggaactagggggtcctatttatagccttggattgaagagatcggactcctcccgcaagaaatcgatccgagaaaatcaaaactcggttttggagataaactcgaaaacgagtttgattcgggcaagatactcaaccatttgctccgattattgaggggaaagatagaggaggacgagaggataaaatcccctcaaaaacccggaagaaaaagagccggattggagcggatttgagggagaaaaggggcggctcgggcgacggcttgggctcggccggccggctgctagaggaagaagaagggcctgacatgtgggccccacatgtcggtgcctagagggaaagggtttttgaactttttcaattaaaaaataattcgtgaaatgatgtttcatttattaaaaatacttcccttgctcaaacaattcccagaaaattctagaaaatagaggaacaagcaaagtatttaataaaattttatctaacccaattttatattgagatttagcacattaaaattagatcttctcttttaagcttttaaaatcatttctaataattccttttaaacaacaatttataatttaaggattttaaacaagaaaagcacttaacaattataattagatcattattgatcaaataattactgaactgttctctgtatcatttacatttaggaattgagctccgaaaaatccgagaaaattccagagagtataattaaccatggagaatttaataaaaattaaatccacccatgctttatatttaggaaattttatttcccacatttaacttcacttgtaaattaatgaacatttcatataaattctattaataatttattaaataatttataaatcctaacacgaaaatcagggtgtgacaaatctaccccccttacaaagaatctcgtcccgagattcggaacggctagaaagaaaaaggaaataggtaaactgcagtctatcttattccataactccgataattattctgaggctttaaagaaaactactgccgctttgaaactggtggctgagttgtaacacttgaagacacaactcttgaagacgcaactggcactgcattggctcctgtgacgacaatgttgttgacttgaccttgcggctgctgacgcttcggcttcggacactctcttgcaaagtgacctggcttgtaacatttgaaacacacccgctgttcccttgctggttctgcatttgttgcactaacatgttgatcaattgggtctgttgagccagcacttgagcaagggttgggttctcttcattgttattgtttccacttccactagcgtgagtgttcaccatctgttgcagattagaaaggatagaaggagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccttaagtagacctcattggtgtcttcaagtttcaaccactagtttcagaactactcaagttgaacgagagaagagagtagacaatgaaacaatttgcaaagagttctagataaggaagaaaggaaaattttcacaaattatgttttcggaaaaatagtccttaaggtttgaccatttggcttatcctacagtcgagatggctctgataccaacttgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccataggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagtttaatcaac

SEQ ID NO: 64086 - DNA, 20075 bp, Oryza sativa
  unsure (1)..(20075): unsure at all n locations
ctatattgcaaatgctctattgttttccttcaaatactgcatcgttttataatgttactatgggatgtttacctattgtcatagccatgctattgttgtaccatgtccctttgtcagcttggggtcataacatgactagagattggactagggattgcttagccatgcttagttcaactagttcacaatggggaaaatcctattaatgtttagactgttggttctaatggttttgttggattagtgccaccgctttggtgttggttaattaaaataaatcacatggtgggctgtgggtgcatggttttgctggtcgcacccatggcagttaaggaccggttcgcgggatgccctggaagaacctatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttagttagagggggttatacgaagggtcctgtcacggcctctttccggtatgtcgtggtggcatgtcggcgcacggaaacgtgtcgtggggctgtgtcttgtgggtacagttgtacacctctgatcagaataaaactattcgaatagccgtgcccgcggttatgggcggtaaaccagtttcaccgtgattagtcttaccctagtgtaatcttttgaaattggatagtttaggtggatggttgggcctgttgcaacgtgggatagcgttggacagtggatagttaatattaattaattattacaactgtttaaatctttcaacttctgtttataaatgctcgctttatgcaaatgaaccactccagctcttctttgataattccctgcatcatacccctattccggtatgacttgctgagtacagtgggtagtactcagtcttgctctattttttcccaaccccagagctcaagtatgtgtcagatgaaggtttctccgaggagtaggcttcgtccgtgccgtcgaggatgcctgtggagtggtgttcccgctgcagttctagtcaaggcttagctcctgttgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcgggaatttttaggcgtgacagcggggagagggccgaaccacccgaacgggtggggtcctccctccgcgagggatcacggcggggaggagttggagagttgcggcggcggtgacgagggtcgtggctctcgctagcatcctcactcccagacggagtgggggtgaacaccaccaccttctccttcaggacctcgaccatgatcgtcgagggtcatgggaaacttgggacggaaggcgacgacttctctttaaagcgcgcgacttccccctacctggcgcgccagctgtcgaggggtgatcctctctagcgggagatcgtgtgacccccccctttcgtgagttcggccgggggaagaagctcgcctctagaaatcgcgtatccgtcccgaaggctcctagctagctcgcagacaaccaaattatacaggttcgggcgctatcaagcgtaataccctactcctgtgtatgggatttagactaagagttacaagggttcttgaactcgggagaacacttttacttccctcctccacaagctcaggttttctgagagtcatcctctttctcggtgggcaaggtcctccttttatacctcaaggggataccacatgcacccgctctacctactcttctataaagtggggacccaccttatcttgactggaactcgaccgtgccttcacctggaagctaaaaccacagcttgtcctttagcggggcccagtgtcgtccctcgcctgacacgaaggacagccctgtcattccctcattaataggtgaagacttgtggtggccgccgtccgaatgagcccccgatgggacgggtcatacctacctccactccgccggaagcagatgcgacgtgggagcacggttgtccgtccagtcagacgtgaccggcgtcaggccggtcatagaccggtcattcttgaccatcgcgcgtcagtttagcacgccgcacatctgccccactgcattaaatgcgacagggggcagttggggcgctgcgcgtattaaaggaagtttagcctaggcccccctcctcgcttgctccccccgccaaacggcggctgggcgagggcctcagggcaaagtagtgcaagggcccgaggggcatgacgtggcaccccgaggccctgaccccccggccgctcctgcggttcgcggaatacggggataggaccaggctgtagggcacgtggcatgatgggaaggtagattcccctcactttacatacccccaggcccatatctccgacaggaacgatgtgactaaaaagttgtgtgtgtatgaaaggtttgatgggatggacagttggaagtttggaaaaaaaaaactttggaactaaacagagccataaacttccaactttttttccaaacttccaacttaaaacttccaactttttttaggaactaaacatagccgaaaacggaaacaaacgatctggcgttatatatgggggcttgcaagcgtgagggtgggatggagttgagattaactcgtatacaaaccgtcttacgtgcgtatcggacaacgacttggatactaatgacgtacgaaagatttagcaaaaacatcttcaattattataatagtagagataaaaaaaattgttcgtacgttgcactatggaaaaatttgtccataacgggttatgacattggctcgcgtggctggctattgcctcatgtttgcttcatcctgttcataaaaatcgatttatcctatatataaatatcggaacatttgaaatcatcggattattaaaaagaaagaaagaaagaaagaaagaaagaaagaaagaagaagaagaagaagaagaagaagaagaagaagaagaagaagaagaagaagatgatgatgatgatgatgatgatgatgatgatgatagtacaattgagcagtgtcgtcgttgtcagctcctgtgagctaggcggcgttgagtgggcggccggctgaccggccggatagtccgttgctcgtacaactaggtactaggtaggtactagctagctactaggtcaagataggtagctagccatcacaggctagcttggagtagctagcagcattcgtcaaccttgggatcgatcaggagtcgtctctgatctcgataggtgacgacattgtgagacagacaaggacatcatttgtgtactgtacgagcaagtttaatagcatagtccattgctagctccaaatcatctgtagtcaatataatagttaattcatactacaatagttgcttactatattattaataactggtccacctgtcatacacacattacgtcttgaagtctgtgctacagctggctacagatagcccgctgcttatctctctcttcctttatctttttaaaatatgtttatagctggcttatagcctgccactgtacctgctctactggtgctcgcgatcatctcgcgttatctccactaactgcaattaattacaaaagaaacacagccgatggatcgatctagttgtaccaggaaatcaactatcagtcgtctctcgcatgatcaagaacataataaaataggagtgaattcaattgacgattaattgggatgccttctcaacactaaaatcaaaaagactaaaatgtcttccacttaatcaaatcctattataattacccccactttatctagttgcaatacatctatttcacatttttacaaacttcaatacaatagttgttgaaaagattaagttattaaaagacctgtttgaatctgatgaagattcagattaaatgcgggcacgtaaaacgagatagctattagcgtataattaattaagttttaattattataaaattaaaaaatagattaatctgatattttagaacaacttccgtatagaaaattttcacacgaaatacaccgtttagtaatttgaaaaacgtgccacaataatttgaatctcatcctctcctttcaggagattcgaacgggaaaagtgtttttttaacggagagaatagttgtagttgcattacaactgtagccagcacaaattaaagtgaagaacttaggtagctagtacaattacgacagctccaattcttcacctcaattagtttcaatagtaaatatactatcaagaaaaagaaaattaaggtgacaaagaattaatgagaagagagagaaaaaagatgattgaagagtccatttcgcatgtaaaagaccactgcctctggttacttatccttttggataaggacacaatcttcaaaaagtaactttagccattattttatattataatatatataaaaatataaaaaatgattttattgaagtgtttttaagactaatctatatatacacatccagttacccatatttctaagataaatattttgaaaattattcatagttaaagattttaaagttcgacatcacccttatccaaaatggcaggtattatcagtccggaggattagttttacacataaaccaataatgaaaaaagggaataggtggataatgggatgtttagattcaggggtgtaaagttttagcgtgtcacatcgaatattatatagggtgtcttatggggtgttcaggcactaataaaaaaactaattacagaatccgtcaataaaccgcgagataaatttattaagcttaattaatctgtcattagcaaatgtttactgtagcaccatattgtcgaatcatagagcaattgggcttaaaagattcatctcgcaaattagtcgcaatatgtgcaattattttttttttgcctatatttaatacttcatgcaggtgttcaaatattcgatgtgacggtgtataaaattttggttgatttgacaagccctaaagggagagagatcacagatgattagatgaatttattttgaagaaactagtggcggagcttgaaggaaaaataagaggggacttttattttaagctggggctattattgtcgacgtttgatgtctcgactacggtatttggacagtatggggatcgtcggtgctaggatatacgcgagactgaggtaaaagagatgaagacatggatttttatacaggttcgggcccctgagctatcaggtaatacccctacatcctgttggccggagccgatgttgctttttattcaccataatcacaccagtataatatgtggggtagcctatctaactgttgtcgacatggcggtctgaaggtctgactcgtagtcaacaacagggtagccttcctcctcgagctcgcgcccgacggaatcagagacagtgctagatccctacggccggcctctgaaggtcccggatagggtcgatccaggcgtatctctgatgtcgatatccggcggcttgtcttggcgtatgtaggcttctatgttgattgtgttgggagttgattgtctcgtggtgggcgtgtgtgtccccctgtcctcctagggaggcttgtatttatacccataggtgtccccttgtctaagtagaactagggaaactaatatggatacaatccgagtagtccttgtcgtttccatgtagaactctggttgtctttccttatccggaactccctcctatatccgtaggttgtttccgtataggacatggtatgtggtgggtcctgccgagattgagtcaactactattaggtatgtggtatccataaccatgacagtagcccctgactttaatgcaaatgaacgaattcatattctcaatcacgcgcagactttggaataactattatcgagctcatgtgaacgttttcggtgagttcagagataacgttagacttcctttgtcagcctcgtgcgggcaccgaaagggtttgtctaagtcaatctctgatgtcgaccgagaaagtatagagcgtacgactaagtctcctgtcttgctgtaatagaaaatttggattgaagtcaagaaattttatctcggcgggtacaccatctcttcattccgtattccttatcgagattcaccaaccgttctcgagtgattgagaaggcgcagaatctacgacggagccttgtcaacatttgtcgtactcgccttagtcgatcttggtgtagaaccatagagacatggagtcttcgtcaatgtcgaatagaattttcctgaaatcaacactcaaaaaagaatatcagatagaaatagcccccgagcgaacgctcaaagggtgacatgttataatatatatggaaactaaaaatgaaataaatttacagaccaatgttttgtgtatgagcgtcttctctcttaccgacttcgatcagtcaatttgtagagtcatacactctccctagcccccagccttgtcgtcggagaatcgttctcgaaggataaggctcttggacccttgacctgcgttggttgaataagcactgatcctagcccccagccgtgaagttggaaagttaatttccgattacacggcttggttaatacgcacggcgagaactcttacatgaccagatcttacatggtctttcgtctctacaggatccgacaaggccttatcggctctaggcgtccccagccgaagatcccttaggttcctcggaggccttgtcaagacggcgtaaagggacagtaggataggtttcagcgctaggtgtcatctgggtaagggatctctgggtaaaacccttggcgatcttgtgtacctgacatcaactttgttgaagtaggggtaatgggagaatcgctacatcgctggtcgaggactaggcagtagtcgtaactcgaccacttgaagtggaaatagtgggagaaacgctacatcgctagtcgaggaccaggcagtagtcataactcgaccacttaaagtggaagtagccggagaaacgctacatcgctggtcggggaccaggcagtagtcgtaactcgaccactgaaagtagaagtagtgggagaaacgctacgccgctggtcgaggaccaggcagtagtcgtaactcgaccacttaaagtgaggcgagagagatcattacattttactggttcgagaaccaggagtaggagtctcttaattacctataggggcgttaaagttggtttattatatgtgcatattatgtggccagcatgactcacatacccaacttatagcatatccggatgtccgttcgcaatcatgtcgggtgatcaagccgacggcgttagcgaggaattatccgttaacaaacttttctcgagtagtccagcgatggccggagctatgagataggtcgtcggtcttcgttggtaggttgggcgcgacgactctgcatttgtcgagatcgttctcgataatgcggtgtactcgactacaacctactcgagtgctcaattgtttctgaaaattattttctagaagacaagatatatagcaggggatatcgagtatgtactcaaaaactgcgtggatcttctagtattatcaggatataacgagcagattaaatatcaggcattatgtaacccgtaaacaagcatgatttatacagaagagaacagagcgagcccccagcgttagaccgtagttggtttaacgtcggaaacatccgcgcaatagatattgtataaaaaacatgctctaggtaaacataataaattatagatctgacaatattgtatgatctgaataggtacgataaattgcatataaaatattgcgtacctttgtagatacatgccggctgtatctacgaaattagtagatcaatttgaaaaaccaatctaccaattaccttattgtgtactcgttggacataatatgatctgacatattttggtacgccgcgtatcttgaggcttggatgatctcgatagaccaagttgtcgatgacgatgatggttccgatctggtcggaagatgtacttcagttgggttagatctcctcacagccgaagtcatcgagtagcttgttgtcggagagtccatatcttaaacgcatctcgtcgaaatcctgaagcaccaaaatccccctacctgtcgcgccactgtcgacgtttgatgtctcgactacggtatttggacagtatgtggatcatcggtgctaggatatacgcgagactgaggtaaaagagatgaagacatggatttttatacaggttcgggcccctgagctatcaggtaatagccctacatcttgttggccggagccgatgttgctttttattcaccataatcacaccagtacaatatgtagggtagcctatctaactgttgtcgacatggcggtctgaaggtctgactcgtagtcgacaacagggtagccttcctcctcgagctcgcacccgacggaatcagagacagtgctagatccctacggccggcctctgaaggtaccagatagggtcgatccaggcgtatctctgatgtcgatatccggcggcttgtcttggtgtatgtaggcttctatgttgattgtgttgggagttgattgtctcgtggtgggcgtgtgtgtccccctgtcctcctagggaggcttgtatttatacccataggtgtccccttgtccaagtagaactagggaaatcaatatggatacaatccgagtagtccttgtcgtttccatgtagaactctggttgtctttccttatccggaactccctcctatatccgtaggttgtttccgtataggacattgacggagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctcactcctcttttctccagtcccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgagcctccgatgggatgggtcataccaacctccactccgccggaagcaggtgcaacgtggaagcacggttgtttgctgatgacgtgaccggcgtcagaccagtcacaaaccggtcattcttgtctaccacgtgtcagtttagcatgccacacgtcagcccttcttcataaaatgacttccttgtaatggttgcgatgaagcctggtatgaatctagccgggaccgacgtgctaactccaggagttcccacgccggctccatctagggacaagtgcctagaggctctcatcattccgacgggacggggcgaggcgtgcgaaaggccgcctgttgccacctaactcgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccgacccctcggggagatagagggaggggcggtctcatcaccctcgggcccgacccccccgagggggtcaggccacgtgggtgaccgcggctgccccaaacctctagtcaagatatccccggtcccatgtcaccgacagtagcccccggggttatgccagggcgatcaccctcctcgaggaaaacgctcgggcgtgacgccactcctcaggcctggtgacaggtggggccggtctctaaaagcggacaggaatccagtggtcgcaaatcgcgcgcatcggcaagggaaaaaccgaccgacaataatgagcggctttcttcaagaccgctacattactcgagtagcgcgcgaattgggacgagccggttcgtttcgcctggagatgtgatgatggtgcatcggtcggcgagcgtagttaacgcgcgcacgatatgtcccatctcgactgccacggccgcacatccgcctcgtgcgccgcaaacgggcgagcgggattagtggaggagttggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgctgccttctcgcatcgtgagcgagaggcaggccgggctgccgcgccgattcatgccggaatctgccaccggccgggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaatgcagtaatgacgttggccatcttcgcgcacctgtgcgagatgttcatcggggtgcgcccatctctctggttgttccggtggttcttcaccgtacagccggtgtcgccaccgtcggtagtcggtggctgctacttccagccgcgggggccggtgctgaaccgctatattccctgcgtccttcgcaagaagtgggatcactggaagagcgactggttctacacccctctcgccgacgaagcgcgcctccgacttccgagccagcccccagcgcaggcctccagctggcgggcgccggtagatctgggagacggctacgacgccgttcttgaccgcctggctggtttgcgatcccaggggctcacgggggccatggtgttcggcgactaccttcgtcgccggatcgcgccgctccagcggcacgcccggggcgcctgggagtacaccgggcccgaggacatcatgaggacccaccaggggcgcaaatgggactgggaccctgaggacttcaggatagtggtccaacgggtgctgaatctcagctccgtggaggcatccctcatccctcaaggggtccttcccctctgctgcgatccagagcgcgccaacatcctgaccatcatgcaggaggtcggggcgtcgggggagcgggccccccgaggccacgatggcgcgggcgggagccgcaggggggaacaatctaccccgggagggggtcgtgcttctgggccccgtgacgggggcccggggggcagccgccctaccgacgcccgggggaagaggaaacaggaggataccccctccccatctcctccccgagggggcggggcggtgcgtgccagcagcaggcgcccgaagggtgctgtgccgacgtcgcagcccgagggggagcgaaaaaagaagcggctccgcaagatgggggggaccgaaccatgccggggaaacctcatctcccccccaaggtggtcgtttagccgacctcctcgcaggttcgtccctgcgcccactgcggccgtattcattctcacatctcccaaggcaagttttcactcacccgtttttcgtcttctggtttttcttctgcctcagcgagatcccgtcgcgcccttcccgccattccaagtccggccggtctgaggccgaggagacggcgaccgcggaggcccggaggcgggaagctgaccggcgagaagccgcaaaccgcctccgggaagccgaggaagctgcccaggaggctgtccgggctcgccaggctgaggaagccgcttgggaggaggccagactccaccgggccgaggagtccgtccgggagacggaggcggcgcgcgcacgccgggcggcctgccaagcccccgacccgactccgcccgaggcgacgacgacttccgaggccacccacgacgaggtcgcgggcgcaccgctcgggcccgacccctcgggcgacgctcaggacgagccagcttcgggggacgtccccgagtccggcacgtcgatcggcgggccgagccgtgcggcatccttaccgaggcggctctcccccatgccttccgctgccccactgagcgctgagccccttctgcaggccttggccaccgcgaacaccacggtgttggacgggttaagtgcccagatggaggtcctgcaggcagagcgggcggagctcgacgcggcgtgggcgcgtgtcgaagaggggcgacgctcggtggaggccatggtggaggcgggccgcaaggcacaccgccggcacgcctcagagctcgaggcccgtcgtagggacctggcggagatcgccagggaggtggaggaggagcgggagactgccctcattgccaccgccgtgtttaacgcggcgcgggacgacctctgcctccaatacgggagccggggggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccacgaggacgagctcactgagcgggagcgagctctcgaggaggccgaggccgcggcgcagctgcgggaggagcaggcgcgcctcaatctggaaggcgcccgcgccgagagggccgcactggatcagcgggccgctgaattcgaggcgcgggcgaaggagctggacacgagagcgcgcagcggcggggcggccgcgggtgacggcgacctagccgcccgcctcgcagccgccgaacacaccatcgccgagctgcagggcgcgctggactcgtccgccggggaggtcgaggccctccgcttggcaggtgaggtagggcccggcatgcttcgggacgccgtctcccgtctagaccgcgccgggcggcaggcgagcctctggggcgggcggaccgcgaaatatgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctactaggccagggaccctgacttctccccgtgggcaacgctggacgagttccctcctggaaccgaggatggcgcgcgcgcacaggtccgggacgccgccgaccacatcgtccacagcttcgagggtacggcccctcggctcgcgttcgccctcgactccgacgaggagggcggtgacggtggtgcggacgacagcgacgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcagctctgtttgttgtgtgtatgagacgaggatggtctatgccgcagtccttctgtgtcttggcttgaacgagggctcgtgcccaggtcctagcctcaaatggcgcgggtcggggctagtgcctggggagatccgcgtgtcgagactggccaggccgggaacgtggtgaccgagggttatggatgacccgattgtgggcctttgccgattcccccccggagttcaccacgccccggggcacggctcggttctgggccccgtttggcgattttagccggcccgggccaccgagggcaggatcgagcacgagcgtgctaattcaagccaagattcttcgaaaggaaacaatggcacagacacagtccttaggaaatcgaaaatgcttttattgaaatacggaagagaaaaaatataagcttatgcatgtggtggcccgaggggacctcagggtgagctcggatgggagaaccgcctccgcgccgtagacgacgaagaaaggcgtttccccggttgctcggcttggcgtggttcggttcgcccagagcaccgctggcaactcctcgatccacgagtcgccgtgcttcttgaggatattgaaggttttggttttgaggcccttgaggatttctgcgttggcgcgctccacttggccattgcttctggggtgggcgggagaggcgaagcagagcttgatgcccatatcttcgcagtagtcaccgaagagttcactagtgaactgggtgccgttatccgtaatgatacgattaggcatcccaaaccgagcagtaatgcccctgatgaatttaagcgcggagtgcttatcgatcttgatgaccgggtaagcctcgggccacttagtgaacttgtcgacagcgacatacagatactcgaacccgcccggggcccgcctaaacggacccaggatatcgagcccccagacagcaaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatgcgctggatgcgttcactcccttcgcagtcctcgggtagagtcttatctgtgaggtacgcctggatctcagtgatccaagcaatcaatctaagggagctgggagcactcccctcgggtcccgaggcctggactccgacaggcctcgggggccgttcaggcgcgtccgtctcccctagggggtcgggccgcgccgacagctgggcaagcctttcttaaaaggcgcccggtggggtctgggctcgcgaggaagcgagccttgaaagttcgtcggcgaccgcgttatcccgtctgggcacgtgccgaagctctatcccgtcaaaatggcgctccatacgccgcacttggcgcacgtaagcgtccatctgcgggtcagagcactggtactccttacagacctggttaacgaccagctgggagtcgcctaacaccaggaggcgacggatccccagtccagctgccaccctgagtcccgcaaggagtccctcgtactccgccatattattggtcgcccgaaagtcgaggcgaaccaagtatctgaggacgtctccgtttggcgaggtcaacgtgacccccgcaccggcgccctgaagagatagggagccgtcgaactgcatcacccagtangcggtgtgaggcagctgcgaggggcccgagcttgcctcggngacggagatgggcttcaggggccgggtccactctgccacaaagtcggcgagggcctggctcttgattgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcaggtcttagcgtcctggagggcctcgctaacgaagtagacaggccgctgcacctttcggcggggccgatcttcttcactaggggccgcatctccagggcgctcttcgtccgagaggccgcgcggggcgcactcggcttctgtgccgacgacctcggggtcggagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctccctgctctctcccgggtcgagtcgacacagggtggggatgcgcggggtgagggttgtcctcgtcgcgctccacaaccaacgccgcgctgaccacctgcggggttgctgctaggtaaagtagcagcggctcatctggctccggggcgaccaggactgggggagaactgaggtacgccttcaactgagtgaaggcccgctcagcctcctccgtccagataaacggcccggagtgtttgaggagcttaaataggggtagtgccttctctcccagcctcgatatgaaccgacttagggcggccatgcagccggtgaagcactgcacatccctaagcttgctgggggggcgcatccgctctatagctcgtatcttcttggggttggcttcgatgcctcgggcagagaccaagaacccaagaagcttgcccgcaggcacgccgaacacgcacttatcggggttcagctttatgcgggcggagcggaggctttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgtattctttaacccgaaaggcattgtcgtataacaataagttccaatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgtttcggggcctgccgccgcactttctgccggaccggccttgcgcccggccgcacggcaagacggtgctcaatcacctccctggggaccccgggcatgtccgccggtctccaggcgaagacgtcggcgtttgcccgcaggaaggagacgagcgcgtcttcctatttgccgtccagaagaccaccgattcatgtggtcttggacgggccgtcgcccagggcaacctctttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgtgactttgaggtcgccatggacagagatggggccaccggggcccggcatcttcatctggaggtaggcgtagtggaccgccaccatgaacttcaccaacgcgggcctccctaggaccgcgttgtagggcagactgaggtccgccacatcgaagttcacccgctccgtgcggaagttggcggatccaccgaaggtgaccgggaggtcgatatgacctagcggccaagtgtgcccctgcgtcacacctacaatcggctgggacggccgaagcaccatccccggggccttgatggcgtcaaaggctgcgggggaaaggatgttgagggctgcacccccatctatgaggacacgccccaacttcacgttgctaacggtgggggaaaccaccatcgcgatctgtcctccccgggcaacgcacggcgggtggttggtctggtcgaaggtgagggcaacctccgaccaccgcgcccgccgcgtcgcctcatgggtaggggccgcggccagaagctctcgcttcatggccttgaggctccgacgagaagcgtgagcgcatgctcccccatcgacggtggcgatggtggccccaggctcctggaaccctaggtcatcgtcgccatcgtcgatgtcctcggcgggggccttctgcttggcctcactttgccggttgccggagggagccgccggggccttgccctcacggcgctcctgcctcctctcctcctcccacttcctcgtccactcagccaaacttttgaccgcgcggcagtccgcgaggtcgtggagggaggtgttgtgcacggtgcaccacttgccggtcgggcgctccctgctgggagcgccggcctccttctttttgtcgctcgcaggccttccctttcaggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccaggcctctttcttgcgagccacacggtccgcgagctgaaaaagctccgcggtggtctggggctccttggaggcgatcttttcgagcatgcggttgtgccgcacgccccccctgaacgcgtagattaccgcgtgtgcggggatgcatggtatggtgttccggacttgacagaaccgctgaatgtacgagcgaagagactcatcgtcccttcgctgtaccgcatgcaagtccgcttcttcacctgggcgcggatatgtgccttggaagttcatggtgaactgctagcacaaatcctcccaagagtggaccgacgcgggcggcaagttcattagccaaccccgcgcctgtcctttcagggccatggggaagaaattcgccatgaccctgtcgtcacccccggcggcctcgatcccggtcatgtagacctggagaaactcggcggggttgacgcttccgtcatatttttcggtgatggtgggccggaaccttgggggccaacggacgttccgaaggctcgccacaaaggctcgacagccgacaccaccaatcgggggcacggggggctggcccccgcgcccgaaccgaagtggcgctccggacgaggaagcgccttccgttgcgtgggaagcgtgacgaccattgcgccagcgctcgatactgaggcgggcatccagccccctacgcacatcttcttgggtcggaggcgttgatgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccataggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgtacagatctaactccaaaccaggagctaagcaaattattaccagttattaacatccataattattgtgaaaggtgtgagactaatcacgaaa

SEQ ID NO: 64087 - DNA, 4829 bp, Oryza sativa
gcatatggcttgtcattctgtgtcgttgccggagtcgatgaggcaggtctcgacgccgccggtcatccagagaaccaggcgtagctgctgcggtgctggctgctctgcggctcctcgtcgatggcgcgggtgaacatgtcctccgcgccggcgaggtcgccgcgtgcgtgccacatgaacagcgcgtacctcctcatcgcctcgccgtccaccggctccgccgccaccgcctgcttgaagtagtcctccgccctgttcgtcaccggcatcgatcacggcatcatcgttaatggcgaccacgtacggggagcacgcgacgtcgatggcggcgacgagggtgtgcgtacctgtcgaggtccttgtcgaactggtagaggagctgcgcgtagttggagaggatgagcgagttgacgtcggcggcggtggcgatgatcctctcgtacgccgccttccgccggtggacacgggcgatgtcgatgatctcctgcaggccgtcctcgtcgtcgacgaacaccggcgtgtcgtcgtcgctgtgcatgatgccgatccgggaccagagctccgtctccatgtcaagctccaccagctccggcatctcggcgtcggcgtcctcgatctggtcggtgtcgccgccgtcgttgtcgggggcagcgttgctggccgccgccgccaccgacgcggacggctcgacgttcttgcgtttgatccggtccatctccgcctccatgaccgtgccgaggcaggacgcgacgaggccgaggaggccgacggcgaggtcgggcgactcgaggtgcaccttgcggatgacccacgccatggcgtccccggcgccgcgcgcggcctcggcggcgcccccggccgcggcgccctgcacggcctccaccgccgcgaccagcgccgcaaccgcgctcgtcccggccgcccgcggcaccaccccgcgccgcaccgcctccagcttcctcttcgcctggatcgcccgcagcgacggcggcatcgcggccatcgacggcagcggcagaatctgcctcttctgctcctcatccccaccaccaccgccgccacctccgccgcacgccgccgccgccgccaccacaggcctaaagaacccacccctccccctgcccctcccccccccgccatgaacgccggcggcgcgcacctcgtcggcatgccaaccacgatcgccgacggcgtcatcccaagatcgaagcccctcccctctggcgttcgttacgatccgatcgcgagaggctctcccaccaaaggcggtgctgtggcagtgggggaggagggcgcggcaatggcgggggaatatatagccgcgcgcgcggcgcgctcccgcgtgccacgctggtggcgagctaaaggcgcgtgacccgcacgcctcggcgagggggaggtgtcccggttctccatgcgcgcgcctcgcgcccgcgtcgcgcgtcgcgcgcgcgccagttcacgtcgggctaattttcgtcagggagaagcctcgatctccatcggccgcgcggcgctctcggcgcgggaggtggtggttagagagcttttggccaagcgagccgcgcgccgcgcgtgagcgcgagctcgcgtccacccgggcgccgtcgggaccaggctggaagacgatgcgtgcgggaggagtagtggccggagtggagagcggagggtgcacgcgcgcgcgcgcgcgcgaggccattcgagaaggaaaaaaacgggaaaaggttgcggaaaagttaaaaaagaagaagaagaagaaaaacgaaggtgttttgttgtgccataccgccatgcatgacagcgtgatgagttttcggggtaccactggagctaaaatgtcgatgggtgtaaaatttcaaatcgagagaaaaacccaaatcttgatggtaccattgtgagtgattttacggtcgttaagaggtgcccgattaaatttgactaacatataatgttatcgaaaatctctctctcaatataatagaagtgatccgaattaaatgtcacgatagattattttttttctgcatttcgcgactaaattcccgacaatatatatggttggagtacacggtaggtgtgatatgctttacacgaatattgataaaaaagagtgataagagaatcggcggtgcaccgtaggtttccaccattttgacgtggaaattctcatatatatatcgtgcacgattaaataataaataatgttgtcggtatcgaggataagctatgacttggcacctatgccacgaaccaaaattaaccgataatttggagaaaatgtatacaacacaagataggtaaggtaggcacataaaacaagataggtaagataggcgtgtgatccataaatatctttgtcatttggcgtaaaaatatcacagcaaacacatatgatgacgcattaaaatctattttttccaagtgaatgtggacacaataatcaagaaaccatgactaaatacttcctttggtgatgctctaaatcgtcatatatatcacataaatcgatgcaaaaacataaatcaacgttatagtcttagaaatcacaaaccattttttctttatgaaagtatgcagtagttcaacagttactcaattctctgttcagcggtaagctagtcacggtaacacgactcatgttttagagatatttaactatttgtcacttttagatgtgacgtttaaaaatttgttattgaacttagacacgtgaggacgcaagataaattattaaagggactatctacaaatcattcgccataaaacgaacccaaacgcagtcggatttttctctactgctaatccatacctaacgatttagtggacctccaactacgtacacccttttacgattaattagggactagtacgtattttattttttaaaccatatgattaataacacataaaaattacaatgtaattattctataactagtaattaatgtaagtggtatgtaaactgtagtgtgagtggtatgtaattacattgtaactgtagtgtaagtggtatgtaattacgttgtaagtgtggtgtaagtggtatgtaagtgatatgtaagtatggcgtaagtattgtaagtacctagtgaatgaattttaacttaattttggcattgaaatcattaatcctactatgctgagttggttagtcactctgtctaagacctagaagaccatagttcgactccccaccactgcgtctaaattttttcctttgcactggcgcgaatctcgatgaatatcgtacgggcaagacctacaagaccatagttcgactccccaccaccgcgcctgaattttttcctttgcactggcgcgaatctcgatgaatatcgtacggacaacaattcaactgttttttgtttgaaaatctggcgacacatttatagcaaatgtcattagaaacaacggacattctgtactttttttttaaaaaaaagaaacaagtttcaactgggtaattttgtgtcacttgcatgtgggtccatatcactatggatccacatgtcagtgacacagagctaggtaacgtacgtgtacgtcagagaatcttgttccgttcaccgcggggttgggcaacggcccaacgccaaacacagtatcagtcttccgctccactgctccttttgctaggtcgccggagtccgggcatctcgccgccgccgcgtccttgaggctgggcatgtcacgccgcgtccccgctcggagtacgcgaccgaagggcgaggaggccgcgcgggtggcagtggcgccgaggacgcacgccacgtgtttgacgaattgctccgtcgaggcaggggcgcctcgatctacggcttgaaccgcgcgctcaccgccgtcgcgcgcgacagccccgcggccgccgtggcctgctacaaccgcatggcccggtccggcgccaagaaggtagtggctcccgacttgtgcacccataacatcctcatctcctgctgctgccgcgcgggccgattggacgtgttggtttcgcggcgttcggcaatgtcgttaagaagggatttagggtgaacgccatcaccatcaatactctgttaaagggcctatgcgccgagaagaggacgaacgatgcattggacatagtgctccgcagaatggctgagctcggttgcataccaaatgtcttctcctacagcattcttctcaagggactgtgtgatgaggagagaagccaataagctctcgagctactccacacgatggctgatgatggtcgctgcccacctgatgtggtgtcgtataataccatcattgatggtctcttcaaagagggtgatgtggacaaagcttacatcacataccatgaaatgctggaccggagggtttctccagatgctgtgacttacaactctatcattgctgccttaagcaaggctcaagctatggacagggccatggaggtacttacagtgatggttatgcccaattgcttcacatataatagtattatgcatggatattgttcttcaggacagtcggaaaaggctattggtattttcagaaagatgtgcagtgatggtattgaaccagatgttgttacttataactcgttgatggactatctctgcaagaacggaaaatgcacagaagccagaaagatttttgattctatggtcaagaggggtctcaagcctgatattactacctatggtaccctgcttcatgggtatgcttccaaaggagctcttgttgagatgcatgatctcttagctttgatggtacaaaatggcatgcaacttgatcatcatgtcttcaacatattaatatgtgcatacactaaacaagaaaaagtagacgaggtcgtgcttgta

SEQ ID NO: 64088 - DNA, 24771 bp, Oryza sativa
gggggccggcgtcggcgctccggcgaagtcgggtcaagggttttgggaggggagaggggaaggaaatcgaagaaatggggaataagttcaccgtacgtccctcaacttaacaactagtattttttttggaataagtccactttggctcccttaaaaatgacccgaatctaatccatgaccctaaaccgcaaaaccggatatctcgacccccgaactatcgaaaccggtgcaatttgactcccttggcggttttggagggtggtttcggtgacgtggcgctgacgtggcggtgttgacttagtctgtggggttgacatggcgcttaggtgtcatttgaattaaaaacggatatgtgggacccgtttgtcattcacacattaaaaaacatggggcccactgacatgtgggacccgttcttcttcctcccttctctctttgtttctctctctcctctttggccggccaggccgccgggggagcacgagctggagcggcggcgggtgggggccagagcggcggaagctgaagcggcggcggcggtgggagtggtggcggatggcgctcgccctgcaggccgactgcttcaccagcgacctgagctagctcatcgccgacatgatgtccgggtcggtgccgcttgacgcaacacgcaagcacaagtatccctgggagggtggccatcttgggtgtgttcaagcgagacaaaattaattgctcccccctgcctactcatcctattcttcagtggatggtgaacgacctgctaacggtcaattttatctctggttagttgctaaatgaatcaattttatttctagatttttgtgatgcttgtggccttagcagcactagttgaaggagacgtaacgggggatgagttggtggcgatgatggggctggcgcgggagttgacggccacgcagcgagctcgagcaatgacttgacgacgtcgtcgttgcaatgctgaatggcgtagctcgatggcggccctcgcccctaactagcttgacaggttcgatgtcggccgtgtcgtcagcttgtcgcatacgccggatgcccggatcttgttgttgcaatcggcggagaggccagagcgccggatattgttatcacggacggcgagaggcggcggagggagcagggagctcgttccccggtgagggcgccatgacggtggaggtgaggactggggttagggcgcttaggtgccgtgccgtcgaccgccgcccccccgctcgatgtcgtcggcatcggcgtcggcgctgccgtcctttcccgcctccttgccggtcatcgagctgcccgttgccgctctggaacccgccgtcagctctagcccgccgccgctgcttcagcttccgccgaccaccaccactctagcccccgccgctctagccgtgctccagtccccgcggctggccgaaggggagagaaagagaaagaaagagagaacggaggaagaggggaggaagaataaagagagagatgatgacatgtggaccccacattttttttatgtgtgtgaatgccaaacgggtcctacatatgtgtttttaattcaaatgccatctaagtgccacgtcaaccctatagactatgtcaacaccgccacgtcagcgccacgtcaccaaaaccgccctctaaaaccaccaagggagtcaaattgcaccggtttcaataatttgggggtcgacatacccagttttacggtttagggtcatggattagattcgtgtcacttttaagggagtcaaagtggacttattccttttttttttagattccttaaccacaaatttagaaatatgtaccctaaactcacacaaaccgtgcactcaacgtcctatgatataatatataggtggtttcacttacatggcatcctagtcaggaaaaaaaagtgcgtgagacctacatgtcagttgcactttttttttctcttctctcgtacttctcatctctattctcttcttcagtgagggaggctggcggcggacgagaattcacaagccacacaagctgctgtctggtccatggatcacaacttgaacgagttgtttgagcttcccatggatttgaggtccttgtacggccccgacgaggtgagctcctgctccatccccgctgggtagccggcacaccgccgccaccgctgctgccttctctgccgcaaccgatgaccccacctaagctccggaggccagactcgcaaggatcagcgacagcgctgctgtcacggccttcacgccgagcgacatgcccggctgcgtcgagctccgcggcctcctgacctctcgcatatctgattttgcggttcgatgacgttttttatctcactgacaagttgagagaccttcagtgtactttttcctaattttgctaaggctatgttcgtatggggtggatgggaacttattccctccgcatggaaaacggaacggtctattagcgcgttattaattaagtattggctaattgttttttaaaaaatagattaatttgatttttttaagcaactttcgtatagaaactttttgtaaaaaacacactgtttagctgtttgaaaagcgtgcgcgcggaaaacgagggagatgggttgggaaaaaggagttacaaacacagcctaagcctagctgcggtagcagcggatctgtaaggcccatctagcccaatcaaatatagcccgcacgtgaaccacaatcccgttccggcccaatttatatgcgacttatgggtggctcatataaaacctcgaaatcaactccaaaattaccaaaattaagttttaagatttaaattttggcatcagcattatataatatacacgttatgtagtaaaagacgtggcacgtacgcaaaatgctgtttatctcagacttcactgtaaaatcgccaatgacaccagtatatcacagacatgcacaaattatgcgtacattctaattttctaaagcaccctctattaattgcgataataaggaagttgcaacgcttcaaggcagagcgaaagcgaggcggcaaaatgaactggcaatataaccgtactgaacaggtcgtcttagttattagccgtactgaacaggtcgtcttagttattcttctgcagatgtcacagttaaaagcgatgtggcacaggcatatatctaagtttgaaatacggatctatgaatacaagaaaatgccatcaatagagcaaactcgatggtcgacggatggtagaaacaccaggaagaggaagatgcggatacgacggtaaattttcctcactccgaaagcgtggacttcagctctccactcttctccagctcaagaacgatgtcacagcctccaatcagttctgatttgtagtacagctgagggaacgtgggccagttggagtacgtcttcaagccttgcctaacctcctcgtcggataggatgtcgaacgctccgaagctgactcctgcttgcttcagtgcattcacaaccttcgaactgaagccgcagcggggggcatctggggtgcccttcatgaagagcatcactggggcagaggaaatcagggccttcaggcggtcttctagactttctttcgcaacgatccctttctcagatagaaccttcttaagctccccactcttatgcatctccataacaatgtctgatccgccaaccagttcaccgtttatgtacagttgagggtaactaggccagtttgagagaagctttagaccctgcctaacctcatcatccgtaagaatgtcaaaacttgagaaagggatcttctcttgcttaagaatatgcactagttttccactgaatccacacttgggctcctcaggtgtaccttttataaatgccatcactgtgctgaaattaacaaggctttccaagcgttccttctgagctgcagtaagcaaagctggttcagaaactgcaccactcttctcagtatcaggcttggctttcactgcctcctcgtttttgcttccctgtggctgcagcggaatgttgtgctccttaaaaacatccttcagttcaccgctttcatgcatagcaatcacaatatcacatccaccaagcagctcacctttgcagtagagctgaggaaaagtcggccagtttgagaactttttcattccttcacgtacatcgttatctgttaggatgtcaaagctcccaaattcaactccttcctgcttcaaaacgtcaactacttttcgactgaaaccacaccttggttgctcaggggttcccttcataaataagaagacgggatgggaattgacaagctgctccaatctcttgttcaatgcatcttctgcactactagtggcagaagctccattttgctgtgccatctcttgaaccttttcaagtacagcaggcccagcagccacacccaggctagcaggcacagcagactcagcaacgctggcaggcccagctaactttgcaaccttattggccaagctggctggatttgcaccctccagagtatcaacagttttaccttcctgcaaaccccaaaaaaacaaagacacaaagatgacaacctctttaagtaaaaagcatcatactgatatttcaaataatttgctaacaaatattcagcaatatactaaaggacctatgcatgcaagctttaatagtaataatcatatgatcaggtgcattggttcaagagcacaattcacagctcatactgattgtaagtccatgaattgagagagactgtgtgttacaccatcagacaacacacctcatcagatgtcataagatacattcataaggagtctttagtgcagacagttatggtgcactaaattacacaacaaggtagaatctttactgcacctctaaaaaatggtaacttcactgtaggcagctaatgtcagtggagacaatccaaactcattacttcagggtatatgagcaagcaaatctgatcactattttgtggaataaaaaaattattgcacctctcatcttgttggaagaatacaagctacttattcagcattatagccatactagcattatacaaggctagaactcatccgcatcaagttagtaaggaagagtatcatgatcctaccagaagttattatgcaaaaatatataactatgtgaaatggttcgtgtcagaacaaattatataaaggcagttgcgaataccttcaagaaaacaaaatatggcactgctgtaactccatatgcctctgaaatttcgggttgttcctcagcttcaacctgacaaaagttactagtgtatgagaaaacaaacaagcaaatgatatagaagtcaaattctacaatataatacagtgattaacaattactagagagactaataggaatataagtaatgcccaaagaaaaatagtcacaaagaagagctactgaattataacagtatttattatataacactcagtttgatggtatcactcaatgaaactacagaataatccagtagcaaaacgaatcataattatgtaagggactggaaatatttatattttgtctcatactcttgagtcttgacagatttcagagtccactgagaactcaaaaggttgcaggacatattctagcgctaagagtatggttcctagcacaatagcaactagtcagacatgcagtaagctacaacccaaggtggaataaacagtgaatcggtgctaagcaggaaaatgatcagcgcttaaggatgttacacaactacctcttcaggagttgcattcaaccagtaagtcaaactggataaacaagttggatgggcaatcaaagaattgtacgctaagcaggaaaatggtcagcgcttaaggatgttacacaactacctctttagttagttgcagtaagtcaaactggctctttagttagttgcagtaagtcaaactggataaacaagttggatcggcaatcaaagaagaagaattgtacttgatagttgatacatccctacacaatactatgaagtaaaagaaacaacaccacagttacaaatcaaacacagaagtagagcagcttcaatagcatttatcctacacagaacatcgaagaaataatcactatcaataatttatatactatgggctctatattatggcagaactccaggcagccaggttagtatcaacctctcaaaaacatatacctacttcccagatatataaaagcaaactaattccaaatctactcatgattcttgaaacaagattcacaattcatcatccgaaaaacatctcatatgaatctactaaaacaaatggtaggaaatacagtatgtgaagccaccagcaagcaagtcactgtaaccttccaccaaaatccttaccacaccataaccctaagcgaactaaacagctcaaatctaccgcgatcggggaggacaccagcagtggcacgagcgcacgcacgtacccggaggaagacggcgtgggagaagtcgacggcgaggtgcgcgaagacctcgtccatctgcttggacgcctcgcaccacgccgcccagaagtgcaccgcggcggcccgcgcccctcccgccgccgcctccagctccgccttcgaccccacctccctcaccgccgccatcacgccctcccccctcccctcccttccctcaccggcgacgacgagagatgcagcagcaggcggcggcggcggaggagagatgagaagacgactcgcggcgggggggcttgcggcttggggttttcctctgctttcctttttttttttcggttttttttcttcttcttttttacctcccgtgacgaggtgcgaaggcgacggaagattccagaaggggcgggcggggcggcgggtgggccggaaagtctcctggtatttgggccgcttcgggcccactcgttaggcgagttggacttttttttttttcttttctgagcgagacgcggtggtggggtctcggcgccgccgggagcgcggctgcgggtcgggggagtgaggctataaaaggggtgaaaaaaggggaggggttcacctgatggggaaatggactcgcatggccagaaaccctagcctccatcccctcccgagccttcgccgccgcaagtagatctgagactctctgttttttttccccttttgtatctgaatctctctgagcaatccagcaggatcagatctgtaaggcgtaggagtagtgatctgaaatccgtcagcagtagttgatacatctgggtttttttggttattgttgttttttatgtgatttttgtggtttgtgtgtgagttgggtgaatcaagtggatcgatgatgcttttcaagaaatactgcgttatcttcctgattacatgtgaggctgttgctatcatggccatggcctcctgatgacacaattatcttgctgagatccaagttgcggtaactttgccctcttctttttttcttctcttctgaattttttcatggtttttgggagagattttcgttacttgattacagttctaggaaaaggccaccttgttcaaacagggctttcttgaaagggatcaatttgctaggagtacatgattctaaaagcgatttcgaaataaaacacagttctcgatctcatacctgaaaacaaaaggcccatactgtgtaaactgtgattatgcttctgttaaaatgggatatttgtacaaaattgacgccaatcacctataaacagattgtgagcttttatcttagtaaaataaaatgtgacattctactcagtgttcagtgatccgatgtcgtctcttctgcgtacaacttctaacagccgttttcggtagtacaaactagcgaaacaccaaaaacgcagcatttgagttctggaatacgctgaaattgttagaatcaaccacgaaaccaaaatcattgttcagaaacgttgcaacgagataaaacacaagaacttgttttaacaaagcatacggacagtacatatacggttacaacacccagtctttatacagttctgctggagttccatctactggctgtcattgtatctcaggacagacaggttaacataggtacaacgcaattacaggctaaaccgaagcgaactacactgtcagcatctctaacagtatcgtcaagcaagcttatttacagctgctctagtaaatttacaacgtccctggcagaatccctctcgtttctggcagcgacgaggcacggtccatggccttagcaggacatctcacccgtcagctgcatagaaagcaaccgacttcagtggaatcacctgctcctgcaaaaaagttggttcgatcaatcacgcgtttaatccaaaacaaaatgggtattaattatgctagcctatgaagctacctcagagttctctatttgctctgcagggaaatgaagtccagtggaacagttctcaagcacctcagggctcttcatccatgctttgtgtgcttcaatggctttcagcttatagcgaaacatctgcgatacggatctaaaattaaggatgtcgacaattacttaacacaacaaataattgaagcaggtccagttaaagaaaagtagcagcgaagaatagcactctgaagtctgaacctcagataaagaaatggttggtttttccagttcatctccctcaacatggattccagtaccctggcattctgggcaaaggatggatgttattttcttaggtgcattttttgcctttcttcctcgattgctttttcccttgcttgcaattttgtctgctagcatctcatattggcataaaatagtccagtgcacaaggcaagaagtgtgaaacaaatgaaatgcctgcaaaattagccgtacaaagtcattggaggttgcagcagaatactacaaatttttaaagaagaaactatacactgtctatgttttgcttgaaatgaattcaaccactttgcattatacggtttggaatccctggtttgtgagaactgtaattccattacaacagtgaagaagttaccataactaatgaatggaaattagtcaaatgcctaattttttaggtttgctttaatttatttatctgtgagaaatgctaagcatgtcatgcgttgctatcttcaagaaatactaagaaactgcaaaggcaaagaatgtttgaaataacttaccccgcttgagtttctactgctgcaggctagatttcctgtcttgcagttgagcaaggtagctacatccttttcaagaagcattggtcgcccacaaatatcacaagctttctcagcagcaaggcgcttctgcttacgcaactccctcctcatagatttggtggataagaggccaacttgaagattgtgtgaagtacctgtcggggaacctgttatgatagcttggctattgtcatgggcggagctgctttgctcattcgactcctctgaagatgcttcttgatctgaaaatgacttctttcttctctttccacggtgtccagcatcatcaatcacgaagaaagatccagcagagataggaaggtcctgatcatcagaagaccacttcctgcccaactcaattgtataagagaagttgacaatggcaaagtcagattgctcataggtgtcacactcatccaagccatgggagccatcctgtcctacccaagcacaccagatcttgctaatctttttacttcctttgctagcttcccataacctgtatgcaatatttccatatcccaaaagatgcacaggcataatccgaaacaacatcctttagcaatacactaggaataacgagaggaccgtcagttccactttggtttgacagcacatgatcttcagatacagaagcagttctaccattaccatgcgcatttgcaccacggcgtgtgccttttgcgccattgcgagagctagaatcatctctcaacctcgaagtcacttcagtgtcgttggctggaaccagagccagctctctggtgttctgcgagctcgagtccagcaagagcgggtccttctcgcgcgagttgttgaagaagagcacgccgtcgttgaacggccatggcatgggcccgaacagcgtgaccttagcctccgcgtagcgccgggagtgcaggttccccttcaggtgatcaaacagcacggtgtcgctgaagcactcggtgaggcagatggtgcagaagaagatgacgcgcttgccgacacggcggagctcaacgtaggtgtgcccattctgccggacctccctcagcgtcgccttggcggcaatctcgcggatgtccacggggccgttctttctcaccaccaattccttccccaccatggagaaaccccctcaattcaccaccgaagctcctcctttttccgctattacagatccctactcaaatttcccaccaaaaaaataataatcccccaaatttgctttcaaaccaaactgcttgctgttagcactgcaccacgcatcaaaaaaaaaaagaggaagaaattccagcgttaattggagggaaatttactcaacctaaattcgaacggatccctaatctacacccccaccgctggggctgccaccaccacgccgggggggtcacgatgcggagcggggagggaagagagagacggctaacgaataccttcaattcgagccgggaggcgacggggggcgtcgggaggggcgcggccgcgtcgtcgctccgagcgttctctcgccgccggccatgcgcgcgaggagggggaggtcgggaagaggaagaggaggaggaggaagaggaggaggccaccctcggcgcgcctccgggagtgctcgccggggcgcgggcgcgcgtggggtggggtggggaggcggcgggagatggtcggcggtggcttcgccggggagaggagaggagaggagaggagagaggagatgcgtggagagaagggaaggtgagatgaaggtgaatggtatgggcgggcggctttggtccgtcgttaacttttttttttctctgtggactccgcggggacaatgttgcgtgggaattgggattagtgagttcgaaagatgagtttttggtaatcgaattaagggacacatatgattttgatagaaatataagcgtaaaatagattattgtaaaatataggaaaaaccgtttgattgaaccgcaggaaaaacacagaaattggatgagagagatagactcaaaggaaattaaccaagaggttgaagctcttgctaaatttcctctaaaatctctataggattgtccattccataggaattttaaaggatagaaaatttttttataggattgaaatcccctaaaattcctatatttttcttccaattcaaagagccctaagaataaaaatcgaggaggaaaaggataaacttcttgaaacagtcagtaaactactactactatgcagcaggatatcccgtatgttgttacatatgaccatgtaaagataaatagttttgagaaaagatgcaaagctaaatactctcttcgttttatattgtaagtcgtttgactttttttctagtcaaatttattcaaatttgatcaagtttataaaatgtcgacgtttgataccacgatttcggtatttgcatagtatggggatcgttggtactaggatatatgcgagattgtaatataaaatatggggacgaggatttttatataggttcgggcccctaaattgtgaagcccggtcgttgctcttattcaccataatcacatcagtccaatatttggggtagcctatctatctgttgtcgacttggtggtctgaagtgctgactcatagttgacaatagggtagccttccttctcgaatccgcatccggcgagatcaaagacagcgctatgtctctcctgacagtatccgtagacaccgtatgggacaagccatgcttatctctgaagtcaatatctggcgtcttgtcttggcgtatgttggcttgtatgttgatcttgtgtcttgatctattgttccgtgtcccctctcctcctagggggtcttgtatttatacccataggtgtcctcttgtccaagtagaactaggaaaaccaatatggatacaattcgagtagtccttgtcatttccatatagaaccctattcatccttccttatgcggaactcctcctatatccgaaggttatttccgtataagacatgatatgtggtgagtcctgccgagatctagtcaactactattaggtatgtggtattcataatcctgacataaaaattttttagcaacatataaaatatcaaattatttttattaaatctaacattgaatatattttgataatatatttgttttatgttaaaaatactactatatttttctataaatttagtcaatttgaagaagttagtcttaaaaaaaaaagtcggacggcttataacatgactgaggaaacttaaagacttctatacttgttacatgatgattggggagataatagtttttcaattaaaaattaataaaggtaagagaacaccttgtaattagttaatgctttcgttatttcctgaattttatgagctatctattgggtgaaccatgtaacaagtggttatggcctttctgaagcaaaagccggacttttttattatctaaaataaatacaacgaagaaatgaatgttactccacatgagcagagaccttctagccctccaatgaacgatctaacgatttaagattttttaggatgatgtagtttaatgcatactgatcttttgactttacctgtatatgatagtgggtcaagttgatattcctttttcttaaatcgatcacgtatcgttactgtgctatgatcattttaaaaaaatagttattgttttgtgaaatttactcaaatatagattgccatgtttgggtttcttattgttcatgcacacaacgttttcacactcagcaatgagacacttcaccgacaggtggccccaataccttacttacattacctgatgcacctaactcatgcagaaactctgatcatcatgcgctacgtgagaatcactcccaccccttctttttgcaaatactcgttggttttaattatggttgacaatgttttgaccacaacaaattttaaatgatataataatgttacatcaaagtggtatatttagattcgtaataaaatgtactttactagtaatactgtatttctttttggcgttcgcaaaaaaaaaactgtatatttagagatcaacttttatattatctaaaagaaataaagaatacaactataactatacccatacaattgaaacaaataaggactatatttaccttaaaataaattaatcagtacgaaagcgaccctaacttattcgccaacggaacatttcatggccatataacccagttcaattctgcgatgaactctcacgcggatgcgaatatgccacagggcttctgccgcgacgccgacctccgaattgacacacgagccgcgccgacacgacaccaaccaaccaaacagaacaaaataataataagaataattgagtggagagcagtgcaatgtcacgcaacagatttgtttcgcacgatgtgacccattcaccaccgtgcgctcgtgcgagtcaacaacatggcacagtatttgggagcaaaaattgggcacgggcatatccagattccatagcataattcaagtgaaaattatagagatccaaagggcatatcctaacccagtcctttaatccttctgacactaggggattcccctttgctacgggaattactaagtaattttcaatattatttttcgttacaattcagctaggagtaaaaagaaaaaaaataatcaaatctcagggcttatcaattttttttaatcatgaaagcactttatattaaatattataaaaatgatagagataattgtaaaactattgtggaaatgatgtgaaaggtagcgattgaatatgcttgcatgttaatttatagaactaaatagattgtagatgatcttgcatgcttgcacgaggttgaatatgtaattattgttagtgggtgataatgtggcatggttgcatgttaagctttaaagttagtgggttataactttatagaaagtatagatagctgttgtatctagagatagcgaatcaaaaatattacagtaaaagaaagcaaccaaaaacaggagcctagtactagtacaagaattactatgaggcctggtttagtttccaattttttttcccaaaaacatcacatcgcatctttggacacatgtatatagcattaaatatagattaaaaagaaactaattgcacagttagaggaaaaatcgcgagacaaatcttgttggtgatatgggtccgggggtatcatgtttagagtttggaggctgccccccaatgcctcgtggccctcccccaaggggagtcaggcccgaggtggggtggcggccactctttcccaaagattagtcggaggaggctgtcccccaatgcctcgtggcactcccccaaggggagtcaggcccgaggtggggtggcggccactctttcccaaagactagtcagaggaggctgtcccccgatgccacgtggccctcccccgagggggggagtcaggcccgaggtaaggtggcggccactccttcccagagactggatggaggagactgcccgccgatgccacgtggccctcccccgaggggagtcaggcccgaggtggggcggcggccactcccttgccgagactagagggagaaggctgccccaggcgccacgtagccctcccccgaggggggatcgggcccgaggttgggcggcggccgcccgctcccgtgactaggggtcgggctcccccgaccccctctctaggtcaccatgtacggtgggttaagtgtccgcctccaggtacccacctacccgcatttatggcggcccgagcagtcgcgccacgccgcatttaatgcggtgtgcaatgcactcaaccggtctgtgaccggtcgaatgaccgatgggactggggtagtgcgcctgtgcgctgctcgtgtgtcaggcaacgtgcagcctgacatgtcccatcaaataatgatggtgagaggtcctcatcctcttatcccagccggagtcggtcctcccgctttggtcaaagcaaggctcccatttcccggtgtaataggagcccagaagtcttcacccattaaatggtgactgacaggggcacccccgtgtcaggcggcaagatttgacaggcctcatcatcaagatgacgtgcgcttgcttcctaagtcaagagacaagacatgcatttaatgcaaagattgtaatccttctccgctaagttatgtttttgggcccatgtggtaaccccttgatatataaaaggaggaccttgcccgccgggaaataggacgactcacagaaaacctgaactctaggagaagaagagcgagagtgctctccggagtttaggaacccttgtaacactcaaccataattccaaacacaggagtagggtattacgtttctcagcggcccgaacctgtataaaccccttttgtcttatcatttttaggggattaaaccccctcaagatcacacagcttcgctcaccaagccctcgaatctcatccgctgcccccggccgaactcacaaaggggggcctcacggttccctgatggaggggttcattctccgataaatcttttgagtctaattagtccatgattagccataaatgttacagtaacccatatgtactaatgacgaattaattagacttaaaagattcgtctcgtggtttccaggcttccaggcgagttatgaaattagttttttcattatttgtgtcaaaaaaaactcttccaacatccgatcaaacatcggatgtgacacgtgaaaattttcttttttcgaactaaacatgcccggagtttctctcagtcgttggagccccctgactggcaatcattaacaggtaactggacttactgtgactgccttaaaattaattaaggactggatctcgtctggatcattttcatgttaatgttaggtggggcacatgatctccaacctggagactagcaagccaaaaattttgctgatcatgtcacaacaagcaaaaccagaaaccgagattatagtgtacataacatgcgaaatactacaatttattgaacctgggctatgatccgggcaagagtagatgactatcaggcaggaaggcatgtggaaccgtgtcgaatgagtaacagaagaaatgcagagcattgcagaatggcaagcccttgaaaaatgcttatgcattctccacaccaggcgcaacgtcctcatcaggcacagcgtcgtctgcattctcatcaggctcacctgccctccgatctacaaagtcgtaaccatattcctcctctgaaagattcacctccacagatctgccataaatgaatggtctttggcccattgttgtgaaaggcaatagccccaatgcacgggcggttttaatctctcttgcaaccttacgctgagctttcgcacttatacgagtctgaaaagcagatcaataagttagaaaccatggcaaagcatttatataaatacataattacgtgtgcatttgtgaaacagactcatacagcaaaacatgaaggtataccctaaaaagaactaaacaagataccacaaaagacactacgctgagagttgccgaggagagatggtgctacgtggcaccttaattatgatattgtgttactttagaactaagcactgaaaagaccacgtccaacaagaatcaacaaagatatctcattaacagcatcatcagcaatgcatgaactatacaaacaagacaatatttatgtctagtgatcaaaagttacatttagaatattggaaacctttgagtccctgtgcatgcattgaataaaagttgctatctgaactctggcaatcctttcttatagagaccattctactctgaaaatatcaatttgaaagctatctaaaatagcatgatgaattattaccatacatcaggagtgtcattacccaaatttctattcacagaaaggggaaaagttccttattacctgactcctcttgattataatgccagcttctgtaagaaagttggccagaaatctaacattctgcaaggaacaaccaagtaatcaaaaactgcagctattaatatacaggcaagatcattgtttgttattgtatcattcaaatgtaaaactatgtttgttttttctgcattctgaattgtacattttcaaccatgcacactcgttttacacgttgaaacttgaaatacatgcctacatacatcccaatgatttcgactttgatagttaccgtgttccagtatttgcatccaaatgtcatcttagaataatgtgaggcaataattcaaataagtaggttaacaagcaacatatcaacccactacagtaaactattttagttattgttaaaattcaaacacaacagcggtaaataaaataccagaatctcaaatgttataacttctaggatagaaagtagatcacatgctatcatcatctaagttatgacttcctcaaatgacataccgttcttgaaattagtcacagcataccaccattatgtgttactgaaattcatgctggttaactggctaaacactctatagtttacaagaatacaaggtgacaaagtaatgcaaaacctataattccattaaaagctaaaaaataaactgcagactatttacacagtttgtcaggcagatgtacaaaccctaaaatcggctttctttaaaacctcctctgtagttgtttgaaactgtggcctaggagggttctttgcggctgcaggtcttgtaaggtcaagatcctgcatgcagtagagtgtgataaacatgctgttagaagactcattccactacagtatgtccatggaatgagcaaacagatataaaaaggtaaactaaaattaatactaagagtcacattttctaagttttcaattgtttaggcattagtgtatcataataggaatttctctgttttgacaagcatgtatccagcaaaagatgtaaatttgtgtgtacatatacaacacatcacaacctgttctagctcacaaatttaccgctgagttccagaatacttattcaggataaatgtaatcctaaatagtgcacaaggcatgtgctctttgtatacttcaacaatgatgtgaaaaacagaaatccctcttaccttgacattataagttgagcctcgcctgaaagtcacatctggcctgtaatcatagtcatcgtcctcatactcctccgtcacatgaaaggtgcgggacgcctcatccaacttctcatccaaaccatcttctaaggaatcgaagcccgtgcacaattcagccaagatgctgctagagttacccctgttacggaacccacccctccaaccccagtcagatcctccacggcgattctcaagcccatcatccaagccactcagcatcctcttctcaaattcttccacgctctctcccacccctgcgccggataagccaaccaaaacaagcataagaacactagtactattgggacatcttttttaggcatcaactcctcaaacaatcactagtactgtcatcgcaattgggattttgcacgcgaaagctctacatcaacagcctcatcttttcgcttatgcatatgcatatccgaatcgcttattgtcaacaaaaacataatttatgagtacaacttttatatatgtgttctagctattcaaaagcaaatgctataaaaaaactacaacgaaaaaaaacacaaaatcaactctaaaattaaatttaaaaattaaaaattggcttataagcagcatatgtggctgcaaatctgcgttaaacctacatctccagccactcgattcaacccgatggataactacaacgaaaaatggcgaaggtgtgggcaagcacgaacaactccatccaggtcaggattcgacacaacttatattagggaatatcgcatggagggatccgttcgagaggaattctcgatcaggaggaggaggcggcagggggggggggggttctcaccgtcaccgccaccggacaggaaggagcggcggaaggtcgcggcggcggcggcggaggcgggggacgggggaggggggctcgaagggaggaggcgtcggagggatcgcctcagcgccgagctcgccatctcgccgcgaggtggtgcgccgcgccgccacccgagacaccagcgagaggaggaggaggaggaggtggggactggggagcgggtgatttaggggtttgggatcttttgcgtttgggaccctggagaatctccttattttgtgcggttttgagttgctggttttttttttttgaagtattgagttgctggttctgcttgtacttgttcgcgctcctccctctccggtcacattacgaggttcatcgcttagtctaataaattaaaatttataatttaaaattttgaaaagttgatttttaagatatttttaacggtagcgttggcttttaagtcgctataaacaaatatatgaaacttttacctataaattagtttttattccctaataaaccgttttggtttattagaaaatatgagcaaccaataagactcttttttcctttattttcctagcagactcatcattttgctcacctgctctgtgttgaataatgaattttttactgatatcaattttgtttacaaaatatcttcaaattataaatcatgtaaatttaatccatttgttaaagaaaatattccctccaatctttaatatctgttgttaggataaacaacttttgtataaatagatagttcatgtgtttatcaaagcgtcatatatcaatgaccagaggtacaacatttgattttgggagaactaaaatcagttctccgaagatcgcataaattttataaacggaatatcatgtttccatttcctctatgcaattgtaacaatatgacacaaacgtacaataataatttcattgtgataaactaaataaccaattcgtatacgaatggttacatgcaaattactactacctccattccaaaatacttgtcgttttgagtttttttcataacgttcgatcattcgccttatttataaaattataaaattattatttattttgtttgtgacttgttttattataaaaagtactttaagtataatttattttttttatatttacactaattttttaaataaaacgaatgatccagtgttacatgaaaaaatgtcaaaacggggtagtagcaaattacgcccaaacaaattggcgagagccgagaagaacaaaagtgggttcctttgatccttcaaacccaaaaccgaagaagcgcggggtgcaaaacgcaaaacaagctcgctcctgcgttctccatcgaagcatcatggcggcggcggcggcggcggcgacggcagcgaggatactcgagctggaccccgcgcacccgcgcgccggccgcgtcatcgacgacatcgtgcgtacggagaagcggatcttcccgaagcacgagtccctggcgcggaccttccacgacgagctcaagcgccggaacaccaccctgatctactcagccgcggccgccaccatccccaccactggagacgccgccgccgcctccgacgaggaggaggaggtcgtcgggtacgccatgtacacgtgcgccacctccctctgcgcctccatcaccaagctcgccggtgcggcacacaacaacaaacactcctctcccccctaaaccctctcaatctcttgggggctgattccgtggctgtggttgctgatgcagtgaaggagagccggaggaggcagggccacggcgaggcgctgctgatggccgccgtcgagggctgccggaggaggcgggtccagcgggtgtccctccacgtcgacccggcgagggcggcggcggtggcgctctaccgcaaggccgggttccaggtcgacgccaccgtcgtcggctactacgctccacgcagggatgcgtaccggatgtacatggatctctaggaaaccaaaccaatcagcatttgagcaagaacaaaaaaaaaaaggcttgtgaattgttcaggaaatgcaaatggagcaatatgttcttcgccaattgtgatagggaaatgctacgggacggtatcctgttcgaacgggatgctatctctaaagatcgcctgatacctggtaagtatcggccgataccccgtttggacgagatggtacctttgaggtattatctcgtttgaagtttgaaggataccgttatgtagcattctccattttgatattgagctcaactttgattggattgattgtattgatgcttctaacagtgaggatgatctgaagggagaaaaaaatggtatgaattggtgatctttgatgactgatgattctgcagtttcagctattgtcgctgactgtgaatattgcttaaaagtcagccagttcagttgaaatggtgttgtatgagcttctcctaaaaggagaagttaactcaataagaggctcaggttaatggcaactcttggataaaagcctcttttaacacaccatgagtaacagcagctggttaaatctgactcactgattagaaaccaaattttgcagcagtaaagctggttaattgtcaggcaatgcagtaatccgtgctttgccaattgtgatattgagctcaatttgatcggattggttatatatttatattgatacttctcaattctcacagtgaggatgatatgaatgaaaactttgctagtaagaattggtaatcttggactgatgattctgcagtttcagctattgttgactgtaaatactgatgtagaagtgttagccagttcaactgaaatggtgctatatgagtttctcatgcaaggtgaagctaactcaacgagaggctcaggataatggcaaatcttggataaacctgagtaacagcagctggctaatttgactggcgctaaccagaaaccaaattttggagcagaatcacttgatgcaaatgttggcagagccatcatgtttgtaaacagcaagagcaagctacaacagagctcagaataacagtaacaaacagcactgcctccatttggggcatgcacaagttctctattgacagagccatgtcagatatatacaagctggctttgatatgcttgaagataggacgcatgtaaccactaaataagttctacaacacgaccaggaggtttgtgtctccacaacggttcaggcatttccaagagcttgagtctaagcatggaaatggagaacttgggggcatagcttaatcagaacagagcattggctgaaggccgtcgacgaagcagcgttgcgagtcattttatgtgggaatcataaatactgaagatgacatccggaacaatcagaggcagcttgtttatgtacatgaacagccttctgaggttctctcttgacactgtctccaagtcaaccacatcttggtcctcaacatagatccataagtcaccagggtcagtcttcttcaagttgtcacggcagaatggacaagactgtgatcttgaattcctgcaataacacaatccttttgttcaagcattgttttttgaacagatatgtatggtagctgtatggcaactccagagtacaaggacgtgatccaagttttgctaacccaaaagatatgcatcggttgtaagaagccaagaataaagataaatcatatagatatgtaatatgagaaaacctaatgcacaataccacaaatgattttgttccgcaaacatattgaaacaaagacaaataaattccagatatacacttatacagtatcaatgttcgctaacaagctaggttgctctgcatgattccatgaccctcaacatgattgattagctaaatagttagctacagaaacaacagatcacccatgttttcataatcaggagtcaaataactacacatgattagaaacaggatgcataagaactaagaagcaggaacaaagacaaggtcgatataatcaatagactcaacaaaatgccattctcaaaagatctttggattatgagtagtaggagacagttcagaatatgctttgatttgctaagcacagaatgtataggcttcctacattttacaatagctgaatattcaaaattgtgctgtttactcgcttcataagtatgtatgtgcccgttatatcctgtttagttaagctactgcctactggacattgattcatagcgtcagaaggacttgaacttaagcctctgagcatattggtagggggcatgtcaacctgacattgttagctaatcaacagcaccacgtttgaagggtcctaagcttccatgggaccacgactctcaggggacgtccatggaagaataatacaaaacacatcatctagccaatgttagttaatcaatcacattcatgacagagaaggctgcagttgcacatcaccagaatgcagtcacacaaactacatgcacagaccaagaaattctgcgtaccagtcctggtagcatctgaggcacatattatgggtgcagttgggcaacaccactttgctgttcatctccatgcaaatcccgcactcctcttctctctcggcatcaatttcggataagatgtttctttcatcctcatctctccttctgtacctctccatgcacacggccttctgctttttgtcctccgtatcagtaatccccctttgcagttgcagcagagaaggaaatatcacagctgttccagccaaccatataacaattccaatcaataaaacaatgcaatgaggagaatatctgcataattagaccctcggctaaagttacaagaacatgttacattaccgtagaattctttgatgctggctttcctctcatgggtagacattgtcgtcgtcccgtcgacataaacctacacaatgagctacaatttcagtaagaaaaactccgaaacgcaagcaccgaaccgacaaacatacattgtaacatgccattagaccttgtagacgaggatcctcagcaagccgagagccccggcgaggctgcagtcagtccactgcaccaggaagaggaatatatgcgccgcggggctatacgagagccgcatctgcaggcacgcgccatcgtactcccggggaaattcggaggccctgctcatcagaacaccaagaaataaacaagcaattagcatcactgggtggtggatcacatcacatgtggctggataggcaccctgccccccctctctctgaatcacaccactaaaattctcctccacttttccgcagggaatttagaacgctggattgctggaacacatgggagggagtagtgttctttttaatatgctaaatgagcacgcgacaagatcccttcctgatctgccaccgctcgtgcgctcgctagctcgcggataatgtatcgaacaactgaggagacgcggcagaaatcccaccacctcaccagccaacccgcgcggcgcgccgcgccgcggcgtggttcgattacccaccgatcgatctctcacgccgcaccggcgcggcctcgccgccgccgccgccgcggcagctggaatcgagaggggaagggcgacgggatcgcggtggggaaagccggaggaggaggagggaggagcttacagggtgttggcgtgctggatgtcagcttcgagcaccttgaacgagtccttgtacgccttccgcatcctccaccaccgccaccaccgccaccgtctccaccgccgccgccgacgccgacgccgacgccctccttctcatccaaccccggggcaacccccccgccgcggccggaaccacccaccct

SEQ ID NO: 64089 - DNA, 9609 bp, Oryza sativa
ccttatattatgggacagaggaagtaggaaatcacacgtggtcctgcttctttctttccctttaagttatgtaaagcacaggataatgtcagccagagaccaataaatattactcctgcaatgataatactagtaaaaaaggtaaatcatacatcatattaggaaaagaaatgaggctattaataatggctgaatccctgattagtgccagtctccactggttgttcaggtttgggggtgacaaggacctgacctgtcttgaccactgccactggctgtttggctcaaatcaagagatttttctatattagtgatcagcattagggcctttgccacttttccaggccggcccactttgacttttcaagcccatgccatgcctagaatcttcttgtaccacacataacatattggaattatctgtccttttaaaatattatttggtacattttttatgatggaaataaaatagtagtacatatatggaatatatatgattaagcattatcgtactatgtaacatatagagcatagagcatgtgaaactcaatctaaaaaaatgtggtggaaaactgatgagtaccccaatgatgagggccttttttcttttctttttttttggtaatcgtggttgctgttctgattttcgaagaatagtctttgtttttcgaggaaaagaaataaaaagcacattgagtcacactgcatgcaaggaaccaataattcaattgggtcaatttaaacaagatttgcccacttgtccatatgttgtgcacacacatcacatcacatcgagatggtgggaaatcgattcatgcaaacattaagtgaaaggtcattgagtttggtactctctgctttgttctctctgaagaagaagatatgcaaatgcaagcaagttgaatcatatcaaggattgcacttgtcttctactactgcaccactgtctgcacattctatttgtcccctctagctagatgggctttcactttcaggctaatctgcacctgcaaaatttccataacatcatagccgacaagaaacctcatgccatgcgtatcaatatagttgatgcaaagtttcatgctgaaaaagcacaagtttttatcgtcagcttctgtgctttttagcctgtccatcttgtttcctttcatgtgcagatttagtttacctcttgagacctagattaactttgacgcatcttaatctttacagttagcaacaactgaacagtggccaactctgtgagatgtaaaacaatactcttcttccaaagttcagagttaagatgcaatatgtaaatatgtcttgctgtctgaaagacaatattgctatgctagctagctgcatgctgttgttttcagggttgctttttttatttttctcgtggacgcatgcatgcacttggcattgtccgattccatttggcagtggaattatttgctgtcgatccgtcgatgcattatctgaaagatttagtaatactatcatggagcagattgatcaatcaatcgagtcaaagttttcacctctgaatctccgatgctatcatcaaattgttaaatgcctcttttcctactgatggtgagatgcatgtttcacagtttcagtcttgacctcacctcgattcatcgtcattgctgtcaaaaagatggatcgtcattcagatttcagagactgaattagcagtaattttgtactgctaatgccagaaaacaatcaatttggattagctaatgacagtggcgtgtctttgtgcatctttgggtacagagactgatcgaagtgtcgtgttccattattgaaaaaaatgttgggacagtgggacataaagttgatagcggagcatgctttggtatatatatagtactaaacagtactttcaggattaaggtcgtgtggctgtcgtcaactgatgaagttgctgtcaactgtgtatatatacttttaagatttgccatgattagtgttcatggtattgtccacgtgcatgaaagatcaagcgaccgacaaccagaccaatcgagctttttatccatgcactaagattgacagatgtatacaaaaatgtttggaatgaatggatttcaaatgaaaccatttgaaaccctgtgaattcgtactgaagaaaacaagttgggcgttcaaaagaaagggacacaagagaattattgttgcattggtttcgtatatcagattgaacttatagaactttagctgaagcagtttcagagttggcatgagatggttattcccaattattcagatttcagaattcagacagggggagtataaacatggactgaattcttctactcatccagtgggccggcattttgcaggagcatatatatggactgggccctgtaaactcatgcatgcgtgaggccttaggttgtgttcttttctatgggttgggaacccatctaccgcacgaaaaacggagcagttcattagcatatgattaattaagtattagttattttttttcaggatcaatatgatttttaacaacttttgtatagaaacttttttttttaaaaacgcaacctttagtagtttgaaaagcgtgcgcacggaacacgaggggttgggaacactgaacagaacacagccttagtctgtaatgggccggtgaattggcatttgggctgaagcccatatattgtaagcaacttgtgtttttcttttcttggggaaggtttttgtcttttgtttccattcgatcggccgaggattttcctgagaaattaggcttcggatttaattacatctagtgaacgaaatacttatattcagactaaaaaaagtgcacgtacgttgcaacagggaaaaactaattaatatttatggttaattaaatggccaatttgcttggtactgccgcgaagatcatgaagttgaaaaatatcagcgtatatatgtcattgatacgagggtccagaccccacatgatcgttctcatgtacaatagtatttcataactcacttattttctcagtatgtattttttgataagaattttctcaatatgtatgaaaccattgggatttaatttagacatgtttgcttcattgcagggagcgatcctgccatgtcctcataaacatgtactactacatatttgcatcagagagcttaattggatgtgcatgtgtaggatgctctcctacagtagtttccctaaaagaattggatgtacatttatatgcatatggagccatggagacgagcagattacataaatcgcctattattagctgaaaagaattgagcatatatcttccttttctcaatggaaggcccatcccaaaaaagcccaataaatatctcaacccagtcttggaaaaaagcccgattcagttctctgcttaagcccatcccaaaaactcctattaggataagtggattatacgtagggattttctacgtatgtgcacatatgtcgcgaaattcctaatcagcgattaatcgcgagcgccctccggcgacacgagacacgtgtcgcgcgcggagaggggcggcggactgcgcgtacgtacggtttcccctcccttttttttcctgttttcttctaccgcgcgtgtacagtttccttttttttttttcctttttttctgttttcttccgtattttccttttttttcttttcgtatctttttcattttttcggtttttataatacatacgtatacaaacagagtcggagaactttagggacataaagtgaacttattccgtcaggagattacacgcagcccaatagtgtgggcggcctgggaacggcgcccggcccgacgcgagagaagctggagccatccgatttgatggacggtcctgatttatccagaactatataaaagttcaaccgtccaaaatctaaccctaaaatcattaacgttccccctctgccgctactcctcccccttcccgacggcgccgctccatctccccatcttcctcccgaccgtccttcccttcctcccctctctcacctccatcgcacgacggatccgacgacgttgaccgcggatggatccgaccgcggtggtggcggtcgaggacggatccggcggcggcggttcccgccgacccctctcggctccctcccgcggtggatctaacggcggcggcggcatcggcggcgaccgcatgtgcatctgacagtggtccggtgcaacagcaaatccggcggctgctgctccccatccccggcgtggcgacgcgaccaggagcggcggtgggcttgggagccggtcgtggcggaaagcggcgatgccgacgacgacaatgacaacgacgatgacaacagcgacgacgaggcggctagggttagggtttggattttatttttgatttgggatgttgattttgtggggattgttgattttgatttgggattgcaattgagtgattttgtgattcatgtattttgggaattggggacaaaggtgttgggagcaatcgaccgatttgctcagggattttttttaaagacggatgactcagactcaaacaacaatgacggacgaagcacgtatttttttaagtaggtatatagattttacaagatatttttttgccaggtccgattttttattaagaagaaagggtgcctaaattacaattgtacaacaaacaaggttgttgcggcttcgacactaaacgctttctaatgatagccaggctacagcttcttaattttgcctcgtcaattttctccatccactcatctttgacaagattgacgacagtttccttgacctagaagcaaaacgaacttgtaaaacgaacttgtaagaccaatttgactgggatctttaatcttaaaagctggatgggcatgttcttgcaatcccgtgtccgatgtgatctctgacgataaaaggaagggtgtgtttagttcacctccaactaccctaaattttcaactttccatcacatcacatccaaaactttcctacacacataggctgtgtttagttcacaatgaagtttggaagtttggttaaaattggaactgtcgaggggtgatccactctagcgggagatcgtgagacccccctttcgtgagttcggccgggggaagaagctcgcctatagaaatcacgtatccgtccccaaggctcctagctagctcgtacacaaccaaattatacaggtttgggccgctatcaagcgtaataccctactcctgtgtatgggatttagactgagagttacaagggttcctgatctcgggagaacacttttacttccctcctccacaagctcaggttttctgagagtcgtccactttctcggtgtgcaaggtcctccttttatacctcaaggggataccgcatgcaccgcctctacctactcttctataaggtggggacccaccttatctggactggaactcgacccgtgccttcgcctggaagctaaaccacagcttatccttgagcggggcccagcgccgtccctcgcctgaaacgggggacagccctgtcattccctcattaataggtgaagacttgtggtggccgccgtccgaatgaccccccgatgggacgggtcatacctacctccactccgccggaagcagatgcgacgtgggagcacggttgtccgtccagtcagacgtgaccggcgtcaggccggtcatagacaggtcattcttgaccatcgcgcgtcagtttaacacgccgcacgtctaccccactacattaaatgcaacagggggcagttggggcgctgcgcgcattaaaggaagtttctccacgctactccgcacaccaagcccctcgtcgtttctccgctggtcatcatggctcaagatgccggcgacgcagtgcttccggcatcgcgcattacggcggataggcaccttagtctcccccacaagatcaagccggaagatgccgccgtgagaacgggggagtcgcggccgcggccgcggtacccggagcgatccatgcacctcctgtcctttgctatggcggggttgatcccgccattctccggattcttccatgaggttttggatttctacgaaatccatgtcttgcatctcgcacccaacgccgtgatgacgctagccatcttcgtgcatttgtgcgagatgttcatcggggtgcggccgacgatgcggctattccagtctttcttcgtcccacagctgctgcatggtgcgttggtggggggatgttacttccagccccggccaggcacggcggggcaatacatcgagagttatctccgcaagaaatgggaggactggaagaaggactggttctacaccgcgctgccggaccacccgtgacttcggctccctaccggccctcccgaacgatccgccgcatggctggcggtttcggagctaggcgaggagtatgacgcagtgcgggatcgcctcaggggcctgcgaagcctgggcctcacaggggcaatggtctttggcgactacttccgccgccgcatcgcgcccctccaagatcaagcccgtggcgcgtgggagtacactggacccaatgaccccatgcgcacgcatgtgggcgagcgctgggattggggcgaggaggacatgaagacggtgattcgtcgggtgctgggtctggacactgccgagcaaacactgattccagacgggatccttcccctctgcagcgatcgcgaccgggagagtattctggctgtgatgtcggccgtcggcgccagcaggggtcagtcccgccggggcggcgccgatggtggcgttgtcggcgtgggtagcggcggcgcggccgcaggcgggagtcggaccagtggccccggcgggggtggcagctccagggctcccggcccgagccgcggacccggggtcgactcggccagcgacccgaaagggaagcggaagatgtccgaatcgcgaccgccccctcccccgcgcggagggggcgccgagcgcgtggcggaccgaccgccggcgggccacaagcgccccgccgcgcctgaggctggacggaagaagaagcgactctggaagataggtcaaacggagccgtgtcgggggagcttcatcgagcccccgaagtggactttcaaccgccctccccgcaggtacgactgctggcacccgcttcgatgctttttgctcatctcggtctcttgttccttcctcttctttttctttgttaacgcgatcagggttattctgtagcatgattccttcccaggggatctcggggtccgacccttcgcaggggacaaagtccgaacgaccagagcggcctgggctcggccgatccagggccgcgggaccttcacagcatcccggcggggcccacgggccgcacaccgggtctgccctgggttcaccacagccgggacttgacccgccgcgagcgatagcggcggcaacgtctctcccgggggcgactccgaggcccaggtccatgcggagcgccacccgggagcgggggccgagggaggtcgcggcccggaagccgaggctggaggcggccctgagcccgaggccgaggccgaaactgggggcgggcccgagcccgagcccgaggccgaatctacccgagggcccgaagcggggggtgagagggacagccgctcccccttgcacttggggcgccctcggggctggccacgcagaaggggggctgagagcagcccccagtctggcgggggatccagcagcactccgtcgtcccgggggcgaaccgtaactttttcttctccgactctagccagtatggagccgctcctgcaggtgctcgtcgccgccgattccaccgtccgggaggggctcaactcccaagttcaagccctggcggaagagcaagcggccctggaggcagagtgggcacagctcgctgcggaccgcgcgcgggttgatgaggggcgccgcgccatggacgacatggtaaaggtgggacgcaaaatgcgccaagcccaactggatgaaatccaggcgcgcgagcagacgcgggactccgtcatgcaggagacggaggaagagcggcaggcggcactgattgcctcaagtgtcctggatgaagcgctgggcgacatccgctttgtcacgcacggaaattcactagtaatttccgaaactaatttgtgcataaaatcctcgtccaggaatcagccgaggtacacaaactgacaatttaatatacaaatccatcttaataatgacgttacatacttacaaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacagctccacatcatgtcaccatgtgcctcagtaccaccacggtacctcggaaaggagctgtgacaataccccttgcataacacaactcaccacagtgcatcgttcctggatcataatcaccctcttataaacaaggcatggactccccagcgacccccgtggacttctcgccacttcacagtctggcgcactataatgaatcatgctatacaaacgataaagccgttgcccacgctggcttgtggttggcacggtaaatgtctcacaacagtagctcgcgaaccggtccttaattgccatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacaatacatataaagtaaacaaacatgtagatcatgattttagatgaattt

SEQ ID NO: 64090 - DNA, 1546 bp, Oryza sativa
ttagattctgagaagcagctgtttagtagccaacttttaaaatctaaaaaactctgaaactcagcttctccaacttctagcttcttaattcatttttcagaatatgtaactacagattctcagaaactatggattgtttagaacagcttcggctagctgtaaactgtttagggcagcttatagcagaagcagcttctaggaaaagctatagctgggacaagctcccccacactttctgttcagattctgaccaaatgaccgatcgagttcagcaccatcgccatcgattgtacatcgccatcgagttcagtagcatatcactgcggtgacgtgttttaccgtcgaaagaaagaaaaaatggggtctgatctgaggctgctactttgatttgtacgaacgaatccttgacttcgcagcaccagccctaccaaactggtactctcagcctattttttgactcaagtactgcaagggaggccccagtagtgtggattttctttattcagagggtagaaccaaagtacaaagggaaaattacaagtcattaatccaaaaaaaagtccctctttataggattcaggcgaacggagaggagttggtcattcttgtaaagagtcctccaattttgggccaaaggtgttttgttcttaaaatttttgcaatccctttgttttcaaatatgccactctgcgaagcaagccgtattgctactttctctggcctcctttagcatctcacccagatcaagaggtattccagtgtattgagatcaagctccagcattgcctgctgaatgggcaatcaaaaaataggtgtaggaatgtttccctgtatgttggtcacaaagcacacatgtcaaattactttcttcaggtgcacaattcttcctatcaagcatgtctttggtgttcagcctgtcaactaggagtggccaaccaaacgctttttatcttcattgtacacttggtcttccagatccatttaagtgtggaatctgttgtgtaaacatgaagttccttgcataaactttctgtgaagaatatatatcatttccccaggtatacacccatttatcatactcagagatggggctgtaattgaagtccacaaattgcatatgtggcatctcttggtgtgcttgttccgacaggggtaatgcaaatgccaaatggatgtctttttgtaacgccatagcaattgactccagcattattctataaaaagaaggccaagaaatatcacgattttcaagttcattattttcacaattcctgaccaatctcaagggtgtatacagtatactactgtatagtatgataaaaaaaaacttaatttgtcaacagatggttacctgacaaaagaaaaatgtttcttatggctcatttgaaaaggaaaacccaggaaaggaaatttaacatttctgtcacagataatatagttctggggtcaaaccgaataagcatattctcaagtgaaaatcattaaaatttacctgcaagttgaagaaaataaaaatacatacatcagtttacttgcagtgaacctt

SEQ ID NO: 64091 - DNA, 1131 bp, Oryza sativa
tgaatttggcaatacgatgcatgcattcgctaataggtgctaattaactataaatttctatgtggatattcgatctccaaatatgtatatatatagtccactcatcttaattagcctttttggaatgagttttttaatcagtaaaatttcatgttcaagcagatatgcaaccactgattatcgtggaaatgctaaatgatacatatatgggtcaggatttcttatttcataatagaaatttttattgaactcaccaatataattaggaggatgtaatggaaatatccactacaacgaaaatagttattccaagccgccaaaatgccttttgcagatggatcgccaataagcaaatacctataaaaatcataattttcacatatagatccctaagacgcccacctatgttaatttcatcatgcatctggtaccaaattatgtcaatcaatatatattaggaatctctcctttcattctgtaggtgtttatcacaaacactcaagctctctggtgtgccgcacgcttaaatgcaaaaaccacggcaacacaggtgcggttttcgtttatgcagaccacaagctactagcatcattttcttctctttatatatatagactcaaattacagaactaacagccggcgaaatcactcaaccgagactcacgccacgtgttggaaacgttcaagcagcatgcaatacatgcaactaaccacaggcgcatttgtcttaactaatcttgcatacatatctactgcttcaactgattcacctggctaacttggacctcgatcgtcttgcaccactccacatgcatgcagctctgcttggtcttctgacttgttcatgaacccttttgctccatttgcaccaccgcatctcgtccatgagctgaaaccaaatataccatgcatataaactctaacaatcaaatcctttctcttttggggtgttgatctgtgttgatcaatggttgcatgcatgtctaaaagttactctaatgagaataatttttaatcttttattctggtgggcccaagacacagatatcaagtcacagtttgattggccggccttaattaaatagggtgtcgtgctagtattttttatgatgcggcaagaaattaataaag

SEQ ID NO: 64092 - DNA, 1634 bp, Oryza sativa
tagggttgctaacggcccgagctcaggcaaacctaggtacctaggcccgagcttagcataggtttgagctgagctcaagccgaacttatcatgaccttcatgtaggttcaagctcaagttgggtaaagctcagtcaaactcgagctcggtttacgtgtaggctcatgaataggtagcagaggttttaagcatggtatcttaataaaaaaaatggtttccagctagttaatcaggctaacataaaagaaagaggggctaaggaaatatatcttatcttaactaattaaaaaattcgtaactttctgatcgtcatcttgtttttgtccatgttttcgttcgtcaacatgctaatttttcgtccgtgcatatgagcacatccgatttcgcaaaacaaaaaatcctatctggattgccccagagccccaccaacgcaaataaaaaggataaaatgcattgagaagaggtgacgaactaattcctttgtaaaatccagaagagaaagaagaaccaaaagcaaaattggatatcagcttcaatggcttcatcccaggtcagagaattaattttcgtaattgaaaggtgattgtttataggctaaagcaataagatcttgaattagaactccaacattgtggtatcaaagcttaactttaacctatttaatttcttattcagattattcatgtgattagaagccatcaatgccattttggttcgacatgaacaattttgagtcaaacgagatcaatcggtttcaattttcccaaaatccccaatttgaaagaaccctaagcccccaaatcttaatcaaatccaaatctaattaagaaaattaagtttgagttctgtcatggttatggataccacatacccaatagtaatcgattaatcttggtggggcccaccatatcttatacggaatcatacctcgtatatagaagaaattacggataagtaaggacaagtagagttctctatagaaactacaaggactactcggatcgtatcgatacttgtctctctagttctacttggacaaggggacatttataggtataaatacaagaccccctagaaggagaggggacagaacaacacacagatcgacatacaagtcagaatagacaccaacacatgccgccaaacatcgacatcagagataagcctagacaaatccaatatggtgcctacggaggccgacaagagggatctagcgccatctctaatcacgatgagttcgtactcgagaaggaagactaccctgtcgtcgactacgtgttggttatctatgccgccaagtcggcgacagctaggtatgttatcccaaatattgtacttgtgtgattctaatgaatatagagcaacaccggctttggccaataggagtagggctattacctgtcagataagggtcccgaacctgtataaaatccttgtctccatctcttttacctcaatctcgcatatacccaggtaccgacgatctccatatcatgcaataaccgtagtcgagacctcaaacgtcgacacatgtgatactccaatttctaactactactcttcttgtactgaaacatactaatttttagcgtttaaaatttactaactttccaatctcatatatatatctcgtg

SEQ ID NO: 64093 - DNA, 590 bp, Oryza sativa
gtaaaaatgcatcacacttttagagtggcaaaaaaatccacaacacagttcgacaaatacaaagctaagagcagatatatgggatatccgatatatctaaagtgatgtacccagaaagttatcttaccaagtcaaagttgatggattcaaaagcctcaactagtggcaaaacctgcgcagataatgaaagcaaaatatcaaaagcatacccaacacatcattaatttcacccactgttacagaggagggaataaaaggcaccacaaagagattagttgagaccagctgagtagtgtactccaacataaagattttcctggacgtttgactatctcttaagaaaaaaaaaaaactagatgtcaccaaagcgattaataagcagcgcacaaactcattgttaactcacaatctaatttccattggccagattgctggaaagttgtaacattagcctgaaatcaagtacccaatgaaaaatcctaacttcctgttttctcaaacaaagaaacctatagcctgacacgcttctacatgccacattagcataccatagaaacagagcaattaactatgcaaatatgttatggaac

SEQ ID NO: 64094 - DNA, 31019 bp, Oryza sativa
attttgttacgtcaaatgtaacatgtgaatgccatttttattttaccttttaacctttacagcctcatcatatatagagttgtttgccaatttcttcctctttaccattccttttcttcatcccttctctcctatgagaatgaggaatcgttggttgtagcataagacaaaccaataaaataaaaaaagaggaagatatattactgcatggtaaaatagacaagttagtcaccatcatgcattaggtgactaggtgttactccttggaagcagtattatttataacataaggcaggcctcatcactctcatttgaattgtttagcactagacaagcaaaggctatatatttagtaatcaatagtaaaaggaaaaatgaggaagggaagttggtccaaagaagattactatttgatgaaaaatcacattgagaagtatggcatgagccatagttggcagaggctgtctgaaattttgggttcgattttttcacctctcaccatgcatataaatcattttccaatactatcattcatctaaactgatataatatcatatttgatagaaaagaaaatcggtctattggaaaaagtaatatcattacttcttcagcggctttctgatccatgttgctcatcagaagtcattgtcgttatttctacattcttctggttaggatcaaataacatttattttcgaagattgaaggcatttgcagttactcgagttcagagatttgtccaggtttcttttatgatctcattagtttatcttagtctcaggaaatatgtatggaggtctagtatttccccttaaaataatttggattcttttgtcaactttggacaagctaatgtttttatttggatttaactgatatgatcaaagtgctgtatgccctcttcctggctcattttttacaaataaaaaatattccatccgttttatattataagtcgtttttatttttttaaatcaaatttctttaagtttaaccaagtttattctagaaaactatagcaacaattatagcaccaaattagttttattatatctaacatgaaacatatttggataaattctttgttttgcgttgaaaaaatattactatatttttatttataaatttggtctaatctaaagaagtttgatttataaaaaaaaatcaaaacgacttataatacgaaatgaaggtaatactgtctcttgttgcaatgaggaggttatctttcgatcttctctaaatgaactaagcgatcacagctctaaattttagatgggacggagacgaagatgctcgataaaaataaccgaacaaacacatatagtagcatattaatattaagcacaaaagaacatcaaaaataaaaaaatagagtataattcccgagtcaccaaaccctagctacgagagccaagataggcttatatacacgagcaaaacagttctgtttttgctcatccggttgagcttgtacttcagagcctttgctgctgatcctggtctccgaatcttagcaggccttactggacacactctgcacaagagaaaactctgtttaggaaggtgattgcaaggtaaagattagacgaaaaacattcactgctggggcgtggatggatcccagtgatacaaaatgtgtgtttcctaatgttcaaatgttcagagacggtttttttttttggatagagaggttagttatgtcatcacctgcagcctcctccatcatcagccatgatcatgtggagcagctcaagagcttcttggcttctgttctcatcacacagccccctgagaagaatattgtaggagaagacattggtatgcaaccgagctcgatcattctgcagagcactatgtctattgcgtcgttcgtcctcttgtcggcacagaggcccttgagaagaggattaatggtgatggcttccactctaaatcccttcttgacgacattgcccaaggccgcgaaaccgaggtccaagcggcccgcacggcagcagcagccgatgaggatgccataggtgtgcacggtgggaggagttaccttgccggcgccggctcgggccatgcggttgaagcgggacacagcggccgcggggatgtagcgcgcgacgtcggcgagagcgagcgccgttcaagctgtacatcgaggcgccgctgccttgccggagcaattcgtcgaacacgtggcgtgcgtcctcggcgccaccgccacagactgcaccctccgagcgaggggtcgcgcccacggagcgagggccgccggcggagcgcgctcggctcgagtgggtacgcggcgtgccatggcgcagcctgaaggacatgagtcagcggcagcaaccggcggcagcgctgagtttactcacaccaggaaggagtcggagggaggcaaggaaggaagggaggagctaaccagcgcgcgaaggaatggcgtatgccggtcttgtgttcgcgatggcctccgccgccggcggcgacggcggcggcggcggcgggatgcggtgctgtgtgttttggcttcgcgttttgcgcagagcaatttggatggcaatttcacttgcaaaattatgtttaacggaaaaggttattcttcaaaactttaacctccaatacttcgtaatgcgtaagattacttctcaatccaaatcactgcaactatgtcctgttctaatttgatttgatttgatatttttaagattacactttgatagtggtttcgatatatcgctgaaaaaaaagaaatattttttcttgcagtgaaagcagaggtgcagtgaagtaaccactcctgtcaatggtgattcagcgattcttgcaaaatagtcagtttaaatgttactttgctctgaaaatttagacaaacattcttcctgttacagattgaaaacaggttatcttcatgtttcaatccagctgacacattttttacttgcacaacttcctggttcatagaagtgtatctggcaacgttcaaaacttcaaattatcgaagtactggagtaccttccgttaatttctgggcactgtactttagccatatttgtaatttttcacacaaaagcatccgggaaattaaagattttcttctggttaacttcctaaaagtttgttaaatcgtgcacttgcatacctgcacttattttcattgaagaaacattactgcaactgttatgtacatatagctgtatatctgttttcaaattataccaaactttcaactcagcaagtactttgcatattcaacacaatttctttagacccttcactccaagaaaaacataagcaagagatgatacacatccatctcccttccttactagcaagagagaaaaaaaatgatggtaaaaacccaactagaaattgtaaaaactcatcaaacaaccaggtcaaaagtggtcaaaactcctggtttgtgagccatggtacattggtacataacccacatcaaattcatgtactagagtacctgacttcctttttcttggagtgtgggatgacgattttcggagcatcaacgtgcatttccagagagttgaactccagagccaagataggcttagataacaagaccataacggtatgtttttgcgcatccggttcagctaatacttccgagcctttgctgctgatcttgccatcaggacactcctgtggttcagtaattcttggtctccaaatcttagcaggccttaccgggcgcactctgcacaagagaagactgtttaggaaggtgattgccaggtaaaaatattagaactacagactctagaacaacaacaatgtatttgcttggacataatgcaacaattgtgaaaaaattcactgctggggcatggatggatcacgttcacaggtatataaaacgtgtgtttgatgatgtctagagaggttaggtatgtcatcacctgcattccacttggcaagagtacttgagaagatcaggatggtcctctatctgtccactgaaattcacagtgcatgtcatgttcggttttgagctattcgataaaaggtctctattttcagaaaaaaaaattgtcgctgtaaagaacaccacatatggctacttcagagagtggaggctttggcagttttcttttggaaaacacaaataccctccacttggttttgacctaacctgaagcttggaagagacattctgattgctggacccatccacttgtgtttatgcgaccctgttgacacttttgcatgattagaaagtgaaagaaagcattgaatcaacaaagtgaagctttagtaacttccatttttgagacataaggttaggcagttgctatcctatggccgtgtacacccttgttggtgtagaggccggattttaatccattatccaaaaaaagggagttgctatcctaaagacattttggaattccacatgatatccatttcacaattagaaccctggaaatgaagaatgaagtcatttgacgaatagtagtatgaagaaggtttactaatatagaatttggtagctctaaataagatgcagacttttaaacccaggcagttttagcgaaaagaactaaaggagagtaaggtttttttttttaactccaacagataattcagtcattcagtaaaaaagatcatgcttgttgatgcattaagcagataagtttcaactcaccagtaagcggtacactaatgttgcacaaatgtcttgtacaagagcccttggtctctgagatctcgatctcacggtcattcccttggttggagacagttgagcgcattccaagcaagctcaggaagctgtttgatttaaccaatggcttgtttctaagcgcatcagcttcagtctagcacattcgaacaatgtccaagcaatataaaaagttgtagacggcaaacatttgacaaacctaatcatgcaagtactctaaacatttgacaaaccttatttcccaagtacctgtgagaatgtagcaacatggcttgggagacctacttcctacaggaatgacaatggcactgatcagggtaataatatcaatgcaaatggacatagcatcacaaacaaaccagagaggggatcccggtgtcaccttgcgaccatgccggcaggcttcggcactgttcaccagcactctagcagcccacctgtgaacgaattcagagacttcagaccaaaccagcagagcacacaagaacttttgatcaaataattagatagcatcacaacccatcacacacactcatgtcaagcatcaaccaccaagcaactcatcttaggcatcccccttgggtatggacatctgaaacaaagttcagaaaagtagcaagtttgcaaattttatccatttttcagctgtctgaaaaacccacacttcccacatgcacatattccttcccaataaaaattgtcatcttttttttttcctgcaacttggccgtaccatacggagcaagtacaggggaatcgaatcgaatcatgcaaacacccaataattaaaagggtgcagcaaaaggagagcccatatgcaaagccctgtgctcaagtacaatcaacactaatcaagacgcgtttttttattggcttttttgagggactcgatcactcgaacctgccgcaatgcaaagctcggggattattttccccctaatctaatgcaacttggccaagaactccacccaatcaggcaagggcaaaagcactagcggtggactcgattaaactaggccaaaaagacgcagcaatctcggcgactcacgcgcaggaggtcggcgggttccacacgatgccggcgatcaccacgagctgcaaggagagacagcgagaaatccgatcaagaaattaacggagcgagagagggacagatcgccggagaaggagaaggcgagacgagacctcgtcgaacttgccggcggggctgtcgtcgtagcgggcgaggaacatgccgccgagggtgtagccgaaggcctccacgaggcggagctccctgggcacgaacgcccgcgccgtcgccgccttcaccaaatgcagctggtacaatgccctgccatagttgccattgcccccaaccatcaaatcaagaatcaatcaaacggaggatgagatcgcgatagagagagccttgcttgcctgcccctgaacacccatggcggcccgcgcccgtaccctgcagcagcagcagcctcctctctgccactgccagccgccatggatggccactgactcaacacacttcctcggctgcctctgcaagaatgcagctactgctactactagtctactaccaccaccaagaaaggcacagtgggggagtggattgcaataataaaatagtagatgcaaggaaggagatggatggatcgggaaggaggagaaggtgatgaatgatgatgcactgcctgatgctgggatgcaagattgcaaaggtaaggagttgtttaaacaagtttttttattcttcttctttttttttttttttttggtttgatggtttgtgcaaggagatcccaaaaccttatccggtgtacagggagcacacgcggcaatagtttagaggatgggggatccgtgagggccccatccatggctttgtgataatccatggtgttttaacttcgattgactctcgtatagcacttaggctgtgtttaattcgtgtgcaaaaatttttttaaggatatggacacacatttgaagtattaaatgtaaactaatactaaaacaaattacagattacgcctgtaaattgcgagatgaatttattaagcctaactaatctatcattagcaaatgtttactgtagcatcgcattgtcaaatcatagcgtaattagtcttaaaagattcgtcttgtgatttacatgcaaattgtgtaattgattttttttttcatatttaatgctccatgtatgtgtccaaacatttgatgtgacggaaaagttggaagtttgaagaaaaaattttgaatctaaacacggccttactccatcaattccaaaatagatgtcgttgtgacgttttgatttttcttttcttgcaatatttgaccattcatcttatttagaaaaattagtgcaaatataaaaatataagtcataagacacaaacaaaacaaataataattccctaatcttttgaataagacgaatgatcaaatattacgaaaaaaacttaaaacgacaagtatattgggatggaggtagcactagttgttgacttttaagacaaacaaatttgaattgtataactttttaagatgattttggagtttttttctttagagtctattttacaacattatcttttaaattgctaataactcgatataaaagataccaataaattaactatgatagcttctttcatcgttacctggcttatcagcatagctaaaatgatcggctcctttgaaaacacagcaatacaggaaatacactaatatgacatgaattcatgtactacctcggtggacaaatataagtactccaagcgattgaattttttggctttatacatctggttggatgtagagtccgggtttactcgttttctaaaaaaaggattgaaatttgtctacaaatataatattctaaagtacctatcattcaaatttatttttatcttattcctatcaccagtcaaaggataattttccaatgcttttcctctactccttttcttttcataaacttgttaactagtaaaaatttcaaaacgtcttctaatatgaaatggaaggagcatttgcgccttgccagtaggggtggaaaaaaaagcttgggctcgtgagctcagctcgggcttggctcgagctcgcttagctcggctcggcatgaatgccaaacgagccaagcccaagcctccttttcaactcgtttctgaaatgagccgagcctgatttggctcgtgagcctaggccatcatgtatctatatggatgattttattttctagtggagttattatttgttaatatataatttattatctatattttgatgaattgaatatataaagttattttaattttacatgttgatgatttgttattgcttttcttaatgattacaaattatatagcttcaacggaaggctcacaagccagcttgagctggctcgagccaggaaacgagctgagccgagctcatgttttagctcgtttccctaaccgagccgagccaaaccaagcctagcttgttgcgagccatggcaagccgagccaagccattggctcatttccacccctacttgccagaacgtttctgaagaaaaaaatgtatcgcaacgtatagcaaaatactagagtcagattgtctgatttcccggggacaaaatcacaggtaaacagcagcacacactcaaaaagatagtgagagagaaccacaaatactgtaaagcaagcactattattagcgtggaagttactgttttagggccactctacaatcatactgcctgtagtatactattatcctgttccatttatcctctgttggacggttttgcttctcttgaattgcctctttgcagatcaactcataataatccaaatccaaaacaatctttgcagatcaactcataataatccaaatccaaaacaaccagcatgtttttgcaaacgagaggcaggtctcaattggcgggagcacgagcacttcctgacaagaaataaatttgtaaatgttttatgacttcggcagaatattcattctccctcggtgcagcaggccaagaagatgttccctgcaaattcatgaaaagtccaaggaaaaatagaagtaggattagcattttaacaaacaaatttcaggggatggttccatgctagaacaatagtaccaaataagtatccctttcctcacaaaaaaaagtattcctttcaatctcctaatgctgagggaaagctttagaaattcttcaacacaatactttttccttacccaaaaaaaagagaaaaatatgtatgacgataagaatcttttttctttccagacccaacaaaacatggccgaaggagcttgcacaaccattgataatttcatcagaagttcagaacctttgcaacaacccttgttctataggatttacagttattatctgtcgctcaaagcaccaggtgctaaaaaccattggcccagattatagaagctagcaaatcatgctgtcatgctttctgccatgtttaagcaaggtagctatcatgatactgcagtcccagaatcaatctcaaaaccagttgagcacaggttgaggttgccaattgtcaaacatctggagcacttcatgaacactagtatctagtagtattattctttttttacaaagttcttctagaataactctgtacatgacgatatccagttaattcctaaagcagcaaatatctggtactcttcatctttgtagccaccgagccagttgtgagaccaaattggggattaaaaattggtgcgagcagcttagacagttcaccttacagtgtaatgttttttattttttccctttttttttgttttttcccctccaacctaatgttcacaatgcaaccttgtcttccacaatttccattaatgagatggctacaaggtagagccacctctacctttttacgtcaaaaatagtcagtttagtacaaaaagcatttcttcatcaaacatttcaagtttaccatatgcacatagtattaatatgttggagatatgatgatccagtagaatatcattttatacaacaagatcttgttccacaatgtttttttttggataattaaatactgcatttgttgaataacaatacttctatcatttcttcagtgcggagaaaggcaaactagtatagacccaacagtattcataattgaactcatgaaaccctcttgattgaaaccttgctatttatgcatacagagaaaagaaccctccactagcaggattgtagcagacaagaattccaattcagaatttcgtagctgcaaaaatcttcagcggttccaatattctataaatacttgtacttttcaggggaaaacctatgatattcttggtgtttgcctccagaaaaaaagatctataaaacagggaaacagaccatgctttgagagagaagtgcttatcatcagtcatggagaggtaagcaccagctctgcttagtgcacctctgtgaaacagtctgctaactatgctatttatcatacaggggaatctttgtcactgcaagtttagcagataataaattagttctaacaaagctacaaaaagtagcaaaattagagaactataatatcatctgggaatttttcttcgaagggaatcagatatagtgtgacaaaaaaaagggcagtttgtacctagcaatccacatgtaacagataaaggtgatccccaaacatagagtggtccagaatttcttgtttgtattactaattcagtgagaaggccaacaatagccagttacaactgcataactgtaggccatttcaaacaggatggatttcacttcagagcaaaacttttcagggagaaattccgtatgtttgattgaatttcctgcttgaaatcagcaaaatcagcaaatcaacagtcgaagcttcaacggggaggttattttgatcaattttggacatgtaaaccccagcactgcctagtgcctacttcccctttttgaagtaactttgtaactctgcaatttagcatgcaggagtcgacacagtactacagtcattgtcctccattgaaagaaatagatcatccaattcttctagcaacccctgttctataagatcttttttgccacttttgataatctgtacatagaattcttttgcagtagcagttcttcctgtacgaaataaaccttgcagcattatgttatatgtgataaaattaggactaacaccattgctcaccatctcttggaaaagtgctaaagcattctccatcctagtaattttacagtagccattaatcaaagtgctatacgtaacacaattaggtttcaatccttgctgcctcattttgctaaatacaagcatggcctcatctacttttccttgcttggcggatgcatatattagtgtgttgaagacataatgatcgggttgcatatcactttgtaccatcaaatcaaagagaccatgcatctcaacaagagctccttcgatagcatacccatgaagtaagctactgtaggtagtaatatcaggctttaggcccctcttgaccatagaatcaaaaatctttctagcttctgtgcatcttccgttcttgcagagatagtccataaacgagctataagtaacaacatttggttcaacaccattgctgcacatcttttctagaaatttaatagcctctgtcaactgccctgaagagcaaaatccatgcacaagactagtatacgtgaagcaattgggtgtaactccattcttaaccatcctatcgtgtacctccatggccttgtccattgcttgacccttgcatagggcagcaataatggagctgtaaatcacaacatttggcaaaatcctccggtcaagcatttcacggtatgtagcgtaggctttgtccggatcccctcctttcaagaggccatcgatgacggtgctgtatgacacaacattaggtaagcagcctcctccatcatcagccatcatgtggagcagctcgagagcttcttggcttctgttctcatgacagagtcccttgagaataatggtgtgggagaagacatttggcacgcagctgagctcggtcattccacggagcactatgtccattgcgtcgtccgtcctcttgtctgcacagaggcccttgagcagaggattaaagatgatgggttccactctgaatcccttcttaacgacatggcccaaggccgcgaaaccgaggtctaagcggcccgcactgcagcagcagccgatgaggatgccataggtgtgcacggtgggagttaccatgctggcaccagctcgtgccatgcggttgaagcgggacacagcggccgcggggttgtcgcgcgcgacgtcggcgagagcgccgttcaagctgcggatcggagcgccgatgcctcgccggagcaattcgtcgaacacgtcgagtgcgtcctcggcgccaccgctcccaacgcgtgctcggtcttggatcgtaccctccgagcgcgggacgccgccggcgcgggcgcgggcgcgggcagcgacgcggcgtgccatgtccggcctgacggacgggcaaggaaaggtggaaacctgcggcagcgctgaataaatcaccccgtggtttactaggaaactaggaaccagaggcaaaggaaggtggaactaaccagcgcgcgaaggaatggcgaacggatcagctgctggcggcggcggaggggcggcctcgacggcgacggccgacgagcgcggctgcacgggtgcgtccgttcgagcagttggcttcgcgaaaggcgcgggaagaagacgacgagaagagatcaatcagatcagcgtcttatttgttctttttttttttcttttttcggtttcacatacatcttgcttcaacgagtattacttgatttggggttactcttttttttttctatatgggaagcatgtttttatattccttaagttactttttttttctagctacgagtggcatgtttttacttgttttttttatactgcaaatatttccaactttctttgttgctaatgtggcataataatatttcacttgcaaaattttctcaattttttcatagactaaaaaaatgcccgtgcattacaatgggtaaagtctattttaatcttgttattattatatggtttagttaaaatgaaattcactatggagttcgcttggatatatatttttttataaaatcatgagctgcagttagaagtccgatcgtttaagttagcatgcgagttttttttaaacagatttcttatatgattctttctgtattgccaaaagtgaacaatgttaaaaaccgactcaaatacggatatgtatttctaaaagcaaacgaatttaaaaaccgtctcgtacccggatgacgtacgaaaataccagtaaaaatattttcaatttttataatagtagagaaaaatgatgccaacgagaatgtcactcttcggtctctctgcttcctatccctactcatcaatccaaattactgcatctccgtcgtgttttagtttctttttaaaatattccactttgatcacttgtttctcacaaaacatgtcctcaactattctaaactgaatcacaatttagaatttttcactacagcatgaaaactcaaatgcttatttatttggaaggcatatccaaaaagtctcagtttgttcatcagcaccaggccaaggcagagacaaatacttcagagttcagagttcaaaacgcttcaaaacaaacactccaaaatgttttcagaacaaggatgcaggcatgcacaacgatccatcgatcgatcgccgcaacagaaaaaaaaaaaagaactctttcttggcgtcgccgcggcagcggccttcactgcagctgctcgcggaacaccgtgagcacgtcggcgaacgtgacgatcccggcgaggcggcagtcgtcgtcctcgtcgagcacccacaggtagctggcgcggtgggcgagcgcctgcatcatcacggccaccagcgagctcgccgggctgcacaccaccggctcctccgtcgagcggcgcccgtagctccccgacgacggccgcctcagccgcgcggcgcggccgtgggcctcgtcgtcggaggacgacgaggtggaggaggaggagaacgcgaaggaggacaccgcctcgttctccaccagctcgagcatggcgtcgaggcccttgctcttcagcccggccttgaccgcgcgaaggatgtgctccggcggcgcgccgaagtagtcgacgtacgccatgaggtcggccaccgacagcgtcgcgatggccgcggccgccgtctcgtcgcaggacgcgaggagcgcgggggagatctcgccgacgaggtggccgccgtcgtcgacgacggcgaccgcggtctccgtggcgatggcgcggcggaggaggggcacggcggacagggctgcctcgtggggccgcaccgtgaggaggtcgtcggcgcgcacgaggccgagggaggagacggagcggccggcgacatgggagaagagggagatggagttgaggaagtagcggacgaggtcctcctgcgtcaaccagcagtagtcgccgccgccgccgccaccgccgccgccgccgagctgcttcctccggccgccggagcggagagggacggcgagcacctgcgcgccgctcaagacggcatcaagcgcctccaacacactgcaaagaacaacaccacattgattaattaaaaaatcacagtaattatactagtcaaagatttagttcatcaagatcctactattatccccaaataaaatttctaagatccaagtattattgcgccatctttgaaccacacaacgacgaaagaacagggaaaagatctcctggacttggtacgaggcgagctggaggcagctgaatcctatcaggaatggagcaaaacgacatggatgcaggtctcaatctctggtgcgccacgcagatcgccaccacaagattgtcccgatgagtcggacgatttgacccggatcgggcgcctttttctaaaccaagattacagccacttgttccaaacgccttcgtgttcgcatattccaatcggggatcaaaatttcaagtgctagtcactttgatcaaggaatatccgggatcaactgaatgtctcgtctttttctcacaaatcgcctcaatagtcaaagatcacagttttcttaactcgaaaaagtaaaatgtcatcatttaataatcgttttattccccaaactattatagaattttaatttttaccactaactcgtactagaaaaataccataaagatctacatcgtttattcattttattagagcaaataggaaagcatttgcgtatcctttaagcatctcaaccattttttaatcgaagattttagcggggattttggcctaaatcgcgttctttgcaacctaaacaacaacaaaatcatcaaagacgcgtcgtgtcccaaaaatctaaaaacaaatcggaacagggcgaaaagtgaagcgggggattttttttctttttacctggcgcgggggtcgacgcggcggacctcgccggcgccgtccttggggaggagcgcggaggcgggcttggagagcgcggcggtggggtgggcgagcgcgcccggcgcggcgcagaggaagcagagcacgtcggcgagcccgagcctccccgcgacggcgcgcccggggccgacgacggcgacgcacgcggccgcccctcccgctgcctgctgcggtcccctcctgagcgccgcggccaggtccccggcggcggcggagagcgggagcgacctcaccgccggcttgccgatgcacaggtccgacacctcattagccagtaggcgcactgccatgcactcgcggggcgaacccttgtcggtttcgagatcgaaaccctcacaaacgatgtcgaggaggaagaagagagacgagacgagacgaggttttttttgcaacggaaatcgcggaggaggaagaagacgagacgagacgggattttttttttgctttttttcgcttccgccgatttggcttggctttaaccgtggagcgggatgggaggcatatatataggctttgggggtggccgctacgcggttgggttcacgcgtggctcgatgacaggtggggcccggttttgtggggaccactcggcagtgggaggtggggggttacacgggtggtttggtttaatggttacccgttgtttttactctgtgctggtttgcgcgcggctcgggcctggtttctagaatcggctcaagccaagccgatctgagctggaaccgtaactccgtgtctccgtgagacggttatgttgtttgcagtttgctttgttttggcattgttcttacagtggtaaataagcgccctccacttcgagatatgatttttttggctctttatatatatatatatatatatatacaaatgtaaaaccaagaaaaataaaatatttttaccttatcaaattccaatggaattattattcattttatatactcatagtacatttagcccctagtttcataaactccggtacaataattacttaaagataaatttattttggaataaatgggatgggttaaaaatgttattatgagatacaggatgacagatcatcgaactaagatttttttagtggacaaactaagattattaaaagcactaaagcagtaaataaatccataatccattgtttacaagagccattatatttgcaaccaagtcacagactcacggtgaaaggaaaaaaaaaaggcaagaagccatgaagtgtgcagcacgaattgccagcaagaatgtcaactgtcaccagcttaacaacgggatgttgtgaaaaacgttgggaagttaattgtgcttactaaaagaactttgacctaatggtgtatgattatcttcttcactatcatgcaatgggtgcaatgctagctgcttcagaggggaagaatatatttcacaatagatgtatggaacatatagatccaatgctagctgtaacttgacaatatgataaatccaattgtgcctccagagttggtacacaggtcagaggagattcaattggaacctgaaaaatagtgcaaatgcatgaactagtaccgaatttgtttttaaaaaaaaaaacagaacaggagtaaccgccatgtgggatcattttgtaattatggtagatctcagatttgttttactaaacttttaattttgtcttgtttggttggctcgctcagccgccaccgctgatgtgctgaacaacactttggtcgaaacaggcagcagcaaagaggtttctgctcggtttaggctacgctttttgaccattccgtttgaccacttgcttcggtttccagcttggcggtagtagcatgctgggttttcttttatagtttttaaatggttattttgcaaacgtgtttccaaaaccaaattcttgtcacatcaatattgcttgcgcaatattttgactaagtattattttcatattttggacatttagaattcagtttgaccaaagtaggacaacaaccattatatatttttgtccgttcataccacatgatcattttcctctatctttacaaacctagtggatatttcggatattaggatagaactgtaaccttttacatgtggaagctttatcagaaatcttttacatgtggaagctttatcagaaatccactaaaacgatgtgctacgaacggaggatgattatggattatccacatgataaattggtatagttttcgtagagtaaagttaactattgtaatataagtccaagcaatcttcattcaagtgttcatccagcctcctcataggctcctagttactactccagtctccatcacgtcttcatgaacttgcattctctattgcccaaatttgacgagatggtttcccaaatttgacaagatggttggtgcagcaccaagtggttagatccatgcgtgacaaggactttctttgaatttttgcaccatttttctaatctaataaactatttcattcgaattttctttctttcattttccagtgtaaccatcatgtttttttagcatcatcttcttcttgttggcttcttccatgaaaagggaacacattaattcataaagatcaaggcagtataactactagctcgttcgttcgtacatgtggttgtaccataaatacgttccatcaagagattgggaggcttggataatcaaccccttttaaagacaaaaatgtgacacatgagctgatcacaacatgaaagcgacaaaaggaaaaaaggttacataaacctactacctccgttccaaaataggtgcagctttctagtttaaattttaactacagtgcggcacctatgttgggacggagagagtatttgattctatcacaaaattattatctttccccaactaaagtctttttccctgtttataattatcgactagttagcaatatctagtgttaaaattgatcgtgaatcacttaattgcaatacataaatggttaatggtattctccaaagcttcccaaatctaatcatttgcacaatggttttgtaggtgttatatgtcttccattaattaatggagaaaatgaaaatactatgcccatctcgtctacataacattcatgacattttcagttctagaaaaaaaaagacgacgctattgttgttgagcctcgcacagttgatcttgttacggctacgtgaacatgcttagcacgtcgattgtctactaactcatctaggaatatacatgtagcaccatactgttatagtggaattgatcaattgaagtacaatctctttggttaatatattgctcttaactgcgctggcaaatcagcattctaacatgtgaaaaacgctctccatttcggtgaggtcatttttaattactcttccggtttagtactatactccagtccagccagagcccgccgccgcagccatctccagaaccttccctgtttgcgcgttaaagcgaaaataaaaagataaacgttacaggtagtagtagtgaaaaggtgggtttcctctcaaccagaaggagccgaaaggcagaaagaaccctggctcgagccgtgaagccgatctgggccgagccggtttggttggcagaagaacgtgtaggcgacgtggcacccggccccaccacgtggacgcatgctgtacgcgtgggcccatgcggaccttccgtgccacggactccgggatcttctgcggccacagccgcgatcaggttgcggccacttcagctgcttctccagctcagctgcagcctgcatgccagattgccaatctgccgctgctgcactgcaatttgtctgatgaaaccttcgctatctgccaccgtgccactgtctgaaccagctggcaaaagagcacaactagtactagtagttcgtacacataacctgatttttcaatgacgagtcatgacaggcagacatggcctgtgtgtgtgtgtcttggggtgtccgtgcacgtagaacacagcttctcgccgtgcgaaaggccacttttagagcaagtgtggaggctgtaaggcccctgtttagatgagactaaaacttttaagtccctatcacatcggatgtttaaaaattaattataaatattaaacgtagactattaataaaacctatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtttatatttaatactctaaattagtgtctaaagacagggactaaagttaagtccctggatgtaaacaccacctaagttagctaaatgctgaggtgcaagagagaagagagagaaggagcaaactataaactaacttacagctggcttaaacataagaaccaaaaaaatcatgtaagagagacaagtggactatatattaattgtaaatagctaattataatatatatgagataagaaaagactgcaaatattacagtcaacaagtctgttatattattagccttgctcttatgagaccgcaacagtagtctgaatctacgtactatcgtgttattattatcttccgatctgaactgaaagaaacccgtcatctacccaacaaaaaatgaactaatctggtggtacgagtgggcgcgcgcgcgcgtgcggtcaaagtgtcaaacacggcaagcaccagttgctgctccctctcgtggactcgcggtctctcgcgcgcgcgccgaagaggaaactccttccacgcgagcgagccgcagtttcccttccccccgtggtgattatccacatccgccaccacgaggcggcgcgagcgacagcggcagcggatgcccttttttccgccgtggcgtcgcgggtgtgatccgctgatgtggcgccgcgcgtcgcggccagagtgcgcggtggcggcgtggcgctcgcatgctgtcacggtcgttggttgctttggctgattcattttcaggtgagcgcgccgcccgtgccaccgtatggtggtggtggtggtacgcgcgcgcgtgatatgtttggctttcgtccgcttcttcggcggcaagccgatggatgcatgggcgcctctcctgttcagcttagctctgcttaccacgtttttatttgacgaatccgcacgaaaaaaaatagttttatcctatagagtagaagtaaaacatatttaaggaaagcaaaaaggaaaaaaaaaaagactatacaagagtctcgaaggacaatatcgcactaggggaacatttccatgagtctcttttccgtagtatttctgttgaaacaatatgtctgtgtaagttatgatataattggaatatgtctgtataagttacaagagcctcagtagcatcttacgtcccaggttcgactccctataggactccaggatggatttacggggtgagtgtgtaattctcaaatgttcgactccctatgagagtccaggatggatttacgggggtgagtgtgtaattctctaaaaaagaaaagttaggatacaattattttttaaagtttggaattttttttatgtttatagagggtaaaaacatatcagttttgaaaacctcataatttacggtaatcgtgattttgcacgataatggtaactcccaccgaaaggtaagaacacctgtgagatatgcctatgggagtgcaggatggatttacggggtgagtgtgtaattctcaaaaaagaaaagttaggatacaattattttttgaagtttggtatttttttatgtttatggagggtaaaatcatgattttacccgataatggtagtaactcccataagaacacccgtgagatatggctagctgtcctggtgaagtgggtggaggatattgggagaagcaggagagtttgttggatcgggagaacgggggcgatccctaattccctatagttcctactgctgttatcggatttttcccaatatgctgctgtaagcctgtaacgagctggcttaggcgattagctacctgattttgtccttttgttcgagtaagtttacgtagacgtggttaatccatgaaaccacacctacgaacggacaggtggaccacatgcacgtagcgctgtcagtggttcacgcccgtttggaccggtataatttacagaggaggatcggattaattatttacagaagttactctggttccaattaaattttacaaaaatcaccggaggagagatcgatgagaaaattgctacgcatttgatccaattgtccggctcatatacgattaagtttgatcaatgactaccgtgcatataaacatctacttaattaattgatctccgtttgagcaaaggccataatattttatttcattataaaaaaaattaattgatttttttacgctttagttatacattagttttacaactaaactatgtataaaggttagtgctttgttgttgagtatcacccaatttagttgcacgatccgactaaaggcatacaaccatggatcaataaagattcttttgaaacataagatctgtgaagaaatttgtaggatttaaatgatcgtatatataggatttaaataatcaatagtaacaccaatgggagaacggacttgtctaacatggataggtaactactcagccaaaacagccaggaacaaccaccctgcaaacaccatggcagcaaattaaaactcgtgtggtccgatcctttggccgattcaagcaccggaagaataattgcttcaggatcaggagacaaagccacggcactgctgcactgatgcacagtgccatactgccattgccatgcatgtcagctgctactcactttgttggcacgcggccggcgagaaaaagatcccgtcccgatacagagaagaagaggaccgatacagagaagaagaggacgggttggctcccgtacgaacgaacgtagtactacgtggtggtctcccggcctccgaaatggttggcacgcagcagtgctgccttgggcggtgacatgacagccgctgcaagccacgatccctcacatggaacgcgacaggtggtgaaaccatgtagtaccagctgatgcatatctgaaggactcagctacagcctagtgcaggatatgcatgctggctgtgaggctgtgtttatttcatgccaaaatttgaagttgggttaaaattagaacgatgtgacggagaagttgaaagtttgtgtgtaggaaagttttggtgtgatgaaaaagttaaaagtttaaaaaaaaactttggatctaaacacggccgagtgaagtgagtgaagagagtggtgtggttgttggtgccgtttggattttttttttgtgagtgtgaggatgcatgcaaatgcaatgcagcaatggaaatggaatctgtagctctcctactaactgccaagagagagaggggtgtggtgtgtggtcctagatagctttggtgtaggacagtacaaggagtacaatgcatgttgctaccatgttgccctctgccactgtttgtttcggttttgcaatgattgaatggttgagcaatgggggcagttatatagggcgtgattgatccagatgctcgcttatcatatctctctaatggtaggagtagtactttattatctttgtcatggaggaaacgaaccaaccatgacgcggtcaagggcatcgtatgttttctattcgacgagacgatgccggccggcaaatctccgtttcttgggatgccatcgcccatcgctgggttacactgttttttccccctctactgtgaacccatacctctcctgcgtacgatcgcgccgtgctgtcgcgtatggcaaaccatcctgagacggccgcacgcgtgcagactgagatcatgtcacttaagtcacccgactttagagccactaaggcaatgtatgagaaatgtccatgggtttttcggctatctttacaaggtggtgggctagatgatctgggttctgagccttactccttctaattatttgatattaggcccttccctaatattcgagttttttactaaggcaatgtataacgctccactctgccctgtggtctcacggcttcacgtcggagccaagctgagctggcagtcgagctcgtggttccgtaggccggagcggttcttgcagagggaacggttgaagcgccggcctaggatcgggagccgcgaagccacgactcgaggactttgcgatggatgagcccggagcccagtgcatcacatcgtccggttggtccccccatgcacctaccctaagtccccatctcgtcgtggtcgttgtcgccgctcattgccgccgttgtggtcgcgtcgcctctcaccagatccgccaccaccgctgctccccgttgccaccagatccagcgagctcgtggtcggatctggtgagctcatggtcggatccgccgccgccggtggcccctcaccgttgcgagaagggggtgggaggggagaggccagccgatgcgacgctcgcgaagaagggagggggagaggccggcgagctcgcggctagatcctccatcgccgtggggatctgccattgctcgtgaaagaggaaggggagaggaaccgccgccaccgttgtggctgtgttgccgcttgctggcaaatccgccgccgttgtggcccgcgccgctagatccggcgagcacgaggctggatccgagacgcccaactctctctcatcgccggagagctcgagcgccgctgatcccgtcgctctctgcctcgcctagagtaaaggagagggggatggggagagggactaggagggaaggggtctcatcggcggggttgactgggagaaggagagcgccggtggtctcggtggagaaaaagaacgcgaggatggcgagagggctcgggagagagagagaaagaggggggagacagaggaaataaaaaggaggcggaagagactgacagtgggtccgcatgatgtttaggggtgtatatgtacttcttttggtttataaggtccaaaatataaagttttaatagatttgataataagatacaccataagggctgacatatatatagatgtgggctaaaatgtaaaatacgttttggagtggattccactgtggtttgtgtcatcatctttatgtggttctgtcctatgtgacgtcttgagatcaagatgtctgtgatctctaatgtacatgccctaataggtaggagtaacccataaagaaaactcatatctcagttactcaaaatcgtatgagataggtcagaggatctcggtgccacacttttaccaggtcacaaatctcagggaaaggctcggttggttttgccgggctgggcgccgtgctcgtggtattgtttggtggatcgagacgatgagatgagatgagatggtgaaatcgctggctgggctaaccagctgctggtgccaagggagaaggttaatggggtgggatcgcgagcatcattgcacgcggcaaagacggggagcaccggagcaggtgtgtggaccttggtggtcgtaggcacactgcatgtttccatcgttttctttgaaaggacgggcgatcgatgctgttgcgtgcatgcacttggtaacatgggatgtcagtgatggtgctgctagagtgctagtagtacgaatgtacgacggctttgttatgtttgcaatgaaaaaacattaactgtttcgtcttttaaatctttttaagaaaacattactagaacgaggaatctggaatgagcacggatcaggagttcaggactaaccttcgaattttccagaactccctctatcccattttaagtgtccaactttaatcatctgtcttcctcttatttaattttttttaattagtattttttattgttatgagatgataaaatatgaatagtactttatatgtgacttatgatttttaaaattttcaaataagacgaacaattaaaattgtgcacaggaaatcatggttacacttaaagggcactatacttaattgccgtacgcctcttgcatgtgtaggtctcgacgagtaataatttagtgtcacactcaggcgcgcctaaagcgtgttcttatacgattgtccttccgctaactgcatccaatattttctatcttgctcctcaatcagccacgtcactgcaaacgcaatcgatccattggtctgagtttggccatatagctcaatgctcctcccatcaaactggccactatttgtcctcttcatgacttcgacaggtctgatgtaattcttatcgattgaacttcagataaagataaatagaaaaagtggagtaatagaatgtttacacacatcaattcatatgaatttttccaaaaggtttaagtggataaaaaaattcctatgttttctctatataactcataggaaaaaaattcctttaatttttctatacttcaattctacaaaccaaatgatactcaaaagaattaatccttagaaatccaaattctttgtttttaaaacaaacaagcacttagggcagttctaactcacaatgtccataagtagtgtctatggtgccatgtcaataagacatcataataaaaactacactccacaatccatgatttcttaaagtgggtcattaataaatacatcatctctcttctctaccaatcatatctattcttcatctattatgaagacactattatctcccaatgcaaaacttgatagtgtctagcgcataggttctcatgttgaagctgggtcttgcatgagacctagtttttccctctcttcactctctctctctctctcttaattaatatagtgccacataagctaaaaatactacatggcaatgtagttaatgccatagaaaccatcttagatggagggttgacactgtccttaggattttagattgtttggaagggtattaatttttcttcaacataaccatgtctggtagcactaactaaatcatgtatagccccaataccgatagtagaggttcgagcccccgcttatggtaaatccaccaccagtactaataaagaaacagttgctcatgcattgcaggcagaggaacagctgcggtaacgcacattaactccatgtaaaatgcagtgccgttagtaactaatctcaaaagcaacaggtttgacactttgacggcagtttagcttcaatacatcttcttggaaattaataccccgagcatgtttggataatggagaataggggatgggattagaattgaaaaatgaatgaaggattaagattaaatggaaaaggaagaataaatggttaggatttaaagatgtatttcgattggtgagaaattattttccatatccattagcccaacgctgcccgagtgtgatatgaagcaaagccatggcactttctgcaaaatcacaccaagccattctctcgagcacacgatccgagccgcttgtgtcttatccaacggtcagaaaacacccatgaaggattcggatattcttctccgaaccccgaggcgcagtacggaataccccgacgtgattcggagttttcgggcctgtttggttgctgccctcgtgttcgtgcctgacctgagatgcttgcctgagacatgcctgtaccttgtttggttggcgtcctagccgctttgattagcctggctcaggcgacgaaattccaacgcctgactcaggcaagtgagaagctagcaagattaaggtgatgtgaaagctatgggtcccactattaattacattctttttctttttcttgcttttttcattcttcccaccgattgatcatgtttgttgagttaatatcatctgttaagagcaattattacagtttgacgttgcattattcttctcaggcacatggtttaaaccaaacaactcatctcacaggctgcctggtcaggcaaatgtcttcaaactttcaggctagcttcaggcatgagttttcatcaggcatgtgtgtcaggtcaccaaccaaacaggcccttcttctctgacccttccccaggaggttctgctcgtaaatagaacccaaaatgagggttccttttgcactagcaaatcttcagtaagaaccttctcttctctgatgaactagcaatcttcagtaagaactagcaagcatagctgatcatatctgagaggcactcgatcgcttgcttcgttttattatgataaatatgctctgatgaaatattttcggtaagttcaggaggatatgttagcttaacttggcactgttaagtttttcgaagtcctgtacttgaacaaatgtgtcctgtcaaaatttggacgagcatctcaaattttcaagcatagaagaatttattttcagaatgaaatgaagtatcacagaggcgtcagttcttaacaacattgtgctagtacaaaatttgcagatcaatgccaagcgtttctgaagtagtagaaacaatagatttttcaggtcaccttgaaagtagtactactagttgaaactaaaagcagagacattataacagcatgcagaattaacacttcgctgcattactgaattcactttaactgaagtttaacaacataactccccgcaaaaaaaaaagaaaagaaaagaaaagaagaagttcaacagcagataatcacagtagagtaatctcagaaaatatggaaccaacagaccatacatatcaatggaagcgccatagttgtcagtctatcaaaggctcacagcaaagctgaagctcaggagctcaacatactctgtcatggtcttagctgttgtatccattcttccattcctccagaagtgtcacattcagcgtgtgtaagttgcgcgattgttactggacagcgaagtctattagtcaccgtcaagctggattcacaatttcgttttggggtaaaaataatgcgagcctagtaagatgtcgaatttcgagtgaaattcatgaaagttgctgaaactttacaagaaccaagcgctttgagagacctctaagatttgggcgacaaaattcgagcgaaaattgtgaaaccatggcgtcaaaccaaccacacgagcaaccataacagtggaacctcagttcacatctcaaaagcaacgagaaagcttgtgcctgtgtttgcaccaaagcattcattccttccttcaaatacaactttattgtaaactgttccaaggaaacaggggcccaaaggccaaaggccaaagcccaacagtactcacagtgcacaaaagccacgaccaacaaaacaacgcaaaaccgcccgtgctctctcagaaaaagccagcagccaacaaacatgactccgttagctcttgtttagtaccacctcggctattcagccagctccacaccagcttaaatactcactcctcacctgctgactcgccgagccaggtagcgttggcttgtcacccgagcgggggcaataaggtggtgttggatgcctggtcgtttgcgcttggggtctgcgcctgtggtttgcactatgcggcccgcccgttccaagttgcgtagcgtgtgtggggcgcctgggcgaaggctcgagcgtccctgcacctagagtggcgggtattgcgtgaggctggtttcacagagcagcgagtaccgcccgcttccaacggtggaaggataacgggccgctgcagccctggcccgcttccggcccaagtgccttccatggcagaccaccacctttttttttagaaaaaagtacaccaaaggtcaaaggtccctcaacttgtcatcgagttacaaaattattcctcgaccacgaaaccagatataccacatcctttaactttgtaaaactgttcactttttttttagaaaaaagtacaccaaaggtcaaaggtccctcaacttgtcatcgagttacaaaattattcctcgaccacgaaaccagatataccacatcctttaactttgtaaaactgttcactttaggtcctttgcggcctgtttagttagagggagttggtgatggggaatgagatatatgggagtttaagtctgtagtttggttggaaaacttgggaattctagagggtttaggatggggaattaaaaggtcgaattcccaccaatctcttacttgggggaggcctgttaattcgtacaccaaaggtcaaaggtccctcaacttgtcatcgagttacaaaattattcctcgaccacgaaaccagatataccacatcctttaactttgtaaaactgttcactttaggtcctttgcggcctgtttagttagagggagttggtgatggggaatgagatatatgggagtttaagtctgtagtttggttggaaaacttgggaattcgagagggtttgggatggggaattaaaaggtcgaattcccaccaatctcttacttgggggaggcctgttaattcgtacaccaaaggtcaaaggtccctcaacttgtcatcgagttacaaaattattcctcaaccacgaaaccagatataccacatcctttaactttgtaaaactgttcactttaggtcctttgcggcctgtttagttagagggagttggtgatggggaatgagatatatgggagtttaagtctgtaatttggttggaaaacttgggaattcgagagggtttgggatggggaattaaaaggtcgaattcccaccaatctcttacttgggggaggcctgttaattcgtgagacttggagggaattcgatgtgaaaccaaacaagggatgaggactacaaatataactcccatgaccaattccaccatcaactccctccttaaaactcccattcctcttcccttctcttgccaaacagaccattggtggttttgtggccggttttctctaacgtggcagctgagtcaagatggaaccgagtcaagatggaacccacgtgtcaggtgaccacgtcatcttctctccctccctctctctatctcatttttctcctcagtctgggcaagccggctggcgacggcgacgacgtgggagcaggagggccgccccccacgccaccgccgccgccgacggtgcgggcgccatatttgcggccatggatgacgacggtggactcttgctctccccgccggctcctcttccaccgtgctctgcaacgacggcgcctcgggcgccggcgacgaagccgctgcccgttcgatctgaacctgctggcctcatccccgtcggccgccgccgaagccaacgagatggattggcgctgcgatatgctgctccacctctagcctgcacatcaccaaacgacagtagcaatcgccggcgaactctagcctcgacgacgacgacgacgatcaaccagcaaacagcaagaatcggcgaactggtactgggttgctgcgctccaatccaaccataaccattgctgctgctactgctactgcgaagaagctctacgaaccccattgctgctgctgcttattgaaattccatctaattaattaactatgtgggaagagaaagtttaaaaggaaatcgcaaacaagaaaaactgatagtgtggactcccatcagttgctaaccacacatcaagattacagtttgaagagttgtgtcttctgttcagcttcagtacttccaagcaactgcgacagtgagccaaatgcataaacaccttgatctgatcatcaacagatggaaaagacaccagatctatttgctattatcatcacacacagtacatctgaatgttacttttgaacgatgtacagatgcatccatggacacaattcgaatgctaggcctcttgtactccaaaggccttccggatttcagctatggctctgttcgctcgcaacatcagatcgaacatcctcggcaaatttgaagtcagatcggcggcggaggtggcggc

SEQ ID NO: 64095 - DNA, 3889 bp, Oryza sativa
aattccccaactctgtgctctgccggtcttacccgaaggattccggccggccaaaccgtcctattttgcaccggttaaaaaactacccgttgtagccctgtcagagggccccatcggccaggccggtcagaccgacatggggtggccggtcagaccggcctcggctcggtcggaccgccatcggctcggtatgaccgactacggctccgtcggctctgtatcggccatcccgagcagcatcatctcggcctccaggaggccggtctgaccgggaaagtgccaccggtcagaccgccactatgtagccggtctgaccggccagggcacgccggtcagaccgccactatgtggccggtctgaccacccctggtcaggccgaacctagtgaatttgtgtaatgaaaaagcgagcacaaatgaaaatgcaatgacctaatgtggcaattaaaatcatctctttgctaggtcattacccctcttaatagtacggcgaaactaaaattaaactagcaaatttgatcgccctacacctcgatcaattctaagttaaagcgctagttttaccgtcttctttccctttgctttgcgccgtcaattttaatccatcgataatcatccatgcacgcatatgacgtggacctaacttaaaatgtatagctcaaagacaacggttagtccacaattagtgcttgtcattaattaccaaaattaacaccgggggcctagatgcttcacattctagcactaaagtgagagagagaaagagagagggagtggtcccaaagcactttttggcacaatttgctactatgtactagcaaatgccaaatgccaaattgccaatttttgctactagtgtttagatccaaaatggcaaaaagtgcttcaaaatgacaaaacttttgccattttggaggatctaaacagggccttatacaagcatgcaacatcatctataattcattgaattctagaaatcaacatccaatcattttccttcacattattaataattacatacaagacttatacaagcatgcaacatcatctataactagatgaataccccgccgcgttgctatgggaaattaagttgcataatatgttcaaataaaatgaaatctaaataataaaacttaaataaattgatacctatgaattttgaggcctaaaaatggttgtgattacttggtgttatgagagaagaaagaagagacaatttgaaccataaatctatcatctaatgactagaaataattggggtgatgtggcttaattagagaagagagaaatatcattaactaaactatataagtatataggattcattgaattctacaaatcaacatccaatcattttcctttacattattaataattacatacaaaacttatacaagcatgcaacatctataattcattgaattctacaaatcaggtatccataaccatgacagtaaccccccgacttcaactcaaatgaattcatgttgtcatccgcgttttctctgtcaacgttgtcatgctcacttggtcgttctcgataacaatcgagaagacatggagtactcaacatcattgaaacaagatcaatggtccacaagtgaatttgaattgaagtctaaacaactgccataaacgagcctgaaatcaacgcaaatgaacgagttgatgttctcgaccggagaccttggaacaacagtcgtcgtgatcgcttaaccgttctcagttgatcgagaaggtgcggagtatgtgactacattccttgtcttgtcgtaatcaagaatttgggttgaagtcaagaattttcatctcagcgggtacaccatcgcttcattccgtaatctttgtcgaactccaccaactgttctcgagtaatcgagtagttgtccaatcgttctcgagtaatcgagtagttgtccaaccattctcgagtaatcaagtagttgtggaatctgtgacaaagctctgaaatatgactatcctgaaatcaatactcagacagattgttagatacaaatagccccaagggtaatacaatataatatgaattttaaaattgaaaatatattgaatttgcacatgacaataaaagagtactctcgctaaagcttccatcagcaataggagtctgggactcttcctagcccccagctgtctttatggaaaaatcgtttttccacaaaggcagctaaatcttataacaaaccaagttgaagatgacgaaattctagcatccagccatgaagttgggaaaaccaattctgattacacggcttagttaatacgcattcaaaatagcacaaaggaacgataggatcgacttcaagacagggcgatataagaaaagaggatcaacggacaaatattacatatacaaacacttacagaggttgtcggagaatccatctcttgaacccatcttgtcgaaaccttgtagcaccaaaatccccatacctggcgtgccactgtcgacgtttgagatctcgactacggttattgcatggtatggagactgtcggtaccagggaatatgcgagattgagataaaagagatagatacaaggattttatacaggtttgggcccccttatgtgacaggtaatagccctactcctgttggccaaagccggtgttgctctatgttcatcagaatcacacaagtacaatatttgggataacctatctagctgttgtcgacttggtggcatagataaccaacacatagtcgacgatagggtaatcttccttcccgagtaggaactcattgagatcagagatggcgctagatcccttttgtcggcctctgtatgcaccatattgggttgtctaggcttatctctgatgtcgatgtttggcggcatgtggtgtctattctgacttgtatgtcgatctgtgtgttgttctgttccctctcctcctaggggtcatgtatttatacccatagatgtccccatgtccaagtagaactagggagacaagtatggatacgatccgagtagtccttatagtttccatatagaactctacttgtccttattaatctggaactccttctatatacaaggtatgattccgtataagacttggtatatggtggccccaccaagcttaatcgattactattgggtatgtggtatccataactatgaaaacatgtttcttctttcactataaacaatgctcgtgcattgcaacgggtgaaggttattttaatcttattattgttataggagttagttaaggtgaaattcactgtgggaattcacttggatatatatttttctagaaaaaccatgagctgcaattagaagtccgatcatctcaagttagcatgcgagttttttaaagagatttcttatatgactcctatatttccaaaaccgaacgaacttaaaaaccgactcatatacggatgatgtaccaacatactggcaaaaacatcttcaatttttataatagtagagaaaagatagaaatatgtatttccaaaagcgaacgaacttaaaaaccgactcatatacggatgatgtaccaacgtactggcaaaaacatcttcaatttttataatagtagagaaaagatagaaaatcatgagctgcaattaggagtccgattatctcaagttagcatgcgagtttttcaaagatatttcttgtacgactcctatattttcaaaaaaccaacgaacttcctaactcaaatacgaatatgtatttccaaaagcgaacgaaattaaaaaccgactcatacacggatgacataccaaagtactagcgaaaacatcttcaatttttataatagtagagattctcaaagcccaagggaaatcaagcaatatattactgtacctccaatacaccaccataatttgagcacaagttgactta

SEQ ID NO: 64096 - DNA, 1490 bp, Oryza sativa
aggtgacactatagaatactcaagcttcacgctggacagtaagtgcttgctcaagcaaattctctaacctcctctctggtaccataacagttgggggaagcaccttttgcaattcctctagcagcttcagccgtgagtttgaagattcaatgccaagcttcgaaaaaccaagtaatacatgctgtggagaagaaattatgcagcctgacagttcatgaactctttttttgttgacaccaagtggtgtaatttcactctgcaaagtccttatagcacccatgacattgtcatttctcaaaagttcaagaaatttttgttccagtatcagaaatatagcagactttacaatgttttcgtccaaaaggccaaccttcttcaaggtaaccactgcactatcccaattcccatcaagtacctgccttctgaaaagattcactgttggggaatgcagagttattcctgattcttcctcaagaactgctccgcttttttcataaccaaggctatacagagcctttgtgattatcctcacaaattcatccctcttaataacacctttagagccaaccataacttctttcccctgggaaggcaaaggtctagccattgtgcttcccaaaggagcggcaggtttcaagcaagaaaaactatctaacaaacttgctggttctactgaggatgctcttgcgcgtttcgagggtggttcatcgtcttcaaaacctcccatgaaatgttaaaatcagcccatatatatttttgacttctagggagatgatgttatgcagctccgagcggaatgcttgcaatgggtggtgtataacgaaaggacgttgctgcagagaaacagcagttgaaaagtgtaagttctagatgatcaaatgcagagaagggtctatctaagtgatcatcctatctacaatttgcagctaatgcccacccaccaggaaagtttgcatagcaagttacaaacaacaaataaaaccagcaaggcatgtaatgcgtgaaatacaattgaagcccggacttgatcggccttagtgagcaaaaaccgcccaagcgtatcaattagcgtagaaactgaacatcctaacatcacattgaatacgcggtacacccatcatcgccgcctaagcaaagattggatgaagcgatcaagagcggcaagcatggatcccagcatccgtagtctgtcaagacatgaactggagcggctgtggtgtggaatccacggccacagaggcggatcttggcagcggcggcggatccctgcggcgctggtcgatgcagacgaccactgaagcaactgtcggcaacgctagtcccagaagatttggggaaatttggccccaacaatccctatcaaaccttaccccccaaacataaaaaaaagattggcaacacgcatgaaattctgattgatcccaaatcccaccgcgcgatcacaaattcctgcagcgcaaagcaccaatccatccagaatcacgcgccct

SEQ ID NO: 64097 - DNA, 1272 bp, Oryza sativa
tttggaaacattccgaaaaatccggtgcgtgaaaacggcatggagtccggataggttacgcgcgacttatccggttcggtttacgcgggcgccctgatcaggcgatctatctctatataaaccgagccaccgccttcacgcagcacacgcaaaaatcaatctagggtttgcctcctactctgtgctgcgccgtcgctcgtagattacaccatcctgctcgccggcgtgcacctgcgatcgggagagcaactctccggaacctttgccttcgacgtcctgcaccgggagaaagcggcaataaggtttttgggaagcgctttgtgcgactgctccctgttcgtccacgacggctcgtcttcctcttcgctcgcgtgcttcgtgccttcgtagacgcctgcgaaaagtttcgaccgagcagccggtctttccgccacctcggtacgtgttcaatatgttgcgcatatttaatctgttcatgttatactgtgtagtttacatgtgtagatctaatgatgcgttcatgctagttttcatatataacgtcatgatttatttatggaatagattaaatcattatatgcctataatctcaacagatatatatatctatctagattaattaacatcaatatgaatgtggaaaatactagaatgatttacattgtgaaacggaggtagtataatttagaacagaagatattttttttaaaaaataaatacttaaaagtaagttatatccactacaaaatggttttcccaaacggctatattacattttcacaggcagtgtagaacccaacacccgcttgtccctagatgttcataaaaaatagtagcgattttcctaaaatgggcagttcaaccgtacgtgaaaaatggaattttcgcatacaaagcgttatgccgcaggactgcaaaaaaaaaaaaaaaaactactgccgccgtcgcctgaagcacatgcccgccaccacgcgctggttgtcgggaagggggagacggtgtactggtggccgctctagccgttctggtggatgcgtcatccccaaggctagtggcggcggatcgttcgctcctatctctactagcaaatataatattaggctataagccgactaaatgttgaggtggagaagagaagagaggagagagaggagaaagaggagaagcggtctgtaaacttacacccgacttggacacaagaatcaagaaattctgtgggagagacaagtgggtcctatattaattgtaaagagctaactattatatgggtgg

SEQ ID NO: 64098 - DNA, 21315 bp, Oryza sativa
  unsure (1)..(21315): unsure at all n locations
aattacatcacaagttctaaaaaatcaccacagaatacatcacgacacaaatacatcttagatctgaatcaaaatgcaccacaagtatcatctcacacacaaaatcaccacaagtacatctctgcacgccggctgccaccacgccggccgcccgccggcggatgggaggggaggagggggaggagaggggagaggagaaggaggaagtggagaggaggatagggggagtggaggaggaagagataagatcggatctaaggggaggagaagaggagatgatccgttcttatctaaatatttcatctgggacttaaccgatcagagataggagaaaatatttactcccggttagtaactccaaccgggggtaaagataaatctttacccccggttgttagtaccaaccgggactaaagatctaaatgatctttactcccggttgatagaccaaccaagactaaagtggtaccaaccgggactagagatcctcggccccctggcacgcatctgacaagggatgaaccgggactaaaaatcctctttagtcccggttggtactaccaaccgggactaaagatcaaaaatttttgaaccgggactaaaaacaatttttactgccggttcttattggaaccgggactattggggaaatcctccaacccagcaaagatcacttctctagtagtgattacgaaaaactcagcggtaaccagtattaggatatttcaaacaatcaaaacaaattctcaaaaaaatcataacattcatgcaatgtatatataccactccataaagttttatgaaaagttttatgaacaactttaactcacatattgagaaatagaagagacaaattcaacatataaacagtagtggtaatattgatatccaaactttttcatttatttagctcgaagatcgagtttggacttatttttttagtgagatttttctatactccattaatttgccatctaaaaaggagagatcaggcatcgccaagggaagatcaagccttcaagatcaccaaggcccctccaaggacgccccatgatcgcctcccaatcgcctctccgtgaaaattgcacgtttctgtttactgtcgatgtacactacgtctccatttaataaagggactatctacaaatcattcgccataaaacgaacccaaacacagtcggatttttctctactgctaatccatacctaacgactcagtggacctccaactacgtacacacttttacgattaattaggaactagtacgtattttattttttaaaccatatgattaataacacatagaaattacaatgtaattattctataactagtaatataagtggtatgtaattatagtgtaagtgatatgtaattacattgtaactgtagtgtaagtggtatgtaattacgttgtaagtgtagtgtaagtggtatgtaagtatggcgtaagtactgtaagtacctcgtgaatgaattttaacttaattttggtattgaaatcattaatcctacctcgctcagtttgttagtcgctctgtctaagacctagaaggccagagttcgactcccccaccactgcgcctgaattattttcttttgcactgacatgaatatcgtatgggcaacaattcaaccgttttttcttagaaaatctggtgacacatttatagcaaatctgtttaataattttctctttttcttttattagcatgcaaatttactaatggtctattcatgtcagcgaaattgcgtgtgttgtgaagtgaccaattttttggcactcccaccatttggttcaaaccaaaattagctgtgcgccaactcccaccgtgaatccattatttccaccgacagccttgtccatgttagaataatcaaattattgtgacgggtggtgtatatatctacatcaaggaaattaattttctgaccttgagatatataagtgtgtcatggaaaattgaatttccccgataagagagtttgtgcacgttagtaaaaccaatgaccgtcagagctagtccggtttttggtagtgtctagttcgaacagtgatcagtgtgaagctaagacatgcattactccctcgatgccatgataaatgataacacattacaagcttgttgctatgatatatcccaattaaactagcttgtgggaaaccaaaaaacataaatctgctaatggtgcattttattagagcgcgcacgataggtgatgtgctgtgttgacttgataattaatcaagctgctggaattctcgcttgctggcttgcactggtagttgggaaaataggtccctagaatccgttgtaattgtgatcctacaacctagagaatgtgaataaggtttttgaaaaagcacggtgcgacattcgtccatcacggctcatcttcctctatgttgaatagctaaatgggtgaatatgttaaacatgcaatattaattattaaatatattagattttggagggatgcaacactttccagtactatgattctggataggcttatctctatattcatagattaggaaatatgacatccctctaaaatcccttaattatgggaaggagggagtacattattgtgttggaattaatagatgggctaaggcccattcgaagattaattctttgaaaaatcacaaaagcccacctcatcggatggcatgcatgtggagtttagtaccaccttgcttattctaggagagggggatctccttaaaagggaggataccctcctagccacttgaagcatgtgtggtggagagaagaagggaaatacacacgcgctcgctggcctggcaggcggcgcgcgtgcacgacatacgtgttgaattgtccacaaaattggcatcctcacccttgcgcagatgcagcctccttttgcagttttgttttgctgcgggaaattcggattccgaaaaatccggtgcgtgaaaacggcgtggagtccggataagttacgcgtgacttatccggttcggttacgcgggcgccctgatccgccttcacgcaacacacgcgaaatcaatctagggtttgcctcttactctgtactgcgccgtcgctcatagactactccatcccgctcgccggcgtgcaccggcgatcgggagagtaggtctccggaacctctgccttcgacgtcctgcaccgggagaaggcggtaataaggtttttgggaaacgcttcacgcgactgctccctgttcgtccgcgacggctcgccttcctctccgctcgtgtgctgcgcaccttcatcgacgcccgcaaccgtgagtagttcctgccgagcaaccggtctttccgccacctcggtacgtgttcgacatattgtgcatatttgatctgttcatgttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttactatggctggttttgccgatgcactgaggccagataaattctccggtgtgcactttaagagatggcaaatcagggtcactctgtggctgacagctatgaaatgcttctgggtgagtactggcaaacctgaaggaattcttattgctgatcagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatgactgacaaccgttctatagtcgaacaggctcatgagatacaaaccatggctaaggaactcgaactccttaagtgtgtcttacccgataaatttgtggctgggtgcattattgcgaaactacctccatcttggagaagtttcggtactgcactcaaacacaagagataggaatactccgttgaggggttgatagcgtctcttaatgttgaggggaaagctcgggaaaaagatgctgcgtctaagggtgatagtgggcagtccagtgccaatgttgtgcataaggctcagaacaagagcaaggggaaatacaaagctcaacagaccaccaactttaagaagaagaagaagaacaacaacaatcctaatcaggatgagaggacttgctttatgtgtggccaacctggtcatctggctaggaagtgtccacaacgcaaggggatgaaggcacctgcagggcagacttctaagtctgctaatgtgaccattggcaacactggagatggaggcgggtatagtaatttacctactgtttttttagttaatcagtctactaattggtgggttgatactagggccaatgtacatgtttgtgctgacatcttattgttttcttcttatcaggtcgcacggggttccatcgtcctaatggggaatgggtcacatgcttcttttcatggtgttggcacggtagatctgaagtttacttcgggaaagatcgtgcagctgaagaacgtgcagcatgtcccttctatcgataggaatcttgttagtggctcccgtcagactagagacgaatttaagttggtttttgagtgtaataaagtagtcgtgtctaaacatggatattttattggtaaaggttatgagtgcggaggactgttccgcttttccctttctgatttctgcaataagtctgtgaaccatatttgtggcagtgtggatgatgaggctaatgtttggcactcatgtttatgtcatattaattttgacttgatgtctcggctttccagcatgtgtttaattcctaagttcttcactgtcaaaggttctaagtgccatagttgtgtgcaatcgaagcaacctcgcaagcctcacaaggctgtcgaggagagaaacttggcaccactagaactcctacattcagatctttgtgaaatgaatggggtgttgacgaagtgtggaaaatgatatttcatgacgttgattgatgatgctactatattttgctatgtgtacttgttgaaaacgaaagacgaggctctagactatttgaaaatttataaggcagaagttgaaaatcaacttgacaaaaagataaaaaggcttaggtttgatcgtggtggagagtttttctcaaacgagtttgacttattctgtgaggaacatgacatcatacataagaggacgcctccctattctcccgagtctaatgggattgctgaaaggaataaccgcacactgactgacttggtgaatgacatgttggacaccacgggactacctaaggcatggtgggggaggcattgttgacctcgaatcatttgttaaatagagttcctaacagaaataaggacaaaacaccatatgagatatggattgggagaaaaccatcactttcaccaagcacatgagggtgcttggcgaaagtcaatataccaataacgaagaagcgcaaattgggacctaagactgtggactgtgtctttctgggatatgctcattacagcattacctatagatttttaatagttaaatctgaggtacctgacatgcatgttggtacaattatggagtctcgtgatgctaccttctttgagagctttttcccaatgaaggatacacatagtagttcgagccaaccctctgaagtaattccccgttcaatcacacaaccagaacaaactgaacatacacataaacatgtcattgaggaggatgtcagtgaagctcctcgaaggagtaagagacaaaggacggctaagtcctttggtgatgatttcactgtgtacctcgtggatgacactcctaagtcaatttcagaagcatatgcatctcctgatgcagactactggaaggagactgtccgtagtgaaatggattccattatcgctaacgggacttgggaggtgacaaatcgaccctatgggtgtaaacctgtggggtgcaagtgggtgttcaagaagaagcttaggcctgacggtactattgaaaagtacaaggctcggcttgttgctaagggctataatcagaaagaaggcgaagatttcattgacacttactcacctgttgctagattgaccacagttcatgtgctactttccctagcagccacacatggtcttctcgttcatcaaatggacgttaagacagcttttcttaatggagagctagatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatcttcaggctttgcagtcaatgaggcagataaatgtgtgtactatcgctatggtgggggtgagggagttattctgtgcttgtatgttgatgacatactgatatttgggacaaaccttgaggtgataaatgaggttaaatcattattgtctcaaaattttgatatgaaggatttgggagtagctgatgttatcttaaacattaagctaattagaggtgagaatgtgattacattcttgcagtcccattatgtggagaagatcttgaatcgctttggctacattgatagtaagccttctccaacaccttatgatcctactccctccgtcccaaaaaaagacaaaccctggtttccgtgcccaacgtttgaccgttcgtcttatttgaaaaaattatgaaaaaaattaaaaagacaagtcacgcacaaagtattaatcatgttttatcatctaacaacaataaaaatatgaattataaaaaaatttcatataagacggacagttaaagttagacacggaaacccagggtttgcctttttttggacggaaggagtagattgttgtaacaccctgaaaatttctgacaataaaaatcactaaaattttaaactttttagaacttttgcatcatgctagatgttatggttgctattgcttgccaaactattaattttcacgattgaagattaagctaaagctgtacaactaagtagtaattagaataagataattattattaatcctataaatatttgtgcacatgatagcaagccgaataaagtacaagtcaattattaatttctataatgcagactacaaattgaatgttaaatacttgaaccatgttgacaagtgtcaggacatctaagcaaccatgaaataatcgccactacgatgaccctatataaaggagcgttccactggaatatttatattaatatttataatgttcattgagtctctcatggaatagattcactcatataaaatatttggtcatgtaaataaattgagtaaatataccaccacccttataatgtattctatggaaatatattaattctatatcacagccagcaattatttaagttaattatagagtaacccaatataatgcaaattcatttggaaataagtaaatattcaaatacatatttgaattcccaaaaccaaaatatatatattacatctcaattcaaattccaatcccattcacttttgcagattagcccctccctttccttcctttcgcttttcttccttttctctcttttcctagccgccactgttcattgcccgacacctgttcgacataggcccagcccagcagatcaggaacgcatccatcccgttcccaacccttgcagcactgctcccgtgtgccgcgtgcatcgcatcgatctcgctaccacccgacgccgcgccgcgccatgcctccgcacctgcgccactcccgcgctcgcgttgtgccatgtgccgcatccacccctcccatgcaccgcgccgcacccgcgtcgcaccgtttccatgtgccgcaccacgccaaactcgagccacgccaagccgctcttccgccgtgaatcccggcctccaaccgctctcccgtttccctccaagaaacacggagcatcgccatcgtcaccatgccgctctgcgtccatcggttaaaactgcgcatccctaccgcgcccgctggacaaaacaatgcccttcctccagctagcgcctagacctgcagtacataggttatagatgcgatgattaagccacagaaccttaatggagaaggagataaacccttatccgcgtcgtccacctcatattccttatccgattgccattagagctctagctcatccaggccatgtgccggcgatcttatccccatggtttccttacatcctaagctaagcccccaacaaaaatccccattcctctcagctttcttcccgaatacatttcatcgagcaccttgcgatcactctctcaccaccgctagagatcagcattgcgaggctccccggccggagctggaggttggagggagtggaggaagagccgtgctgccgccgtcgccattgagggagctgaggaccgctggacaccgggaaccacgcgtcgaacactttcgggcatcgccgaccgctagccacctctgctttgtctgcaccgcaccacgcgtcgccgcccttcgccgtctctccatcctagcgtaatccctcgaccccatagcatcctctaactctctaatagctagcatcggctccaatttcgccaaatagcacccgtggccgtaccggcctggccgccattgcactgccggcgagctcgccgtggacaagccatccgggagctcccctctccatctagctgatgaaatcgaatccccatacgccgtagacgctcacgccctcaccagtttggtcggaaaccctccctatcgccctagcacctagctgcccgagctcagccatgctgcgccactcgccctcactccgccgcgcgtcgctgacggtggtgggaggtcgccggagcctctccgtactttccgcagccgccgccgtgccggcctcgcgccatcccggctgtgcccagcgcgcatggcacggctgcctctgcccggctggaggttgaagacgacctccattcgagccactgacaggccgggcccactcctatatttcccctagcaaaaattaatccggtggaaaaggaataaacccggggtcccacatgacagtcaatgtagttgtggataggatttcggattaagaacaaatctattaggaacagtaacttttcacaatttctcggattaattcgaaattgaatctttaaactagtataacttattcattttagctccgattcgagtgaaacttgaacctaaatttatctaaattcataagctttccaatggtatgtaactcactgtttagtaaaatatatttataattgttacataattaatatcaaatgattagattatgatcaacttaaaaatatgctaataaataaaattgattattgtacagtaaactaggtgtgaggataattctctttaccatgctttatcactgtaaaacccatgtaaactaattagaagcatatgtggtcatactcctaccataactcgatagatcaactctgatttaatgaaatgtgtatcccatttatattatgatgattagatcctaaacaagccgccatgacaataggaatgattaagagattatccgtttgcaaacacgaatcgaccccaacaactatattttgcttgtgcatatttgattgaatattggtttttctcgcgtattatagaatttgtatatcggttagtcgtgaggcaacgtatgcagcttccaggaggtgaaggttgatcaagattatatcaagaataagaactatcctgagcatgcaagtcatcaccccaccccttgagcatgttgatcccaattgcgaaattgttttgtttacaaataaaattgcatgcaatgatgaatatcctacttgttattatgccatgcctttgattattgcttatctcattattcccttgtacccataattacgtatgagtccatagtcacttgtgacaaatgctgagtaatgctaatttagattcatgcattctcatatttatcaaatgctttatgcttgggcaactaccttggggagggtagttgagatacggcatgtagagacatgagtgccacattgccatggcattgatgagatgatttgtgaaagaaaattaaaactaaacaaatgttttcgactggggcggctggatgatttgggtggtgtccggtaaaggctagtgccatccctggtcagttaaggacagagccatgaagctaagcatgaaacgaccccaatacaaccgtacttctcgaatgggtatagacctagcggagtagatagccgagcggaggcagtacccctgcatagtggtttcacttaggtgtgtggatgaacaagcagtctgttggcggatacccgatacggatggccagatggcggatacccgatacggatggccagagactgacttgtcaagactacaagactacaaggagatacccaaaagaggacagcatagattgggttcaactacaggatgcgatgttagacttgcgtgagttttcttcctcgggagcgccagaactcctctcactgctagaaacttatgacgcctagagtgcatgaggacttaagttcatggagcgggtactgccaatgtgaggttattgaaaggctttgccgtgacgcgtctcatgtgttgggacgaggctcatgtgttgggcagttgcggagtacgggtaaagtgtacatccactgcagtgtgagtaaaacaaatctattcgaatagccgtgctcgcggttattgagcaccgggacatgtattacacttggctagactctaatttcttaatctgattgggatgggatatgcatcatgattttgtactagtggatcaacttctcgagaggcgagaaggggtagaccccagaaaaccatgatggccagtggcgggaagctatccttgggaacacaatggatggtggatagaaccgtcgctgtttaatgaacaatggagttaaaacttgatcagtttatgctaggtcttaggtttgtgaaatgatatttgaaaactcagctttacgcaaagtaaccatagccactccttgtattatcctgtacattactacattttgtgtggtggcttgctgagtacttttgtactcattgttgctctatatatatcttttagcagagtgttgaagagaagcccttgttagtgcgcttgcgtacctaacaagatgatcggagtttaattccattctaggtctcgtttcccagtcgactgcttgtggtatgtcaaccgggcccctgtattattttgtcttccgctgttgtttctctgatagttgttggcctgccaggccctaatgtaagcatttaactcttttagcctgaattcattcatgatatgttgtgattcggctatgtatgtgtgtaccaactactgatccagggattggtactgataaacataggagatttccgatttccaaaatcggaggtcgacaattgttgcttcgcaagaacaagagaattgctaggaatcaactggaatactcccaaatcattggctcgctgatgtacctagctagtgcaactaggcctgatatctcctttgttgtgagcaagttgagccggtttacctctaatccaggagatgattactggcgtgcgcttgagcgagtaatgcgctatctgaaagatactatggaattggggcttcactattctaggtatcctgcggtactggagggatatagtgattctaagtggatctctgatgtggatgagataaaagccactagtggatatgtcttcacactgggtggtggtgctgtttcgtggaggtcttgcaaacagaccattttgacgaggtcaaccatggaagcagagctgacggtactggatactgctactgttgaggcagaatgactgcgtgatctattaatggatcttcctattgttgaaaaaccggtgccggctgtccttatgaactatgacaatcaaacggtaattgtcaaagtgaatagttctaaggataataagaaatcgtctagacatgtgaaaagacgattgaagtctgtcaggaaattgagaaactccggagttataacgttggattacatccaaacagctagaaacctggcagatcccttcacgaagggactatcacgaaatgtgatagacaatgcatcgtaggagataggtttgagacccatgtgagttatactatggtggtaacccagtctatgtgatcggagatcccgtgaattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgatgtcctgcagagcattcttgaaagaactcacctttgtaagcttgactgttggtcgcagtctatagagattttgggtgaatcttctaggaatcttactaaagatctaggagtatgacttatacgctccacccgaggggtagtctacagacggtctagtaccagataagactctgagtgaaacttgcttgcacaagacttgcaattcaaggcgtagtccattgttcaagttgtgagtaagtgtagcttggagttctaggtggatgtttaaccttaatcggtctccatcgaaccgctggtatataaacagtacattggaaaaggcaaatctcagtgggattttgagatttggtgggggattgttggaattaatagatgggctaaggcccattcgaagattaattcttttgaaaatcacaaaagcccacctcatgggatggcatgcatgtgaagtttagtaccaccttgctttttctatgagagggggacctccttaaaagggaggatgccctcctagccacttgaagcatgtgtggtggagagaagaggggaaacacgcgcgctcgctcacctcgcctggcttggcaaggcaggcggcgcgcgtgcacgacgtacacgtcaaatggtccgcaaaattggctcctcacccttgcgcagatgtagtctccttttgcagttttgttttgctgcaggaaattcggatttgttttgttttgaaacattccgaaaaatccggtgcgtgaaaacggcgtggagtccggataagttacgcgcgacttatccggtttggttacgcgggcgccccgatcaagcgacctatttctatataaaccgagccgccgccttcacgcaacacacgcgaaatcaatctagggtttgcctcctactctgtactgcgccgtcactcgtagactactccatcccgctcgccggcatgcaccggtgatcgggagagcaggtctccggaacctctgccttcgacgtcctgcaccgggagaaggcggcaataaggtttttgggaaatgcttcgcgcgactgctccctgttcgtccgtgacggcttgccttcctctctgctcgtgtgctgcgcgccttcgttgacgtccgcaaccgcgagtagttcctgccgagcaaccggtctttccgccacctcggtacgtgttcgacatgttgcgcatatttgatctgctcatgttttactgcttagtttacatgtgtagatctaatgatgcgttcaatctagtttacatctgcaatgtcatgatttatttatggaataaattaaatcattatgcgcttataatttcaacatattgtagccgcacacgtagcatgcagtcctggattgcttgaatctatcggcatcggctgattgacaactaatcaaacataaccaattgaccttgaccatatcatcaatcgaacctttcactggatatataagcatgcatatacacactataggcatgagattttatatatagagagagagagatagagatctgagttgaccgccgtcgacttaattagcattcaagtttttaggagatattctttttatcttggaagcaatgtacatcgatctgccatgcaagcatgcatggatcatggatgcattatgcatatatgcgtgatgaggaagcattatatgcatctggcatctcaacacttgacttaattatctcttgaggccacaatatatagctaggataaagtagccgatcaagcatgcatgaagcacttgaaaccttgtgtgcttataagtagctagctagctataggggcagctccaacaccttgctactgcagaaaagtgtaaaaaatggctagtggatcggatgcaatgggcactttccttgcgatggcagcgttaaccttccaagtgatgcttcttggtggtgccgtcgtcgccggcggctgcaacgatacacggcggtcgtcggtcccggcgatcttcctgttcggcgacggcgcgctggacgtcggcaacaaccaatacttgccgtcgtccgaggccggagacccgatccgcgccgatcaccccttttacggcatcgacttccccggcggcaatgccaccggcagggtcagcaacggctacaccatggccgacttcattggtaattaaattcatttcctttttctctatatgcatgtggcctagctaactagctatacgtactaactaccagtggtattattcattataatcccttcgttccattttaagcacggtcaggagtttctaatgtttaactttgatcgtctgtcttatttgatttttttatgattaatatttttactattattagatgacaaaacatgaacagtaatctatgtatgacttatgttttttaatttttttttaaaaaactaaataagacagacgattaaagttagacacggaaactcatggttgtaattaaaatggaacggagggagtatcaaattgggaaagtctgttcatctctagatatgacatctcttcagggagcggacccaagggtgtagtgtgcactggcatacccaagaaatttgaaaaaaaaaatttggatcacctactccttagcactatggcctaagtccagtagataatggttctgtttagttctcttcaaacttttaaaaattccgtcacatcaaatatttagacacatgtatggagcattaaatgtgaaaaaaatgtatagtttacatgtaaattgcaagacgaatcttttgagcctaattacgccatgatttgacaatgtggtgctacagtaaatatttgctaatgatggattaattaggcttaataaattcgtctcgcaatttacaggcggaatctctaatttgtttcgttattagtttacgtttaatacttcaaatgtgcgtatgtatacgtcaaaaaaaatttagaggaggaactaaacacagccaatatagcagattaggcacatgccagaacagcatgtcaggcctgttgtaagtgttaagtgttaaacagagttgtactctctctatctcaaaatataagggattttgggtagatgtgtgacaaatcatagtaatatgaatctagacagcttctctgtctatattcacagtattaggatttatcatatctacccaaaatcttttatattttggaacggaagcctggagtagcaacaagtagcagtacatgtgtgagcgcgcgtgctgaactgttgagtgccgacacgggttttggggtagcgccgatgatggccagaaggatgatgtattcacaagcgggagaagctgattaattaattaattaagtattaactattataaatttaagaaataaatttatttgcttttataataacttttatatagatttttttttaaaaacacaccatttaacagtttgaaaaacgtgctatatatgaaaaatgagtaagttagagtttggagttgaagaatagaacagggccttgctcaacaagcacaaagcgcacaattgctatatatcatccacttattcatatttgcaatttcctctcggtcccagtttccctcaaactgaattactgaaaactaaaactattttgtgatttctgttcttaaattaagttgagtgagcaaacatatgtgaacaagagcagtgcctagtgtttatttttagtgatcaccaaagaattcagattctagctatactttgacaaattctttaatttatatctttcattacatagttgcagttatatcttctatctgacaatttttgttaattatgtataagcgtctgaggcttatttgtatttgtatgcataaagacttatatattttcttttaattgacatgtgcgggcacacccaacactagtttttcctgtgtccacaattgcgtctcttcatttttacttatagcctaaaaatcatcaaaaaaatattaacagaatagattcgtgataatcaccaaaataaatattaataaaatagatcggaggtgctcatagtggtaggattcgcatgtgtgttcatagacgtgagtgtgtgcacgttgtgagcgcctgtatttgtactgtgtttcttaaaaataaatagattgttgatatatcattgttcaaattcaatttatatatgtagaaacaaaatagcaaatttgactctgaacagaacataaaaattcactgctaaattgttgtctctaattatataggctgaattaaagttatatgtttatgatatatcgtaattgatcaagctacctatttttttaaaaaaatgacgttttaaccaacatcacaaaacgatgggggttccctcgacacaaacatcatctcctatcagactataaactaattgtgtcaagagatgcatggtaatatgatattgtnttgtgtgtggttggagcaaaggctatggggttagagatgagccctccagcttttctgtcgcttaataatagcctgatcgaagtggatgcgggtttcagcggcatcaactatgcttcagcatatgcggttatttggaaagatttgtaagtagtcaaacattccgtccttcgatccgtgttctactggctcagttctttttccaactttcctaactcaccttcctcgttttccgtgtgcacacttttttcaaattgctaaaggtatgtttttcttaaaaaaaaagttatatatgagagttgttttaaaaattcatatttatctatttttaaaaaataaattagttaatactaattaattatgtaataatatgtgctttattttgcgtgccaaagaggactcctcctcctcctgaacatagcctaagccatatatacattttcttacataaaccaaacattttcttacatatacgaccttttcttacataaacaatacagttgggaaatatttccatggaggtaaaacgagtcgaatctcatgttaatttcataaatatttaccattttactatttatcagtcgcctgattttcccaaacaccatacaggacgacgcagaatcagtatcactgccgagacaagtgcgatacttctccaacaccgtggaggagctgaacggcaccgtgaccgagcacgagctaaccgagcttctctccaagtccctcttcctcatctccgcgggcacctccgacctctaccgcatcgccaacatactcgactcgccgtcgccgtcgccgccgccgcccgacaacgagaccgacatcccgcacctcgtcgcctcctacggcgagctcgtcgtccggccactgcacgccctgggcgcgaggaggttcggcgtcgtcaacgccccgccgatcgggtgcgcgccggcggtgacggagcagccgcacagccacagccccgtcggcggttgcgacgaccggatgaacgccctcgcgagggagttcaacgacggattggggtctctcatggccgggctgagctcctccctccccggcctccgctactctgtcgccgatttctacggcttctccaatgccaccttcatgaacccgtcggctaatggtatttaattacttgacaaaatctgtcagattattcgtgaaccgtcacaatttacttcttgcatttctttttaatgatgatgcattcctaatgttagtttgtcatcgtatgtacacagggtttacgaacactgatgctgcgtgctgcaaagggccctgcaatgagcagttcggagcgccgtgtgggaaccggagggagtactggttctgggacgtggggcacaccacggagaaggccgctaagctggcagcagctgcattttacgacggagaacgccagttcaccacgccgcttaacttcaagcggttgatgggaatacactggagatgatcgagatctcctaatttttcacatatttaatagcaaatttgatgggaatacactgatcagagatgatcgagatcacattttagtttttcttttaaatttgctattaaataattctaccccgtttgatttttattataaataaaaaatcacattaacattgatgtttttaaaataagttgcacgtaagtataagagagggaaatatattcattttataaaaatctaacataatgggtaaagaggggataaaaagaaaaattcagtggtacaactgtacatgagatgatgcaaaatttaaaaatttaaaggtatagaagggattgaggaaaaacttgtgggcacatatggaattttctgaagatcaaaacacggcaaccaactaagcctagcgttggaagaaataaaagtaaaataagttgatttttaaaagttggtattttttttagttgttacaatacatgctacttagctcaaatagagcgctacatgctctgtattagttctactaagtcgtatatttcaagtaagaaattttattccaagaacctagcccattagtagtaattttttccctaaaatacttagctcattaatagcaacaacaacaataataatacttactacctttgtttttaatatatgactatgttaacttttttacatcatgtttgattattcgtcttactaaaaaatttaagtaaatactccctctgttttaggttataagacgttttaactttggtcaaaattaaactgctttaaatttaatcaagtttatagaaaaaaaatagtaacatttttaacccaagacaaatttattatgaaaatatatttaattattgatttgatgaaactaatttagtattataattatgagaggggaggggaagtagaggctgacatctaggatccacccttagtcagctgtcacgtcagacaaaactggagtgaaaaccacttaggaacctagtttgcactggttttgtaagttgggggatgtgttgtatccggttttgcagtttaaggatgattttgtaactcgatgacagttgagggaccttaggtgtactttttcctttttattttcttgtggacggccgtaagccgctaaataagccctttgtcgctgtgtttcggcccattctgctggaaagaaagttgccgccgtcgagcttcctcctctctctctccgccgtcttcagttcttcgccaccaccggggcggggggatgtcatggaccggccggcggccgccaccgccgggggagccaccaaccagcctggggagggccgcgcttccctcgctcttcttcttcctgcgccggccgcgtatgtagctctccgcctccacctcgtcccccaccatctccgtcggccgtcgcgtcgctctttttccaggcagcgcgcgtgagtgagattccggcaggcagcagccacgcacttgtcgaggaccctctccgcggccggcgcttctctccggaccgtacgtgaccactctccctggcaagcagctcgaggagatcgatgatgcatcatcagtatttctgcaaacaccctcggttgctggtggtaggttgaagcatcttgcgatttgtttttcttgtgtgctcaagtgtgattcatggacagctaagccgacgtgttacgttttattaaaatctagggatttcaagctttgttcatcagattgtctgcacaaattatcgagctcttgttgacatagttgccttatgtgcccattctgctcttgaattcttgtaaagaggctgctacttccacctcaattttctgtactctatattaatttgccatctgaaaaggagagatcagccatcgccaagggaaaagatcaagccttcaagatcaccagggcccctccaaggacgccccatgatcgcctctccgtgaaaattgcacatttctgtttaccatcgacgtacactacgtctccatttaataattttctctccatcttttattagcatgcaaatttactgatggtccattcatgtcagcgaaattgcgtgtgttgtgaagcgaccaattttttttggcactcccaccatttggttcaaacgaccgaaattagctgcaactgccaccgtgaatccattatttccaccgacagccttgtccatgtcagaataatcaaatataattattgtgacgagtggtgtatccacatcaaggaaattaattttctgaccttgagataagtgcgtcatggaaaattgaatttccccgtgcacgttagtaaaatcaatgacgaccgtcagagctagtccggtttttggtagtttagctcgaaaagtgatcagtgaagacatatgcattactccctcgatgctatgataaatgatactccctctgtcctataatataagggattttaggtggatgtgacgcatcctagtacaatgaatctatatagacagagacagaatgtgtcatatccacctaaaatctcttatattatgggacggagggagtaacacattacaaccctgttgctatgatatatcccaattaaactagcttgttggaaaccaaaaaaacataaatctgctaatggtgcattttattatagcgtgcacaatagctgatgtgctgtgttaacttgatcatcaggctgctggaattcttgcttgctggcttgcacaggtagttgggaaaataggtccctagaatccattgtaattgtgatcctacaacctagagaatgtgagggtttttgaaaaagtacggtgcgacattcgtccatcacggctcgtctttctctgtgttccgatgctacttgtcatcgtccagataatattgcatctcgtgtgtcatgaacgcaattaagctaacctatccagcacaaaagaacatcatcgacttagcttgatcaccgactgcaggcaacaaccacaggttcttttgtgctgaataactgaatgggtgaatatgttaaacatgcaatattatgatatatgccaatatgccatcgtatggccatacatccagtgatcgcacgtgtaacaatcttacagctacacaatattcactgccacagaaacgattttcctggacagggaccttcagattgcgtgcagacggtaactcgtcgcatctgggaaaatcggctc

SEQ ID NO: 64099 - DNA, 8552 bp, Oryza sativa
cgagtgtgcgtgccgggcgcgcaggcggaggcgcgcgcgcgctccggccggcgccacgtgtgcgccgtggcgcgccgcggtggcgtgccgcgtcggggcgcgtgcgtgtcacggcgcgccacccgggtgttctcgttgtcttctctctcgcggtaattacctgccgtaagcctgtgttttgcattctgtagtacattgggaactaatcctctcaacacttctgtagtacattcttaaaacatcatttgttagattaatttagtattagcttaacaaaacttctttaaaattattattatcatatttttaaattgattttttatgaaaaatcattgtttaactatttagaaagcatgtgcgttaaaaaaattgagataactggaatttggaaagcgtttagcaaccgacaaaaaagaaaagccgtaaactaactgtgtgagaaagcgtcgtcctttatcctacctatggagtagatgtaatttcgtcgagttaaaatgaaaatgaaatatcaagtcttcgcagagccgaataaactttcttagaacttgcattggattgagttaaggtgatatctaaatcaaaagaaattctgtaggatttttacgggaaataactcccctgaaaaaaggggtaaaattcctgttgttgaaaagaagcttagcgtgtgagaaaatcttttgttgaaatggatcgaatacctctcatgttgcatttagaatgcgggaattttacgataatgttacaggaatttaaatattcgtatgaaacaggaacaataaacaagcatatgtgttcaaaatgagcatcaaatgtgaaagaaatacttcatcctaagctgcctctatgctgcttcaaattgatttccttatgttctaggaagacttcaaaatcttgtatattgctttaagcaaaaaacgagccgttaaagttaaacgcaggtgcaatgcattaaatcgtataagagcttgctttgtcacaggtggagcattgtataatctgcctttgtgttcatctgggcacacaagatattttgctagattgggtctacggttatgccgtcgctttctgcctttttcacgaggtacaccagctctaaccctcctaaatcacaccccgcctgcaaatcatcactacagctacccagtatattgttctcaacatgtgcttgtatttttcatactcttaggtggcatatctcgatcgaaaacctattgttaagctaagtgctcgtagcaattttttctattccatatcagttttcagtcaataaagctgtacaaagtacaaactttcggtgttaattagtcaatacctgatgtgtctgttagtacaacattaggcatttacatatcctttttaccatcgatcaaaataaaactgtccacattttatcccgggaccaaaccaaaatgtttttttgactatgtggtgcctccatcgaatttattgtttgtcctatggccgctgtaaaattttgaattctaaaacatagttttgaagttgtttttgagattttctaatcgtagtttattttgtagtttatttttgaacgtcgactcctaaattgctaaggccatatataaaaaaaagtgacccaaaaattattttctattgctgataatccatgctgcttataataagcattagactaactgatggcaacaaaagagttatagcatcaacacaccaatcaataacaaacaataacaaaatagagagaaatgaaaagaaaaactacaacatacatgtcaatatcgcttcaattattttaaattgctaaataggatggcacatgcatgatgccatgccatcaaaaaccgctcttggtcgcgaagctaaagcgaaagttgtagaaagctggaacaaaaaacaaaagcttgcttgaaccatcctatatcctaaccctcgaaagcgaagacgcaaagcttcacttttcaaaaggaaatgagtgaggctgacaatttaggtctaggaataaaatatgaagagtttcaagagttgtaatatggagagtttcaagagttgatggatgtacagaaaccgatttcatgacaattgcaagaggatgatgacgaggtacaaacccgaacagagccactgaaagttggaggttgagatggctaattgagagaacttcaactatagcttaaaaaaccatcatctggaacgagaaaggagatcatcgcagttgcggtgtagctcatcggagaagaaagtagcagatgacacaacttccttttcattgagcttgaggacaaaccctacactacagcattgatggtgagcccaaaagcccctagatgagaggcagttgctaaataagattgtggcaataccctccatgaccggacgcaaccgggacaaaacaagttagacgcaaacggctttcttgagctataaaagaaaagagaaaaaccaactacaggaagaactcaactatagaggacacaatccccttaccaacggccgatgactagggggaagaaagagaggggacggaagatgggatgcatgtaagtaactacaccggtacgaaagaagagagttttatagtatcacttaaaacttgaataccaagttatacgacgagatatcaatacgacaataccatttttaccatcagattttagttatttaacttacacaaacaagacaatcacactaaaattttactactatcgagctaatacatggacgctaatttatttatccaccggcagggaaggtgcaaataagcatcactgggtaggattatcagaggaacctaacaatttcggcactaatgggccccaccaagttgatgcaccaattggacttcatgaggtaggctgtggattcttcctgcaataaattaattaaggaaatgataatgataactgcggattagctaagagagcctaataaaaaaaacagtagtacgacaaagcagagaggagttcgggatatttctagactaacccagctgtagctgctccgagacagattgccttatccactactcctggtcccatctcaaaacaagattggagagcatctcatcagtacactgttcttctgtcaatgagatcgcattcaacctctgtcacttttgccccttctgaatctccccagcttgatgcagtttgtttatttttcaatactctaacctttaacacctttttctacaacaattgatttttcattttgatatgaaacaaaaatgaggaaaataaggtgttgttgttctaatataattgaggaatttcactttgggctatctttattaagtaaaattttacaatgaactaggactaaattcatattttcacacaacactgcatataattatatttttttttgtactttggactagggttcacaaagttgcaagcaccgaagactccatcaggtgatctactattttaataaattgttaatttaactttgggatggctcaattagacaattactctgctttaaagaaccgagcctaattaggggcgctataatccagtttcattattatggaattaacattgagtatttcattatttttagtttgagtacttcatcaagttaagtgccctcaactgttaagtagtgaaatatgatttgtgagcgttcatatgtagtaatgaaaccccatttatttaataggatctactataacttgctacattagttgttcttgtgctaacatgtgtatagttgtaatccctggtccaaatgcaataagaatgataactatatatgtggtgtcatgtgaaagataggttaggtcttaacccattgtaaaactttggttattaaagatcgtccaaagtaagattctctccacattattttagtttactactactccactagcttagatgctcatagcttgtaaccaaaaactctccataatttctttttttaaaaaaaaaactctccacaatggtttatttggcgatttggagagcatatgatttttttttgcaagcttcgagactgtattatcctgtttattgccccgtgatagactggtaatagaccttgtttatttaatatttcaaaataaattaaacatatgcaggagtaatcgtctgtcggaaagattttgatggtgaagccgaaaggtgtttcagaaaagaaagaaagaacgaaaggatgatgttacttcatattgagtatctcactctcaacagtcacctcctatgttatgtaactaatgcacctacctaggcctagcagaaggcaaaaatagaaaaaacttttgccccattatttacttgctgggttttattagccgtagcaaattttaaattttggaacttaagtataaagttatttttaatgttttctatggtactttgtttttagctttggattttttttaatcaaatgctttcgcccatctttactaacaaaacataacgattgttcttttagcattggattttaaataaacaagcagatataaaagttttatgcgttcgttcatttctccacgggttatcagccacagagcgatcgatcagagtgaattaataggaaattctattgcatcaaaattttatttacctgaatgccgtttttcttttatctttttaccactctctcttttacgctttaaactttcatttcaacccctttgctctctcactcttttcagaataaggaatcgttggttaaatagtagtagcagcagtataagacaaggcaataaaaacagacaagaggtagaaatacagtaaaatggacaaactagccatcatcacaggttcagtacaaggagcagtatttataaggactatatatcactatgcccccagtgaattcttgagcccctcttggagacaagcaaatttgataaaaaaacactagcctttgtctgaaaatattttagtactagtgaaaaggaacaatgaagaagggaaaatggtccaaggaagaggacgatttgatcaaaaaccacatggagaagtatggcattggccgtagctggcaggcactgtctgatgctttaggtttgtttttttttttcaccccttgatgcatacacactgttctgaacattggtattaacattaacaaattgatgtgctcccatcataaactaaaacgaaaagaaaaacttgcttatgtgaaaattgtgtttttttaatcaaatcgtcctcttcattggagcattttattgtagtcaagtaacctcttgcaaatgatctgctgttgctgtctagatcagttaatcttctgtttagggtaatagaaaatagtaggtaggtaaccctgttctactgcatgttatttactgtaaaaatggaaggcatgtgcagttacttgactacaataatttgtgcaacttttatgatctcaacagtttatattagttgcagaaaacactacaaaaattctgtttttattactagtagccccattatttatttatttgatcaatcctctaactgtacagtttcttattaattttttagacaagaaatatttctgttaggagtttaactgctatctattctcttctgattctctcagaaaaccatcactatatcgtttgctcatatctgacttgatcatggcaatgtatgaaacaagtgttttttttttccgatggttcgcagggctgcagaggtgtggccggagctgccgttcccggtggctgaactaccttcggccggggctgaagcacggcgacttctcgccggcggaggagaggatcatctgcaagatgtacagcaagaagggaagcaggtcagtgagccagcctcatgtatccacttctgttgttcataatctgagaattgttgattgtttcaacattgtctgcaagaactgcactgttttactcactgatttgatttgatttgatttgattggtctcatgttatatttagctgagatttcggatcaaatgatctgtaactttgtttatcacttctgttcatcgggatatgagaaattgagaattcttgattgttcaacattgtctgcaagaactgcactcttttactcactgatttgatttgatttggttgctctcatgttatatttagctgagatttctgatcaaatgatctgtaaattttgtttatcaatgatctgctagtgatgaataatgcttcaaaatctgcctgcttcgctttgttgcatcacggacacaagttgcgaattgttttttggttgccattgttgatggacgcagctggtcggccatcgccgcgcagctgccggggaggacggacctcgccgtcaagaactactggaacagcacgctcaagaagaggttcccggcggcggcggcggcgaggagcaccgccgccgcgcgccgcaggcaccgccccgccgccagcgccaccacatcgtccgacgacgacgacgacgtcgacgtcgacgacgcgaccccgcccggcctcgcgctggtcgtctacagcgaggggagcaccgccgccgcggcggcggccggcgagctcgctccgtactccatctcatccccggccgccactgccgacgcggcggaagaagaagagccgatcgcggccgttccgatcagcacctgcatcctggcactgccgccgccaccaccaccgccaccgccgccgccgagcgatgccaccggcggcgaggtgagcatcccctgcttccccttctcgccgctgccattcatcgagccggacttgccggagctgacctggacgaccgacctcgacgacattaccgccaccttcgatgccgccgcctgccgctacccgaagcggccgcatccaatcacaccggattcgcctcgccttccgaagcttcccgccattgccggcttcgacgacgtgcagagcttcttgtcttggttcgatgactgatagtgtagcaagaaatggctcagttcttggtcggaattaacagtagctggtttaggaggagatgcatggttatcatttgtgtaatctgttcgaaatttttttaaaaagtttttaaggttgtttgtgtggctactggctacgtgattatctaagaactatcggttgatctaatcattatctgtgaacttgctggttgcgaaggtgaaccaaatgatttagttttttagcataaatttgtcgcaaatttgttttataatttaaccaaaagcttttttgaaaaattgaaaataaaatcatctgtagcatatgcctacggtataatacgtcgccgtttctgcttgctcgtgccaccgcagcgcctcccgccgccgccgccgaccgatgcctcgccggtcgccgctgcctctactctactcctcctcctcctcccctttcaccgcttcattggcggtgctcgcggcgtgaccccgagctcggagctgacgtctcagcgctgctgctccgcggacggctcggcgcgcgccaactgttcgacgaattgccccaccgagtccggtggcgccgcggctaccttcgcgccgccttcgctgcctccgtctccaacctcaacgcgcgagacggccacaggggaggtaggtttcgatgatctcatcacctgcggcgatcgatcgatctcagctcgtcagcttccgatctcgcgtgtgacgcctggacctctcgtcgctttggttttggttgcattttaagagctttgtttaatttttttttcttgcagtgaaagcagaggctatgaaatcatcggcgcaatgaagtaatcactcctgtcaatggtgattgattcagcaatgctgctatcttgcgagaagtcaatccgtttctcgatgaaatattgctttggtctgaaaggttagacaaacattatcctcttgttacagattccaaacaggtttcttttcatggtttaatcctgctgacacatgtggttactggctacatgatacaatagctgccaatgaatgccaaggttggatggttacaaactgcatctgaacttgaaattgaaacactgactgttggtgcaaacctagagtttctattatgtttaatcggtataggacatgttttatgatccaatcttttatttttactggttcataaaagtgtacctggtgccaaacttcaaaaaaaaaagaaggtaaaagtgtacctgccttatctgccagtgtcgtatccagtacagagagagaggaaacacattgtattgagcaagcagctctgtcagtgtcaataaccatactactgaaatctattttcacagagtacaagtgtgctgatgatatataatggtagataccataggttattggtgagaaaatcttttaactttggaatttctgtttgtgcatacttcattaactgtactatccctattgtcctgttgctgtaaaactcgttgatcattttattaaaaaaaatatttttaaaaagctagccctgaatacctcattggattaaaaaaggtgttcatgtttgttctctttctctggtgctgaagctgaaagcatgttctccacatttttggccaacctataaattaaccaagttatcgaatgcaatatatcttagagaggacaactagatggtgcaaatatggtactccctccattttttaatagatgacgccgttgactttttctcacatgtttgaccattcgtcttatt

SEQ ID NO: 64100 - DNA, 19774 bp, Oryza sativa
ccacgcttacttagctgccacttaaatcaaaaccggggtcaaaaccaccgaaggatctcgggtgactggttttgtatagttaagggaccctgcatatctggttttgtgtttcgagaacgttttttatcccgatgacaagttgagggaccttcggtatactttttccaaaacagaattgtttagtaccacctcgcccagccacgatagaggggagccggaggcgctgtatataacgcgacccgataccaaatcacaaagcatacctttctcagccttttggctaagatcaagtgtagtatctgttattatcagtttaatatctgatatgtgggccatatttccatggatattaaattaatattttgtgggggagggtccaccacggtagctcgctactgggcgagccctggctttgcactgctgccttggcccggcgcacctgtaaaattttttaagcttttgctcatgttaatttggtttaatcattgaccgaattaaactgactaggagtgaaatcattgatgaatttttgacttgacttgacttttcagtgaatgattttaagatttatttgtccaaactgagttattttggttccagtttatattgaaaaacaaacaaacgagaggtgtgtatttggtttaatcgttgaagaaattaaactgactaggaatgaaatcattgacgaattttttactgactttttagtgagtgattttaatatttatttgtccaaactgtgagtgattttggttccagtttatattgaaaaacaaacgaacgagaggtgtgtatttggtttaatcattgacaaaattaaactgactaggaatgaaatcattgacgaattttttacttgacttttcagtgagtgattttaagatttatttgtccaaaccgtgagtgatttttggttccagtttatattgaaaaacaaacaaacgagaggtgtgtttggtaagcctcgtctcgaaatggcgacttgctccgctgcttgcgctcgcccagccgtcgtcgtcttcgcgtcgccggccgccgcgcggcggcgcgccgcctcctccgtctacctccctggtcggcctctgcgcggcggcggcgtcgtgcgatgcagcgctgggcctgtaagcggtgggatgatctcgaagaagggtaagatatgttcctcctcgtctcgcgtggggatttttttcgcttggaaaaatctgacggtggccgtggccgtggcagtggcggagctgtgggcggcggcgaggagcgcgtcgccggtggcggtgatcgccgcggtggccggagcggcggtggtctacaaggtggggtccagtctcctcgcgccgcctcctccgccggcgaggccccgggaggagcccagcgaggaggccccgccgcctccggagccggtgcaggtgggggagatcacggcggaggagttgctgcagtacgacgggtccgaccccgagaagccgttgctcatggcgatcaaggggcagatctatgacgtctcccagagcaggtcgctttcgttaagccctagcttctgtaaaccctcgttttaaagcttttctgctactatgtttctagtttcaaaaaccaaagctgaattgtggatttgtgatagattattcaacttagttcactgacgagtggaatcagctacagaaatgaagtgcaattcatttaatttggtgactacatctatgctattctattcgttgtgtttgtgaagattacatggttttaagaataatagactaacaggcaagtagagtcgaatcaggatcaatctgaatgctaatcggcaagggcttgttcggttaatccccacgatggagggattggaggggattaattccacctctcaataggtgtggaataaatcccctccgattccccttgaatccccttgtgggagggattaaccgaacaaggcttaaatgtttgatgttcgtatccttcagtcctggaaatgaatataagatcaattttagatttctcaaaataaactgcatattcatatgacaaaattattgttcatatgctgttatcaatgtgcacatgttatctgattgtgtgcttagatcatcagtgatcagctcgccatgggactaaagtctgttgttgttcttatagatcaccactattcgctgttaagtatgcctgctatctgatattgtgtgctacagcatgcagtaacatatgcctcaataaaagtctagaagcctaatactaacttctcagttgggatttatgcatgtggaagtactgtatatttgtaagaacaacatttcctatgataaaaatagagtattatttataacctacatttggttcctcatgaggtctgctgaaagtttggaacttacgcatgaaaaaatgctggatatcaaaggaggagctttaatatcaatatagtattaagaagagagggtgagaagcctgggattgaactcaggcccggtggtagcgctggtagctcttctaccactacaccttgtgccattctctggaacttatgcatatgcctacgtttctccaaatcaccaacttataatgttccctacaatagtgtttttcttgcttacgattacaaaatccatatccagttatccgcactcccagggcattttgttatcttcctcagttcaaactttcagtaatattgtctttgcctcatattgtgtttactgcacataaccttcgtaactaaatgattttctctgtgcagattgttctatggacctggtggaccatatgcattgtttgctggtaaagatgccagtagggcgttggcgaagatgtcctttgagccacaagatctgactgatgatatatctggcctaagtttacttgaactcagtgcccttcaggactgggagtacaagttcagcagcaagtacgtgaaggttggaaccataaaaaaggtgctcgtagaacagggtggcgatagcactgccgatgcaatagaggaggcagctgtcgatggtgaagacagcatcctgactgctaagatgtctaatcaattactatatgaggaagaaatggaagtcggtagtgatgatccatgaaggcttcaggagttgaaaactgaattgccttctagcagctaacttcacgcatcaagaattcaagacaaataatcgcagaatgatgtttcatgaattcatgtgtctataggtgtagattacaagaagatactgcattactgctgtcgatttccctttgtcaatactcaaggatatgttgccgtaatgccatgttattagttggctgtcctgttcgtcaataatttcatatttctacctgcccacagaaccccttttcttggttacatgctaattcttcattctttcttgtattgctctccatgcattcttgtagcattgtccgccatgccattattggaacagcttaatacttcataaataccttgaatctgggggcatgtcaggtcaggtgtaattgatttgaacagcagaggaaaatcaaagcaaccagtgccaaactaggcaaggaacttaggcgcaatgagtaaattattcatccagcacaggtatttcattctctggtttctgatggtggattggtggtttctatcacaatttattttaagattgtaaagggcagaagatacataatctctattgcaatttattttagtaatgcttaattgctaagcatattatcttgtacctagctggcatcgaacaatccattccatgaacatgacatagatgttttcttgcgtaacacaccttggcatgagatctagaagcacaactaatatattcaaatgagcttcaagaacacaaataaaagattgctcaacaaagaaacaaccgacaataaaacaaatattttctcagggataggtggacagcgcatgagaccaacctgaagctgcctttttgtttatctcatcactgcttgtatcatgccctacttcagggagtcaactactttcgtcagcaaaatgcaccaggattgttcagctgcataggaacaagaagttgaatttatacctttttcctaactcccaaagtgtcaactttttcatgttctaaccacctttttcatgatcagtgtgacaggtgtaaggacagaggaagctacttccaacagcaaaattctgaacttctgttttctttgagcctttgaggaagtactattggagcacacaacactcgcacaaattaagtatgtcttctttttttttagaaacatggtagattaaattaaatgataggagatattacaaccctgtttttacaagaaataaaagcaaacgctccgttaaaatagaacaaagagatattgcaagatatgcggacagacgagcgcgtagccactgatgaaatccgatgtcaaacatgttatctgctgatgcccagacatatatgttttctaacacgcttaaaatacttttgttgttctaggcaccagcatggccttcttctaacagttaatagccatcaaccgtgcaaggttgttacttgttaccactacaacacaattacgtagcagtaacagatgtaagatttttcctccttttttttttctgaattgaaagatggatgtaagatgttttgccatgtgaagtcttcaggtaacctaagaataaaagatttagcaaaattgcagtcaaagccaagcctcaccaggtcacccactcaccacacggaagagtcttgttgacgagtagggatcttctgtggcatgatcatctcctttgtttgcttgaaacggtcgcatcgtaagcagccagcaagtagcagagaatgagtcattgtgcacataagatcccagctttgacagattaagcgtccaactaaaacgtgcaggaaaacagccgtatacacaccagcacgatgtcaaacgccatagaaaattagtattgtttaggaaggttcaactctggtcttctaatctgcagtgtgtaaactgagctgccacctttgatgctcctcatttctttttgagaatgtttcccggtcaactacggttcatgcatgcaattgatgcaatctcagtcctgtctaactgaaatattctttgttcttaaaaaggagtgtattcataatcaccgctcagttcttacaattattggtaccattagatcccaactagattacctctaattaattaagttcagaagtaatatagtttctttaaagcaaaggcaagaataaattttaaaaaataatgcagactgaatactccttttttaaaaaaacttactgagagtgtgtttagttcgcgctaaaattggaagtttagttaaaattgtaacgatgtgacggaaaagttaaaagtttgtgtgtagaaaagttttgatacgatgaaaaggttgaaagtttttttaaaaaaatttggaactaaactcggcctgaatactgcatgttgaacaactttctccccgacactgaacaaacagggcaatgctgcaatgttaatttcgaaagggaaactacattttggcaggatggttcttccatggccggcaatgacgggagctttggcttgatgtcgccatttccacgcacactatgttccaaaatgtgagtccaatagcaacggcgcgagaaaggaacattgcaaagatgcaaccgtgttctttgctctcatcagagagagaaacgctccatttgtttatcaaaaaccattttgctaaagcaaaaccacttgggtattagtaaattttagagaatgattcatagcttgtcgtgcctcaaaatcttcgaatatgcgtcgcattattatcgattagtactcatcttcaacatgattaaagaaatccaaaatagacccaagcaattacaaaataaaatgaaaccaagatacttaaaccgagttctaaaatggggttggaatcaatccctctaccacgatttccgaactgttaaaagatgtatttcgtgatattttttacatatttttgaaataaataaataaatctctatagtttataatactagttaatgctcaactaatcataaattaatgacttatcctttttttcaagcctaaggatgagttctattcttctctttcccaattcacctttctcttttttcgcatacacgtttttcatactactaaacattgtattttttcaaaaaaaattataacaaaagttgtttcaaaaatatattaatataatttaaaattatttatacttaattaattatacattgataaaccaccacgttttctaaaatcagcatgagacccttgaccgacatgtgggcccacaaggtcaggagagtgtggccaccacgtcgacacgctggggccgtcggccacaggaggtggacgtgcggaggccatgggagctgcgtgtgcccacctcgcatgctcaaaatttgatggctgcaattcgcgaatgggttttctttcagagatgagaaaaagcgaagagagagataagggtagaggatagaatgtggcagctgcagccaatcagaggccagaggccaccacactccccctaccctctcatcccttccccccaccccccaccaaacccaacatggccatgggattcataaacattttggaaatcttgggatagtcaccttttgtttttggggcttgtagtttttggaaatttgggggaggtccaactcttgctccttttttttttcttttacaacaccgtgtttagttccaaagtttttcttcaaacttccaacttttccatcacatcaaaactttcctacacacataaacttctaacttttctgtcacatcgttccaatttcaaccaaacttccaattttgatgtgaactaaacacatcccaagtttgaatgtgaaggtgaggtcaccacgtaatgagtatttactcgcatttcgctctttggggacccataagataaaaacttaaagcaaaatacgataagttcaatctttcctagttcccacatgctgctaaattttctcggaaatttttattgtataaacttatgacaaacggtgacatgctggaacgtgatatcatctgaatccaatcaagacaataaacttctaaccaaatttgatcaatctcctggtgaaagaaatctcttcatagatctcctgatgaaagaatttaacactgaaagaaaaacaagagattcacaagagcttgagacaaagttacaaattcccccctaacacaggggcctctgaacaaaactaattttgcaatagaaaaattcagagccggcagtagaccgagccaatgcatcccactgttgcgtgggccccacacgccatggcctaaccacccctcctcttcatccccccataacctctcgctccaaagctccaaccttttcctcctcttgaccaagccaagaacaccaatccccgcatcaccaatccacacaagcttcgcagctcgcgcgccgcgggaggggagggagaaaagctcgcccccgagatttttctcctctcctctctgctcgtgtttcttggattggtccatatatccacggttcttgggggcgcggcgcgccgccattgatctggttttggttttgtgaggaggagaagttgcggtggtgctggtgctggtgctttcttgatctgatgatggcgagcacgacgtcagcgacggccgccgggggcgcgttcgccgccgcgaagacgcgggcggggtcgtcggcggcgggcggcggcgcgtgcgcgagggtcgccgccggcgggcggaggcggtccggcgtggtggtgcggtgcgacgccggcgtggaggcgcaggcccaggcgcaggcggtggccaaggccgccagcgtcgccgcgctcgagcagttcaagatctccgccgaccgtgagtatcctcctcgcgtccctagcccctccttttcttcccgcttcgagctcgccggcgttgatgcgacagctgtgaaaatctttgcgtttttcttcgtgttttggtgctttgattactgctagttcatatttgagcatgtcaattagtcaataggtaggttgtgtatggagaagaaaaggaaaagatttgggatgtcgcattgctcttttctagatttgctttgatttgtatgaactatttctgcaggttttctgctaagcgaattttgtttactacctatacgtttaaccggctaagtaatttgagagagaaaagaagaggcaatttgtgagctatcttggcattagagcgaattagcattggagatgacgaacttacacgctaacccaaaggaattattattttttgctgttctccagtgaattgcagggagaaagcacatgccaacttgtttttttgtgggttagttgtagacctgtagtagtaatacacgaaatggctttttttattatggcaaagagcttttcatagtaagtaaccgaataatagtagttcaacaaactggttactattactgcaagatgccaaattttcaaatacataaagatgaaaagaacacgtcgtagttgtattttgttttattattagctattggccaagtatgttgcatggaaaaaggttccactctatcttgttttggtcaattgtttgggaatttgaggttgtaaccctatgtaattagtaattactgcaaaaagtaggtattccagatttgcaaccattacactcataatgtaaacacaggatacacccaaaagaaaaaaaagtatccatgtgcaactattgattgaaaacgttttgtgatgcgccatcgatttttagtttcatccttttagtacaattttttacatgtttacttcttgcagtatttgacaattttttctttcactatcagggtacatgaaggaaagaagtagcatagcggtaataggcctcagtgtacacactgcaccagtggagatgcgtgagaaacttgctgttgcagaggaactatggccccgtgctatctcagaactcaccagtctgaatcatattgaagaggctgctgttcttagtacctgcaatagaatggaaatctatgtggtagctttatcgtggaaccgtgggattagagaagtggtagactggatgtcaaaggtaaggattgtttcatcaaatgctcatttgttctgtccatagtcttcttttctcgtcttttccctttttctgtgactgaagaacgcggtttgtcttagatggttctaattcctctgctgctttttttttcaacagaaaagtggaatccctgcttctgagctcagggagcatctattcatgttgcgtgacagtgatgccacacgccatctgtttgaggtatctgctgggcttgactctttggttcttggagaagggcaaatccttgctcaagttaaacaagttgtcagaagtgggcaaaacagtggaggcttgggaaagaacatcgataggatgttcaaggatgcaatcactgctggaaagcgtgtccgctgcgagactaacatatcatcaggtgctgtctctgtcagttcagctgcagttgaattggccttgatgaagcttccaaagtcggaatgcctatctgctaggatgctgttgattggtgctggcaagatgggaaagttggtggttaaacatttgattgccaagggatgcaagaaagttgttgtggtgaaccgttcagtggaaagggtggatgccatccgcgaagagatgaaagacattgagattgtgtacaggcctcttacagagatgtatgaagccgctgccgaagctgatgtcgtgttcacaagcacggcatccgaaaccccattgttcacaaaggagcacgcagaggcgcttcccgctatttctgatgctatgggtggtgttcgactctttgtcgacatatccgtccccagaaatgtcagcgcctgtgtgtctgaagttggccatgcgcgagtatacaacgtcgatgacttgaaagaggttgtggaagccaacaaggaggaccggcttaggaaagcaatggaggcccaaacaatcatcacccaagaattgaaacggttcgaggcatggagggactcgctggagactgttccgactatcaagaagctgaggtcctacgccgacaggatcagggcttcggagcttgagaagtgcctccagaagatcggcgaagacgccctcaccaagaagatgagaagatccatcgaggagctcagcaccggcatcgtgaacaagcttctccacggcccattgcagcacctgagatgtgacggcagcgacagccgcaccctcgatgagacgctggagaacatgcacgccctcaacaggatgttcagcctcgacaccgagaaggcgatcattgagcagaagatcaaggcgaaggtggagaagtcccagaactgagattgaagaagagatttttttttttcagcccgtgtatctactatgtatactactaccatatctgtccagacattctaattccaattttttttctctctctcttgagcctttgcttactgagccctcgctgagttggtcaaattgtctcgtgaattagcgccatggctgctgctagagataactaggaaaatgccttgtttgtaaattactgcatctgctgtggcaagagctccattttgaagatattatatacacgctgttggtgaaataaaatcagaagttcatcaacctttgaagctgttgttttgtgagcttatatcatttttgtacagttatgtcagatcgtgtatgtaaaattgttgattattaacacttcccctagtgttcagctgtttgtccatgttgattgcctgcactctgcagcgaatcttaagggaatttgtgctcctcaggcttcgttttgtgctgaactggcttttcagaattacacaacaaaccacatactagagctaacaattaattctcgtaatttttcgtagttagtgcacagtgaacacagtggagcccgatttgtataaaaaccatcagaatctgtatcttggaaactcaaaattcaaacacgactagtacgtagtacacccttggtccaaaaaaaaccaaaattctaatacgctatgtatagattcgtagttaaaaattactccctctatcccataatataaggcgtgtacatatttcaagattcaattttaaaaacatttgaccaacaattattataatataaattaaattttatttgctaaaattaatataattgacatttaaatttactttaagatggttataattttgttgcaataaactttatagtatatgagaaattataaaaaaaaattttgaagaccgtaccaagtattattattattttaagctggccggaacagcgacgcgcgccgtgggctggaatctacacccagtctcaccgaaccgggcctggccggcgggccgtaaacctctaattctttcctcgggatgagtagccggcccggcccggcccacccagctcaggcgagaaacctcttccccgcgtcgccgtcgccgtcggtctcgctctgttcacgacggcgaagtgaggagctctcgcggcggatcaatgtgaaccctttgacgcgccgccggctggctgggacacaccatcgctttcgcccatcgcgtcgcgtacgagcaatggccggcgaggattttttttttcttttttaccccaaacctggatcgaattaacgagcctttttttctgtaatatttctgttcttctgtagatgctactattattttttttctgataatgtttttagaagtatattttagaaagctgcatgttctatgattaaagttgcagaaaacaagacccttggagtattttctttaaaaaaaaacttgcaggaaatcacacatattatgatttctggcataaaacccaccttatttaaatctcaagtaaatttagcatatgtgaaaagaatattattcaaaacagcgtagtaacaaaccaacaacatgtattaaaaaatcggaagctaatttttttacagacactttatacgttgaaattttaaaaaaaacacattcaacatgtataatgagtggtgatcaaagtatgatgagtcatcactgatgaagacttcataagtgatgagatggcggattgcatgagtcaggctcttgtgcctaacaaattatggatgccatcactgaaaacttgttgtcttctgcactcctcagagacttcttgagtcttgacatcttgaacagaacagtgcatctcttgtactagcacattgtacacaattgtacatcatgcatagtgatcagctaggctgtctaacttctgctgctaaatcctagctaatccctaactctacaatttctagcccaactctctccaattacagagatatttaatggccatgtgtcctccatcagtggattggtctacgaactgttcttaactgaagttcatgcattgatcattgcttgacacctagattaattcaatactatgcgtaattgcaccttgctccgggtaaagcacaccttgtttcactttgcaccagatttatcatgtactttcactttacactagaggctattgcctattgatatgagattcaattaatatccagatgcagcatcaaacctataaaaactattatgaaatttcagaaaattatgcatgagttattataaaatatgaatacaacttttatgaaaactcatgagttgtattcatattttataagatttatcttcaattatatgaagcaacttgatgcaaaataaaacttatttagatacactctatgtgtaaagtgaaagtatgtaattaactgggtgcaaagtaaaacaagctacactacaccgggtgctaagtgcaatttactcttaaattattataggagaaaaactctgtagcttgtttttttctccacaagccggatcatttgaaatataatgatcttagttccagaaaaaaaaattataggaggtcaatcttgtcacaatggtgggcagcataagtccaagtcggtgccaaggaggtccttgcatttacttcttacagtgcacttggacttgggagagctttcttggtgacttggtgaaagatccatttgccttgtcactataaaagcagaaaagcaacacacattttcgttagaactttttgcccccagatctcctcctctcttccttgctcagctgttcttgttcctcttgctaggtgaaacactttcttgaattgctgagaccatgttgagatcaagaaaatccagggtaatggtgatgctagttactgctgctcttctactgacggatatggccggcgttagctatggccggaggctcatcccggacctcgatgccatggcggtcgtcggcggctcgccgccggcgaaaggcgggtacatgtcaaggttgcaggttcctccttcagattcaggacatcacgttggcgatgagtacagaagcatgcatgctgtttccaagagattggtgcctcagggaccaaatccactgcacaactgatcagcagcttcagctgagccagcttcttctctgctgccttttcaaggagatatgctacagtttaattgcagtcaattagccacactgagtgaattttcacttcattgagtggtgtaaattagatcttgtagagtagtaagagtaaaaggtacatatgtgtgtatgtaagtattttagtgtgaagagtgaagaatgtaacatttggttctttttacttatagtaaactctgaaaagggtaaagtctttctggtttgtggtgcgcaggacgaaaatgttattgaaaatatatgcaaatgtatttactagaataatataggatacaagtcaaagttttcagtgcagttgtgttctttgtcaattttctgaaaagaatatgttcagacttgagagataagaacaatgtactgataattgatgatttaggcagtacaatccaagttatcagaacttcaaaattgtggatcccaaagtcttcatggcagctcagactttagaacttcaaagcaggactactcgtatatcatccaaatgcatgtcattgtttagtcaggttggtggtaaatgatagattaaagaaatcaaatggaagaaggcttcttttttctgccgctccacgtattttagtaaggaaaatattgcaatgaaaatgacataagcaaggaaaaatatatttttgtcagtaggacaactagcgcatatcatcaaggttcaagtgagagatcacagcacatcaaggtgctgaaaatagctagcaatgtattgtcattcgtgacacatcaaacaagttaggctgttactgtgagtgtggtgctatttgacttggaagcacgtgaagcgattttcaggcagttttctgaaaacaatattcagaattcaagaaaagtctgaaacctttctgcctggtccatatatagcacaatgccaccttccaagtctgaaacttttacaaagattttatttttcttacaatggagagtttaggtgctgtgaatttgaaacatttaccaagatcgcatcctcagtaatgcactctttgtttttcaccttccaaattaaagaaaagttttgtcgataaaaccatgcaggcaaagtacggatctccaagatccgaatgttcagtcaaacattcagattccaaattgcaattcggctgccatccaaactcaccattctacagtctatactctaataactctatacaccaactctaacaaaatcaatcatacgatgagtcacgcagccgatccacatgaagacgcattttgcattagacaaatccaatatgtattcaactgttcattattagataaatccaaagctcagaaccaggacaaccagctcccgaatagaaaaaaactgtggacactagcgcacatgagccatgaaacagaaccttcaacttaaaaatcaatccatgattggccttggagagttggacctcactccatccagttccatcttcttgacctcctttccagcttcttcttactctgctcccaaatcttctcacatacatgaagctgctgctgccgccgtcgatacgacggggcatgctggtcaccttcttcttggcatgcttctttcttgcagagcttgctggtttcagccatggaaggagagttatggaggacaaagaagacgatcactcagaggcgtcttcagaggagcagctctacgagttgccaagaacaagaggacggccttttgtcagtgctcccagcccggcgtatgaagcttccgacaggccagtgcctcaaggctcgaatcctctgcataatcgatgaggtttcttcttgctgaatttcctctgctggccaagcacatgcagatgcgttaattgtagctctagcagtgtatgcagatgagaagaatgctgaacattgaacaacgagtttggcttttcacccttgtttgtgagtgaaaaaagtacatgcaatagcacgagtaagcaaacttggagttgcatatagtatagacctgttaattgatgtgtttttccacaattgcattatcctagttgcatataggacaggaagcaaatagttaaaaagttgcaagcttggagttggtttgcttccttttattttgtaaccttgtacagtaaaccagtctgtagtactcactagttctatttgatgatcaaatcaaccccactgttcttgacaaaactggaccaaaaaaaagggtgaaaaaaaaagatgggggtctgccatggaaggcacatgggccggaagcgggccagggctgcagcggcccgttatccttccaccgttggaagcgggcggtactcgctgctctgtgaaaccagcctcacgcaatacccgccactctaggtgcagggacgctctagctttcgccagggcgccccatacacgctacgcaacttggaacgggcgggccgcatagagcgaaccacaggcccaggccaaagcgcaaacgaccaggcatccgcaccaccttattgcccccgctcgggtgacaagccatcgctacttggctcggcgagaaagcgggtggggagtgagtatttaagctggtgtggagcttactgaattggcgaggtggtactaaactcgagttgtttgtcagcttcctctgactctgagaggtttgttttttggttagctcgtggccttcgtggatttgtgaggatggttgggctttgggcttctgtttcacaataatcaacaggccttgtccttggagcacttcgcacaaaactcggtccttgtgagatgggaactggactctccgttgtgttcttgcagaaagtttttgtggattgagcttgtagtgattttctgccgttgatttttctttaattgtagcatcaaggcagaaaggttttacaattccaagaactgcatttgcagagatcaaaatatattactagcaattttagccatacaatagttgctcaacttcaaaaatgtcatcctgtcagttggcagggatctgtaatttggatggacaagctagcagatcattttcactcaaatttgagaagccaggacatgaaaatttcactttacatgtacaaacggatagattgccttggttctagatctgaaaattaccaggtacatcaaatggaaatccaagggcaaatcgcccaattcaatctctttcgtttacaactaccacaaaaacattggagcaaagaattccgcatatgacactgaaaaggtagctgcattcctcttcctcccaaagatcttcttcccccatcagaaactagtgccagcatttcgatgcatccaggatctgcgtcagcaatgcagcgtttcttgtgcaaagccagcaaagcaaccctgtaaaatgatcacctcaaaccggatcaaattttccttgccacaaacttgaagctggcatgatttacgtatctgaaatctgaaggaatcccacaaatctatagaacaagatgctttatacgaccaaatcaggaatcaggtacagaacagatgaaccaaaaaaaaaactcaagagaattacaatcacaaatccataagctattcgagtcacacactttatgaacacaaacacaccgcacaatgcagggacgatggtttcttgaatgccccccaccgaaagaacgccaattgaaccacacgcatccacagatcacacgaacacgcagaaactaatcaagaagcggatcagagaagggagcagcagatgagatcacatcttggcgaaggaggcggaggaggcggatcggtcgtagtagtactcggggagggcctgggggcgggagagcatgagggggcggtccttggcctcctcggggtcgtagtcgtcgccctcgtcgtcggcggtgtggacgtggatgcaggagcagctctccatggacgcgaagaaggccgacgccacgctggccccgacccagatcgcgtacccctccagcttctcgtacgacaggatgccgccgccgccgccgccgacgccatccatggctagccgccgcgctcgccggaaaacgtgaaaaagtgggagacagtgggggaggaagggttcgtggtggctatttttctctcgtttttgcctttggttttcctggaacagttcgttttggctgttgtcctaaagttggcgaaggaggttgggaagttgggaaagggaaagcgaatgtcggattttgagaccttcgaggcatgtggttttttttttcttcttcaaaagaataggagtggttaatatgatgtctaaataatataaataaataaataaaacttattatgttgcatgtacctccacaagcatgtcggatcaaattctgttgatattttgagaaaacaataaaaatggatcataatctctcgagtggtctccctgttctcatatgtatatacataattattttttaaaaaaaatgacaagctttaatttcaaatttgatatccttaagttaaaaaaacaaattaaactctaaccagtatacatgtccatgtagtcatatttgtttttatgttgtagtttgtagatttcaaatttaaagcatattaatatatcttgttaatttttaatattttttataacattttagatgatatgagaaaaaaaacaaggcaaaagtatttccccgaaaataaagaatctagtaaggggtacatcataaacaaatagcaaagcaaaaatttacaggcatgttactttgtggttgtaaagttagatttcaacattcaaattttggttgcaagcagataaaaatcgtccaaatttagaataagttcaccggccatccctcaactttacaccacgattttttaaggtccttcaaccacaaaaccagaaatctccacccctaaaccatacaaaaccgctcactcaaagtctctaggcaatatatatgggtggtttcgctgacgtggcatcctaatctccatgtgtcaacgacggttgccgccaccaccaactgggcgcctgcgacgctagcgcatgcccgcgcctccccgtcgcccacccgcgccgccatgcttccccactgtgtccgtcggcgcggtgcagcgccgccctcctcctctcctgcctcgcctcgccgaccggcctacagacatatatatagagagaggaggaatggagatagagagaggaggaatggaggaactgaggagtcacctaggtgtagaaaatactttctggaggaggaaccgaggatgagaagaggggagagagaaggatgacgtggcatccttacatgtgagtctcacgctgactcagccgccacgtaagacaaaaccgggtcaaaactaccgaaggacctaatgtgatcggttttgattagttaagggacacctggttgggggacgattttgtaattcaataacaaattgagggaccttcagtgtactttttcccctcggggaatcacgtgggccctgcggccgtgaaggcccaaaccgtccgggagacgagacgcgacgcgagacgacgaaggcagataagtcgataagatcgtaagatcgcggcgaggcgcgcacacacaccagctctctctctctctctctctctctctctctctctctctctctctctctctctcttcgccgcagcgcagccaccctcacttgtcgcggccgcacggacatggcctccacctcttcctgcctcgcctcgccggccacggcggcggcggcgccccggctgcgggtgcgggtgacgccgagggcggggcgggtggtggcgtgctcggccgggggtggcggcgggccggaggcggcggggctgtttgccggtgagcgcaaggcggtgggcgggcttgcgtgcggcgtcctcgcggcctgggccgtcgcgtcctcgtccagccccgtgattgccgccagccaggttggtctccatggcattctattggggggtgtagtgatcttcctctggtggaataaatcccgcacgatcgtgacaacgggtgaacaaatacataggctagagttgcgcttggcaggaattgtgtgcttagaaagagaaatcacttgatttggagctgtttaattccctgtcaaatgcaatgagagttaccaaatcaagattgaccccagtatttcgctcaaattcgatagaagaaccaagtaataagggaaatgcatttagtttagctgacctaactgatcaaatcgagtaaccatccaatgttgctcttgattccttcttcaaatcccatcaaagaaaaatctgcttaaatttctccatgcaaaagataggcgggaccgctggagtgttgttagaatgtaggattttttttttgagtaaatttcacaaaactacagatactatgaccaaattatcacaaaactacagatttaactcgatgtatcacaaaactacacatttaacaccaaatttatcacaaaactacacatttaagatgaagtgtcacaaaactacatatttagtaactaaattatcacaaaactataggtttag

SEQ ID NO: 64101 - DNA, 13921 bp, Oryza sativa
ataggaaacatgacttaacatcagaggaaaacatggcttggcaatgaatgatgtgaaattttgtctacaaaagataacttatcaattatccactacttggacacatgactaatacccaattcaatactagcatcttttaatccattcaagcgtgcaaaaatgtttgatagaatgaacagaacataacaagttaatcgaatgaatatacaaactcaccagctgaagctggaattaggtatacccccatcctaatcttgtggactgtgctaaatagttgacataatagtgcgcattacccaccagctaggttcatatcatccagctgcaattataacaaacctttccataccattaagtaaatatgtggtagatcagaaggatctgtacaattattcgagttgaatcattaactaactcatcacaaggatcttggagacatacatacaactttagagggaaaaaaatctatatttatcagagagttacaaccctgttaaccagtaagcatataagtgcaaaaagaaaggaaggcaagacttctaactgaaaattgcattgatatatcacatgctacaatcacttttacaccatacaaagctacatcaatctgcatttaatcagtcaagtataaccattgtccatttcaagcagcaatggagaatccgattggaacgatgagcaggatgctgcgcagaaagcagagtatgcaaggccatccaatttctttaattatactgcctaatcactaggaaagtatgaatgtgaaacccccattttcttaaagagtcagaggtatttatccttgattaattttagtatctcctcaattcttttgatgattttagggttcatcaagtcccttgcttgcctaaggagagtgccttctctgctgttataatatgcatcaacaatagcactggcccaagtgtgtaatacctctggactcctgcaatccactaactatgtcaccaagacttgacaagagaaaggaagaacagccacagaatctattatgaaagggatttcaatatattgaacacttacgtgtataatgtatcaacattatccccctgaagttcaggcccaggagtaaatgcgtcattcaatgcactcaagcgttcttctggatcctcaatcattataagatgctttagtattctgatatcctttggcatttgtctctggagattggctactgcagtcatgtatagatgaaacattatatctttagcctgcacaatgtattgcattccagtgagcactcaaactgatgaatttgtaaattaggtacatatatggcatagctactctatgttccaaatggtacttgaatgcttttctgttttacctcagattttgtgatgtcagtaccctttgcagctgaccaagcttttgaaagcattaagactaacgcagaatccaattcctttttctcagctaagtcatctatctttctgcatgcagcatccacggaaggtgaattcagtatatctttcaactttaattcagcagcactcagagcttcaagactcccagatgtgtcatcatgagcttgtagagcatctacacaatcatttccaagttgtgccaattctgcaagcaaaccagtcaaaaaggaaaatgataagctcccaaaatactaatggctgaaaataaagggaaaaaaatatgttccaactatacaagcaagtagacccatgctacatattgtacaatagcatgatatacattcagtaaggactgagaaaactagaaaatagctgttgttggtggtgtagtgtatctatattcctcgacatgtgattcatatgggaagttactagggccttaatacaaggaaagctatgcagagtaccaacatatgttacaataaaaggccaaatgttgcaaatagacgttcttgtgtatgtctcacctctttgtttttcagggtcatcatgataagactctgcaacataataaaggtggttgaaaaattccaccgtgaaatctttatggcgcttagcaataacagaaccaatttcatcagatggtgtagattttactacttcaagtagttcattatgcctttgtacatcttcatctatctgaaaagtgagcgaggaaaaaaactgttatgaataaaggctaaatttaatagttgaaataaagcatagataggcttcctggaaaccactaaagtgaatcacctctttcagttttctagcaagcctgagaagattgtgcttcatctcagggtttgattctgcatctgctctttcctgacagcgtttgaaaaaatgtggccttatgttatcccattccctgctaaaagacaataactttctccaatctgttggtgtaggcttatcgaccataaatacaccaattaacttgtcagatattttaatcattttttggttttctttagacgtctggtttgtcttggcaacccttcctgccagattatcttcatgtgatgaaatactcgtagcaacatttgtagatccactgcttgagggcatgttttctgtataatcctcaggaactgctgtcacatcaccaactgcttctagattagaggttcgtggttggcgttgactaagaaacaggtgacctgtgatcagaaaataaacacattgagggtaaaaccttcaaaattagatagatgccccatatacaaaaaatctatggagaccatcagatacaagaatagagccattacagatggttacactgtggcaccatgcagtgattcgtgcatgcctaataggttgacacaagagagactaatgctgagatttgattgtttcattgggcacatggtaaatcctgaagggatcaaatgccagcaggataaagacttcgtttcaagtggtaaacctgaattctaacacacaaaaactagagcaaccacagatagaattccagaatatacagtatggtcacaggaaacaaccatatagggcatatgcatgaactattgatgctgttaattttcaagactattgaacttatcagtaaaattttgcacctacaggagtactacagaagaagaagaagaagaagaagaagaagataacacggcactaaaaccttaaaacttatagatgttgaaggaaaacaagaataggctagcagaccattagaggatcacaaagtaagttttggttacagaattggttaatcgtctagtttgatctagtttcagagcagattgattctcaacaaaggactcaaatcctcagtaaagttaaacatcataccagcaaccatatttacgctaaaccttcgtcctcactcatcattgctatttacacagcgctattaatttgaaattcaaaatggaaaagaaccgaaaaccatatgacgctgaactctccccctgtggtaagaaacaccggactcacgaccgattcagaaatgccaaaaaatcttaatggtacgagctccaatcgtatgcgcaccataagctattcaactggaagtaacggtggatctacttttgagctctaattgcaacgattcccgctcaggtgaagtccaattttgcaacaactcacctttggaggcgacgggggcggcggcggcggcgccatgggagcggaggcgacgggcgaaggagagggtgcgggcggcaggaggtggggtgagcagggggaggccggtgggcggcgcctggcaggaaggggcggccggcatcgccattggcggcggcgagaggaggcgggcgtttgctagggtttaagcggaggcgtacaagtgggggcaaggagtggctgggtggataggggagaggtgacgacaccgcgagcgaggtgatctcaccctctcgcctcatcactttctttgtcatcttgttgggttctgaattgcgaaacacaccctggaatttggaagaatctacaaatcaggtgcccgattcgtagtaaaaaaaaaaaagttaattcgctcgacttggcccgtatcgatttgttgacgagctaagccagattcagctaacgagtcaaacacaacagcccaagtatccaactatctaacagtgatgtgttaatatgaccctataaaaatattaccatatggcctaggcgcccagcccatcaaggaaaaaaaaaaggtaaaaaccttataaggagagaagaacatacaggacacctccatccctctttttagcacactcgttcacttgaatatctgctcctctttgctctcgctttcacaccgtcaactaggtcacattgttgaccgcttataggccgtagcggcaccaagcccccaagcgtcaccctattatctttgttggcctcccaccatcgctaacccttcacctcagttggccccagccactagccctcttggccttgcctctgtcagccctggccactggtcctcacctccggcaacaccaagttctaggccctcgacaaccacctgcccagccagagtctgaaatgttttgatgcaatgttttttggacatctattatctagccaattgtctctccgaaagagggttttctgtccattgcccagggtgatttttatgcaggcttggaaaaagtggatatccactgcattgtaagggagatccatttgttctcaaggcctggatgggtttgtccaccttagccaaatccatcttaatcttaaggccgaggagaatttttatagatctatgatttcaagtccacccagctactttggtctgcaaacagtttgccaattcaccaaactagcccctagcttaacattttctggctcctcacctttccaaaggaaagcccttatgagtttattgattcttttgaaaacccatttaggtattaaaagagctgacaaatggtatattggaatggaggacatgactaattttaccagagtttctcttcctgtggagctgaagaatttgcccttccattctggaattcgcgatccactcttttcaattaaaggtaggaagtcaactttcctaagctttcttaagtgaagagggagtccaagataacttgttggaaaagattgtattgagccaggaaaatcttaggtgagtgattgtacatcaatgttgtcacaggcaattggcaaaatctacgttttttttgcacattgttatttaatcccgatgccttgccaaacacctgttagagattaagctttacgataacactcaataacccttgtggtccaacacagaacatcgatgccgggcctcaactaaaccctatcactgatgaggatcatcggtgacgggtgctcacttaccgccagtcactggtgctttcgtcctacgtaccctagctagcggtccgatgacaggcgctgacgttaatctgtcactgcagatgtcgaaccaccgccttctctatccagccggtctatctggggtgaactttctcctaacatcggtaattcactgtgccagtgttatcgcccatcgcccgtatcttctggtggcttgtggagtgggattgggagtgggagcgaggatgggcgaaagtagtgggtagcagtatggctgggttgattgatatggagtacaaactaagtgtagcaatatagtactccgtccgtcctaaaataaatgcagttttgcactattcatgtttaacggttgacggttcgtcttatttgaaatttttttatgattattatttttattattattagatgataaaacatgaatatactttatgtgcgactaattttaaaacaaattcataaaattttcatataagattgatggtcaaacacggattcccacggttgtacttatttaatttgagattgaggtagtacttaataaccactaagggattataatccatcttaagactaggggttacttgcgtatctacagttgactttaactccgtgtgattataactacacatcagcttgctggccagcctctcccatcaagagttcattatgcagcgtagcagtagcactcttgcggtgatggtggtgtcgtttgtagtgctgctcgccggtggtgcaggcgcggcggccgccgccgtggcgcagccggtgccgctcttcgtgttcggcgacggcacccttgacgtcggaaacaacaacaacttgcccggagacgaggacgtcggggatcctcctcgcgccaaccacccttattacggcatcgacttccccggcggcaaggccaccggcaggttcagcaacggctacaccatggccgacttcatcggtaggagcagtatatgcatgtggacaaaacgtctataactttttcgaaaaaaaaaacacaatcatgtacttttttctgtctacaaatatatgctttaaatttgatccataaataaaaccattgctaaggtggtgtttggatccagggaaactttagtctttgtatttaaacactaatttatagtattaaatatagactacttacaaaactaattacataaatgaaagctaatttgtgagacaattttattaagcaatagattcgtctcgcaaattagtctaaaattatggatggattttattaatagtctacgtttaatatttataattagtgtccaaacatcccatgtgatagggacttacaagttttagtctcatctaaacagggtctaattatatattactagtcctatgaatcatatctcgtctaaatttcttcacatctcttcatcccaagcatccttccaacccgatgcattttatatttcccaacaaatggaatatacattagttattaactgttagccaagaaagtgaaatgtttgagtatgttttgagttttgactagtaatgcacgtccatgatgcatatgcccataagctcatttaattatacatgatatgtatggcaatgcggttgaacgcagcaaagtacatgggatatgagatgagccctccagcttacctgtctctctccggtccggtcaacatggacggttttactggagtcaactatgcttctgcagatgctggcatacggaactccacagtgagtcaactctactccttttttcctttttaagcaaaggagcttagagacacagtacgtcagtaccatgtgaaggtgttttttaaacacaaatctacaccactattattgtcacatatcaaatccttatatattattgtgttcattactgatttaataagatttggatgtacgactagtttgcatacattaatagatgatcttttaagaactgagtgagtacaaaataacacatattaaagctacaccatgggattttcgtaattaagtatacatgcacacgttattaagaaggttacagttaggtcaagaattttacgttggtctctattttctaatatttcttccgtcccatattataatacatatattttttataattaaggtatttaatgatattttgaccattatttattctacgttatgttttcaacaaatataaaattagtatcacatgaaaaatactttgaactgtgaatgtagtgatataacatatatatatatatatatatatatatatatatatatatatatatatatatataatatagcataatatggttagtatgattattaatcaaaagttaccgagtttaatttttcttaaaaagatggtgtccctataatttggaatgttaggagtatgtgttaggggcacactcacatactcggtgtccttcacttgtatgcgttctgtgtgtctgtgtctttcatccatcatatatggcgtgacaatgtcaatgttatgaaatcaaatcgcccaataatcagcatgatgcatacagaacgcaggcttgaccatcccactgtcgaagcaaatcagctacttcgccacgacgaggtcacagatggagtccaagctggggcgcctcgccatgagcgacctcctctcgaggtccctcttcctgctcgccgtcggcaccatggacctcctcccggactgcaactacttcctgacgttcccgccgtcgccgccggacaacaagacggaggtgcagcggctcgtggagctctacaacgccagcgtcacgtcgctatacggcatgggcgccaggaggttcgccgtcgtcaacgtcggcctcgtcgggtgcgggccgacggtggacacgcgccgcggtggcggcagcggcggcggcggcgggtgcgacgcgaggatgaacggcctcgccgcggagttcaacgcggctctcggggcactcctcgccggcctccggtccgagaagcgtcgccttcgctactccctcgctgatttctacgccttctccaacgccaccttcgccaacccatcggctgccggtaaatcctgatctctcttctaacgcgcacaaattaatgacaccattttgtcctcgcaaaaaagaaaaaatgacaccattttggatatcaacacacgtatgctattcaatatatttgtaactttgactgttttatttctattgtaaaatgagacctttttatgtgcttggaattaattaggatcgttgatctctaatgatctaacacttcaaagagagaaggtactaggagataggtattaaaagggtgggctggaagctggaaggttaaaatggtaattgagttttattaattgactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaattttttttaaattctccatgattagttacactctttgaaattatatttgaatttttcagagcttaattgttaattttattaatacaaacgtcatttaacaattatttacttggaaaaagaaagaaaatacttccttttaggtttgcttcgaaataaacacattcaataacttataattgtaatgcttctgaaaaaatgagcactaaaaatgaatttattctctttttttgggcctgagggacctaaaatagacttatttccggcccttgccggtcggtccacggccttttgtgcacgcacaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacgacgcccctcttcccgcgagcggcggcggcggcgccctcccccacaaccaacggcgcggcgccctctccccgaacaacggcggcgtggaggcggttgcggcccggcgggagcgggaggggcggcgggccggacctcgcctccgccagatctggcggcatggaagcggctgtggtctggcgagggcaggagaggcggcggcgtcgtctctttctctctctctgtgcatggtggggaggtgcggcagtggtggtggtggcggacgtcatggaacgccggtcgggcctcgcctccgccagatccggcggtgtggaggcagctgcagcccggcgggggtgggaggggcggcgggccggacctcgcctccgccagattcggcggcatggaggcggctgcggtccgacgggggcgggagaggtggcggcgtcgtctctttctctctctctgtgaatggtgtcggttctcctggtgatgctaaccgaataggacttggtataacagatgggagtttgtttcctatttttgtggaatcggacatattctttttttttcccgatttttcttttaccgcgttgatgaatcggattcgttccggttttttttcacccggtttttttgacggacgatggaagcacctcttattttttaagtagtagtagagttgatgaatcggattcgttccggttttttttcacccggtttttttgacagacgatggaagcacctcttattttttaagtagtagtagatttgtacggctaaggacaaaatcgtcttatttttatatctgtatcctactcctatccgttacaagacaagctgcattcatgcagcacaggaggaagaacggtgtgcttcttttcgtagttaaacgtttatatcatacttttaccgatatgtacatatacatctgcacacctgctcaccgccgtacgcgcccgccgctcaccgaggccgcacgcgcccaccggtctcagccgcttcacacacgctgaggtcgctgctgttgtatgcgccctccggtcacagcaaactaatgcggcagtcggtcgtcgtctccgccaccgcacgcgcctgtctcggccgcccgtcgtagccgacgtttgcggtagccggtcgtcatcaccgccgccgcacgctggtcatagccattgctcgcgccagccggtcgctgccttgcacgtgcttgctggtcgccgccgtcacgcgcgcagcccctgctccttgcatccgagctcgttcaattgggattggagttgattagggttaagcactgaaatcgtggaaagggaatcgtgaacactaggcaacggatggagaattggtgattggtcaattactaatctatcctttgtagtaataatttttgttcctaaattaccctttgtgaattaacggtggataccaattgatttaggaggcaccataaaagaccgcttgtaaaatatatgaaaattatatacgatcatacggccataagtattagtcagttaaccttttttattatcaaacttccaaaagtgtggccatgcagatatttaccttaaaaaatactttcatatataacgcccataaacgtgggttttgtgaacttgtttaaataaaaaattatggtcaaattggcatattgaagactagaaaaaaagttcacacgacatatatttatgaatagaatgattagttttacgaaaaatatgttttccatatacgaattgcacccgtccaatcgaatttttttttaaaaaaatagtggcgtaaaattttttaaaaaagttttgtcagtctaaatttgtaacagtttaacttagcatttttctcatgatcgaagggctctaatatttcattttattccttacctctgatttctccaagctctgaatttctgatacggctcgttataattttgcagggtttgtgaacatcgacagctcgtgctgccccgggccttgcatgcccttcccctacttcaaccaaccaccctgcgacaaccgcgcgcagtactggttttgggacgggggttacaccacggagcaagctgccatggtggctgccgctgcgttctacaatggcaccgcaaagttcaccacgccggttaacttcaagcaactgatccgaaggaaaaagtgataactccacgctcgatctcatgtagcaaggcacggcgcccataaaaaaaatcttacgacattcgatcaataataagttaaatgttctcctttagaatggaagaattttaataagaattgatacaattactgacatttcaatggataagtggtttgtttatatggattttgctatcttcaaacaacattatatgtaaaggcgtggtcaagatccctagtcaaactgtttttttttaactcatacttcacacaccgacacattgtgagtggacttagtacacatttacactgtgtgggaaactcctagtctggttaaattcaacactactacaaagggagtcttttacccctatgctattaaaaaagttgctgcttacctgtgtgccacaaaaaagtttggagtcacctgtatgccatgagaaaaaactttcgttgacccgtgcgtccaccttctgttagaacttaacagttccatagctctgacatgtgggaccatgtataaaaatgactaatttgcccctaaggattttcagctctattctcctctcccgctatctcccgtgagtgcctgctctctccccgttgcgctgcaagccgccgcaccctaacctagccgcacgccgccgccgcctcgcctcgccggagccggagccgccgccgcctcgcctcgccggagccggagccggagccgtcaccgcctcgcctcgccgaagccgtcaccgtctcgcctcgccggagccgtcgtcgccgccaccgtcaccgtgcgcctaggccggcgcgccgctgcgccaggccgtcgtgcctcctcctctcctcctccagggcccacgcgttcccgcgtcctccctcgtcgcgcggcacgtgggcggcacgcgcggcgggtggtggttggttcgggagggcggcgtcgtcgtcggtcaccaggtggtgcggcgccgtcgggccctccgtcgatggccgccaccgcagatgagcgagtgagatatttgcggtggtcacgtgagattcgaatcacgatgtgctagctgcggctactgctctcgtgctatctctcgatctctcgctctcgctcttgctctctcgtgtggggtttcgagatgcatctgtatatggtttggagttctcgtcttttgcgagaaacggaatttggaattatgcgattgcttttggaaattggtgccctttggaagctatatgtgtatgcttgattcgaagcattaaataaaaaaaagggcatatgcttgttttcatgtattggacaataatacctgcccacatgaattcctgtcactcacaccaaactacaatatttgattacccgttattttttggtatgcaatggtcatacacctgtttttttcttttttacaaaatttatttctgatttttccttattttttccaccattttctaatttttcccacattttcctaatttttcccggatttttaaacatttttaaaatttattctcactttttctgatttttaccttttttaaatattatttttcatttttctggtttttaacgcttttcctaaattatttttcacttttctgattttttaaacccattattgtacacaagggcaaaactgtctttacacagcctctaacacctctgttatgtctccatccatccaaaatggcacacgggtcaacgaaagttaggctcatggcatacatgtaactccaaacttttttttgtgacatacaggtaaccaacactttcttaatagcatagtggtaaaagactcccacaaaagtgttaatcaccgtaagcttcccacctaagctaacatggactagttgatgcacgaaccgatagggttgtattaatatcggtttatgacataaactggtagtgatatgcttcaatcatatttcacgttcgtaccacaaattaactgaaaatgaactatatgctgtgacactaactagcaactgacattattcgagagcaacactattcactcttcactcccggttgggaaacccctttattactcccggttatacaaccggaaccacgaatccgggactaaaaatacccatatttagtcccgggtgaaataaccgggagtaaaaatgtatttttagtcccggttggtgttaccaaccaggactaaaaatggagacaggctagttcagttgctccttttttttattgtttttaacactgaatgttgatttcactccattcccaaatcatccccaaatcccaaatcatccccaaatcgtgaaattttaaatcgatcatcacatcacagatcaaaagaatccttcaaatcctcaaatcaatcatctccaaaaacatcataaattcttaaaaaaattacatcacaagttctaaaaaatcaccacaaatacatcacacacaaatacatcttagatctgaatcaaaatcaccacaagtatcatctcacacacaaaatcaccacaggtacatctctgcac

SEQ ID NO: 64102 - DNA, 12932 bp, Oryza sativa
  unsure (1)..(12932): unsure at all n locations
tttctgtacaacaagattggccgatgaaaaatacccacaattccctcgatacaatagatcctagattcactcctacgatactgtatgctggtccgaccgatgtgttattgctggtcagaccggacgcatcgatcggaccgacgggtgtaataccaccagtccgactagaggcagcagccgatccgattggagggacatcaccggtcagactacgctcggcatgtttcgtagaatcagctcatgtctggtgctcctctaaaagacattgacatgtggggtccacgggctgactcaacaagattggataaactgcctcctaaaccgttcaaggagtcaatttgtaatggttttgtgagttggaggataggttatagggatgcgattcaaccatgggcatgagttgagggaagcaaagtagacttagggcctgttcactttgatgaaaaaaaaaaccttaccaaattttggtaggcaacttgccaaaattttggcaggatttcttatatagttatcaaaatttggcagcaaattaaatatagtcacttttttggcaaatttactaaaatttggtaaggttgaaaatgacatcaaagtaaacaggcccttattacccacgggaatggtgtggggtgggctggtaatataagcccagaaaccaatccatccagcccagcaactgcgaggtcggctgctagtctaacgtgcacccaagccatcaccccacacgtgaaaaatccccgctccacccgcgccgcgccgcgcccaggtagttcagccgcgcgccaacccaagctcgctcgccggccggaaatggcgctccccttcctcctcctcctcgccttcgccctgctcttcccgctctccgctcccccgcgctgctgctccgcggcccccgcctcctcgccgcccccgtccccgcccccttcccctgcggcggcggcggcggccccgcgccgcacgccgctcgtcccggcgctcttcgtgatcggcgactccacggcggacgtcggcaccaacaactacctcggcacgctcgcccgcgccgaccgcgagccgtacggccgcgacttcgacacccgccgccccacggggcgcttctccaacggccgcatccccgtcgactacatcggtacgcgccccccaccttctcgatcggcggcgccatggctgtggcccctttgctctctcgtgaatcctccccccccccgcttcaaaggttgcaggtggttctggaatcgtcgatccgatgctgctttgcctctcgtacgcctatggatgcagcatgttgtgggtttagtgtaatctgggttttgggtttctggtatacgaaggttttgcttagttgttggttcctatgaatttggggcatctgatctcatacatcgggggtatgtggatttttgcccaacaattgctgaagctgaagagtaatcagttcatagcactctcctacacagctgaccacctggatctcacatacatagactcctgcggcttcctctccttgatctcacatagcaatgttgtgggtttagtgtaatctgggtatttgggtttctcgcatgcgaggggcttgctcagttgttggttcgtctgtgggtttctgccgaacaattgctgaagctgaagagtaaccagttttgcagcacaaccaccacagtctgggcatcatttgatcctgctgttcttagcactcctgcagagctgaccacctggatctcacgtatctatatagaatcctgcggcttcctctccaaatcagtatccagtatccaccaccgttatcagccgttgaggcaatgcattggcagaatgccagaacattaagaagtgccatcataatgtacaccattagtccatgcatccagaaaacattgccagaatcctgcaatgtatccatttgatagtcctgagtcccgaccagttgtctacatgctccagtctctttgccaccacacactgttaaatctctcttgtccaatgtccaccacattctggacagtttcaaggtcctcacaggaagcacagctgcacaacctttgttaatgttgctttaagaaagtcatatctactcattagtttctttgggagagtaaggagggaaaaggcataggaaagaaacatttaactagggctactggctcactatgtgaaagatgtttcccttcaatttcatttagctggtgttctttatctcttttgcccgtctctgtcagtacttatgtttttcatgaatcaatagtatcttgttctttcttctgtttttaaattattttttccgtgatttcttaatcttagacttttttgtgcatttgcagcagagaagctggggcttccttttgtgcctccataccttgaacagaacatgcgcatgggtgtcggcagtgtcgacctcagcaacattgatgggatgatacaaggtgtcaactatgcatccgcggcagctggcattctctccagcagtggttctgagctggtttgtcctcctaacttcccaacaactctatttcacgcttataatctagcaggaatgtctttgtgagacccttctctagaggacgaatcagaaggagggtgtttcaacaacagactagaagcaatgactcttctcatagtgtctacatcctctctagttaggaagaatacttgctcaaccatttgaactaatgctgaaagattctcctgttcggctgctcccttccttccatgtgttccaactagtgtggattatcagggcatcaaattcccttcttagttcctaggaattcatgacttatatatgcttcctaccagatgtgagattgtctacacgagacgattgatatgctggtgctgatggggggtttatttatgctgctggccttgtccaagtttgcttgtgaagctacagtgctataagttgtatggttgttttattttcctgcacgcataaagcaaaaggagatatatgtagccatctactcaaagctaatttatcataatttttttattgtctgaaactaaaaaactgcatttgttctatactatggcttttgggatgatcaaggagttagtaagaatcactgatccggcaccaatgtgatgaaattgatgtatatcatcctgaacattccattttcatatcaatctttattcctgcttatgttgttgaatctccaatctttgtgcccaaaacaacaaaaacttgtggagctgcaaatgctaattttgtcatttcaataaaacatcatggtggtgtctaaagaggagaaatgtttacgtatgaacattgctgcaaagttttcctttatgtggctatatgttttaactttctataaaggattggagcctcttggttagagtcaagcttgttgatttgcataccttttcattattcttaaatgtacttgaaactaaatcgacatgatcattaactatataacaccagtctaaagaacaccaatctaaagaacacacttaatgcttctctatgaaggtttctcttttggtatgtaatacttgctcatcggatgtatccttttttgttactattttgtctcgtgaactatacatttgaagattattttgtggtggtattctttactactgcggcattccagcagctgtaaaagtatgtgcaattatactgttaaaaaatctccaacattggcagtcccctagcttggaatctgtcgatattttctgtgtttatgttatgatttcttgcaaacatattttagattcttaaattttaatggcgtggttgttctagcttaaatatgtttagaacaagggatgtgacacctttactttgtgcagaataaaccttcatgctgatctcttgtgtatcaagccttcaggctaggggtgtaagtggctaacccgcgaaacccacttataggctaaaataagccgcgaacccgtttattttgacctataagtgggttcgcggctgacccacttacagccctacttcaggcacatgaggatcaatcatttcatagtgtgactatttgtagttatctgtatggccgtaaataatggcctctatattgttctgtattggagtatctctctactatttttttctctgaagaagagcattcttttacctatttttggttttcataatttaatgtgatgcataatttgattctgttcttttttagataaaggaggctaatttgattctgttcttgcaattgtggatgcactgcagggaatgcatgtgtcgctgagccagcaggtgcagcaggttgaggacacatatgagcagctctctctggctctcggggaggcagcaacaactgaccttttcagaaagtccgtgttctttttctcaatcgggagcaacgacttcatccactattacctgcgcaatgtgtctggcgtccagatgcgttacctcccatgggagttcaaccagcttcttgtcaatgcaatgaggcaggaaatcaaggtgtggttattgttctccagtttattctctctgtgcaacatttcttgcctccttatgattccagttttagttttttgatcagtgtgttgcatattgcccaaaggctgtagtatcgtgcttagcagtggccaatgttgtgagtatgaatttgatccgtaatttacggcccgtaaatattctgtgcttgaaaggtatctgctctcagttccaccacccagatgtgaatagttctttgtactcctggttaggaatatgtttgagaaaaggaggagtgtggacctctggggactgcagatacatgaattatggaaaactagctatgaacattaatttttatgtttcaagggctagaaaattttcaaatgtttatagagaaacctgatatagtacactttttctgtaggttaaagttttcaaatggtggatgagtttaaaaccgtgtacagttttggactgaagcttctttgagttactgaaatcctcaggctgtacagtttttctgtagttatgaattaggttaaaaggataggagggtatttcatctgtacatttgtaatatgggaaagttaactgataaatacatggaattgattaactcaatggatatttatatcgttggctgttagcagttctgtggtgttatgtactttacattctccgtctaccgtaccttagtttcagatttgaggtagtacgttgcaacgttgctcaacaaggacatacttgttttttatatgttcattttgaattcttaacattttgatcagataaggcggccccaaatctgatagggactgatgtaaagtcgatactgaatattgtcttggactgaatactgtgtttgagtcccttagttcttggtctgcgcatacttccagagtggattgtactttgtactgcctcccatttggaagtgcaagctaaatgcgtgttacttttgctcaacttgtaggacaccatgcacactaccaatatgcccatgatcttaccatgatacaaacataattctcacatcatgcataaatgcataatgcacaatttgattttctccctaatttatcccctttccttttttgaacggataattttaatttgcaaaagaattggtaaaaatggccccaaatttctattcagtaaatctttggcagagcatgcgatgcacattgattgaggctgcatgcgccatgagtttatttgtactgtccaacatttgagagcagaaatttctgttaccattgtactcatccaagttgacttgagatgttgctttcttgtttcttaaccttagtaaatcagttacaatgatgcatttttttattatttagccatatgcagttcttgtcagattagattattaagctatttatatctatatataagagttctgtacttcctgcagaatttgtacaatatcaatgttcggaaggtcgtcatgatgggcctccctcctgttggctgcgcacctcactttctctgggagtacggcagtcaagacggggaatgcatcgactacatcaataacgtcgtgattcagttcaactatgccctgagatacatgtctagtgaattcatccgccagcacccaggctctatgatcagttactgtgatacttttgaggggtctgtggacatactgaagaatcgtgaccgctacggtgagcagatgtatcattgttactactgtcagattgcctttctgtccttagggaagaactcacattacgatggaatcacattgtgcaggttttctgaccaccactgatgcctgctgtgggctggggaagtatgggggcctgttcatgtgtgttcttccacagatggcgtgcagcgacgcgtcgagccatgtctggtgggacgagttccaccccacggatgctgtgaaccgaatcctggctgataatgtgtggtctggtgagcataccaagatgtgctatcctgtggatttgcagcagatggtaaaactcaagtagaactgaaccaacccttaaactccattgtagttacttgctcagcttttgtgattttctgaccaaaaaatgaaaaacttaacaaggcggcacggagaagtgtatatcttgagagctagtaaaattttttcgtagatacagatttgtgtagaaataccatgttcatatgtgggcactgcactgtaaaggatctgtatggccaaactgcatgaggtgcttggtaggtgaacataaaacattgctgagaactcacctggtgtgcttaactccccaattctcacatgttttgtttaacttctgatacggttatagatttatggtgaaatgttattatgtgttgcagttttctgcttttctggtgaatccatatgggcaacatcaaaggtatttccaagaacacaagttttatggtactctggtactagctatgttctgttatcaactgatttatcctcttatagatcaaaacactgcttccactgcctcctactgcactaatcaacaagcagtaacatcttgtcctgctttacacggtcagtttacaaaatacagccttgcccataacagagagacaaattacaacctccatatcaacatgccccttaattacaatcaactcctcagctgaccaccttgtagcttgtttagattctgatttgcaatcctatccttccaagtgctgacagctggagctctctctgttgctgcaactagagaaactctgaattccaaagctctgtatctgaagtcctgatgctttagcaagctgagctatctctcttcccatggtttggccatactcataagagaaaaatataaggaagagcatggagagtagctgagtagccatggatgctacaactcttcatcatcaactccagagttgagaacaaaactggggaatgccattgttatgtccctgaacacgaaaatcgacaaggcaatacatcagaatttcatttatagttgaaagcaatgtaaaaggtaactacggtgaagagaaacctgaaaaattgtagatggtacttacttcaggtatgggagggtcatgttcttcagcaaagcagggtttttacttgcgaacgccttccattcatccgggtcgatcttcccgtcgctgtttaagtctgcttgcttgaacgtctgtcaaaaagtagcataaattcaaacttcagttatatggggaagaaataaattgagactagtattacatcttcatgtgctttacctgatccacaatctgctcaacagcgtcatcagaaaggagcagatctgattcattcagaatggcgagcaccatttcgtacaactgcttgattcataagggaaaaaaaaagaggtttcagtaactttaggattttctctgtcaaaatgaaaatgcagtacaaatattgttccgaaacaatactttgtatctccagttttccacgctcagcctctggatgttttaggatttaaacaagtctttaacagggttcaatacatatattcttcaccatttatacaaccattatttatgcatgttttctttgatatcgccaagaaaactggtgtaccatcgccatcagtactgaaggctagctatgcatggaaattacattatgttttgttatttctacaaaatatagccaattagtcatattctttagataatggaagctttattgaacccagccaattacacatcaaggtgttcaatggaaagaattaaggatattgtttagtaactcaatatacctcttcacgttcgatgtatccagttcctctcagatcatacaatctaaatgcaactgcaagagggaatactgtcagatgccaaaccaagaagtgatatatgaataaaatgaagattgatatgacatgaacagaagacaaaatttgactgcaaacaactccaggatgttgaaaagcaaatcatgacaaaagatgaagatgattcttggcttataccagaatactctgaccaactaactgacttatttctgcttctatcttttaaaaatccttgattaccagcaagtattgttttgaggtagttttaatattagcgactaagctatttcttaagacaactgagaaaagaagattgtaattaagtacaacttaaccatatgcaatgcaatgtggaagggctgaagtagggtatttcttacaggcaatcttctctgccaaaggcgtttccgggtgaaaaatgttgagggatcgaacaaactccccgaaatcaataacaccattgcgcttaagatcaaagagatcaaatatctgcttgaaatgagaagactctgtcagtctttcacacatctggaattgttctataatttaacggaaaccataaaattgtgcttaattagctcagaaaagcttttgcagtgagacagcaaaatactcagaaattcaaaaaaggcaaaccgacccgatcggcgaaaaggttcttcttgttgctgttcctgaagagtgctagctggaactcctcctgttcaagaaaatggcagttcagaattgacaaaataccagaatttcaataccaaatggtcacttttgtcaaaaagatggcctccattaaaaatgaaattcaagagagttaaccttgtgaataagcccatctttgaatatggaatggcttatcttcttgaacagctcatacagggcctccacctcactcacagaaactacaagacgtaaatcacacaggagaaagcataattaatcactctccattcctgaactgaagaatggtgtaattcagtgagttcttacatgtggtctctttggccaggatagcaggatcctcatgctctgcagctcgtttgaactgctttgatgatatgcagcccatacaaaccacacctttatcttgttgttaagaaacggctttcctgcataaagtgataacagtcacctcaaagaacaggataaagaggctgctaacaaaaaaaagtgaagtgacatgaaaaagttaagtgaaacattaaaaacacaagaaacacagccaaacaacaagacctcctttggaacagaggaattagactaaatcggatgaaaatcccataaaaattcctgcgttccaaaggagccctgaatcgacaaacacagaagaattaatctcacctagggaagaaacagaggtgcctttgaacttctggacatcaagaagaagaagttgatgagcaaaatagagggggggggggggggggggggantnnnnnnnnnctgngtgtnccaaatacctccaagcttattgcagatacaatggacatagaagaagaagatggcacatatatttatatatgcacatgcatagcaagcatctgggctccacagtgtggcacagccccagctgtgccgaccgtgtgtagcaagagttgacttgaaatggttccctgttacacgatctgcaacattaaattattactactgttttatattgctcaagttcagcatctgtcattgctgaaaaataatcagcaatggcgggaatagattaatactagtagtttacagtgtgtatctagcctagatgtagcaatatatacttgttgagtaatggaccataagaacgacggttttgttcttagttaagtgatgttaactaggccgtaccaaagatacatgcatccaaaacgggcgtattgtgattgatgtttaacgaaaaatgtcaacgtcgccttgtagctatcaagcgtggttttttttatatatatggaaggagggatccaaaggtgacgcatgctcttccgcttaacaagggatggagcgcctgttcatcaaggacctaattttggcgttattttctcccgtctaccgggaggtactagtactgggaggtacaaaatcaaatctgaccatctatcgtgagagggtacaattgagaaacacagaagagaagcgaaaccatctccggtgtcgcgccaccgctttctcatctgtttaaagggttcgctcttctcatctgttcagaagaattcggtaaaattgtaaagaaattgaatggcacaatttcctgagtgccttgtagttgcagacagcagcagaatgtatagtaagcagaactaagtgttcactgttcagggcttcagacaggcgcttaggcagccatagtgtagtggtgcaagcgcgcgtttataagaaatgtgtgtatgcacgcgtatatgagtgcctacattatattatttaaataataataataaacgtctggaacagatatcgttcaccattatgttacatttagggggacatatatgtgaaaacaagctagggggacatatatgtggaaacgagttaagtgttggaaactcatgaaaatcatacctaaaagttttgtaaattcataaaaaaaactaggaataggtgtagatatgaaatacattctcattaaatctcaagtttaaactcaacttcagttaggagtaacaaaaaagacaaatttcaggtggatggtacaagactatattcatccgaaatttgtctttttttttctcttaagcgaagttgagtttggatttgagatttgatgataatgtatttcatatctagacctatctctagtaatttgttcatgatttacaaaaatttttagatatgattntcatagtttccaacacttaacttattttcaccgttatgtcctctatatttagagcacgtgcattgttactttttaggggatctatggaagagagaaggagagagtccactctatacgttgcatgatttttctaaataggtttcaactttcaaggtagtaacaagtactagctatggcaccgaatttcaaaggagatagagggtacattccactactcatgagaggaagagatcaatccttaaatctacttttaataacaacagatctcacccgtaacacctttgctagttctctacattatagatttcttaacgaactactattctcgtggtgaatctcactcgtagcatcttcgctggtcctacacacatcaaccatgctcttagagcaagtttaatagtataaccaactactacctccaatttatctatagccattctaatagctcgttcatacaatagctacatactatactattaatacacggtcccacctgtcgtgtcttgaagtccgtgctacagctggctataaatctgtagcccgctgcccttctctcttctcatttatcttcttaaaatatgtttgtagctggcttatagcatgctattgtacctgctcttagctagtcactcagttagagagacaggagggggagagaaatggccctggcggcacggtggcgtgctgatgtacgaaccatatataggtgtagtagactaagcacaaggttcaaattaaatttgaattagttaccccggtaaaagcttgttaaaagtacctacagaaaatcagcgtaagtctaagggtaaatcaatggagaaaaaaaaacagcatatataaatcgtgcaggatttcgcatgaacagagtgtcaggcacgcgcatcagaaaccatatcgacaatgacgagctagccgacgacagcgattgcctggctgccaactaggatatatataatgtaacaagaaaattaattaattgggtgagatcgatacgtgaaacatgctgattaattatcttttaatttggtccacttgtagtaagtttgttgtgaaaaccaatgatttctaattatcaggggaaagtgaatatattaacattgcccgtggaactcgaatcttgcaaaatatttggcagggaaagccaatcagatgctaaattcaacccacaccaagctaccatgttgtttatgtacacttggctgcagatgatagtgatatactataggctgattgtatccagacatcttatactttttcagtaaagctgggcgtcagccttttgttctaaaattagggttgaaagtgattcgaataatttccatccgaccggaccttttttcggattcggatagtttcggtcggatatatctgaaaatttttgaattcggatttttttttcggatatgaaaacgaatatgatataggtgatatccgtcagatattatccgatattttccgtcggatatccgacttacacataaggctgccataatccataagccagcccaacccagaggagtcaaatcaaagttcttgaaaaaaatgaatttcgaattgaattttatgatactgaatgaactcatatgaaaaagttgtcaaaaacaaagttgtagaactcattaagatctaccaattttattttggtcatttctccatccgagtttcattgaactatataaaatttgaattttaaaatataagaaattcaaataattcttcgggtagtaaatgatttcaaatggaaaaattgtcaaaaacaaagttgtataacttaccaagatctataacttttattttggtcattttcctatatgactttgtttgaacagtttgaatttgaatttgaaaatatgacaacttcaaacaatattttcaaatactaaatgatttcaactgaaaaagtcatcaataacaaagttgtataaatcatcaagatctataa

SEQ ID NO: 64103 - DNA, 6165 bp, Oryza sativa
tactgcttcaaaatatcatttgaagttttgaaattcaaatttttaattgataaaacaaagtcacaagaaaaaatggccaaaataatagtagtaaaaacacaataacatgatagagcatgattttagaaacatttaggaaaaagaatcatccaatttggagttcttatgagtgagataaactagtttcaaatttttaaaatttattttcgcatacggctcattaacgtctgtatttttccatgcggtctcttaagtggtccgcatgcaaaaatgggctcattttggcatcttaaggagtagtatgcgaaaataccaatgcggcaagttgtggtccgtttgcaaaaatcatagggtcttgtacacaaaaatcgtttgtgtagtattgaggggtttttatatttcgattaatattcatcaccgtattcgcttcgcttcgtattcactccatatttgtattcgataatattcgatttcgttttcatatttgggtttccgattccgattttgattccgaaaaaattatgaaaacgaatataatagagctagtttccgaccgtattcgatccgttttcatccctatctaaaatatagtataggctgataaaataagatgggtcgtaactgtcgacgtttgatagtcacgactagggaatttgaatagtatgggatcgttggtaccagggtatatgcgagattgaggtaaaagagatgcagacagtgatttttatacaggttcgagccccttatctgataggtaatagccctacatcctgttggccgaagccggtgctgctctttattcatctggatcacacaaatacaataattgggataatctatctatccatcgtcgacttggcggctatataaccaactcgtagtcgatgacagggtaatcttcctcctcgaatctgtactcggcgagaacagagatggcgctagatacctcttgccggcccatgtaggtgccggatagggcatggctaggctaatctctgatgttgatatacaacggcgtattggcttgtattggcttgtggctttgtagattgtggtgggtgtgtcccctctcctcctagggggcttgtatttatacccacaggtgaccccttgtccaagtagaactagggagataaatatggatacgatctgagtagtgagtagtccttgtcgtttctatgtagaactcttcttctccttccttatccggaactccttctatatacgaggttttttttccgtataagacatggcatgtggtgggccttgccgagcttagtcgattactattgggtatccataaccctgacagtaaaaacttcttaacaatgcatgcaaaaatgtattcttgagtaattaaaggtctatatttaaagaatatgacaaaattaaatatatattaccataatattggttacaaatataataattctttttttaagtagatatgattaaggttcaaggggaaaatttctattgccccttaataaatgagggatgtttgtgagtgatggtggttaagagtaagatgaattgaatgaaaattgattgacaagtactagtattcagaatgcttatgtttatgaactaatgttaaaccctttagttgattgactagggagagtacacacacacatatatattttatcaacgcttagaccattcgtcttattcaaaatttttgtgtaaatataaaaatatttaaatcatgcttaaataatatttgatgataaattaagtcacaataaaataaataataattacataattttgttgaataagacgaatgcaaacgtataaaaaaaatcaacggtcatacattgaaaacggagggagtagcgaaagagcttgtagcctagtggttagagcctcagtagcaccttaggtcctgggtttgactccccataggagtgaattttctaggatttaatggctttgtgctttcagtggtagatgacgtacccgtcaacagcgaagcgtctgtgttaacttcgtcaatttccataatttgccggcccagtcttcgaagatgctcataggggtgagtgtgcgtgcattgtgagtgtctgtgttgtactgtgtaatttttttttttaaaaaaacggagggagtatataccaatcacctattcaaccacgatctagctagatcaccatctaaatataacaactcataattttactcttttattacttaagcaattccacttgtgaatattttttttactcaagccgtttggcagttggcaccaatgtactcacaattttactctttttacaatatctatttacatattaacactaatgtaaatcatactcaagttgttattgtgcataaaataaaaccacatataaaaccgcacatgagttatttaaactggtttcagtacttcatgggtagaatatgcagtttcatacttggggtagcagaccaacctcaatcggtagtactacatttataaaaaaagtatatgtttcttatattatatcgcagctagcgcactgtataccttatagaatgttatgatgtgcgggaatgaaattttacgtgctatgtatttgtgtactttgtatataaatgtgagtaaaaagttttactcacaacatgtggtttagcccaagcggtttttatattatgcgactttagatgatagtttgtttgaataaatttaggcagttgaaaaagagcaaaaccttgaagttctgtaatcttgtttgataaaactgcttttagaccttgtgagatgcttttctttttcatttatgttgccactaaaccatgatattgttccatcctgaaaacataaaacaattggagaagaattgacaaccacacatatattggagaaagccgaaagacgagtctttattacaagaaacataaaaagcaaaaggctaggaacacacaccaccgttgggacgacgaccggccaggcttaaacccaccaccactcaaattaagacgcaaaatatagttaagctggtcaccattatttataactcctcaataatacaaaagattaatgatttctcgaacttaatcgaaattttccattatttgtaacacgcttaattctctgcaaaatcttagtttaaaatcatccctacatatataacctgtgaatctggcatattaatatagccaaggtcgtcgagtcgtgctcgatctgtggacacgagcattctgatcaaaagaagaggaccaaaatttcctgagtgaaattaaaaggtataaatcaaacccctgtccgccgtgacgacgagctgtcagccttggatgcactgctcagatgatgacctatcgattcgtctacgtaagggcaccaaatttcatgttataaatcgttttatcttttttcttaatcaaacttgtttaatattgatgcagtttaagaaaaacataatatatatattttttaaacacaaaacatattcaatgttagatttaattaagctaatttattgttttaaatgtttttatttttttctataaataacttagtcaaactcaacaaagtttgattagaaagagttaaaatgagttatactccctccgtttcacaatgtaaatcattttagcatttctcatattcatattcatattaatgttaatgaattttgacatatatatctatctagattcattaacatcaatataaatgtgggaaatgataagatgacttatattgtgaaacggaggaagtaatatggaacgaacggagtatattcaagtcctgtgtatcgatcattcatgtatatgatcagtcggaatctcaggttgtacatgtatgtagtggtagacacctttgatagctatccattttcacagtagtttcgtgtgatctccacagcctccacagtacatgagagatcgaatgaagagggaggctctactacatatggtcacctgcggtccatctgtcccaggtcaccaccagtacatatggtcactatatatatatatatatatatatatatatatatatatatatatatatatatatatatatatatatatatatatatatatatatatatatatatatatgttgactgatgcatagtttcccatgcataaattgtggtagtcgatcgataatatagaccctgtttagatgtgactagtttttagtccctatcatattggatgtttggatactaattataaatattaaatatagactattaataaaacccattctataaccatggactaattcgcgagacgaatctattgagcctaattaatccatgattaccctatgtgatgctacagtaaacatgtgctaattatggattaactaggcttaaaaaatttatcacgcgaattagctctcatttatgtgattagttttataagtagtctatgtttaatactccaaattcatcagatatgacagggactaaagtttagtccctagatccaaacaccaccataatgcatggctgtagacgcgagatgaggaagcgtatctttggtgactagaaatttagttagatttacgcctttatggatttatatattttatagcctctctctatatatattgcatatgttaaaggggattatgggcatgcatacataagtgtattatgtgcgtatctatctttgtgttccgtgtagaagaaataaaagatgtggctacctatcttactataaagttataatccacaaatcttaaagcttaacatgcaaacatgtcacctcatcatccacaagcaataattacatacaaaacttagggcctgtttagatgcatttggaatggcaaatggcaaatggcaaaagtttggtggcaaaagttttggtattgcaaaactactagttggagtttagatgcatactaaacttttgccattctgtaggatcgagatgtcgactagagggggggtgaataggcgatttaaaactaaataatacctaatcaaatttaacctaagttgctaggcttggtgagggagaactctaactaagcaactaagttatgttttgcaaacctagggtgatagtggctcaaatatatctctaggaaagtaaatcacgctcctatgtcgatgttttgcaatcctagggtgatatgatctcaagtgtgtctctagaaaagtaaattgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagctggcccacggagaggactacccaagcctcgatcactcggggtagttcttccttcactccgaaggtggtgaactctaaaccactcacaaaccggcgccggacctcctccacaatcttctcggagaggtcaccgggcaactcctccacaagccgtctaggaggcggcaacctccaagagtaacaagcaatgacccggtgtggagatgatcaagtgccacactagctctacaatggaagcaaatgcacttgactcttggctaaacaaccatctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaattccccaactctgtgctctgccggtctgaccggaggtatgcggccggtcagaccgtgctactctgcaacggctagaaaactagccgttgtagccctgtcagagggccccatcggccaggctggtcagaccgacatggggtgcccggtcagaccggcctcggctcggtcagaccgccatcggctcagtctgaccgactacggctccgtcggctctgtatcggccatcccgagcagcatcatctcggcctccaggaggccggtctgaccgggaaagtgccgccggtcagaccgccactatgtagccggccggtctgaccgcccctggtcaggccgaacccagtgaatttgtgtaatgaaaaagagagcacaaatgaaaatgcaatgacctaatgtggcaattaaaatcatctctttgctaggtcattacccctcttaatagtgcggcgaaactaaaattaaactagc

SEQ ID NO: 64104 - DNA, 4347 bp, Oryza sativa
gtgagagataaaataagtttcatcttgatgaaatcttatctacactgtttccaatacagtttctcttgcatgttctacctacgaaacaacaaaaacaaaaccacatgtatcgtatgagctattttaattctcaattaaatgctttgttgcttatgtggcactactggaaacatgcaaatgatacttcctcagtcccatattatatgggattaggggttaaaagcgtgtctcaaaatataagggatcaggtaggtagagtactaatacaaacagacatcgggcagggagagtactaatgcgaacagagagctgtcggtggaatttgtccctaccttatcctctcaccgagtcacccatcgaccaccgcttgttcccctcccgattttctttgccttttctctatcccctccatcagcgcctccctcccacccgcatcttcttccacctccccccatccatccgagctccttcccttccacctcccatccgtcgacgccaacgccggtggtgcggcagccaacggtggcggccaagggcggcggccaacctggcccatgcgccaccgccaccggtgcccaacctggcccgtgcggtgggggcaccgccggggaagcgaatcgaggtggtgagggagcgggagaacacacttctcttgttcggccgggccgccacgcacgccgccgtcgccttcgttgagttcaacgtccatgtatatatatacagcgtagccgagttcgatgtgtatgcttccatttccatgttgttggtagtacctgtgtttgttttggactttgcattggatgtcagtttacgctttggattgtttgattttgacaccgcagcaacgcaatgcaagatttggaagctagcgtgggtatgacttggatgtagccattgattggtgtggtactggacatgaaatttgcagcaacgttctagccagtgaactatatgggataagcctcacaagtaggagtatcaatttaattgactcttgtcaacatgtgcattaatgtcattgtatactgagaaatgcttactctgtctttgtgccaatcatttgctggcaagcttgtaaacccaaatattctctcactactaatgcccagtactaaggactggtttggtttgtggtctaaattggcattaccaatttttatcaatgtcacattttgtcaacttttggcatggctaattttggtaaaggtaaaattgtgtttggattgaagccaaaatagcctaaattaactgttgaaatggcatattttcttaggcatgccaaaatttagctccaaaccaaatagacaataaacactattgaagttgacaaatattggtaaggccaatttaggcctcaaaccaaaccagccataagtaaatgaggggtacatgtgtcttttgccagcctccttattttggatgaatagtgcccagtcccatataatgtgggatggagggagtacctcccactgagaatgacctaacaataacaccttttgatttgatttggaagctatgtatcaagcaaaaaccaaagtttgaattgaattacaaccattcgctttcatagaaatccaagaaaataagtcgatttgaactttaatatccgatactgtttaactctaacccactgaatcattcatatttcaatcttgagtttttcttttatttctaatagtagacaaaaacttcaacaagttcataaaaaaatccattttacatttttactccctccaattcacttaatcatgtaactttttgtttattttacttctaaactatcacaatcggtccaccttacatcttaggtgcctacatcttaatagtatttatattttttttctttatacaagttattttaagatgaaatattttaagccataaaaagatgataccattctcaagttttatattctcaatttttttcatggctatttgcttgaattttaaaatatctatgtttagatcagccttacgtaatttcaacctatgtaaaaaaatattgataggtaagttgtaatgcatttattcatcctactgaatttcagtgcaaaatataagttatataaagagaaaaaagcagagaaatagagttatggagtaaagtggatcagtttcaatagttcttagctgaagattagtatataggtttaagtgctctggtaaaatattctttatagggagtaaaatgaactttttttcttcaaaaaagtattgtttgcacggaggagtatttactactgtcgacatttgatgtctcgactacggtatttggacagtatggggatcatcggtgctaggatatacgcgagactgaggtaaaagagatggagacagggatttttatacaggttcgggcccctgaattgtcaggtaataaccctacatcctattggccaaagctggtattgctcttattcatgataatcacaccagtataatgtttggggtagcctatctaactgttgtcgacatggcggtctgacgatctgactcgtagtcgacaacagggtagcctttctcctcgaatccgtgcccggcgagatcagagatagcgctttcgtctctcctgacagtatctggagacaccgtagggtactagccgtgcttatccctaaagtcgatatccggcggcgtgtcttgcatatgtaggcttctatgttgtggcttctatgtcaattgtgttgggtgttgatcctctgtgtatgttgattgaggtggtcgtgtgttgattgtcatccctctcctcctaggagggcttgtatttataaccatagatgtccccttgtccaagtagaactaggaaaaccaatatggatacaatccgagtagttcttgtcgtttccatgtagaactctggttgtctttccttatccgaaactccctccatatccggagtcagttcccgtataagacatggtatgtggtgggtcctgccgagatttagtcaactactattaggtatgtggtatccataaccctgacaactacctagataaattttgtgtgagaaaaataaattcaattgaaccagaaaatggtgtttaagacaattgcattcaaactattcaattgtaaactgaacttatcctggttataatatataatcaactgctcaatgcagaattgttttgtgacttttttaagttcacttattgatttatgaaatccaaaaagaatcatatcactacaatggtatttttaatttcataaattcattaaaaaaatcttgcctgctgcaaaattggaatatttcagctaactattcttataaagtgataagcgacatacatataaacaacaatatgtccatggtgactttattaatatcagtcaagtctctcaaatgtgctcatacgaatatgatgtgcttacttatatccatagggatgagtgtgtgtatacaagcatctatgtttttactatgttttgaaaataaagtttgttaacctaagaagatacatttatttagttttaaacattttttctcttattatattttgtttctcctaccaatttttttttctataatatatatactcttatagaggaaatagtagtagtagttgatgataataataatattattattaataatgtatcacatctagttctagatttgttttttaagtacgtcatcttcacatcatctaaaccactataaattcggtgttaacattgaaaagcgtacggttttgagtaaaatagtgtctgatgttgacattgatttccataattttataatagttcagggccggggtgatcttttctaaatttgtgcgctgagattatttctttttcctcgttttaattaggatatcgtacaattaaatttcaagtcttcctggtggaatgaccggattaattaaattgctcgtggttattccaaatttcaaaggctcacgcctgcaccactcaaatcgaccaaacaaacgtcagaaaacttctcaaacgagtactacatccagaaacttcatactaccacctctgttgtcgattactactccttccgtctaaaaaaaaaagacaaacatgagtttccatgtccaacgtttgactgtccgtcttatatgaaatttttttataattaatatttttattgttgttagatgataaaacataattaatactctatgcgtgacttatctttttaatttttttcatatttttttaaataagacggacggttaaacgttggacacggaaacccagggtttgtctttttttttttacggagggagtagttgctaatgttgaatgtggcgcataaattatttttaactattatataatgataaatggaagttgggtaattatataattataataatgatcagtacttaaaaa

SEQ ID NO: 64105 - DNA, 651 bp, Oryza sativa
ctgttgcctaccactatgttggatgttttatactttcagatttatgcagatattgacagcgtgaatttggtatttaatagccgtcaacagacgccaacttcacgctgtcgacccggagcaacagatccggccatggggggaggaccaaatccgtgcttctcggcgttggagttggacgccaccgatggcttttcctcggcgtcggcgccttgccatgcatgagctttctcttgctggcacctcgaccgccttgaccatgagcgagagagagagagagccccatcaaggtcgttctcgtagctgcctgtttttgctggcagcgactcgggcggcggcgaggcgaggcgggggaggggaggagaggggggaggggggcggcacagcttgtttcaccacccgtgtcgtccccggggcagagcgaccgggcattggtatcgctgcattttttttctagctatagaattggtgcatgtagtagtgagcactatatagaattggtgcatgtagtagtgagctctatacatgagttaggggttgtttagttctcaactaacattgttataacttattttagaaaagtgtggcttgtcatatttttttttcctatagattgtaagttgtatttgtggtaaagttaggtaaaagattaaa

SEQ ID NO: 64106 - DNA, 775 bp, Oryza sativa
gacgtgacatagttcccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccataaatagagtgtccactagatggggttttgtttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctc

SEQ ID NO: 64107 - DNA, 743 bp, Oryza sativa
tttttaccaaagtgatcatatccttttttttagaacaagatttattgatttttagaacaatagtagtcatatcctagagatctagaacacctgaagactgctaatgcagagaaaacatggcaacaatccaatttcttcaatgagtaagagtgaaagcacagtacaataggttatttgggtgaaaaaggttagcattacagcaagaaacccatcgcatatacaacagtatgattgaaatctacagagagtagagataccttggacgagtagggataccttgaacggtccatttcgccctatcaacccacaaagagaatattcctgacacttggtccagagtgccttcaagatcggtggaagtctctaccatagtcctcagtcctcgcgaccataaacatcgatgatacctgacaccacagtcagacggactcctaaagaagtataatgtatgaagcatgctcagattgagaaaaaattaataaaaaaactaaatgatgatgcaaggtcactaccatccagactgtttttggaaagcaatatagttcctatgtgttgagtgtccatggagtcttcctctttgacagtatcggtaaagaacacaattattttctgtaacaacatatgcccacaactcaagttaaaatcatttttaaaactgcacgatcataatgggaatagtgcaaaagaggaaatacaccagctgatactagttagaagaatacatcactaaataattctaaagc

SEQ ID NO: 64108 - DNA, 868 bp, Oryza sativa
ctcatcagactatactcaacggtgcactgcaaagtcttctttattgccaatgattgtaactgaatcatctttgccaggagacaccggaggaggaatgacggaatgttcgctccaaaactcctataaatacagctccccgagctgcagctcagagcacacagaacttcacagcagcagcacagtgcaatattgcaaatggagagctcagcagctgagaactggtgggtgctgccactgaccttcctcccgcccatctcagggcaaaatgagagcgctgccacactgtcagccatggccacgagcttcgtctacctcgcgatctttgcatgccttgcatgggcaggcactgctctgctctactgggctcacccgggtggccctgcatggggcaagtaccggagggcgagggggcagagcccgaggtgttcgatcccagggccgaaagggctcccggtcgtcggaagcctcggcctcatgtccgggctggcgcactgctcgctggccgccgaggcggcgcgccggccgggtgccaagaggctcatggcgctgtcgctcggcccggtacgcgcggtcgtcacgtcgcacccggacgtggccaaggagatcctcgacaacccggcgttcgccgaccggccgttcaaccacgccgcgtacggcctcatgttccaccgctccatcggcttcgcggagcacggcccgtactggcgcgcgctccggcgcgtcgccgcgggcccctgttcggcccgaggcaggtggacgcgttcgccccgtaccgcgcgcgcgtcgcggggggcgtggtcgccgcgctgcgcggcgcgggcggggaggccgcggtgcaggtgcgcggcgtcctccggcgcgcgtcgct

SEQ ID NO: 64109 - DNA, 12594 bp, Oryza sativa
ggcctcggctcggtcggaccgccatcggctcggtctgaccgactacggctccgtcggctctgtatcggccatcccgagcagcatcatctcggcctccaggaggccggtctgaccgggaaagtgccaccggtcagacctcactatgtagccggtctgaccggccagggcacgccggtcagaccgccactatgtggccggtctgaccacccctggtcaggccgaacctagtgaatttgtgtaatgaaaaagagagcacaaatgaaaatgcaatgacctaatgtggcaattaaaatcatctcttgctaggtcattacccctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcgcatatgacgtggacctaacttaaaatgtatagctcaaagacaacggttagtccacaattagtgcttgtcattaattaccaaaattaacaccgggggcctagatgcttcacattctagcactaaagtgagagagagaaagagagagggagtggtcccaaagcactttttggcataatttgctactatgtactagcaaatgccaaatgccaaattgccaagttttgctactagtgtttagatccaaaatggcaaaaagtgcttcaaaatgacacaatatagagtaatagcccatacccataccaaatatagcccaatcctccttaacctattaaatatgaggtgactaacctcactactactagacccaacccacaaaacataaaacacgctattctcccccttttggcatcaagcaccaaaaaggtcttcactcttgtggaggagaaggaggacgcgccgaagtggaaggatgagaagcatcacggcggcgatgatagacaaaagcttgggtactctccaaggtttggacgcgagaatccaatacacccaccctagtatgcaatcttcccaccgaagtattcaagttgccaacatcggtgcgcaagccacgaacatcctcacgcaatgcttcatgcccggtggataagcgttgaatgctttcactgagggtattaatagccccaaggaccgggttaaagaagtcatttggttgcattccaaagtaggcatattgtggatggaataaagtacttggatcatacccttgaggaggaggggggctgcactttagcttgcaccttgatcaaaagttggttggcgcacacgaggagctctaggggaggagagttggagacgaggcttgtactccttatgttcttttaaattttgaccaatttgtcccaacttgctttgaatcaacctcattatgtagggagcataatagattccttgtccaatagtcccctttgagatggcaatctccttcatcataaggttgataacatcaaaccgacgaccatccataatggcatcaataacatgccaagcaactccgcgtatgtcatcattgttgccgtatcttgggaggatggtggcccttactatgcggttgatcacacttgggagagcccttaaacccgccacctttccatatgtgtgccttcccccttcttcataaaactgagaaaagtgatcaatgggaaagagattgtgggtgtgctcatcatgaaggtcatccccgttgttgaagcgaatgtgcaagagctccttgaattcacggcggttgatagagcatcggagggtccccgacatccacttcattgcatcacaatcgccggacacccatacggtggcatagaattgccggatgagatcttcatcaaaaggttgcttcatggtgacaattctatcaatcccaatggtccggaacatctcttgcaaattctcaaactccggtgtctcaccaatgtgcctccaagagatccatttgtgttcggcgaaggctttgttggcatacacttgtacatacacggacttttggaaccgtgtatgaaatcttggatcattacaatcgttaggcctccggaattgatcatgatgacggaggatagtgtattgttgagcattcctcaaattaagcacaaattggatcgaggaatcgagaggactcccatcatcacttgcctcatcatcttcaccatttgcactctcattgtcatcaccatcatcacttacttccatctcatcaccctcaacattttccatattgtcctcatcactttgaacatactcatctccgcttgattcctcattctcactaacgggatcgggcgtgggagcacgacgaccatgccgagtgcggggaggcatagctgaaaaacaaggagcaaaggatggatgagcaacaattttagaaaccacatagtgaagtgggaggaagggcgagtgctgcctgtcaggggcggtcagaccgagagccacggccggtcagaccaacggctcaaggccggtcagaccgccggccctcggccggtcagaccgcgtccggtcagaccgccactgacacgagcacacccaaatccttccacaatccacacaaatgattctaaaaattgctagaacagtgttgcacaagattggaactagaacatcaaggtgtaggtctattgaagcaatgggaaaactacccttaaccctaaagattgaaatagaccgatttgagagcaatgcacaagagggagagggatttaccggttgaaggagttgaatcacaccaagaaactaccctctattggtgcaaatcgatgaacacctcttccttcacctagggttccatgccatggatcacaaactcaataagaactcaaatcaatccatggaatagagagaggaagaggaggagatttacttatggtgtaaccggagtgattttgacagttgaaccggatggatttggtggagggaggtggctagggtttgggagaggagagaggaggagtttttttgagttggagaagagaagagatgagatgggatgaggaggggtcgggtagaaggaggaggaggaagaaaggacaaagtcctgggcccaccatccctggccggtcagaccggctatacgtggccggtcagaccgccaggatgcagccggtcagaccggttcctagaggccggtcagaccgccaccaccaggccggtcagaccgcgcatatagcgccggtcagaccgcctggccccccagccgactgtgcatagcccttgcacagttcggctacccccatacaataaaattcaacaaaaatttgaattttggagcaattttgaaatgtgtgagttgaaatattgccaaccattcataatatttgaaatttatgaagatttgcaacaaaacttacttgagtgctaggaggtgaccatttatggtctataggggtttttgggcgaatttgattttcaaacaacttttgaaatatttggattttgaatatgatttgaataccaaaaacatttcaaatcctcctctctaccaactttgttttgaaacttttctcagattccttctcaaactcattttggggtttaatctcattttggccaaaaacaagaatctagattcttcaaaagagagccaaaatagcatttttcattcaaaaatcatttttctagcaatgtgaggcttggaaaacatatagggacccttttgaaacattttccaagagatagttttcaaatttcattgattttgcaaaacttttgacttatgttgacttgggcattttgaaaacactactagcacttttagttgatttgctcacatataaaaggaagtagagcacatgcaagagtccaaaactcccccttaatgtgacatgctccattttcgcaatgaagaaccaaatggcaataagtccaaagcataagagcaaataggagcaaatatacaatatgcaaaagaagcaaccatggtgcaccatctcatgccacattagagaagtctatgacatttaactcattcctcaacttgcaaaagcgggtttcatcaagaggcttggtaaaaatatcggctagttgatcctcggttcttatgtggctaatgactatgtcacacttggtaacatggtctcttaggaagtgatggcgaatgtcaatatgcttggttctagaatgttggaccgggttattggctatttttatggcactatcattgtcacataggagtggggttttggtgaaggatataccatagtccaacaaggtttgtttcatccaaagcaattgggcacaacaactacccgccgaaacatattccgcctcggcggtagagatggctacggagttttgtttcttgaatgaccatgacacaagggatctaccaagcatttggcaactaccggatgtgctctttctatccactttgcaaccggcataatccgaatcggaatagccaacaagcttaaatttagcaccttttgggtaccacaagccaatagtagaggaatgctttaaatatcttagaatcattttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcaagatgtccgttggttgccataggtgtcttgatgggcttcgcatcctccaagccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttgcaaaatacctcattagtagaaccgaatatgatgtcatcaacataaatttgacacacaaagaaatcatcaccaatgatttttgtgaaaagagtggtgtcaacttttctaattttgaaatcctttgacaaaagaaaatctctcaatctttcataccaagccctaggagcttgttttaaaccataaagagcttttgagagtttgtaaacatggttaggatttttaggatcttcaaaaccgggaggttgttcaacaaagacaagttcggcaatttcaccatttagaaaagcacttttcacatccatttgaaatagttttatatcaaagcatgatgcaaatgcaagaaggatgcgaatagcctcaagtcttgccacgggggcaaaagtttcaccaaagtccaaaccttcaacttgtgtgaaaccttgcgccaccaaccttgccttgtttctcaccatcaatccattctcatcttgtttgttcctaaagatccattttgtccctatgacattatggtctctaggtctttcaaccaaagtccacaacttgtttcttgcaaagttgttgagctcttcatgcatagcattcatccaatccggatcacaaagagcttcatctacatgttttggttcaagacaagaaacaaacgagtaatgttcacaaatcgaagcgacacgagatcgagtttgaacacccttactaatgtcacccaacacttggtcaattgggtgatccttggaaagagcggtgtgtattcttggaggcataggtggatcttgtgccttctcctcctccacttcaacttgagcttgacttgacgaggcggaagtagatggctcttcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccctttcggtaaatataacacttgcaaccaaaaactcgaaaataggcgacatttggcttcctcccagcaattagctcataggaagtctttttcaagagacgatgcaaataaagcctattggttgcatggcaagcggtgtttatggcttccgcccaaaaggaatcggaaacaccatattcatctagcatagtccttaccatctcaatcaatgtacgatttttcctttccactacaccattttgttgaggtgagtaggtagcggaaagttcgtgtttgataccaagatcatcacaatagtcctcgatattggtattcttaaattcggaaccattgtcacttctaattttcacaagagtgcaactaaattcattttgggccctttttgcaaactttttgaaaatctcggcaacaatagacttatcatgcaaaaagaacacccaagtatagcgagaataatcatcaacaatcacaagacaatgactattacgaccaatgctcttataggttgttgggccaaacaaatccatatgcaagagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgagctagcctcctatagcaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgtgggaagaaggcacatgacaagctaagatcacaaatttgagcaaccgaaagcaaattgaaatttagagatttaacaagagagacattttcaattgacaaatcattggagatagcaattttacctaacccaattacctttcctttgctattgtctccaaatgtcactttctcttgttcattccctcctacttcaaatgtggtgaatatagccctatcaccggtcatgtgttgagtgcatccactatcaagcacccaatggctcccaccggtgcggtagttcacctacaaaagaagatcaagctcttttaggtacccaaactagtttgggtccttggaggttagagaccaaagctttgggcacccaaatggcattctttttaccaccgagtataggggaacccacatatctagcaacaatgttaccatcatgagccttcctaagcatataatgagaatcaaacatgcatgtcttaggaggcttacctccggggcaatcactcaccaaatgcccaacctcacgacacttggagcaatacttaccatttctcttgacaaaacgagtggcatggtgagaaggtttcttatccttctttggaatgaatccaagtccctccttgttaaggatgcaccgttgctcactcataatcttgtcaagagtgttattacccttgaagcatctctccaaactcttgttgagcttagccacttgctccttaagctcattgttctcaacaacaagtgaggcatcacaaatagaaacacacgagctagaactagagcaagggctaggcatatccataagataatcacaagaggtagaaatgctagatgatgcaacatgagtaatatggcaagtagcactatcatcaagcaaatcacaagatatgccaacatcaatgtgagctccatgttgagtagttgaaaggaggttgtcatgagcttccttaagcttctcatgagaaatggtaagtctctcatgagaggtctttagctcctcatacaagacctccaaagaagcatgatccttctttagggccttgaacttgacaatctccttctcactataagcatggagctcctcaaacatactcacaagctcatcataggaaacatcatcacaatcatcatcactctcactatcactaagagatgttaccttagaggaaccctttgccatgagataaagtggagcaaagagtgatggagcctccttgatggcaacaacgatcatcttcttcttcttggagcttgcatcatcaccaccttcttcctcggacccggatgaggcggagcactcctcatttgagtcccattccccgatgaaagcctcaatcttcttcccttccttcttaagcttcttcatgagcttgtagcctccactcttcttcttggatgacttgtctccatcatcatccttggaagggcacttggaagcaaagtgtcccttctcaccacactcaaaacacctcaagttggagagagtcttattgagtcttctatttcttctcctattggagttggagccccttcctctctcctttctccttcccgagagatcattgaaccttttagcaagaaggaccatctcttcctccaagtcctcattgacttcattcaccttactcttgctcttgtcttcaacttcggcttggagagcaatgcacttcttggagggtgaggcttcctccatctccttcttcttcaacttgtacatgtcattggtgttgatcttccccaagaggcttgtggatgtcattcttgacatgtcggaattgatgagcatggtgacaagggtctcatacttctccgatagggctctaagcatcttttgggcaacctcaagatcggtgtagttgccccaagccccttgagatcattcacaatgacattgagcctcccatacatgtcattcacactctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttgcggtgatcaatctccgtcaagggtgtgccggtgatggcaaagtctacatccacaatactccaaatatggaagctcatagctttgaggtgagtagatattttaattttccaagtggagtagtttgtgccattaaacatgggagccttccctacatggttcacctcgttcgacatcttctctctaggcggtgaagcccaatcaagagagaccaagctctgataccacttgtaggatcgagatgtcgactagagggggggtgaataggcgatttaaaactaaataacacctaatcaaatctaacctaagttgctaggcttggtgagggagaactctaactaagcaactaagttatgttttgcaaacctagggtgatagtggctcaaatatatctctaggaaagtaaatcacgctcctatgtcgatgttttgcaatcctagggtgatatgatctcaagtgtgtctctagaaaagtaaattgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagctggcccacggagaggactacccaagcctcgatcactcggggtagttcttccttcactccgaaggtggtgaactctaaaccactcacaaaccggcgccgggcctcctccacaatcttctcggagaggtcaccgggcaactcctccacaagccgtctaggaggcggcaacctccaagagtaacaagcaatgacccggtgtggagatgatcaagtgccacactagctctacaatggaagcaaatgcacttgactcttggctaaacaaccctctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaattccccaactctgtgctctgccggtctgaccggaggtatgcggccggtcagaccgtgctactctgcaacggctagaaaactagccgttgtagccctgtcagagggccccatcggccaggctggtcagaccgacatggggtgcccggtcagaccggcctcggctcggtcagaccgccatcggctcagtctgaccgactacggctccgtcggctctgtatcggccatcccgagcagcatcatctcggcctccaggaggccggtctgaccgggaaagtgccgccggtcagaccgccactatgtagccggccggtctgaccgcccctggtcaggccgaacccagtgaatttgtgtaatgaaaaagagagcacaaatgaaaatgcaatgacctaatgtggcaattaaaatcatctctttgctaggtcattacccctcttaatagtgcggcgaaactaaaattaaactagcaaatttgatcgccctacacctcgatcaattctaagttaaagcgctagttttaccgtcttctttccctttgctttgcgccgtcaattttaatccatcgataatcatccatgcacgcatatgacgtggacctaacttaaaatgtatagctcaaagacaacggttagtccacaattagtgcttgtcattaattaccaaaattaacaccgggggcctagatgcttcacattctagcactaaagtgagagagagaaagagagagggagtggtcccaaagcactttttggcacaatttgctactatgtactagcaaatgccaaatgccaaattgccaatttttgctactagtgtttagatccaaaatggcaaaaagtgcttcaaaatgacaaaacttttgccattttggaggatctaaacagggccttatacaagcatgcaacatcatctataattcattgaattctagaaatcaacatccaatcattttccttcacattattaataattacatacaagacttatacaagcatgcaacatcatctataactagatgaataccccgccgcgttgctatgggaaattaagttgcataatatgttcaaataaaatgaaatctaaataataaaacttaaataaattgatacctatgaattttgaggcctaaaaatggttgtgattacttggtgttatgagagaagaaagaagagacaatttgaaccataaatctatcatctaatgactagaaataattggggtgatgtggcttaattagagaagagagaaatatcattaactaaactatataagtatataggattcattgaattctacaaatcaacatccaatcattttcctttacattattaataattacatacaaaacttatacaagcatgcaacatctataattcattgaattctacaaatcaggtatccataaccatgacagtaaccccccgacttcaactcaaatgaattcatgttgtcatccgcgttttctctgtcaacgttgtcatgctcacttggtcgttctcgataacaatcgagaagacatggagtactcaacatcattgaaacaagatcaatggtccacaagtgaatttgaattgaagtctaaacaactgccataaacgagcctgaaatcaacgcaaatgaacgagttgatgttctcgaccggagaccttggaacaacagtcgtcgtgatcgcttaaccgttctcagttgatcgagaaggtgcggagtatgtgactacattccttgtcttgtcgtaatcaagaatttgggttgaagtcaagaattttcatctcagcgggtacaccatcgcttcattccgtaatctttgtcgaactccaccaactgttctcgagtaatcgagtagttgtccaatcgttctcgagtaatcgagtagttgtccaaccattctcgagtaatcaagtagttgtggaatctgtgacaaagctctgaaatatgactatcctgaaatcaatactcagacagattgttagatacaaatagccccaagggtaatacaatataatatgaattttaaaattgaaaatatattgaatttgcacatgacaataaaagagtactctcgctaaagcttccatcagcaataggagtctgggactcttcctagcccccagctgtctttatggaaaaatcgtttttccacaaaggcagctaaatcttataacaaaccaagttgaagatgacgaaattctagcatccagccatgaagttgggaaaaccaattctgattacacggcttagttaatacgcattcaaaatagcacaaaggaacgataggatcgacttcaagacagggcgatataagaaaagaggatcaacggacaaatattacatatacaaacacttacagaggttgtcggagaatccatctcttgaacccatcttgtcgaaaccttgtagcaccaaaatccccatacctggcgtgccactgtcgacgtttgagatctcgactacggttattgcatggtatggagactgtcggtaccagggaatatgcgagattgagataaaagagatagatacaaggattttatacaggtttgggcccccttatgtgacaggtaatagccctactacctgttggccaaa

SEQ ID NO: 64110 - DNA, 12056 bp, Oryza sativa
ttatctgtcaaacctccccacgattcaggtgtcgctaatgaactccccgcaagccgcccatggcaggcgagcgccgaaagccgctggtggtaggggacggccgccgcatccactcctattcaccgagatccacgggaggtatgggaccgcggccgcatccgctcctatttgccgagatccgtgggaggtacgagagctcggccgcatacgcccctatctgccgcaaacctagggtgctacgcgaccaccgccgcatgtgctcctatcagccgcaagccgacaaggagtgatgcatttttttcttttttatgttaatttcagaaaaaaaaaatccatatatggaatccgggaccgtccggaccgggtcgattttaaaaaaccatggttttccggtcaatcgctcataaaatatagcggaacggtttattttggataaataaaaaaaagttgactatggcaagatgttgaacaagaacaaagtgatctcagagagcctgtatcaaatcatcacgaagaggcctatataaatccaaacgttgacacgacttgtgaaacgaaggtaaggcaaattaaaattctctcgctaatgttactacaacttatcataatactaacgtgaacatgacctaacaggaggacagtaacgagtgcaatcaaagcagcaagaggcttataggtcctacaggaagaatatacaaaccaacaaatcggactgacttcatctacgaatcaaggggtaaaaaggacataatcagaacccaaacaccaacaaaaataacaccaggtactatgctatttcatccttacatatgctcatgattggtactaattttcctcattttcaagcgcgaacggaaaaagaagctatcatgccagacacagacgaattacagggtgaaaagaagagaaaacaaagcaaccaaacactgaagaaaatatctgaatgtatgaactctctacatcatcctaaattttattacttcttttctatgtttgtgtattactgatttgacttacccttttgtagtgtacatcgataaggaggatcttatcaaaaaaacacaaaagcccaccaaagaacgccttacgaggtcaaaagaaaagaaaaacgaacagccagacaccgataaaaaattctaaaggtaatatctaaacattgtacttttctataaatctattatatagattctatgtttacatattaaaaatttgtacgacatttgaagagttgactaaaaaagaagaccctttcattacctacattaataagacaaaggataacaaagtgatggtgcatattgaagaagtgaaggttaatcggaaatcaatgaaagtactaattgaaccagaatacttgaatgatgatgtaagttcgcctatttaacaaacctactttccttttataactatatttttaatgtaactgaactaacctcaaattcaggtcatggatgcatacatccaatgtctccgagataaagagaaaggaatcaggggagatcgcaaggccttcctagagcaggccataaaaacaggtctactcaatgtagagggagcgcatgttgaatctaacaaccctcgtgataaacgatggattagagatatggcatgcgactaactaccatttgacatggtaatacttatttaagctatgtatgtaatggctattacaatttatgaatgtatcttactgttgaacatctgcagattttcctcccaactaatattacagaaacacactggtacctagccattcttaatgccaagcgacgtgaggtgcaaatactagattcgcttgccaagccaatcaatgaacatcgacccgaactagggcgtgtggtaagtgatacacttccacttgcacaattcaaattggttttgccatgttttaaccatactgatgttgcacaaaacttcctacctgctagctatcgagagaggattacacgggacaaagaatgaacacccacagttaaaacatgattggcttgattttgttattaccaaatgggaatacaacaaagtcaaaaaattgctaaagcaaggagacaagtgggtgacccgtaaactcttccacatgatattcacatttttcaattatggtaacttgttaacctaatgactcaattcttgtagcgtctcgtgtggcctatacacccttaagttcatggagcattggagtggatcttatctcccagaaaatcaaatacaggcaactacaataaactctattcatattttgcaccaatgcttcccattatgaaaaccatttaaaatgcactccctttacattagagaaaattcctatatactcctgaaaatttactcaatcccttcaatacccctgaatttgacctcattccttatatacccatgagttttcattttaatcttctctatacccatctccattagttgaccattagttgaccgttaaatattttacaacgactatattacccatcctatacatatgtggtacctactcaataaattttcatatgaaaaaaattaacttatacaaaatacaagcaatataatcatttaatgcccaacttaaaaaataaaacttattattttttattttttaaaaaatatgattaaatccatacattagtttcaccagaaaattaagagcaaaaactaaattttatttaggtttaaatttttgggaagatatacgaaattcatcaaatttgatctgaaatttatttaaaaattttaaatttgttttctaatttgtgacaaactaattacatcccctttattttttcacaacgaatcttttttcactaaatatttgttgaaaagtaattttcaaattttatgcagaactttttttacaataaatcttttttattttaatgaaataatgttttatttttaaaaattcataacaaatatttagtaaattattccttattggttttcacaactcaaataatttacacaaaacgtttctagcttttaacaatataccaatgacaataaagtaatttctacaataactaacggtcaaactaatggtcaactaatggaatgggtacgtaagggatccaaataaaaattcaggggtatataagagatcaaacaaatttcaggggcgtagaagggattgggtgaaattacaggggcatgtagggaattggacctttacattatgcagaaggatatgaaaatatttcgacaggacttagcaggaattttgatcaagtccgaaccgaacaagattaaagactgtccactactacaaaccacgatataattaccttactatgctctcttccacttattacagattttagatactccttgagtatttcattggtcccaaacgttgttgcattttgagttaattttcatagttcagattttgctacgttggggtcacagacagtgaagcacacacataaggctcatgaaatggaaagccacaacaaatccgatagccaaataacaacgatcattctattcatggtcgtaatagtaatgagaaggagcagtatataaaaccttacgcttcgggatgactcatggcagtaagctgtccgcgtcactcacgtgcatctgcttctacgtcgcacctatacaccgagaacccctttgccggcatgcagatccccttcacgcacgccaccgtcttgcatactgaccctgctcctaacaattcaaccaaaataatcaaaaaacaatacaatggtttgaagaacgagcagccattttctgcaataatcgggagaaagagtaggcttttagaggggctcacacgggagatgaaaacttcagggagggccaccattggtcgtcaacgaaaatacgaggagcagctccatagctgctccgccacagccgcataccaccggcgaatcgccacagccacacccgaggtcgctggaggcggaggaggcggatggggcagagggccgtgagggcgctggaggcgatggacgcggcgagggagatggtcgggcgatggaggcgattaatggcgtcgaaggaggcggcgagggtagggtaggaagacggcgggggaggcaagggcatcgaagggggaggagacgccaacggcgtcggaggtggagagggtggggccgacggacggcgacgtagggggcgggaaaggcggtgagggcgggggagacggacagcgacggagggagcggagaaggcggcgagggcgggggaggcggacggcgacggaggggggcagagaaggcgacactggcggaggataggacggcgacggagagggcggagaaggcggcgaggccaagggaggcggcggtgctggaggggacggagacggcgagggagaaggatcggcgatagaggcggtgagggagatggacggcgacggaggcagggatggaggggaacggacgacggaggagagggatggaggggaatggcgtcgattaggataggatagggagagggtgaacagttagataatgacaaattacataataccctacgcgaattattatctctggacaaatatacccctccacatttctactctcattaaatctggtgggagtataactatatctcaacactacgattaaatacgatcaacggttcagattaattttactacaagtataaagcaccggaacgagactcttcccaactatattgtatttctgtgtataactcccaacagatggtttggtttatgtagaaaaggtacatacatatttatggctcggtagagcacggatcgaaggacggaatgtttgactacttacaaatcttgtccaaataaccgcatatgctgaagcatagttgatgccgctgaaacccgcatctacttcgatcaggctattattaagcgacagaaaagctggagggctcatctccaaccccatagcctttgctgcaaccacacaaaaaaaaatcatattaccatgcatgtcttgacacaattaactgatagtttgatacgagatgatatttgtgtcgagggaacatccgtcgttttgtgcctgttgtttaaaacgtcatatttttcttaaaaaaattgacaagatagattaatatgggaatgtatcactttataaacatataattcagcatatataattagagaaaacaacaaatttagcagtgaactgtatgttctatttagagtcaaatttatttttttctacatatataaattgaatttgaatagtgatatatatcaccgatttatttttttaaaacacggtacaaacgcatgcgatatatatcacaatagtgatatatatcaccgatttatttgatatatatcacaacgtgcgcgctcacctctataaatacacacacaaaccctacccttataagtacctccgatatattttgttaatatttcttttgatgattttcatgaatctattctgttaatattttttttgatgatttttaaagcaatacttaaaaatgaagagatgcagatggcggacacagaaaaaaaacaagtgttgggtgtacccacatatgccaattaaaagaaaatatatgtctttatgcatacaaacacaaataagcctcagacgcttatacggagtacataacaaaaattgtcagatagaagatataactgcaactatttatgtaatgaaagatataaattaaagaatttgtcaaaatatagctagaatctgaattctttggtgctcactaaaaataaacactaggcactgctcttgttcacatacctttgcccactcaacttaatttaagaacagaaatcacaaaatagtttcagttttcagtaatttagtttgagggaaactgggactaagagatgaaagtgcaaatatgaataagtggaggatatatagcaattgtgcgcttctgcttgttgagtaaagacagttgcacagcttctcccgcttggcaatacatcatccttctggtcgtcaccggcgctacccctaaaactctgtcggcactcagcagttcaccacgcgcgctcgcacaggcactattacttgttgctactcctggctttaatccttaaaatataaggtaatttgaagagagatgtggcaaatcctagcattataaatctggacagccgcttatatattttaggatggagaaagtacaactttgtttaacgcttacaaccaggtctgacctgctgttctggcatgtgcctaataagctattatatactccctaaacccagccgcttatatattttaggatggagaaagtgcaactttgtttaacgcttacaaccaggtctgacctgctgttctgacatgtgcctaatatgctattatatactccctccgtcataaaaaaacgaatctaataccggatgtgacatattataaaaaacgaatctaataccggatgtgacatactatggtactctctccttacaaaagtctaagtcatttctttttgcaccaagaccaaaaacaattaattcattcacccgagacaaaaccaatgagcatgtaaccgataaacactaaggagctgtttggttgggctgttttcggcccgtatcagataccagcgtgaattgattcccttacatctgtttgttttagatggaccgtaatcggttagcccgcaaacgaatcccagcccaatacaaagttgattacgctccagatcgggcgttacgcgttaccgatacggaggcggagcggagcgaacgtgacctagccttgagcgccgccaccttgcagcgcaccgtcgctggcgccgctccccctgcccggcgtgcgtcgtcgacaccgctgccccctgccccgacgccgctgcccctcccctcgcacgctccatgaccgcccggagattgcccgcctcgacaaggccgacaacccactgctctgctaccttcagtccctcctccatctccctcgagttccacatccctgacgactggatctgcgagaaggacgaggctgttgagcatcaagaaggcatggcagagatcttgaggcacacgaagaaggcaccagccaccaaggaggttcttctgtcgtttccgccgtcgccggtgagaaccctcccctcactgataccaccactctttatgatgatatacttgtgatgctgatgattgatgatctttttcttttcattaacaaatcatgaagtagtttatactagtgaatcatttgtattcttgattggttgcatgtattcctgcctcagttctgtttgctttataagtttacatgagttttgtagaatctgtttttcccgattgcaggaaaaatctggaatagtagttgatggttctttcatatttgttttcgagtgtaggtaagttccgaaattttgtcggaccaactcattttactctctagattttgagaattttgattttcattactgccaggtgatatattattttgcagagtgtgagattggaaaaaaaaaggtttgtcgtgcattgccttttcgacagaattgtcatcttgcacatatataatcaatttacttatgtttcgcagcatggactgttccaaaccaatctactcgctgaatctgagtctactaatctagtagtttcactcatgtcaattgttcatccatatatttcctcagtactttatttagacagatcacaatgtatcctcttgttgtttagttcattgaacttctgaagttctcactcccagcatgggtcttatatttactcttgagtattcggaagctacatctacaagatcttgttcagagatcttccaggatgatgctaggctgatattagatacaaattcaagaaactagctgctttcaaatatttgcatgtcaaaatggatccgatatttactcttgagtattccgaaccaaacaccaccctagcttgagatcgttggatcgagattgaactgttggagttccactgctctcatcgtgatccttccacaaggattcaagtgccaattattgcttatctcatgactgctgcgaaaattagtctcgcggtgcagctatttacttgttggttaactgcctatatatctggtatgtgcataactgtcccatgggcaatttatttctttacttgttatattccaaaaactttgttagcaaatattttttttgcagctgctgttgacattgttcaacaaatatttgctctactttctgattagcatttaattttctcttgtccaggaagttgacttcagatggccctgctttccattttcttttaaaattcactttgcagaagcaaatggagggtaaatttgcaggtgagctaacttatatttcatgaaaagtgtatgattggaaaccatagaaactattccacttgttaccaattgcataagtggaacacatatttttgggtttcgtgctctcctttaaactcacagtggcatcttttatttcttttaatgtagaagtaacattataaattggattccttgcatctttgtttgagcatgagaacatatttacatgcatgtgtgcttcttaactttggagtcaatgccctttttagaatgaagcgaggacctgcccgattattcactttcagtagtttctagatgcatgttgtccaattatatcacttgaattctaaagccacatgaccttttcttgaattattcctgtacatgccctagctagagtgctaccactatccataatttctacttgagattattaaactgatgttcacattttcaagactgtatacacttcccaatgtgtgatagtatcaaacagttgcatgttataaaattgtgaatatttttacatagctttgatgtgctacacgtgtttgagaacactgctgctatgtagcttgtaatgtgccttagctttgagctacgtcacgttctaagcgctccctgcttcggaagcagccgttacccgttaccatgttccatccaaacaatgtaatgcaaacatgagacgttacagcggccaaccaaacaaaacctgtaaagtgatacattttcttcccttactgctgtagctgatcccatttacgtttgcatttcctgacctcaaccaaacaccacctaaaatggcttcttggtacctatcaataatttaatttagcacataatgattacaaataggactaaaatggctttttggaaaaattaaaaaataaaataagtcttagacttttggaaggagggagtactacgaatctagagatactacgaatctaaagacatgtatatccagattcatatactgctagctagaatgtgtcacattcggtactaggttagttttttatgggttagaggaaatagtggacttaggccatagtgctagggagtagctagctgatcctatttttttttcaaatttcttgggtacgccagtgcacacctggcacacctcctgaagaaacgtcatctcgaaagatgaatggactttcctaatttgatacaatgaataatcactagtacaacaacaattttttccatacagcccaaaagtgattttcgcgtacggaactctggcccatctgctttgaagggtctgcataattcactatttttccacgcgtgcgggcaaaatcggatttttgcgtgcgggtacttatatggtttccacgcaaaaaacaaaaattaaaaaaaattgcaaaaaataaccctagccaccgccagatctgggtggcccccgctgccaaatttgagcggggctcatctgcccgctgcgtgatctgtcgctgccgcccgccactcgctatcggcgcacgcccgccgcccgatgcctgtcgcgaggccgacgaaggcggatctgctcgccgcccgcggatccggccgttgagggccctacagcggcggatcaggctatcgcggaccctacggtggcggatcaggccatcgcaggctcggtggaggtggatccgccagccaccgagccgcccactatcgccgatcgctccctccgcctgctgcctgcctcgtgccgctcaccgcctgtctcgtccagtgaggtgagagaggagatgaggtgagagagtggagaggaaataatgaggagagaaggtgagagagaggagtggataaggatgaaaaattttgaagtgtcgagagggaaatgaggatgtaactcagactttagacagatccttaagaagcccgtctacaaaaatatattttcgcatgcagccccttaagaggtctgcctgcaaaaataggcttatttttacgtgcggacccttaagaggtccgcctataaaaatcgattttttatatggtcctcctaaggagccctatacggaaaatagaggttgatttttgtagatgcgaaattaccgtctgcaacgtatgtctcatccagaaaaaaaaaaccatttctgtaggagtgaatacctcgagtagttagtacatatagctagctaggccacatgcatatagtgaaaataagtgaatttagggctggtttgattttaccaatatttggtaatttcaatagtgtttagtgtctatttggtttggagcaaaattttggcatgccaaagaaaatagggcatttcaatagttaacttaggctattttggcttcaatgcaaacacaactttaccttaacaaaattaaccatactaaaatttaccaaactttagctttaaaaaaattggtaaatctaatttaggctacaaaacaaaccagcccttaattaccaatgaaatcggccatggtgtagccgttgctgaccctgccggtggcattgccaccggggaagtcgatgccgtaaaaggggtgatcggcgcggatcgggtctccggcctcggacgacggcaagtattggttgttgccgacgtccagcgcgccgtcgccgaacaggaagatcgccgggaccgacgaccgccgtgtatcgttgcagccgccggcgacgacggcaccaccaagaagcatcacttggaaggttaacgctgccatcgcaaggaaagtgcccatttcatccgatccactgcccaactagcaattgtttataatttctgcagtagcgaagtgttggagctgcctgcccctatagctagctagctacttataagcacaaggtttcaagtgcttcatggatcaagtattcgtgttgatccggctagtttatcctatctattgtggtctcaagagataattaagtcaagtgttgatcgacgccagatgcatataatgattcctcatcacgcatatatatatgcataatgcatccatgatccatgcttgcatggctgatcgatgtacattgcttccaagataaaaagaatatctcctaaaaacttgaatgctaattaagtcgacggcggtcagctcagatctctatccgatccctctctctctctatatacaaaatctcatgcctatagtgtgtatgtctgccaatgaaaggatcgattgatgatatggtcaagatcaattggttatatgtttgattagttatcaaccagccgatgccgatcgattcaagcaatccaggactgcatgctacctgtgcggctacaatcactaataggagaacgatttttctatgcggtcgaatctgattttcgcatgcgggtggtcggcccgcatgcaaccaagggtctgcgtgaatcgcgattttcacgtgtgggtgcttatatcgcccacacggtaaaataaaaatcggaaaaaaaatttcaaaaaaaaccctagaatcggcagcggcgccgttgctcccggccgctgcctcctcctcgtcggcggcggcgcccgcctcgtcgttgtcggcgcccacctcccgccagcctcctgtcagcgccgccactcccggcctccacgcctcccaccgccgacgcccctcccctccgtcggatctggggagggaaggaatgggaggagaggggagccggatcccacgtgaggggcggccggccgccggatccatgcggggacggccgccgcccaccggatcccgcgcctccaccaccgccgcgtggaggaggccgtcgcgcaccgccgtcgctttcgccgccgacctccacacccgcctcggcagcggcggcggccgcctcccaccagcctctcgtcggcgccgcttctctcggcctccacgccgcccgccgccgtcgccatgggctgccgccgaggagaggagaaagg

SEQ ID NO: 64111 - DNA, 9269 bp, Oryza sativa
agatcggggcacctggtccatcctttttatctgtcaaacctccgcacgatttaggcattgctaatgaactccccgcaagccgcccgtggcaggcaagcgccgcaagccgctggtggtaagggatggccgccgcatctgctcctattcaccgagatccgcaggaggtatgggaccgcggctacatccgctcctattcaccgagatccgcaggaggtacgagacatcggccgcatccgcccctatccgccgcaaacctagggtgctacgtgaccgccgccgcatccactcctatcagcctcaacccgaccaggagcgatgcatttttctcttttttatgttaatttcaggaaaaaaaaatctatatatggaatctgggaccgtccggagcgggtcgattttaaaaaaccatggtttttcggtcaatcgcttatagaatatagcggaacggtttattttagaaaaataaaaaaaagttgactattgtaggatgtggaacaagaacaaagtgatcccagagagcctgtatcaaatcatcacgaagaggcctatataaatccaaacattaacacgacttgtgaaacggaggtaaagtgaattaaaattctctcgctaacgttactacaacttatcataatactaacgtgaacatgacctaacataaggacagtaacgagtgcaatcaaagcaacaagaggcttataggttctacatgaagaacatacaaaccaacaaatcagactaacttcatctacgaatcaaggggtaaaaagaaggacaaaatcagaacccaaacaccaacaaaaataacacagtactatgctatttcatccttacatatgctcatgtgaatggtactaattttcctccttttcaagcgcgaatggaaaaagaagctatcatgccagacagactaattacagggtgaaaagaagaggaaacaaaacaaccaaacaccaaagaaaatatctgaatgtgtgaactctctacatcatcctaaattttattacttctattttatgtttgtgtgttactgatttgacttacccttttgtagtatacatcgataaggatgatcttactaaaaaaaatacacaaaagcccaccaaagaacgccttacgtggtcaaaagaaaagaaagcgaataggcagacaccgataaaaaattctaaaggtaataaacattgtacttttgtatagatctattatagattgtatgtttccatattaataatttgtacgacctttgaagagttgactaaaaaagaagaccatttcattacctacattaataaaacaaaggataacaaagtgatggtgcatattgaaggagtgaaggttaatcggaaatcaatgaaagtactaacagaaccagaatacttgaatgacgatataagttcgcctatttaacaaacctactttccttttataactatatttgtaatgtaactgaactaacctcaaattcatatgatggatgcatacatcagttgcctccgtgataaagagaaaggaatcaggggagatgacaaggccttcctagagtaggcagggctagtcctgacttttcagagccccggtgtgaaactagatataaaggcccttatcatacgatataataataatcaatagatatatatattgaattatggtcataaatatttaaattgcattcatcaataatatttatataggaaacattgaacatttacctcgaaaatttcttctgacatttctagctgcgaagtcattgataatggtaccaatatcaatttcatccaataatttcttctcaatgcataaagttatcaaaccatttaaccttttcttttttataatgtacatgtgtgcagcacaatagtgcagtcagggccttcgtcgattcgtccaactctaggagcaacatcaattgaattaattaaataatcgattttgctatatctcactcgaaagattttttcttatctctcactcgattttctcacttaaatttacagtacattttcttttcttgtaagttataatgtaatttatgaaacttacattgtaacttttgtaagttacagtgtaatttttgaatcttcgcatgtaagttttgaaatttgtattggatttggtctttttcttaaagatatggtaatttagtgtctactatggtgtttcttagttgctttttgccttttactgtgtctattggattttaatctaaagattaaaaatctgtctgatacgatcgtaaaaatcttttaaaagatgcataggtactcccttaaataattaacctaacattcaatcctagggaacaactgcaactgaatcaatttttcacatgtacttatggcaattgggaatttgagatttaggaaattgactcactcacctgaacacaaaacataccactccgagtcctgattcctgaatttactgatcgttctcctcggcagtactcgatggcagcaaagcaatctggaaagcggcaagctgcactgcaagaagcggcggctgcggctgcggctgcggcctgcgggcttgtgtcggcgggacggcgatggcgcgacatcgcgactcgcgtgaggaggagacgaggagggggttagggttttgggcggcgacgcggcaatgtcgctcctcgatcgcgtcttctgatctgatcttctctctctttatgttggctttctctgcgcgaggccgaggggccgaggctgcgccggcttactgttggattgggccgtaagccggtaaataagcccttttgtccctgtatttcggcccattctgccggaaagcaagtgtgccgccgtcgtcgagcttcctcctttctctctctctacaccgtcttcaccaccaccgcgccgccctccccttcggtctgcgccgccacgccaccaccgtggcggggggatgggatgtcatcggccggccgccaccgccggggggagggccgcgcttccctcgctctccttcttcctgcgccggcctctccgcctccacctctcgttccccacatctccggcggccgtcgcgtcgctttctttccaagcagctcgaggagatgatgcatcatcagtatttctgcaaacaccctcggttgctggtggtaggttgaagcatcttgcgatttgtttttcttgtgtgctcaagtgtgattcatggacagctaagccgacgtgttacgttttattaaaatctagggatttcaagctttgttcatcagattgtctgcacaaattatcgagctcttgttgacatagttgccttatgtgctcttgaattcttgtaaagaggctgctacttccacctcaatttgatattctattccgagattttgatgatcaatgctacgaatttataatcgatttatcaatttttgtagttccaaattgatgtttcaatctgaaattcaatgtctgatgcaatgctcaatacgacaatacccattttttggatcagtaatgcaccttactccactgatctagccgtggatgttcagtaatggggggctattatttcactggtatagttgggttacccaactcccaagcatgctcctactggcttaagaatcttaggcattcgttgaatgaaaattataaatctcaactactatatagatgttcagggacatatatagaacacatccaattgaaggtaggctacatatagaaacttcatagtctgctattgtgtatgcatttgctctcccagcactactctccagccataccttgctgacttcctccaaaactgtaaatgccttgcttctttcagctagaaagactcagctcacagtggatgtattgatcacctttaatttaattagcccatgcgcttaccctgaataaatcaactgcaactagacaagtactattagtcgtacagctaaaaattctatttaggcaagatcaaaaaaaaaatctacgtaggccaagagattgagagtagagctatatgacttagcttttaaaaggtttgaggttgccgacttttaactacgaagcatgagccatgtgataggaattactgaataagcgtcatatctcaatacttgactttgactttcataccatcagtttaattaagaccatggactttgataacatagttgacacttaatttgtgcatataaatagctagctagctaactgcacttttacttcctatcaatcgtcagttcaatcatatatatacattctacatgaatgctgtataaataacatatgcagtagtgttcctgagttttaattggcttgtttggtgatgatgatggggcacttcaggatcatagttctaagccttgtgataatagcatcctttcaagtgcttggctctgctgaaggccataagacggctgtaccggcgatcttcgtgttcggggacggcatgctggacgttggcaacaacaactacttgccgtctgacgccccccaggctgactacccctactatggcatcgacttccctggctctgagcccactggaaggttcagtaatggatacaacatggctgacttcattggtaattaagcgacttgatcgatcatattgcccttattatcttttacagttatgtcaccattaaattgtattttctgtgtcatagtttttcatatagttatttgtgaattagatggatgtttgatggttattatacagtcttttttttttgctttagccgaaagattttttaagtgttttcaagcagttagaataaatcgcccacaatatacccaacacgactacaaataattaatgaattaatgctaattggtagtgtggtcgttgctctatactactattgactttcagaagacattagcaaataaaggtagtaatgttattgtagtttgtaaaaaaaaaatgatgaatataaagaaatactaacgacgattcagcatttcataatgtttggtttgcaaatggtatttctttgttacattgatatatatgattctatatttgagaaaggtagtgcatattatcaagtattcttttatttgagaaaaatacccaagttaatttttggtatatgcatgcaactttaattggtgtgtgctatgcatgcagcaaaggatatgggattcaaaatgagccctccagcttatctatcgcttaacagttcgataaaaatggagaccaatttcaccggagtgaactatgcttcagcaggtgctggcattcagatcatcatggtaactccagaatatatgcttaaatgcaaattcaaccataatattaattgtgaatgctgccatggcaatggcatcaagaaatggtgattatatatccaagttggtcatataaacatatttgaattgttgcatatctatatcactaattatcagaagcatgatctttcatgatggttaattaatgattggaaattgcaaatgaaagaagagagtaacatgtgactagatatcttgtcggcattgtaattttcaaaaaatttctgacagtgacataaggaaaattttatatcaatataatatcatctctgactgtcaacttctgatagttcgctgggccatttcatgggcaatctacaattatacatgtcttcgttcaatttgttcgttactctttgctatcaggaaaattatacccaatattatttagtcggtagatcaagagcttattttgactttgtagtaactcaacattttatataggatattgaaatctatgatgaaaagtagctaccacaaactgatgaatttcttggttatactatatatacgcatgctaagaatatgagtgatcagatctgctagcaagatgaaagatcaaagtgttaataaacatttgatggttatttaacagataaaatactgggttttccctggaaataaccttaattgatgctatattgtgaatatgcagaacgatgaagcaacgattccattcgtgtaccaagtgaagaacttcaatgacacggtaagccagatggaggctaacctaggccaccagaagttgagcaagctgttggccaaatctttattcctgataagcattggtaccatggatctgtctgtaaatatatggagagtattaagatattccagaaagccatcaccattcaacattccatatacactttcctcctacaaggccataatcatgcagttgtatggcctgggtgcaaggaagtttgggatcatcaacatccagcccttagggtgtcagccatggatgaggaagaacttggaaaacaatgtcgactgcaatgactccatgaacagtctcgctagggaattcaacgatggcctcaagcccctcttttccaatctcagctctcagctgagtggtctctcctactccatcgccgacttctacgcattctcaaatgccaccttcatgaaccctcgggcttacggtaagtcaatcgaaattattgaacactttttttgtggttgggatagaggatcatgagatggactgtaacacaaaccatggaaatgctacttgtccttgtttatctaatgtatttattgtggttatatcttgtatgtgcagggtttgtgaacatcaacagcacatgctgtattcccccctgcacacctgaacatgaaccaccctgccaaaaccgcaagcagtactggttttgggatctttcttacacgactgagcgggctgctaagctagccgcctctgcattttacgatggccctgcccggttcactgcgccggttaacttcaagcgattgataaagatgaaatgattttataataaagatcttttcgtgttgcaagtccattgacgagtagttgatcaggttttcctgggtgtgtatgtgtgctttccttaattttcatcatcttttttgtatgcctctggattggtaatttggtatatatatgtatgaattccatgctaaggaatgtgtcacaataagttgatcgataagaagaataaacccaactatatataatcgacgtttttgtttcagtgagaagattttgtttttttttttccctagactcctggtttccacaagtttgttaccaacctcccatcatgtcatgtgtggcattcacactgtgatttgggtggatagaataatttgagacgcactcccggatgaatgaaccaacactgccacaatagtaacagactcttcaaacaaagaaaattaaaaagaagaagaattagatatagaaaagataaaaagaaaaaaaaatcttgcgaagcagttaatcagccaaccttacctacactcttctaaactaagtcagtttgactttttttcttagttgaactttttaagtttgattatgtttatagaaaaatatagtaatattttttaacacaaaaaaatattattaaaatatattgaatgttatatttaatgaaactaattcgatgttataaatgttactatcttttttaataaatttggttaaatctaaaaatattttactagagaaaaagtcaaagcaactaataaaatgaaacggaagtaggaaaatattatagcaaagatgaaataaaaggaaaatctttaatctttatctagctcataataataaataaataaatcattaattaataaattcttcggagtttggactcaccaaatcttgttaacgtgtaagacttactgtacttttaagggattgacaatcaaataggcttttctactactcataatggaacaatttactgatcattcattgcacctagaagctagggagatgcacaaagtcacaattacaaagaaccaagtacttcctccgtttcatattataagactttctatcattacccatattcatacgtatgtctaaattcattaaaatcaatatgaatatggacaatgctagaaagttttataacctgaaacggatgtagcagtaacaatcgccaaataaacaggctgcacgttagtgggggaagatagtagggatgggcgtagtcgcccattgggcttgttggccggcctgtctcataaattaatttgagcaggcccaaactgaaaagaccagctttagtgggaaacttaggccatgcccaacgctccaacgtggagcgtgatctcaccccttccaaggagtatatttgtgccagctcggacaggaccgtatcccggtagagcgccgcgacccctgcagagggccggataatttcgtcagcttttcggtgcttttgggcaagaaacaggagaggaaccgcgttggggagatgcttcacctcaagccgtcgccacgcgccgttgctgctcccgcgcggggaagaagatggagagggggtggactagagagaacggtcgcatcgatcccccccccccccacgccggcgcgtcgagaccggccgccactgcgtcgatgggtcagccgccgccgcttcgatcgctgccggggaggggagaggagaggagaggagagctatagaggcgtgaaatggggagggtgttggtggggactggggagaagagggaggaggagagattttatattaatttctagattttagggtgtttagtataaaatttaaacatctatataaattgaaaaattgtgagaactaaaatgaaaaacaccaaggactgaaataaaaatatgaggctaccacctggagaaactagcacagtaggaaattagctttttgagagtgttgccccatcccacgtggcatttgaggggtaccctgcgttggccatgcccttagggtgtgtttgctactggaggttcccaaccaggaacagtgtgcgtggaaaacggagcggtacattagcacgtgattaattaagtattagctatttttttcaaaaatgaattaatatgattttttaagcaactttcatatagaaacattttagaaaaaacgtaccgtttagcaatttgaaaagcatgcgcgcggcaaacgagaggggaaagtgccgaacacacctgcttcaccgaattattaaaagcatcgatccctgacatcatcacacatgacgctccattttctccatctccacttccacgccggcggggcggtgccgcttcctcccttctcccaacctcttcatgccggcgcgattgtggctcctcccctctactcccttcccccatcctccacgctaatgttggcgcctgccctagaatttttacaatttagtacttttgaaaaacttattttacaaataaactcctggaaaaacttatcccataaatggttcttttcagggcaccagagtagatggcgccaacctcctgccaccgtggtggggcggcgctgaggtggcagggggagcgcgccagagtggctgcccccccccccccccccggcc

SEQ ID NO: 64112 - DNA, 19192 bp, Oryza sativa
cgattttcccagatgcgacgagttaccgtctgcacgcaatctgaaggtccctgtccaggaaaatcgtttctgtggcagtgaatattgtgtagctgtaagattgttacacgtgcgatcactggatgtatggccatacgatggcatattggcatatatcataatattgcatgtttaacatattcacccattcagttattcagcacaaaagaacctgtggttgttgcctgcagtcggtgatcaagctaagtcgatgatgttcttttgtgctggataggttagcttaattgcgttcatgacacacgagatgcaatattatctggacgatgacaagtagcatcggaacacagagaaagacgagccgtgatggacgaatgtcgcaccgtactttttcaaaaaccctcacattctctaggttgtaggatcacaattacaatggattctagggacctattttcccaactacctgtgcaagccagcaagcaagaattccagcagcctgatgatcaagttaacacagcacatcagctattgtgcacgctataataaaatgcaccattagcagatttatgtttttttggtttccaacaagctagtttaattgggatatatcatagcaacagggttgtaatgtgttactccctccgtcccataatataagagattttaggtggatatgacacattctgtctctgtctatatagattcattgtactaggatgcgtcacatccacctaaaatcccttatattataggacagagggagtatcatttatcatagcatcgagggagtaatgcatatgtcttcactgatcacttttcgagctaaactaccaaaaaccggactagctctgacggtcgtcattgattttactaacgtgcacggggaaattcaattttccatgacgcacttatctcaaggtcagaaaattaatttccttgatgtggatacaccactcgtcacaataattatatttgattattctgacatggacaaggctgtcggtggaaataatggattcacggtggcagttgcagctaatttcggtcgtttgaaccaaatggtgggagtgccaaaaaaaattggtcgcttcacaacacacgcaatttcgctgacatgaatggaccatcagtaaatttgcatgctaataaaagatggagagaaaattattaaatggagacgtagtgtacgtcgatggtaaacagaaatgtgcaattttcacggagaggcgatcatggggcgtccttggaggggccctggtgatcttgaaggcttgatcttttcccttggcgatggctgatctctccttttcagatggcaaattaatatagagtacagaaaattgaggtggaagtagcagcctctttacaagaattcaagagcagaatgggcacataaggcaactatgtcaacaagagctcgataatttgtgcagacaatctgatgaacaaagcttgaaatccctagattttaataaaacgtaacacgtcggcttagctgtccatgaatcacacttgagcacacaagaaaaacaaatcgcaagatgcttcaacctaccaccagcaaccgagggtgtttgcagaaatactgatgatgcatcatcgatctcctcgagctgcttgccagggagagtggtcacgtacggtccggagagaagcgccggccgcggagagggtcctcgacaagtgcgtggctgctgcctgccggaatctcactcacgcgcgctgcctggaaaaagagcgacgcgacggccgacggagatggtgggggacgaggtggaggcggagagctacatacgcggccggcgcaggaagaagaagagcgagggaagcgcggccctccccaggctggttggtggctcccccggcggtggcggccgccggccggtccatgacatccccccgccccggtggtggcgaagaactgaagacggcggagagagagaggaggaagctcgacggcggcaactttctttccagcagaatgggccgaaacacagcgacaaagggcttatttagcggcttacggccgtccacaagaaaataaaaaggaaaaagtacacctaaggtccctcaacttgtcatcgagttacaaaatcatccttaaactgcaaaaccggatacaacacatcccccaacttacaaaaccagtgcaaactaggttcctaagtggttttcactccagttttgtctgacgtgacagctgactaagggtggatcctagatgtcagcctctacttcccctcccctctcataattataatactaaattagtttcatcaaatcaataattaaatatattttcataataaatttgtcttgggttaaaaatgttactattttttttctataaacttgattaaatttaaagcagtttaattttgaccaaagttaaaacgtcttataacctaaaacagagggagtatttacttaaattttttagtaagacgaataatcaaacatgatgtaaaaaagttaacatagtcatatattaaaaacaaaggtagtaagtattattattgttgttgttgctattaatgagctaagtattttagggaaaaaattactactaatgggctaggttcttggaataaaatttcttacttgaaatatacgacttagtagaactaatacagagcatgtagcgctctatttgagctaagtagcatgtattgtaacaactaaaaaaaataccaacttttaaaaatcaacttattttacttttatttcttccaacgctaggcttagttggttgccgtgttttgatcttcagaaaattccatatgtgcccacaagtttttcctcaatcccttctatacctttaaatttttaaattttgcatcatctcatgtacagttgtaccactgaatttttctttttatcccctctttacccattatgttagatttttataaaatgaatatatttccctctcttatacttacgtgcaacttattttaaaaacatcaatgttaatgtgattttttatttataataaaaatcaaacggggtagaattatttaatagcaaatttaaaagaaaaactaaaatgtgatctcgatcatctctgatcagtgtattcccatcaaatttgctattaaatatgtgaaaaattaggagatctcgatcatctccagtgtattcccatcaaccgcttgaagttaagcggcgtggtgaactggcgttctccgtcgtaaaatgcagctgctgccagcttagcggccttctccgtggtgtgccccacgtcccagaaccagtactccctccggttcccacacggcgctccgaactgctcattgcagggccctttgcagcacgcagcatcagtgttcgtaaaccctgtgtacatacgatgacaaactaacattaggaatgcatcatcattaaaaagaaatgcaagaagtaaattgtgacggttcacgaataatctgacagattttgtcaagtaattaaataccattagccgacgggttcatgaaggtggcattggagaagccgtagaaatcggcgacagagtagcggaggccggggagggaggagctcagcccggccatgagagaccccaatccgtcgttgaactccctcgcgagggcgttcatccggtcgtcgcaaccgccgacggggctgtggctgtgcggctgctccgtcaccgccggcgcgcacccgatcggcggggcgttgacgacgccgaacctcctcgcgcccagggcgtgcagtggccggacgacgagctcgccgtaggaggcgacgaggtgcgggatgtcggtctcgttgtcgggcggcggcggcgacggcgacggcgagtcgagtatgttggcgatgcggtagaggtcggaggtgcccgcggagatgaggaagagggacttggagagaagctcggttagctcgtgctcggtcacggtgccgttcagctcctccacggtgttggagaagtatcgcacttgtctcggcagtgatactgattctgcgtcgtcctgtatggtgtttgggaaaatcaggcgactgataaatagtaaaatggtaaatatttatgaaattaacatgagattcgactcgttttacctccatggaaatatttcccaactgtattgtttatgtaagaaaaggtcgtatatgtaagaaaatgtttggtttatgtaagaaaatgtatatatggcttaggctatgttcaggaggaggaggagtcctctttggcacgcaaaataaagcacatattattacataattaattagtattaactaatttattttttaaaaatagataaatatgaatttttaaaacaactctcatatataacttttttttaagaaaaacatacctttagcaatttgaaaaaagtgtgcacacggaaaacgaggaaggtgagttaggaaagttggaaaaagaactgagccagtagaacacggatcgaaggacggaatgtttgactacttacaaatctttccaaataaccgcatatgctgaagcatagttgatgccgctgaaacccgcatccacttcgatcaggctattattaagcgacagaaaagctggagggctcatctctaaccccatagcctttgctccaaccacacacaaaacaatatcatattaccatgcatctcttgacacaattagtttatagtttgataggagatgatgtttgtgtcgagggaacgccccatcgttttgtgcatgttgtttaaaacgtcattttttttaaaaaaaataggtaagcttgatcaatatacgatatatcataaacatataactttaaattcagcctatataattagagacaacaaatttagcagtgaatttttatgttctgttcagagtcaaatttgctattttgtttctacatatataaattgaatttgaacaatgatatatcaacaatctatttatttttaagaaacacagtacaaatacaggcgctcacaacgtgcacacactcacgtctatgaacacacatgcgaatcctaccactatgagcacctccgatctattttattaatatttattttggtgattatcacgaatctattctgttaatatttttttgatgatttttaggctataagtaaaaatgaagagacgcaattgtggacacaggaaaaactagtgttgggtgtgcccgcacatgtcaattaaaagaaaatatataagtctttatgcatacaaatacaaataagcctcagacgcttatacataattaacaaaaattgtcagatagaagatataactgcaactatgtaatgaaagatataaattaaagaatttgtcaaagtatagctagaatctgaattctttggtgatcactaaaaataaacactaggcactgctcttgttcacatatgtttgctcactcaacttaatttaagaacagaaatcacaaaatagttttagttttcagtaattcagtttgagggaaactgggaccgagaggaaattgcaaatatgaataagtggatgatatatagcaattgtgcgctttgtgcttgttgagcaaggccctgttctattcttcaactccaaactctaacttactcatttttcatatatagcacgtttttcaaactgttaaatggtgtgtttttaaaaaaaaatctatataaaagttattataaaagcaaataaatttatttcttaaatttataatagttaatacttaattaattaattaatcagcttctcccgcttgtgaatacatcatccttctggccatcatcggcgctaccccaaaacccgtgtcggcactcaacagttcagcacgcgcgctcacacatgtactgctacttgttgctactccaggcttccgttccaaaatataaaagattttgggtagatatgataaatcctaatactgtgaatatagacagagaagctgtctagattcatattactatgatttgtcacacatctacccaaaatcccttatattttgagatagagagagtacaactctgtttaacacttaacacttacaacaggcctgacatgctgttctggcatgtgcctaatctgctatattggctgtgtttagttcctcctctaaattttttttgacgtatacatacgcacatttgaagtattaaacgtaaactaataacgaaacaaattagagattccgcctgtaaattgcgagacgaatttattaagcctaattaatccatcattagcaaatatttactgtagcaccacattgtcaaatcatggcgtaattaggctcaaaagattcgtcttgcaatttacatgtaaactatacatttttttcacatttaatgctccatacatgtgtctaaatatttgatgtgacggaatttttaaaagtttgaagagaactaaacagaaccattatctactggacttaggccatagtgctaaggagtaggtgatccaaattttttttttcaaatttcttgggtatgccagtgcacactacacccttgggtccgctccctgaagagatgtcatatctagagatgaacagactttcccaatttgatactccctccgttccattttaattacaaccatgagtttccgtgtctaactttaatcgtctgtcttatttagttttttaaaaaaaaattaaaaaacataagtcatacatagattactgttcatgttttgtcatctaataatagtaaaaatattaatcataaaaaaatcaaataagacagacgatcaaagttaaacattagaaactcctgaccgtgcttaaaatggaacgaagggattataatgaataataccactggtagttagtacgtatagctagttagctaggccacatgcatatagagaaaaaggaaatgaatttaattaccaatgaagtcggccatggtgtagccgttgctgaccctgccggtggcattgccgccggggaagtcgatgccgtaaaaggggtgatcggcgcggatcgggtctccggcctcggacgacggcaagtattggttgttgccgacgtccagcgcgccgtcgccgaacaggaagatcgccgggaccgacgaccgccgtgtatcgttgcagccgccggcgacgacggcaccaccaagaagcatcacttggaaggttaacgctgccatcgcaaggaaagtgcccattgcatccgatccactagccattttttacacttttctgcagtagcaaggtgttggagctgcccctatagctagctagctacttataagcacacaaggtttcaagtgcttcatgcatgcttgatcggctactttatcctagctatatattgtggcctcaagagataattaagtcaagtgttgagatgccagatgcatataatgcttcctcatcacgcatatatgcataatgcatccatgatccatgcatgcttgcatggcagatcgatgtacattgcttccaagataaaaagaatatctcctaaaaacttgaatgctaattaagtcgacggcggtcaactcagatctctatctctctctctctatatataaaatctcatgcctatagtgtgtatatgcatgcttatatatccagtgaaaggttcgattgatgatatggtcaaggtcaattggttatgtttgattagttgtcaatcagccgatgccgatagattcaagcaatccaggactgcatgctacgtgtgcggctacaatatgttgaaattataagcgcataatgatttaatttattccataaataaatcatgacattgcagatgtaaactagattgaacgcatcattagatctacacatgtaaactaagcagtaaaacatgagcagatcaaatatgcgcaacatgtcgaacacgtaccgaggtggcggaaagaccggttgctcggcaggaactactcgcggttgcggacgtcaacgaaggcgcgcagcacacgagcagagaggaaggcaagccgtcacggacgaacagggagcagtcgcgcgaagcatttcccaaaaaccttattgccgccttctcccggtgcaggacgtcgaaggcagaggttccggagacctgctctcccgatcaccggtgcatgccggcgagcgggatggagtagtctacgagtgacggcgcagtacagagtaggaggcaaaccctagattgatttcgcgtgtgttgcgtgaaggcggcggctcggtttatatagaaataggtcgcttgatcggggcgcccgcgtaaccaaaccggataagtcgcgcgtaacttatccggactccacgccgttttcacgcaccggatttttcggaatgtttcaaaacaaaacaaatccgaatttcctgcagcaaaacaaaactgcaaaaggagactacatctgcgcaagggtgaggagccaattttgcggaccatttgacgtgtacgtcgtgcacgcgcgccgcctgccttgccaagccaggcgaggtgagcgagcgcgcgtgtttcccctcttctctccaccacacatgcttcaagtggctaggagggcatcctcccttttaaggaggtccccctctcatagaaaaagcaaggtggtactaaacttcacatgcatgccatcccatgaggtgggcttttgtgattttcaaaagaattaatcttcgaatgggccttagcccatctattaattccaacaatcccccaccaaatctcaaaatcccactgagatttgccttttccaatgtactgtttatataccagcggttcgatggagaccgattaaggttaaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctagatctttagtaagattcctagaagattcacccaaaatctctatagactgcgaccaacagtcaagcttacaaaggtgagttctttcaagaatgctctgcaggacatcatcttcgctaattaaagccaacagaactcattaaggcatagccaacctgccttgcagctcacgagagtacatgcatcttcacttagagagggtatagattggtactctcctctagtttactaatggtttgttcttcccaggttctaattcacgggatctccgatcacatagactgggttaccaccatagtataactcacatgggtctcaaacctatctcctacgatgcattgtctatcacatttcgtgatagtcccttcgtgaagggatctgccaggtttctagctgtttggatgtaatccaacgttataactccggagtttctcaatttcctgacagacttcaatcgtcttttcacatgtctagacgatttcttattatccttagaactattcactttgacaattaccgtttgattgtcatagttcataaggacagccggcaccggtttttcaacaataggaagatccattaatagatcacgcagtcattctgcctcaacagtagcagtatccagtaccgtcagctctgcttccatggttgacctcgtcaaaatggtctgtttgcaagacctccacgaaacagcaccaccacccagtgtgaagacatatccactagtggcttttatctcatccacatcagagatccacttagaatcactatatccctccagtaccgcaggatacctagaatagtgaagccccaattccatagtatctttcagatagcgcattactcgctcaagcgcacgccagtaatcatctcctggattagaggtaaaccggctcaacttgctcacaacaaaggagatatcaggcctagttgcactagctaggtacatcagcgagccaatgatttgggagtattccagttgattcctagcaattctcttgttcttgcgaagcaacaattgtcgacctccgattttggaaatcggaaatctcctatgtttatcagtaccaatccctggatcagtagttggtacacacatacatagccgaatcacaacatatcatgaatgaattcaggctaaaagagttaaatgcttacattagggcctggcaggccaacaactatcagagaaacaacagcggaagacaaaataatacaggggcccggttgacataccacaagcagtcgactgggaaacgagacctagaatggaattaaactccgatcatcttgttaggtacgcaagcgcactaacaagggcttctcttcaacactctgctaaaagatatatatagagcaacaatgagtacaaaagtactcagcaagccaccacacaaaatgtagtaatgtacaggataatacaaggagtggctatggttactttgcgtaaagctgagttttcaaatatcatttcacaaacctaagacctagcataaactgatcaagttttaactccattgttcattaaacagcgacggttctatccaccatccattgtgttcccaaggatagcttcccgccactggccatcatggttttctggggtctaccccttctcgcctctcgagaagttgatccactagtacaaaatcatgatgcatatcccatcccaatcagattaagaaattagagtctagccaagtgtaatacatgtcccggtgctcaataaccgcgagcacggctattcgaatagatttgttttactcacactgcagtggatgtacactttacccgtactccgcaactgcccaacacatgagcctcgtcccaacacatgagacgcgtcacggcaaagcctttcaataacctcacattggcagtacccgctccatgaacttaagtcctcatgcactctaggcgtcataagtttctagcagtgagaggagttctggcgctcccgaggaagaaaactcacgcaagtctaacatcgcatcctgtagttgaacccaatctatgctgtcctcttttgggtatctccttgtagtcttgtagtcttgacaagtcagtctctggccatccgtatcgggtatccgccatctggccatccgtatcgggtatccgccaacagactgcttgttcatccacacacctaagtgaaaccactatgcaggggtactgcctccgctcggctatctactccgctaggtctatacccattcgagaagtacggttgtattggggtcgtttcatgcttagcttcatggctctgtccttaactgaccagggatggcactagcctttaccggacaccacccaaatcatccagccgccccagtcgaaaacatttgtttagttttaattttctttcacaaatcatctcatcaatgccatggcaatgtggcactcatgtctctacatgccgtatctcaactaccctccccaaggtagttgcccaagcataaagcatttgataaatatgagaatgcatgaatctaaattagcattactcagcatttgtcacaagtgactatggactcatacgtaattatgggtacaagggaataatgagataagcaataatcaaaggcatggcataataacaagtaggatattcatcattgcatgcaattttatttgtaaacaaaacaatttcgcaattgggatcaacatgctcaaggggtggggtgatgacttgcatgctcaggatagttcttattcttgatataatcttgatcaaccttcacctcctggaagctgcatacgttgcctcacgactaaccgatatacaaattctataatacgcgagaaaaaccaatattcaatcaaatatgcacaagcaaaatatagttgttggggtcgattcgtgtttgcaaacggataatctcttaatcattcctattgtcatggcggcttgtttaggatctaatcatcataatataaatgggatacacatttcattaaatcagagttgatctatcgagttatggtaggagtatgaccacatatgcttctaattagtttacatgggttttacagtgataaagcatggtaaagagaattatcctcacacctagtttactgtacaataatcaattttatttattagcatatttttaagttgatcataatctaatcatttgatattaattatgtaacaattataaatatattttactaaacagtgagttacataccattggaaagcttatgaatttagataaatttaggttcaagtttcactcgaatcggagctaaaatgaataagttatactagtttaaagattcaatttcgaattaatccgagaaattgtgaaaagttactgttcctaatagatttgttcttaatccgaaatcctatccacaactacattgactgtcatgtgggaccccgggtttattccttttccaccggattaatttttgctaggggaaatataggagtgggcccggcctgtcagtggctcgaatggaggtcgtcttcaacctccagccgggcagaggcagccgtgccatgcgcgctgggcacagccgggatggcgcgaggccggcacggcggcggctgcggaaagtacggagaggctccggcgacctcccaccaccgtcagcgacgcgcggcggagtgagggcgagtggcgcagcatggctgagctcgggcagctaggtgctagggcgatagggagggtttccgaccaaactggtgagggcgtgagcgtctacggcgtatggggattcgatttcatcagctagatggagaggggagctcccggatggcttgtccacggcgagctcgccggcagtgcaatggcggccaggccggtacggccacgggtgctatttggcgaaattggagccgatgctagctattagagagttagaggatgctatggggtcgagggattacgctaggatggagagacggcgaagggcggcgacgcgtggtgcggtgcagacaaagcagaggtggctagcggtcggcgatgcccgaaagtgttcgacgcgtggttcccggtgtccagcggtcctcagctccctcaatggcgacggcggcagcacggctcttcctccactccctccaacctccagctccggccggggagcctcgcaatgctgatctctagcggtggtgagagagtgatcgcaaggtgctcgatgaaatgtattcgggaagaaagctgagaggaatggggatttttgttgggggcttagcttaggatgtaaggaaaccatggggataagatcgccggcacatggcctggatgagctagagctctaatggcaatcggataaggaatatgaggtggacgacgcggataagggtttatctccttctccattaaggttctgtggcttaatcatcgcatctataacctatgtactgcaggtctaggcgctagctggaggaagggcattgttttgtccagcgggcgcggtagggatgcgcagttttaaccgatggacgcagagcggcatggtgacgatggcgatgctccgtgtttcttggagggaaacgggagagcggttggaggccgggattcacggcggaagagcggcttggcgtggctcgagtttggcgtggtgcggcacatggaaacggtgcgacgcgggtgcggcgcggtgcatgggaggggtggatgcggcacatggcacaacgcgagcgcgggagtggcgcaggtgcggaggcatggcgcggcgcggcgtcgggtggtagcgagatcgatgcgatgcacgcggcacacgggagcagtgctgcaagggttgggaacgggatggatgcgttcctgatctgctgggctgggcctatgtcgaacaggtgtcgggcaatgaacagtggcggctaggaaaagagagaaaaggaagaaaagcgaaaggaaggaaagggaggggctaatctgcaaaagtgaatgggattggaatttgaattgagatgtaatatatatattttggttttgggaattcaaatatgtatttgaatatttacttatttccaaatgaatttgcattatattgggttactctataattaacttaaataattgctggctgtgatatagaattaatatatttccatagaatacattataagggtggtggtatatttactcaatttatttacatgaccaaatattttatatgagtgaatctattccatgagagactcaatgaacattataaatattaatataaatattccagtggaacgctcctttatatagggtcatcgtagtggcgattatttcatggttgcttagatgtcctgacacttgtcaacatggttcaagtatttaacattcaatttgtagtctgcattatagaaattaataattgacttgtactttattcggcttgctatcatgtgcacaaatatttataggattaataataattatcttattctaattactacttagttgtacagctttagcttaatcttcaatcgtgaaaattaatagtttggcaagcaatagcaaccataacatctagcatgatgcaaaagttctaaaaagtttaaaattttagtgatttttattgtcagaaattttcagggtgttacaacaatctactccttccgtccaaaaaaaggcaaaccctgggtttccgtgtctaactttaactgtccgtcttatatgaaatttttttataattcatatttttattgttgttagatgataaaacatgattaatactttgtgcgtgacttgtctttttaatttttttcataattttttcaaataagacgaacggtcaaacgttgggcacggaaaccagggtttgtctttttttgggacggagggagtaggatcataaggtgttggagaaggcttactatcaatgtagccaaagcgattcaagatcttctccacataatgggactgcaagaatgtaatcacattctcacctctaattagcttaatgtttaagataacatcagctactcccaaatccttcatatcaaaattttgagacaataatgatttaacctcatttatcacctcaaggtttgtcccaaatatcagtatgtcatcaacatacaagcacagaataactccctcacccccaccatagcgatagtacacacatttatctgcctcattgactgcaaagcctgaagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatctagctctccattaagaaaagctgtcttaacgtccatttgatgaacgagaagaccatgtgtggctgctagggaaagtagcacatgaactgtggtcaatctagcaacaggtgagtaagtgtcaatgaaatcttcgccttctttctgattatagcccttagcaacaagccgagccttgtacttttcaatagtaccgtcaggcctaagcttcttcttgaacacccacttgcaccccacaggtttacacccatagggtcgatttgtcacctcccaagtcccgttagcgataatggaatccatttcactacggacagtctccttccagtagtctgcatcaggagatgcatatgcttctgaaattgacttaggagtgtcatccacgaggtacacagtgaaatcatcaccaaaggacttagccgtcctttgtctcttactccttcgaggagcttcactgacatcctcctcaatgacatgtttatgtgtatgttcagtttgttctggttgtgtgattgaacggggaattacttcagagggttggctcgaactactatgtgtatccttcattgggaaaaagctctcaaagaaggtagcatcacgagactccataattgtaccaacatgcatgtcaggtacctcagatttaactattaaaaatctataggtaatgctgtaatgagcatatcccagaaagacacagtccacagtcttaggtcccaatttgcgcttcttcgttattggtatattgactttcgccaagcaccctcatgtgcttggtgaaagtgatggttttctcccaatccatatctcatatggtgttttgtccttatttctgttaggaactctatttaacaaatgattcgaggtcaacaatgcctcccccaccatgccttaggtagtcccgtggtgtccaacatgtcattcaccaagtcagtcagtgtgcggttattcctttcagcaatcccattagactcgggagaatagggaggcgtcctcttatgtatgatgtcatgttcctcacagaataagtcaaactcgtttgagaaaaactctccaccacgatcaaacctaagcctttttatctttttgtcaagttgattttcaacttctgccttataaattttcaaatagtctagagcctcgtctttcgttttcaacaagtacacatagcaaaatatagtagcatcatcaatcaacgtcatgaaatatcattttccacacttcgtcaacaccccattcatttcacaaagatctgaatgtaggagttctagtggtgccaagtttctctcctcgacagccttgtgaggcttgcgaggttgcttcgattgcacacaactatggcacttagaacctttgacagtgaagaacttaggaattaaacacatgctggaaagccgagacatcaagtcaaaattaatatgacataaacatgagtgccaaacattagcctcatcatccacactgccacaaatatggttcacagacttattgcagaaatcagaaagggaaaagcggaacagtcctccgcactcataacctttaccaataaaatatccatgtttagacacgactactttattacactcaaaaaccaacttaaattcgtctctagtctgacgggagccactaacaagattcctatcgatagaagggacatgctgcacgttcttcagctgcacgatctttcccgaagtaaacttcagatctaccgtgccaacaccatgaaaagaagcatgtgacccattccccattaggacgatggaaccccgtgcgacctgataagaagaaaacaataagatgtcagcacaaacatgtacattggccctagtatcaacccaccaattagtagactgattaactaaaaaaacagtaggtaaattactatacccgcctccatctccagtgttgccaatggtcacattagcagacttagaagtctgccctgcaggtgccttcatccccttgcgttgtggacacttcctagccagatgaccaggttggccacacataaagcaagtcctctcatcctgattaggattgttgttgttcttcttcttcttcttaaagttggtggtctgttgagctttgtatttccccttgctcttgttctgagccttatgcacaacattggcactggactgcccactatcacccttagacgcagcatctttttcccgagctttcccctcaacattaagagacgctatcaacccctcaacggagtattcctatctcttgtgtttgagtgcagtaccgaaacttctccaagatggaggtagtttcgcaataatgcacccagccacaaatttatcgggtaagacacacttaaggagttcgagttccttagccatggtttgtatctcatgagcctgttcgactatagaacggttgtcagtcatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgatcagcaataagaattccttcaggtttgccagtactcacccagaagcatttcatagctgtcagccacagagtgaccctgatttgccatctcttaaagtgcacaccggagaatttatctggcctcagtgcatcggcaaaaccagccatagtaaaatcacagcgcctataataaggtttttggattgttgaaattataagcacataatgatttaatttattccataaataaatcatgacattgcagatgtaaactagattgaacgcatcattagatctacacatgtaaactaagcagtaaaacatgaacagatcaaatatgcacaatatgtcgaacacgtaccgaggtggcggaaagaccggttgctcggcaggaactactcacggttgcgggcgtcgatgaaggtgcgcagcacacgagcggagaggaaggcgagccgtcgcggacgaacagggagcagtcgcgtgaagcgtttcccaaaaaccttattaccgccttctcccggtgcaggacgtcgaaggcagaggttccggagacctactctcccgatcgccggtgcacgccggcgagcgggatggagtagtctatgagcgacggcgcagtacagagtaagaggcaaaccctagattgatttcgcgtgtgttgcgtgaaggcggatcagggcgcccgcgtaaccgaaccggataagtcacgcgtaacttatccggactccacgccgttttcacgcaccggatttttcggaatccgaatttcccgcagcaaaacaaaactgcaaaaggaggctgcatctgcgcaagggtgaggatgccaattttgtggacaattcaacacgtatgtcgtgcacgcgcgccgcctgccaggccagcgagcgcgtgtgtatttcccttcttctctccaccacacatgcttcaagtggctaggagggtatcctcccttttaaggagatccccctctcctagaataagcaaggtggtactaaactccacatgcatgccatccgatgaggtgggcttttgtgatttttcaaagaattaatcttcgaatgggccttagcccatctattaattccaacacaataatgtactccctccttcccataattaagggattttagagggatgtcatatttcctaatctatgaatatagagataagcctatccagaatcatagtactggaaagtgttgcatccctccaaaatctaatatatttaataattaatattgcatgtttaacatattcacccatttagctattcaacatagaggaagatgagccgtgatggacgaatgtcgcaccgtgctttttcaaaaaccttattcacattctctaggttgtaggatcacaattacaacggattctagggacctattttcccaactaccagtgcaagccagcaagcgagaattccagcagcttgattaattatcaagtcaacacagcacatcacctatcgtgcgcgctctaataaaatgcaccattagcagatttatgttttttggtttcccacaagctagtttaattgggatatatcatagcaa

SEQ ID NO: 64113 - DNA, 942 bp, Oryza sativa
ttttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaaaatttgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggagggcgatttttaaaaatcgccatcccagagggcggtaggcgaccacttctgtcaattttcaaaatgaaaaattatttttgtaaaacttttaataaaaaaaaataaaaataaaaaaaattctctggcgacgaggcatttacgtgcacgggcccgatgccccgatgaaggcggtggcagggcgagattccccggcgtctcgctcgcatttacctcccctgcgtgcaaccgcaaccgcacgggcatctctcatcaatgcacgggcatggcatgcacgaaccatattccagtcccggcttgggcctgccccaaccaacaccccgccttgtctcttttgtctcgccgtttgggcctcattcaacgccaacaccacgccaccaacacacaacactctcctctcgcccattcaatgcaactcggactcgccctctcctctcgtcctgtatgtactcctcattcatatacgtgctagtactactactagtactacactacagtcatg

SEQ ID NO: 64114 - DNA, 657 bp, Oryza sativa
ccccgccggcacttccgctccagatactcctcgcgcgccgcgccacgcccttcactcagcaagcccgccttgcgccggagctcgggtacgtgaccgactgctgggagataagagatcgcccgagcccgggattaaggcagaaaataggggagaggaggaaggagtctctgctactttggcggcgtttttttttctctattgctcatgaaagccggcgtgatctagggttttgggcattggactcggtgagtcgttccaggtgtggttgcaagatgttgtagtcagacccagagttttggccgtggcaccatgtcaaagagtgggggattgtgcgcaagcctgacgccaatcctcttgaaaggagcaaggggacatggctgttccgctgatttcgtaccttcgtgagttttccggttcccctccatcatcgttatgtgcttttgttatcttaggtcctgttcagtttaatattattttcaaccattttttcgtaaagttaccaaaattttggctatgtttagtttgttgccaaattttaataaatacatatgaaatcttgctaaaatttttgacaaccttaccaaaatttggcaatgtcaaaacttggtaagattgaaaatgatagcaaagtaaacaagcccttatttcccttggatg

SEQ ID NO: 64115 - DNA, 826 bp, Oryza sativa
gcacttgtgcgtgggaatcatctcgcgcggccggggagaagaccgcatctgaatcctcacagcgacgtcgtggtcagtcagccgagccgttgtctggcggtggtagtggactcgtgcaaggtccaactgatcgatcatcgcgtgacttgactagacttcacttttgagagggagacttgcctggcaatggtagctattgacttagacttcatatttcgtcaactgagatgcaaaagcgctctgtagaattgaattgcagatggagcagttaagcaggtccatctctgtctctgatttggagccctgctttgtataagtttaagggtttattccacgtaaattgttcaatagatctaatagctagttttaatgttagatttgttgattctttggtcttctcattctctttggtgatcggtggctatcgcatttgtaaggtctttgatgtcgggttgcccattattcaattggcagcatcggctttatcgttcagatcaccggtgtgtttgatgacgttgtttgaggatttataagatggtgatcgatttcgtttgtatacttctatatttttgtttgtacaggagttgatcaaaactgtggctacgctcatcagctcgtatctcttatgttattctagcaagcagactatctttatttcgttttggtagttgttcttatttgactattacgtgtaaaaacactaataatctctatacaaatgtaatgtacattgtttcaatgagaaaaaaaaaagatccaaagtagtaccaaagcgcaatgctaagctggttaggtagcaggttacaagttagctataaacacgtgg

SEQ ID NO: 64116 - DNA, 518 bp, Oryza sativa
aagtcgggagttacctcgtcggcgccagctcgggccatgcggttgtagcgggacacggcgcccgcggggctgtgacgcgcgacgtcggcgagggcgcggttcaagccgtagatcgaggcgcccctgccacgccggagcaattcgtcgaacacgtggcgtgcgtcctcggcgccactgccccccgcgcggcctcctcgcccttggatcgagccgtccgagcgaagggcgccaacagcgcgggaagcggcgcggcgcgccatgcccgccctagctgacaggtgcagcagcagcgccggcggaaaccaacgccgcaacgcagtttgtcttatacggagaggtgggcggcaccagtggaggatagaggggaggggaaggaggagatggcagggatggtgtaggagatcggcgacgggcagggcgtggagagaatgagagatcggccggcgacgtcggggcagggagatcgcgatcgatcttttctgcgcggcgctcttggggaaaaaaaagccagaaaaaaa

SEQ ID NO: 64117 - DNA, 670 bp, Oryza sativa
tgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttggtctcgctttggttggcaggttacggccaagttcggtaagagtgagagttttacagtcaagtaaggcgtggcaagccaacgttaagctggtgagtcgttttaagtgtaattcggggcagaattggtaaagagagtcgtgtaaaatatcgagttcgcacattttgctgtctgattattgatttttggcgaaaccatttgatcatatgacaagatgtgtatctaccttaacttaatgattttgataaaaatcattaggggattcatcagagctgcgcatttttctactgcgcgccgtgaaataatatgatatggttggatttaatttttattaaattaatcatgaataataatgctctttgaatattttttaaaattttcggagcttaatttctaattttgataatataaacaccttttcaacatttatttaaaaaaaaattcccaaatttctctatgggccatttccagtccatttactatctcag

SEQ ID NO: 64118 - DNA, 568 bp, Oryza sativa
tagtgtgataagtgcaaaaccaactggtcagtcaattgctagatgtggtgtaataaattcagattcaattgatatttgctctcccgttcaaatgaccaatgaagaagatactggtgacacttgtaaccatgcaccaaatgtagaagactcagctgctcttgtggactggagtaagttggcaatcattttggatggcttagatggtgatgctcatgcattgttggatgaggatgaactatttgatgctatgggtttcaaaaaaacagatgagagagcagcagcaacagcaatacaagaagaagctgcactccctgttattccaattgagattcaacaagatatgatagatgcagccattgtagttagtgatgaggtacctgctgacccagaacttgtttgggatagggatgatccaccaatggaagtagggacaaagtatccatcaatgaatgagttcagaatggcagtgaaacagcatgcaattgttagtgagtttgagcttgagactgaaaaatctgatccagatagatttcgaggaaagtgttctgcaaatggttgcccatggaaa

SEQ ID NO: 64119 - DNA, 964 bp, Oryza sativa
ttaacagggccttagtttagcctacgtaccatgcgcacgctcgtgttgaagtcacatgattggtactgacaccgtgacacggtgacaccgagtaatcgtggcaaaatcatgaaactcggcgacgcgtaatgttgcttgcaatcattggtttcacggggacctccattgggagtttctggagatgcgtagatggataagcttaaggtctcggtcacaaactcacaatcacagcccacttcattcccatccttgtcggtccatttgatgatccaaataatctcggcctgatttaacgattagcatttacatctaacgggccaatctagtgaaattctgtaatgtgcaaggcccaatcacatatattttctcgtggcctagcacctccgtaaatagtggagtaatgtccttgttatgtcaaagccatagcggcatagcgcgcgccctgtacttttgaagcagggcgagaatacttaagctaggagtctcttttccttctgcccctctccccgaaacgacttgcatatgttaagcaagctagcgttccttctgagccaggatcataacttgttaggactggttcattctgtagagaccatcagcaattatgtacttcagcgcagtgcctaaggcctagtacaagctttcttttatgaatcttagtagcatcaagtattggtttgggcttgtttaaaattttcattatgtggttctggactcactgtgtgagtttgctattttgtgaactatgtaataattggttgtagctcgtttgagtaaaggccgggatatttgattctattatctaaaaaaaatcaaaaaaagaaattctaccgcagttagcctattgggtgtgtttggataatggaaaataggaggtgggattgagattgagaaatgaatatagggttaggattaaatggaagaggaataatgaatgggtaagatttaaagatatcttttgggt

SEQ ID NO: 64120 - DNA, 600 bp, Oryza sativa
tacaactacaaacaagggagtagtagtcgtagtagtgatcgtcaagtcgtcaaggagttaggcatgcatgcgtgattcttcatcgtctcctgagtcccgatcagccagatctgcagctagcgtcatggagtacagtagtagtacattcaaattgccatggtcccggaggttaaccccgttccagtacctgtcccaggttggccacctaatcgagtgctcttgtagaggtgtggctgtgcatgacagttttgatcgatcatctccctgggcaggggcaggggcagggcatgctcagcctgactgcatctcaatcgctgctcgtctcaatagtcaatcgtaatcgcaatattgccaagatgtttctgaaaccgagcctgtttatcctgacctgtgtgatgcagcatggggcggctagctgatggcacatgtaagtttgtgtctccgtgaatgaatgctgtaagctatagctagctgtaatcgtccggatctcgccaagcagatcaatcaaggcccgaaatcatccttacccgtccctcctcggccggtctttcagctcaaaaacccaccgaattaaacgcgaggaatcctcacaccagcacg

SEQ ID NO: 64121 - DNA, 6343 bp, Oryza sativa
ccgctgctgcggccgccgccttcctcccgccgtagcctcccgcgacgccgccggccacccgagctcgccccgcctccgcctcctccaccggcgcggatctcgccccccagctgctgttgcggccgccgccttcctcccgccgcagcgccgcgccccgccacagcctcccgcgacgccactggtcacccgagctcgcctccgccaccaccgcccgcctccctagcggccaaccgagtgggcagactccgcctaagatgacgccgatgcctaagagcggccggccgagcaagacagagaaagcaaagggattggggaggggagagggatgacatgtgggtctaggtgtttttttaattttatttgctgactggattgccacgttggcgccacgtgtgcaaattcaagtcgaaaacagctaaaaacagtgctgagggtttgtatagttgaaggtgaaagatgtccggttttatggttcaggaggtaatttggtcgaccacgatagttcaaaggtgtaattcgtactttttcctatatataaatatgtaaacattgtccacggttgggacacattcaatacagaacacatattaagcacactagttggattttgttccaacaattatttaaattttttttaataaaacgaacggtcaaacatattttaaaaaacgatctcaaatatttagggtcggagggagtaatataaaatggaaggaataataaacacgataaatcgaccaggtcgaaggagggaggcggtgtgaggtgcaccacagaagaggcggagggctttcggctcgacggcggccgggttccaaacttccaatcctagacagataggcaacgcaaacgtgccagccgccgtggaaggcaagacgatcggcggcggcattttgcatgcagcagccgcccgtgccggccggccggtggcacgcatcccaatgtcgtgaccgatcgaggaccagtagtggcgcgacctccacccctccctccagcagcctcgtctcgtcgcgggtcctactgcatcgagccatcgagggccaccgtcttctccgccgccggcggatggatggccctctcgctcctcgcgctacctctggcgccgccccactgcctgtgcttcaccgtccttcgcgtcgcgcggcgccccacgttctgccgcgcggagcgaattaatggaggcgaccacgacgaggagctcgacggggtgccaaatctgagccgaccaccgccggatcggatggacggccaaatctgcgtccttctgccgcgcgcagcagccgcgatggccggcgacgacgatgaggacctcgacttcgaggcgcgccacgccgcggccgggttgtcgatccgtgtcttcaggggcggcgaataccgcggccacggcccgttcccgtggcgcggaggctgatgccgccgcagccgccggcaacaggtgggcgcacgtcgacagcgacctgatccacttcagcaacgcgcgtacgccgccgccgtacgtcgtgctccatggtggcagcttccatagtcgttagtatagtaattaattgtctggtggaatcatacgcatattgattgccagtacgttggaatgtcctaatatcggagaaaatggatatttggatcttcaaaactaggtttcgctattacatcatcatcaaattttcaaatggaatgtgctgacatgtgcttttgatctaaaacaggtcaaggaccttcaccatgcttcgaggaaatgagcaaaaaatggggatagctgttgttctatggtcaatttacaaatataggaataatgcatgttttaagcatgtcatccctgatgtggagattatgggtaccccatacccacacggcatggttatctgactggttataggggacaactaatatctatgaaatatgtaacggatcatgacttggggcgtctacgtcttcaccgaccggcttgcctccgccgccgccgactggtgtctctgcctgcatggctagtctattatgccgccgtcgtggggcgtctacgtcttcaccgaccggcttgccttcgtcgccgccgactggtgtctccgcctacacggctggcctattataccgccgttgttgggtgtctacgtcttcaccaccggcttgccttcgccgccgccgactggtgtttccgcctgcacggctggcctattatgccgccgttatcgggcttctacgtcttcaccgaccggccgcctcgtatgacgccaattggagctatcctcttcacggttgcccacgtcgtcgtcatcattctacttctttcgtcgccgactggttatgccgccgtcgactggtgtttttaccttcacaactacgcgtcttcgctaccggtttgcttctgttaccgccgattcgagttcacttcatcactgctatgcaactttgtcatcatggtggagcaacttcaacttcattgtcttctgcaccggcaatctctattgctgctacttcgcaagttttgctacttcaccgaccacgacgtctacatgagcctcaacatattgacgtgtcacgaaatttgacgtcgtcctaatctactactacaagtggttctacaattttcaagacttcaactcggacatcttcaacatgtatcctcactcaagcaatgagtactcgacgacaagctacagtttttgactctatattcagttgcttcccaactaaccaaagagtcgggggctatataaatacaagactcaaaatccgacaagttttatgtcaagataaagcaatcaattaatcaaggagtcaactctgggagtcattatcttcgtcttcacttccgagcaagctttctacttcatcaactccaattatttcaccggcaattttggcttctctgtcgtcgccacgatctacttcaaatttctctagtatcaagtttgagatttaatctacatattcgggaggatggagttatcaaccaatttcaacgagttggacaacaatttctacttttcttcaagtgaagcatctacaacagctacaactccaagttctattgccatctttataaatcaaggggtgttgcatcaatctttgttatgtacacgctcgcatcaaggaaactactcgagtttcaatatcttctcaacaatttgatggattattgtcactgacatcatcaccaacacctctgcttcatcggccctgacgtctccgctgttgctaatggatgattatgtcttcgccgacttattatttcaccttcacagttgacctactacgcaaacgctgatgagcatctttgtcattatcatcggctgctacaccgctattgactggatcaccgacatcgtcatcttcatcaacatcctgtcaagcctcttcaacatagcccactctactaatattgatgggcaacttcgtcatcatatttgatcatctctattgttgccaatcgtcattaccatcggttgcatttgttgtcgtcgactatttcctgcattttcatgattggaggatttcgtcatcgtcgttgatgcgcgtctacatcttcatcgttggcttgttttcatcgccaccgactggtattctcgccttcacggatggcttattatgttgccactagtgggcatcttcatcttcttcaccagctgcctcgtatgtcaccgactgattatttcgctgccatggttacacaactttattgttgggtgccttcatcttcattgttggctgacctgactgctgccgactggtttcttcacctctacggctgtgcaacttcatcacttttgattggtatcactatcttcactaccaccaatatttttgccacctctgttgggtaatattatctttatattggtcgtcttgtctctatgccaactacgtcagctaccatcaatggacaattgtgactacgatagaaggacaagctatatgctcaggggcttactacctcaaacacaagtatcataccttcaatttggacttgttccggatacatgcaacatgaattcatgatcatgggtctattttctgtgctcaaggactagactatttattattccccgtaaaggttatcaactgaatacttgcaccagtcgggattcaattgttatatctattttggagtatcccataagggataatcactcagatcagaagctattcatatgagctacacttggtctatatcacccggaagatttattactcgggagcatgttatatgcgtcatcctttaaagggtgtcgaaggcatattttttggcctaggcctaatatgtctgcagcccacattttcaggtgtggtctgtcacgttcttttagggacttaggcactttttgcttaggccaaagtgcacgtgatcaagtgcccaataccttaaaatccttttataccgcagttacttaactttttaggagttggtacaatgcatcttaaaagctgtcaaacagtaaagctttatatagctgccccgctgacttttttatatagtcaaggcgctgtttgggtttatcaagcaattgattggatacaatatcgttgctttttgcgatgtaagtgtgcatttttattgaccaatattatggcttaggctgattatatattgtggtcattttccaggcagctggtaaatcctttatgagtttatttacttggattttacaccacatatgctgtatatttctaggtgtggtgaaaccatgtgtcttttagggacttaagcacatctgttaaagcagtgtgcgcatgacttatgcccaatactttggaaatttctttattcacagcattcaagcttttttataactgttttgctatgtgaattttcaatgatgtagtcaactttaggttgctctcatcaaattttacaaagcagtcggtatatcatctggatcatgttatttagggattcacaccgcatatgctatatattgatatcaagtcacttggttgactataattatcaaaaaccactcggttggttggattatttattccttgactatatgcttggtttgttcaactaatcacatggtcggaggctacacctattaggtgcatatactcgatgcacctaaatttacattcaattatttttcagccctccacagtctttggatttggtaaaagtactcgagagaccatggcatagatgattgaagcactcggctctggagtaatctagttcgagagaagattatcttttcgactgtgaaggtctcaggggctactgtggagattatgggtaccccatacccacacggcatggttatccgactggttataggggataactaatatctatgaaatatttaacgaatcatgacttgggtattacgtttccctgtatattatggaacggcctaaagtcctggtttgataatattataaaatagatttaggaaaccgataccatattggttaaggtttctatcttgtaaccctgccccccaacctatataaggcgggcagggagccccctctaggggcatgagcacatatgactcaactagatcgatagatcaatacaacacccggcggattcaaatccccaaacaggagtagggtattacctctcatcgagagagcctgaacctgtctaaattatttgtctccgcatccatccacttttaggtctcgtgcgccacccccttttactattaccgaatttatgtttcgacacctgatgacccaactgacatcatcaactgaatgtcgaattgggcgatcctgcgtcgcgttttgggcttttggctggagaagatgtgcacgaagactttaaggttgaaaaaaagatatgcatctacaggtgggataaaagaagaggcttggatcctgaagtggagtcttttgtatgcagatcatgttgcatctcagtttcattgtttcttcaggaaaactatggaaatctggatgtttttgtatttataatatatatgctcgaataggttgttgttttttctgtctttctggaggcctggtccacgagtgcagaacactttatgcagctctatctcatttctcttaatggaaatggagggtatatccctttgataaaaaaaaatttaaaacgtgattcgacaaaatgtcaatctcgagcacatgctatttgccgctttgccattttcgttttccagtgatttccaaaatgtttttttgcccttacgcgtggtgataagatgaaaatgcccctatctatggtaagatgaaatgtttttttgctctttttatttgacgaaacgaacgcagccggccacggcaacagccggcgcagagcttcttctcagcggcctcgtcactgtcgcggctctccttcacgagccacgccaccttggccttgggcagccgcatcagcctccatcgg

SEQ ID NO: 64122 - DNA, 12777 bp, Oryza sativa
gacgacgccgctcaggtttttgatcaaaccaatccattgacacaaacgattgatgggcgaaaagtgggttgtttggatcttggagataagtgagttgttccggtcctggaggattgacggggagaactgcaagttttcggagccgagatatccattcgagtcactatgggcgtatttgttcaattgacacgtccgaaggaatcatcgttggacttactggatctttagctattcatgtgagaattgatcagctaatactcatccgtccaaaaaaaacccaatcatagctacaaacatggatatatagtgttcagattcgtagctaagtttgtctttttttttaggacagagtagtaatatttcccaagtatagtacagtacactaaataaaacgggagagcagtgtacaaaacatactacctccaatccaaaataagtgcacatttgagtattcgcgtccaacgtttgaccgtccgtcttatttgaaaaatttatgaaaaaatttaaaaatattaatcacacataaagtgctatgcatgttttaccaactaatagcagtaaaaatactattacatcaactgattcatatacactaacgaacaagaagtgcaaggagaaaagatgaataatgatccaaaacagaacagaagcatatggcatggcaaagaagcgaccccaactaattccttcctttgcaaccctcgtcatgactcatgattccaccataacagctatccgtattagtctctacttataaacagtgcacgctccaaattcatccgagaataaacgtcaccttagcatctaattgcagacagaacgatatatcaggttgaaatacataagagtgcatatgttacacattatccaaatgcatgccacattaatacaaagccacataggtttgtaccgtctcatagataaaaggtgcttagacttagtaccacaaaatacataaccatcaaggataacattcagacaggtgaatcacatgattcgaagggctaacagggatatggtaaagctaatattcagacaggtgattcacatgattgcgaagtgctaacagggtgaagaacacagcaccagacgcagaaacagcggacagcgccatgatcctgtaatatctcgcttcatctgcatgtcgtttagccaattcagcaagaaacctgatgtcctcttcaagagtagaggcacggcccttgccagtaggagttgtagtcttgggagatgctgtgccctatgcatggttccacatgaaggaagaaacataatcagattgctaggcattgccaagtgcaaacaaacggatgctgattgaagaaaaatgcccagccaacagatgaagtagctagcataactagtcgctcatttagtcagttgcacataccctcaactggtgcatcttgcacttgcctagcagttacatattccctctatccctaaatatttgacgctgttgacttttttaaacatatttgaccgtacatcatattcaaaaacttttgtgaaatatgtaaaactatatatatacataaaagtatatttaacaatgaatcaaatgataggaaaagaattgataattacttaaattttttaataaaacaaacggtcaaacatatttaaaaaagtcaacggcgttaaatatttagggacggagagagtacaaccagtatgtagatagagagtgacactaattctatttaccataacaaaccggatactcactacttacacgatcctatccatgcactcttaatataatatataaatattttgcttaccaagccagcaatttaagagacaatattatatgcatgcatgcatagacaaggtaagttaacatcaggcaggccatgaagcaattgagtagagaaaagagaaacttcgattgaaactttttccccaaattgtgctctctaatctgggtcgggtggggagagcgcgagatgaatcgaaacagatcctgaggccaggaagcgagcgagcggggctaattgcgcgcagctgacggtggattaaacctatgcgggatcgatcgatcgatctaacgaaaatagggaagctgagaaggggggcgaaggaagagagacaacctcgaggcggtggagggagcgcgatggcggcggcggcggcgcccggcgcagagcagccgggaccggcatgaccttcctcgcaagagtgcgcatcgccatagccgccatgccgccgacgtacggacgaacgggagcaaggtcgggggcggcggcgacagcgagctagggtttttctctctctctctctctctctctctcggtcgcttcgctgggaaggacgaaggcgtcttggttgagagccttgtgtgtttcttcgccttttccttttctctctcttttgttaccgctgccctacccgttactgggaccgactccagatgcgccaataggttcggcccagcccaccagcctgtaatcctgtatttatgctgttatagaaaaactatacatataaattttaatttcatattttaaaactttatacatacaaacttttattatttttttacgatcactctacatgaaagcatataaatctgaaccaacgtacatataaaatgttttgttgtaggtgtaaaatgtttgatgcataaacttgacaaaaggaagacatggttgttgaaataggaaatcttccatgtttctatagttaaattcactgtgtcgctttaggacaagcacattttcggcgtctactttaggctccgccatctttgtagtcttggtagcctagttttccctaattaattgtgcgttgtaaggtttagtcttattttctctttaaaatgtgacaccttcttctttatataaaatgtcggcaacagcctaaacgttcggaaaaaaaagtttgctagatagtccgaattttttatttatagtaattattgatccttaaataaaataaatagtaaatctcagattaaatttgtaaaaataggaaggacgttgttcccaatagcgtccagacttggacacacttctgaggagcgtccaaaggtggacgctgttccggacggcgtccaatctggttcacctcatcctcttgggttcggttgttcttcgacgttctccacaaccatttgcaggcgaaggtgcaccatcgccggctttcctctcctccctgcacggctagggcagaggagccaccaccgctgtccacctcgacgtctgggtggcccgcaccgacttccacctccacctgggaaggtactgagtccacctcggctccagcctccggggaggcggcccatcgctgtcctcctccacccttgagaccgtagccgcttgcctccatgcccaagaaaccaccatcgtcgttcccctccatgctgtcttccatcccttctcaagtacgccacaaggttgctgccaccgccttcagaggagatgcgagcctgttactcaactccgcagtgctcgtcggtggtagactggaagcccaaacgcctccattgcctctcaccgccctttgtgatgtgttctcttcaggtaattctttatttggagcttccattcctcagcagttcatggcctaccaaattaaagcaaaatgattagttcatttacttcagtacttggcaatacttgcatcaagttcagaaaaaaatctctggcttcacgaacaacaatattactgatgctaatgtccatcatgacatacccccaatgttgcattggtgatcgatcttcttgataaatttgaatgcaggttagaaaaaccggctactaattaataatgtcaattatgtgttatggatgccttggccagtcaatgtatcaaaactatccgaaaacaagacattggttcttattttgctttattttgtgtgctcaacgtctgtacttacaggctatactttcaaatattagtgaattccatgcataccactaccagttaattgtcatattctgtttatatgtattcttctgtacagcctgctagacgctaataggagtaaaaagatagagtaattgagtaaatgactgcatcacattgacaaaattgataacgtgtacagtctgtctgttagagaaagggatgaaggcaaagctattatatatgcacttcaatggctaaagacaggggtacagtacgtaaatattccattaaggacgcaaatcatcatttgttgatcctctcctttcggcgtggtgggtgaatggagaggagacttccgcacccagagaccccaaatgtgcgatccattctggccggacgcgttgcgcttgcgaaccaggatatggacgctgttgccaacaacgtcccgatctggacgcacttagttacagcgttcaatcctggacgctacagtcaagagcgtccttcctatataggtaaatcccaccccataattactaaatttttaatttaggtataattaattattacaaataaaaaaatcggctagatagtcttttggggcatgtgagtgctgcagccatttagagttgggacaacaaacatatcaaagtgaagaacactactactccctccgtacgtcccaaaagattcgtctcgtaattttacacgtaatatatgtaattattttttttatatttaatactccatgcatatttttaaatattcgatatgacagcatataaaattttgacggggcacgatctgtcgccatatattctgacggagggagtatggttcaggtctctttgaatttttgttaagactgatggctgatgctatctcggcttcccgtcgcttgtctgcaataatgttcttttgagctgatgggcgatatgggctgctgattgttgctttcatacggtatagtagtattaagggcctgtctatattccaccctaaaattttacatcatgtcatatcgaacgtttgaacgcatgcatgaagtattaaattatagactaaaaataactaattgtataggttgtgactaatttgcgagacaaatcttttaagcctaattgctccataatttaataatgtggtgtgacagtaaacatttgctaataacggattaattatgcttaataaaatcgtctcgcggtttactgtcggattctgtaatttatttttttattagcgtccaaatacccatacaacactttatataatatccgatgtgacacaccaaaactttacacccctgtatacaccccctaacattcaatccttctgcatatttgaaaaaaaaaagaaaataattgtttgaattgatatgatgtttttcaagttctataatctatacagggtcaaacattaatattaaattaatgtgatgtgagaactagttaatgctgtggatgatacgcctctgcttgctcgagcttgctgccttgctgcaccgctgtttgtgcgagcagtagagctacgggactctttcgatccctgccaaaaattttacgccatctcatatcaaacgtttgaaaaactaaataaagtataaaatataggttaaaaataactaattgtatatattacgattaatttatgagacaaatcttttaagtctaattgctccataatttattaatgtggtgctacagtaaacatttactaataacggattaattagacttaataaattcgtctcacagttcactgatgaattctgtaattagtttttttattagtgaccgaacaccccatacaacaccctatataatatatatccgatgtgacataccaaaattttacacctctaaatctaaactggttttccctggattgttagttgtttgaacctaatatatactatgcttcgagattacatcctttagttctaccggcgccctgcctctgcatgcataacagtattgtctcttaaagtatctatggctagcaagtctaagaggatatgtgcaactgactaggtcctatttagattctaatttttttcttcaaactttaaacttttccgtcacatcgaacttttctacacatacaaactttcaacttttccgttacattgttccaatttcttcaaacttctaattttagcgtggaactaaacacaacataaatgaactgactagttatgatgttcctccgctgcttggttttatatgaagcaacagctgtttatactgtttgcacttggcaatgcctagtaaatgtaatgtggtaacataataaattcataatgccatattgtcatagataaattaaaaaccggtttgattctaaaaaaccgccatcggttcactgttcccataaaaaccttccggttcaccggttttttaccggtttgattgcaggaacagtcttttttgctaaactgagccaccaagatgctagttcaggtttttttggtttaaccgtcagtccagtccggttttttttattatggtccaaagtgatacaatatggtaagaataggggatctaaagtgaaaataagggctaaaggtagttcagaaataaaattcggttagacatgggacctagggttcatgcaggagctagtctgctagtgctaacacccaagcacgtgagtcatgtgatagaaattcgccgcttatatataagttacctagaagttagaacgtgattacatttttagttattattataccgtctatagttatatttgaaagcttttcaaacaagaatctgttgaatgttttatagatacacccaattaattgagcagttgaaactaaagcaaaacatcatgcagtgctaagcagaatgggtgtttggagcaaaagatcgatcggtggatgtggctagcaggctagggcttttctttttgtgcaggctgtgactgtggcgctgtcttcccgcgccttttgttttggcaaatggcaatcctctttcccgtgactcctgcctggctcgtgctgaccaaaccaaaccaatcaaggccgtgtttagtttgtgtgccaaaaattttttttatacgtacacatatttaaagtattaaatgtaaactaataacaaaataaattacagattctgtccgtaaattgcgagacaaatctattaagcctaattaattcatcattagcaaatacttactatagcaccatattgtcaaatcatagcgtaattaggttcaaaagattcgtgtcgtaatttacatgcaacctgtgcaattaattttttttccacgtttaatgctctgtgcatatgtccaaattttttatgtgatggaattttcggaagtttgaagggaacacacagtcgtagggtgtgtttaattcacaccaaaattggaagtttggttgaaattgaaataatgggatgaaaaagttaaaagtttacgtgtgtagaagattttaatgtgataaaaaaattaaaagtttgaagaaaaattttagaactacactcccgccgtagtactactccatcaagtttacacgagtagtagactgcactcgtattatcatatcacttcatcaagttgtgtgaaaaggctatcctctcactcatcagtagcatcatcttatcaatcagatcacatcgtggcagccaatgcgtgcaaaaaggatggagcatacgtatagacagtgtagtttcagacttttacttttgtaggagtagtactactagagccaaattttttcccaaaaacatcacatcgaatttttgacacatatatgaataattaaatatagataaaaagaaaaactaattgcaaaggaaaactaattgcacagtttgcatgtaaatcgcgagacgagtcttttaaggctaattaggccataattagccataagtgctacagtaacccgcatgtgctaatgacgaattaattaggctcaaaagattcgtcttgcagtttccaggcgagttaggaaattagtttttttattcgtgtccgaaaacaccttccgatatccggtcaaacgtccgatgtgacacccaaaaattttcatttcctcgactaaacaaacccgagcctctttctttttcttttgcgctacctatacttgtactagggcgaaaaatttaaaatttagctagggtggaatcaaggcattgtttagggggtgtctacatcagggtgaaaattactgaggtgtcacatcggatatatggacataaatttaaaatattagacgtagtctaataataaaataaattacataatccgcatataaactgcgagataaatttattaagcctaattaatccgtcattagcaaatgtttattgtagcaccacattatcaaatcatgttgcaattatgcttaaaatattcatctcgctcatgtaaactatgtaattgatttttttcatccacatttaatattttatgcatgcgtccaaacgttcgatttgaaagggtgaaaatttttgggacgggatttaaacaagaccaaacgttcgcgaaaagaaacaatagttttggagacatattatattatgggattatgggatagagggagtactaattatttaatttgatgattataatacttattatgagtagaaataaaaaaaatcgggcggatgagcggatggatgtgctgggccgaacgtggtcgcgcgtgggccgagactccctatacctccccgcaacggtcaacctatccgatgtcggtctcggattgtataagtgtaaaggaggccgagtcggtcccagcaacgggtgggaccagagtgtatggaccgggtttatttagggcagcggcaaaattaaagatatgcgatacgttttagagagagagagagggaagggggaaaggcaaggggaggcggagaaaaacacaaggctctcaaggagagagagaaaaccctagctagctaggcgccgtcgcaaccttgctcccgtccgtccgtacgtcggaacgcagctatggcggctgtggcgctgcgctctctcgcaaggaaggccatgcccgccccggccaccctccgccgggcgccgccgccatcgcgctccctccaccgccacagcctcgaggttcttctctctttccttctcagcttccctattttcgtcagatcctgcgtaggttcaatccaccgtcctcgcgcaatcaggccagctcactcccgggctcaggatctgtttcttgttttcgtgattcattcacctcgccctcaacccgaccgcgattagagccccgatttggggggggggaatattttttttcccatcgaagtttcttcttttccgtattcattcgcttcatggcctgcctgatgtgaactttgtgaaacacaagcaaaactgcccccccccccaccctcccaggaattattagttgtttgaacctagtaaaaatttatgcttcgatattgataatccttggattctactggcatttcaaaactcaaaccctgtctctgcatgcatactattgtctcttagagtaattattagcttgccaagccatatacagtatgctgttagactatatggataggatcgtgtagtatccgttttggttttttatacatggtagataaaattagtttccctctctatctacattctttcatatatactagtagtatataatatggctacgcaagtgcgatacataacagttcgatatgtgcaactgactaaacgaacaactaattatgtcttccttccccttccctttttcctttgtatcctgcaataggtttagtcaccatcatcgcgcaatttggccagctcgcttcccggggttgggttaggatctgtttcttgttttcgcaagtcacctagtactccccccaaaccaaattagagaccaataggggaaaagtttcgttttttttctatcaaatttcttcttttctgtactcatttgcttcattcatgacctggctgatgttaacttggtgcaaactggttttcccgcgaattattagttgtttcaacctaaaatttatgcaactggtatttcaaaccctgcctctgcatgcatactgttgcctcttacagtttctagcttgctaagccatatatatcatgtagtaacaactactatctctgttccatattataagtcgctttgacttattttctactcaaacttttaactttgatcgagtttatagaaaaatatatcagtattttcaacgcaaaacaaacatactatcaaaatatattaaatgttagttttaataaagctaatttgatattatagatgttagcaaatttgatattaaatgttagtttgactaaggaaaaaaatcaaagcgacttgtaacatgaaacagagagggagcagtaacaatggctaggcaagtgcaagatgttacagttcaaagggtacatgcaactggctaaatgatcaactagttatgatgttaattgttagcccttcctctgctgactggtttatcctgaagcaacagctgtttggtagtctgcacttggcaattcctagcaatataattctgtatcttcattcatgtggaattgtaggataagctgcgtggcacgacatctcccaagactacagctcctactgatcaaggtcgagtcagttattttgaagaaaatcctgagctttttgctgaattggtgaaacgagatgcagctcggaggatgttcaccaggttggtgctggcgggtgctgcttcagcgtacgctggtgcccttttcgttgtgtcgtctatgcgcgatagcgtgaaggaagagcttcgcaaaaacatctacgactaggagctctatcgccagctggtggctacatatttctgtctctgtgttatctatgactctgccctgcttatcatggcttgtttaatgtaacatggcatttcctactaatcatcgatgtgtaacgtaccatcgtactatagttgcactctataatagtttgtgatggttggttggtagtaacgccgttacttcatggtatttttggatagactggtgaatagccaatacggtttctatagttttgctctgtgatcagtttagtccctaatatttttaacaagtctgcaagatttaccacttggcctaaatctactgaaaatggcatgcggatgtgacatgtcatcctcgcatgcaaagtcggcaattaaaatttcattataccattatatgtgccacagtaaaaagaaagaaagatcggaaaattgaaaaaaaatgaaataaaggccatgcagaaaaaaaaaacacccaacagttcgactatgtaaaacaaacatccgtgcaaaaagtactcccttaatattataagttgtacaagtcgtttgactgtaaaacaaacatattataaaaaaaacattaaatattagtcttaatgtaattaatttggtatcatagatgttgctaaatttttctataaatttgatcaaacttaaataagtttgactaggaaaagagtcatatttttaagttggtttgtccttccactaaaaaatagttagcttgtcttatttttgttccatctctattttcttaccatggtttatataatggtagaaaggctaacttgcatgtaagaataacgtgacatgcccgtataacatttttttgttgggtttaatgattatgctaagccaaataataaacctttagtacttatttggataatttgatacatcaaagattaaattgaccttggagcggagtttcatacaccatatttgctattcacttgatgattatggatcactattatggtatcatgagtcatgacaaaaatatggtggtgtttattaattttgtaaagtcgggataaatgcgccttgggagagcttttggtaactgtagtttctcgcaaattaatagcactccaaaccatcaactttttgtccagaaattatggaagcttctggagattctcatgagctccttatcagaacctaaaactctccaaaacaagcctttagacttatcttacaaagcaagatgtatttgcaaaattatcacaaaaaattctagaaaaaaaatcatacatgtacttccaatagtattacatctacgtgcaaagtcgcatcttcaaattctttctacatagagagtaacaaaaaagataaaattatgacaacattataactttaaaactgtcagattttttttgttacagctaaaatgtaatgaatttgatgttaacattttacccttagatgtaacactattgaaagtacatgtatgattttttttatagatttttggtgacatttgttagttggtgtgcataatatatgttgcatatatatatatatatatatatatatatatattaaatattttgataaataaacttatgtagcttaggacaatggatttgtttaattaattcaataggaaaagttttttgagaaaacatatttgtagagatgtagaataaataattcactacaataatcctatgaagtatagctgaaaaacaggatttggtcgtcaaagttagctatgcccactaaatttgtgtgcacttccattttcgattgggataattctattttactcctcttgtactctccactttatctaaaactcaccccaaaccctaacaagtaacacctcaggattttcataatcccaaacattcagcaacgtttaaccgacagtcgttggcctaatctgaggtggttctagaggcctagtcagccaataaaaaaagttgtagtaaatttcataaaaccacaggttttgggacatttataaaacaaaccctagcttttgcaacttgtttcaaagaatcatgggctttatggcaaatgtttcataaaaacccacattcatccctatatcttttgtttggctattatacttacgcaaaatacatgtataaaaaataatatgtcataattttctaagtagatacacaggttagctacttccataataaacatgttagct

SEQ ID NO: 64123 - DNA, 5753 bp, Oryza sativa
catactatcaaggggggtaatgacctagcaaagagatgattaaattgccacattaggtcattgcattttcatttatgctcacattttcatcacacacacatattcacattgtatctcactgggttcggcctgaccaggggcggtcagaccggccacatagtggcagtctgaccggcgagccctggccggtctaaccggccgcaagaaggcggtctgactggcgcataaggccagtctgaccggtggcacacgcgcggtcagaccggccccctggagaccgggatggtgctgctcggggtggccgatacagagccgacggagccatattcagtcagactgagccgatggcggtctgaccgagccgaagccggtctgaccggccactcaacctcggtctgaccggccaggccgatggggccctctgacagggctacaatggctagttttccagccgttgcagagtagcacggtctgaccggccacatacctccggtcagaccggcagagcacaaagttgggggatttcacccccaacggctagttttggttggtgggagtataaatactccccctccagcagcaagggggctcccttggcacccaatttaattgcatacaccccttgcatctctctcacacccacttgagctttgtgttcatccatctagtgtgttagagggttgattagccaagagacaagtgcattgcttccatttgtagagctagtgtggcacttgattgatcatctccacgccgggtcattgcttgttactcttggaggttgccgcctcctagacggcttgtggaggagttgcccggtgacctctccgagaagattgtggaggaggcccagcgccggtttgtgagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaactggcgagtttccaaacctcagtgaaaaatctcttgtctcattgtctcgtttgattgtcatatttacatttatgcaatttatatttctagagacatacttgagatcatatcaccctaggattgctaaacattgacataggagtgtgatttgcattcctagagatataattgagccactatcaccctaggtttgcaaaacataacttagttgcttagttagagttcaccatcaccaagcctagcaacttaggttagttttgattaggtgttattcatcccccctctagtcgacatctcgatcctacacggatagcaggtgctatatcagacgctaagttccaataacatcatttaattgtcacacgtatttaggtatatatatacttatgtatcatgaataatgaatttataaagcattaacaaagaaatcataaacaaattagtgatagatcgatacacctataacctatgaggataagtagaggtttagtagcacttggagaattcatatctcgtgccaacttaaactaaattaagaaacaaacatgatattctacttattagacgttatgactcacaagaaaatgttttggaagacaaaacaactaacaaactcatcatttgttatgtgttggtggttatataaaataggctcacgctatagcggccgctaaattaaattacagacgctataacggcccattaagttccaacatgctatgtacaatccactacgtcgtcgtagcggtagcggtaggggctcgctactgctatagtgcccactatgaacgctatagggtgtgtttggttgcctcgcacctgtgtgtgcaactttctcttgtttagttgtctggtgaccttttcagcctagcccaacacaggcgggactagttttactgtatctttagctatttttgtaaacgttgatttgatagtccgtctgaaaaaataaaatcatgatgttgaaaaaaaatcgtttttctagtggtggctacctcgttttctgttagcatgttttgcaaactactaagttataagttatgtgtggaaaccttcttataaaaaatttgctttaaaatatcagatactacttttaagtttataatagttaaaatttaattaatcatatgtcagtggtttgcctaagaggagctaccgagccaccccagtaggacacaggcgtacgctcttgcgtaagagtagctagtaatacgcaagttacgtaaccatctgcgtaccgagttatggaagtaaggactgctctaactccctcagctaaacagtttcagttctaactaaaatagaatttaaatggagcgctattataaaataaactaaatatatagaactagattttgactgtttcacaactacacttcaaacctaactcctaaagcttaggtgatgttgagataggagggacttattttagtctctctcacacaaatatagacttatgtttagagagttggagctatcaaatagggcctaagctacgtactgtacgttttttttttagaactacgtacgtgtagtctaatcaaaactctctgcctcgctctgctccatttgaaagatggtgaagtccatgcttagacacagaaccaagcatcttaattttttttctagtcagtggagcttgtatgcatttcgtaagccttatccgatcatttatgacataaatttattagagcgcatgcaaacaacattctcccctcacatccaataattaatatatatacgtacttaattagtaattaaatatcaattatctatattttgggcagattcgctctaggatttgcacactacttaaaaaaaacctattagtgccggttcttaaggcctaataggtgtcggtttttttaaaaaccaacacctataatatattataggtgccaaccggcacctatagtattgctaccggtttttactaatgaatcgacatctatagtgctttaaaggtgccggtttttaattttttcagcgtgcagagataggaaaaggcctataggcgtcggttttaaaagaaccggcacctgtaaggccgatccctatgagtgtttttgtagttagtggcacttccaattatttgatttttgcacaaacaaaataagaatcttaaaaagaagttgaagcttaattgatttggtatagtattttaaaattaaatttcacatgaccgtatgaactatggtctttgttgtataaacggaattttgacatgtgtcacacatataaccttggtagtatatatgatatcagagcttcacataaccgcatggttatcaattgttcttttgattcatcgtaaattctaaaatcaaatatcaaatttattgaatagaaagttttagtcatccaagctgagacctttttttaatctattttactataataccaagatggagtagattggttaaaggcgtagctttgttaaaactatacagaacagttggagttatgtgccacttgctaaaagtgttaaaatcttatttatctttgagggggttggtgtagttttccttctaggggggctaaagatgcccatatacaaatttactgccgtttgttaatggcagctctaattaaattatgttgccaaaaggaaaaacaaatggcatgattgcaccatcggataataaccgttttaccggtttgtgcaggagactgttggtccggttttgagctttaaccaaatcgatgtgatatgacaggtccgccagctagatatccggtctgaccggtttgtgcgatacgtgcatgacaccaagtcactctcctagtgatctactctctccgtcccataaaaacttaacctagaagaggatgtgaccccttttaggacaacgaatctggataaaagggtgtccagcttcattagacacattccctcctaggttgagttattttgggacggagggagtatcataataagaagaagcagagcagagtgatcatgcgttactccctccatccataaaagttacaccaattacttttgtcgataagaccaagcagaaattaaatcaacttggatatttcaaaatcaaagagtgaatgtaagcatgtaaccaatgagtatttagatgactccttaggttctaataaaacatttaatttatctcttcatttaagtattgaatgtataaagattataaataggacaacttatttggaaaaactcaaatgtgaaataggtataacttttgtggatggagggagtacaacggaaaaactatttgatcgggtttataacaccttgtatatgtgtagtattttgtgagtaacggattatgactttggctcgagtggttgactatcgctttcgcatcacacactcttaatttaaaccaaatggcggaaggaaaccatacgttgaaaccacgtcagctttggacagaaatgataaaaaaatcataaataatgacataaaattataataaaccttatcataattcatatcatgaaaagtatctaacggaaattttatgttgattccatttagctaaaacaaacattcaacgagcatgagaaaaagatatgctttaattttcctaacaactgtaaatggctcaaacagtgcaaaccttataccgtaaatggaaaaattatgctaattttcccggtaaaacttctaataatataaagcggagtgagtaaaaattaagaaataaaatcagcatgttcgttatcggtagattcagtatatgtgaggcacgatcgaccaatgcttaattagacaccaactcatcgattgcgcacgtcgtagctagaaacaactttaaaaattctatagcagtagagatatcctcgcaaagaaacaaaagaaaatttccgtcataataaaatttcggtaaaacctacacacacatatgtgtgtgtgtttgtatatatgcacaaatttgtcttcaaacaaagctgtcattttcaatatacccctgataaattttaaattttcagtcttacttaaaatttgtctaaatttgacaacttacacaatgaaatgtttgcaggactttggaaccaaactggctactggaaatactaccccgtgcaagtaaaacacgtgactacagtaagcctagctgctaatctgctactctctccatcctatatataaaaaatcaaactagtaaggattttggttttttttgacggtggaagtagtactagtattctctccatccaaaaaacataagctagatgaagatttgacaccatcaaagataaggaatttagataacctcatattcagattcattgtctaggttattgttgatgaaaatccgtgacaatcctcatattagattcagcttcgatctaacttttctctccgatgctgatattaccaattttggtcgttaacagttatctatttttaagacggaggaattaacgtagctggtgtttgaaactcatatagatgaagatgaagattaagtgttttacacaaaacaaggtagtattaacgtatgattaattgagctttaattattataaacttgaaaaatatgtttatctgatattttagagcaacttccttatataaagtttttacatgaaacacactatttagcagtttaaaaaatgtaccacgaatatcaaatttgtatccaattttcgttagagaaaagagcggggcctaactccatccttctcggctctggaacatccttctggcacacaatgtgacctgatcgatggatactc

SEQ ID NO: 64124 - DNA, 8103 bp, Oryza sativa
atgaagtgaccaaccaaaactatagtttatggacaaactatacagtacgccggtcttgttgatcatgggtgaagatgttcttgtgcacatcttaagttttcgagtgacaaaagattaaaaaaaagtcactactaaacttcaattgtcatcgcatggatttgagatgaatacatagcaattttcttaaaaccaaaaaaacagaattaagaaaataagaaaaacacagtatgttaacatgaatgtaagggtaaaccattgaattatacacgcacgggaaaaaaaatacagaagtaaccgtttcactcgatggcataacgaacacgctaaaaatgattggtataccgtatctcttatgttaaattttgtctaaaaattaacttttgtaggattattaggacaccttcgggacaaaggaaatattatgaagtattattggacggtttgaggggctgtttggatagattactcactttaccaaacttctatgctacaagtgtggtatgccatatagtttttgtggcacaaaaaagagagccacactagcggcaatttttttaacaagtgagtgtatgacatgtgggccatgagagtagaaaagtatggcataccaaaactttggcttcaaccaaacatttacaccaaaaagtcaaacttgcctaactatgaagccatttggaacagatggttggttcctaaagtttcatttgaaaatcctctcttattgtgcccgcaattgctgaatttttttgggagaatagccaataagattcctaaagtttcgcttttgggtcattttagtccttaatcttttatattgtctaaacaagttctttaaatttgtcatgtgggctgatatagtccttagtcccaccaaaatcgccatatggacataccacgtacgtcaccttcctatgtaaaatctatatgatttatctaatttaccctcacatatatcataggaaaataaaaacaaaagaaaaaagtttttaaaaaatatggtatatgtaagagcagaaatatacctcaaaagagtgaaaaaaaaaggagaagtatttttttcctatggttatgtataattcacactaatatttatttttttatgatatatgtaagggtaaattggacaattcatcattgattttgcatgaatgatgacatggcatatccatatgatgattttggtggacccaagaattattctaggccttataacaaagtttaagaatttttttggaccatttaaaaggttagggactaaagtagctattctcccctctctttttttttcatgtgttatgtctacacgactgtttgaagcgtttctaattttcggcaggaattcaaaaagcgtggcatcataatcccgtgctttcaaattcccatgttccaaaagaaagagcgtgtccaatcatttgtttgaaagggccaaaattacactatgaatgaagcattttagtgctccctccgtttcatgttattaggggcacgtttggatccttggcaaaccaaatcctagccttaattagcttagcaaagcgaggtgtttggtagagcgattaaaaacttgctttgccaggcaatgtgggctataaccgcccaaaaaagcttgctcccggcggagagccaaatcggctctcccgagtgggcaagcgatcgtctggttgcaccaaaccctctgtgagtggctctttgtaatcatattaaaaatcatcaattagactgtttattcttctctaggctagagtccggccaatgcatatggatcgttttttcttcgcttgaggacttgcttactagtcaaatcatccattttactatcacatgagcatgcttatttgcccggcagaaccaaacaataagcctggctacttcgagctatagctcagccgggctaacttatcctcacccgactaagcaagatgggagaaagatccaaacgtagtagctgttttgactttggtcagagttaaactcattcaaatttgactaagtttatagataaatatagtaatatttacattaccaaattaattttattacattaataattaaatatatttttataatatatttatcttagataaaaaatattacttttttctataaacttgtcaaatttaaagcactttaactttgaccaaagtcaaaacattttataacctgaaacggagtgagtagtatacctcataggagttgtgggggtgcttcggagtacaattaatgcccagctaattaaaagcttaattctggttagcttagttatgtaacctagtaataaattattggcatgacaaatcgagttgccactactatctactgcaattacttcaatttactccattcgtctcacggtatataaaacataaaactagataagtaatttcctcaaacacgctcctgtcatgtacggtagggttaatttcctgaattgtaagggatttttttaatcgtaatatgatggatcccattgatcaatcctataattttttttcttttctctaccgtattcatttttcctttaccaccaaatatgcaaggtaggaatactctagaaagtgcccagctgtccctccctccctccgtccctccctcaattattaggacaagagacgcggaggcgctcatttcgaatccaaagcctccaggcgagggcggcgaaaccctaggctaggctagtcctctcccggaggccggagaagctacccgccggcggcgcgcccctccaccctcgccgtcgcccatggccctccttctgcgcgtggccaagaaaagccgggcgaccgcggcgatggctctcgtcggcggccgcggggtcgccagctcggccgtggacagcgcggcgggtcgtgcgctggccaccctcgaccacgtccccaaggtcatcaagttcgccgccctccctccggcggccgtcgatcgtcaagacgcaggcgccaagccgggggtggagaaggcgcgccgggacgtgcggcggtggcgcgcgaccaggtgcccggagcgcaacctctagggctcggcctcaagcctggtctggcccagatcctggctccgtcaggcaagctcaagctcggcgccggtggcggtgggttgccctactcgtcgtcggccatctccagcggcggcggcggagaagtgcagccttcccgcgtcgccgccgacaactgcaggtgtggctcgccgcacctatgggacaaggggcgggtggccgtgccaggcgccgccggaggcgttgaaggagatggaggacgccttccgcgcgcagatgaagataacagaggatgcaatcaaagcgcacacagccgagtgtctgtcgagcaagaagctgctcaaggccccccgacctctgtaccaagtcttccttgtctgtgtttttgttctggctgcagtctccattctggtgattggattctttgactacgcgctcacagttggggagatgactgtggtcaacttcctcaatggaaaagagttcaaggctgtcaaaaccgacttcatggatgaagccgaagccacacttctcgatctcgcccaacaggagagggttcgagaggtgaggaaccggtacgtgcaggaggcatggaccgaatcaatgggctgcctgatcagggccctcaccctcaagtcctaccgggactcctggttccgcacaaaggaggaggactccaacaacagcaccacggttgctactccaagcgccaagtagagatccacatatatcacatcattgcctgagtactagctagtgtctagagtattagtatctttacttgtggagtttagtacctgttatcttcattccctagcagtaacaatttccatgattagtactagtaatatgtaatgttgcaagatggatgagactatgcagcaccattggttgtaacccacaccaatgcttcctaggagtatgtaatgatcatcctgctagctctatggcaatctactacagtactctttatggaactcagtcacctactgctgctgctgtgatatatgtggtaactctttatgatgttgatctcctctaattttttactgagatgccatgtgatttcctctcttttactcccaacatatagcaatcttttggagttggacatgcctaggagtgaatattgagatggcctacaaggggaggggaggggggtttgggggtttgtgattttgttgtgtgagaaacaaaactactgtcatgtgattttgctgtatgagaagcaaaaattactgtcatctactgtaatggcatatgatatactgggatattttgataggaatcaataccgaggttttagaagaacttaggattactacacatgtcattgtcttatgtatactgtaaataagtactatctccatctcaaaacataacaactttcagaggcatatctggacctacgtttacttgttagtacattttaacagagggccactacactgcacattacacaagtgtgctgcacactcctcgtggcattcttcctagttggtcttgcattcttatttatactagtatatcacaacagtagcctccacaagtatcctctattgcacattcctatttattcttagttgccagctgcttcaaataaaatagcttgtcctagcatgtattatatatatgtgccatttttgcacctgattcaactgtttctggagttctccagatagtaaaattcacaaacctcagaaattaaaaaaaaacccagaggcatctaaaaaagaaaagctaaatagtacacaattgttaagaatggagcatacttctttttatttagtaaacctaacatacagatctcagaaaagattaagcccacacatatttctgcaaacaaaaaaaaaactaacgaatgcaatgcaacagaaagaaacagcaagtacatggacagcatcaatcctatgattttctgagcccacacgtcagtttatcaacatgtctccaatttatcttggcagtagccatgaagtcctcctaattcattcatatgctactaaaaatcataatagtggaacctgcgtcagttgaatatggtcgtatcgttgtccctgctggttgctaacagcacaagacgctgaacaaaaccaaaaggagatgcagtggatggtattgatagaaaacattgcaaacaaccacatggtgaacactgagttgaatgtgtgttgcaaattgcaactattgacagttcaagttaaccgtatctaagctaaccgaaaccacttaatcagcaacacagttaaaaatccatatatcatgaccaacaactcggttggaaataacaaacttgacaaattaaacagttttcaaaatgaaaatcccaagcaataattctcaagcaagaaagtagcgaaactgatatcacagctccagaggtaatgcaaattaaacagcagcaacttggtcatgactcatgataccataacagtgatccataatatataaacacagaactaattaagctcatccaaaaaccctaagtaatgttgcgtacagatcatccataacaaatcgttacttcatagcatctacttgcaaacagcagatatatagggtaccaatgcatagagtgcaacaacaatacattacaccgataattagtcttacataaagacatgtcacatgcatgccacattaaacacatgccattataggcagagtcacacacaaaaatagaaataaatagcccctagacaggtgggtaaagctgctagtcgtagatgttattgcgaagatcttccttcacactacggcgaagagataacataatgacaagggcaacagcatagcctgaagcagcacctgccaccaacatcctgttgaagctcctccgatctgtatctcgttgaaccaattcagcaaaagtcggatgattgtctttgaaatagctgcccctgccattgccaggaggagctgtagtcttgggagatgtcgtgccacgcagcttatcctacaattccacatgaaggaagaaacagaatcagattgctaggcattgccaagtgcaagctaccaaacagcagaggaggggctagcaattaacatcataactagtcaatcgtgcgtaccttatgaactgtaacatcttgcacttgcttagccatagttactatagttgttactgcatggtatatatggcttagcaagccagcaattaagacataacagtatgcatgcagaggcagggtttgaaatgctggtagaattaaagggtgtaatctcgaagcataaattttaggttgaaacaactaataattgacgggaaaaccagtttgcttgtgttaaacctagttaacatcatccaagcaatgaagcaaatgagtacagaaaagaagaactttttatagaaaaaaaagtgaaacttttcccccattgggctctaatttggtttgggggcaagcactaggtgaatcacgaaaacaagaaaacaaatcctgagcccaggaagcgagatggccaaattgcgcgaggatggtgactaaacatattgcaggatctgacagaaatagggaaggggaaggaagacataataagttgctcatttagtcagttgcacataccctgatgtaactgaagtgttacatcttgcacttgtgtagccaaagatactactccagctgttaaatactactagcatatataaaagaatgtagatagaaagggaaaataattctatgtatcataacaaactacacgatccaatccatacagtctaacaatatactactcatatggcttagcaagcgaacaattaagagacaacagcatatacatgcagaggcagggtatcaaattccggtagaattcaaggattatcaatctcggagcataaattttaggttcagacaagtaataattcgcggagggggaacccagttctgcttgtgtttcacaaaagttaacatcaggcaggccatgaagcaaatgattacggaaaagaagaaacttggaagaaatcgaaaattttcccccaaattggacgctaatcggggtaggggcgaagcgcgaggtgaatcgaatcgcggaaacaagaagcagatcctgagcccggcgagcgaggtggcgtaattgcgcgaggatggtgactagaacctatcgcgggatctgacagaaataaggaagttgagaaggggaaaggaagagaaacaacctcgaggtggtggagggagcgcgatgacggcggcgcccggcggagagcagccgggacgggcatgaccttcctcacgagagagcgcagcgccatagccgccatgccaccgacgtacggacgaacgagagtagggttgcgacggcggctagggtttgcttcctcctctcactcgccgagacgcgtcgcgtttgcttcttgtctcttcctgtgtctgtgtgtctcctctatcttatttctagccgttgccctgtatagaccaggtctatgaaccctggccccacccgtcacgcactcacgctgcggatatagtagactactactactccagaaaattgtttttcttttctgatgttccaacttcaaaacaaacaaaactcgcaattccactcaacaaatttttaacttcgggcttattcactttgctactatttttaaccttaccaaatttcgatattatcaaatttcggtggtaaggttgttaaaattttagcaagattgccaaattgaacaaaatacacacgaagacaccttaaccctactcattcgcattttattctaaacgatactctaatgatgtagtggaattagagtcaaatgtaatgtttgattttgaaaaaacaggtcaaatatgcaaattagaaaaaaaacagagtcagattaatacgtaggtttcgaaacaagatcaaataagtaactaataatattaaatagaggaagtactcctctaacaagaaaaaataatttttatctacttatatatatctggacatatttttatctaggatttgtttttctttagactggaggcgtagataattataacatggagctagtttgtcaatcctgtacaaacccagcctggccgtttgacttttgccccaatgaatccactatacacaggcacatactagtacagccatgggacggatcagccaagcagcagagatgctttgcccttgct

SEQ ID NO: 64125 - DNA, 12129 bp, Oryza sativa
tttcaggtgctacctgcctaagagagtgcgtgtgcgcgtgtgcccgatcgagggatttagggtgcgtttagaaaatttttgaaacatccggtgggtgagctatttttgtgtgcggaccatttaacaggacttgttaagtggcccatatgcgaaaattgattttttttcgtgtggtcattttaaaaagccgcacgcgaaaatggagcacgtttttgcagacgtggccacttacggtccgtctgcaatataaaatgagtcccgtccagaaaaaatcattcctgtagtagtgatctacctctccgtacgtttcctcctccaattgattataaaattgattccctattactccctcatcattttccccttgatttcctcttacaattcggctttacttcacaagatttaatctctatttaacggttgtctttttattcccgtcgcttttccggttttttcatctgctttttccatcactattttttagtcacattttttggcacgcggtaaggattcagttttctttacccaattggtttttttccatcgttgggatttaatcttcagccgtcacccgggccaaaccctagcgccaccgccacattgatctgcctccatgtgtgtttactcttccaattgattacaaaattgatttcccactactccctcatcatttttcccttgatttcctcttgcaattcggttttacttcacccgatttgatctccatttaaaagttatcattcttatcccgagtttagaggattgctatgattttagcatcgtatgggcactttcgagattgaaaactatagttggttgtacgagttaggcctacagctttacttatgggctaagctaaaaagacttaggccaagcggagatagagatagcaaactacgctaggcttaaaaggaaataatgggctttcattccaaaaccaaggaagtaatataatattatatagcgatccaaaaattgttttacctgttacaacgcacgggtattttttctagtaatcaaaatacaaatctattggtgccatactatagcagtaatttaatttgtcagaattttgtgaaagttcgtcaaaatttgagtcaaatttgaaagtggtgtacaaaagtatcgaaaaatatccaagagtatacttatttttttaccccacatttaacaccgttaacaagaattaacggaacggaggcaaatgagtgatctgtttcgaaaaagtagggagaaaaactaaaaccctaaagactaggggcaaaatcaatattagcaagaacgaaattgccgcttttcactcttacgagtgttgataaagaatctgctaaaagaaaatacagatcgtcctaaaagcgacaaaaaaaaaaataaatgaccccaaattaaaacccactcacaccccactcccactctccgcttcggattcggaatttcggagagaagaggctctcgcggtctctccgccttggcctcactcaaaccctagcccgccaagaagccacccgccgccgagccgaccatcacccatggcgcttctccgagcggcagcgcgggcacgcgtgcgccgcttggtcggatctggccccccggccctcgccacctttgccggcgccgacagagcgacgggcgggcggggcggcgcagccggggagcgcgctctccaggcgatgaggctatgctgcgctaccccctccgtcgccagcgtcggccgcgacgtcaaagcgccggtctctccgcccgccggcgcctccgtgacgctggtggtcgagcaggcgacgaggttcgccacggccacgacggcgcttccgcttccgcttgccaagattccagccgccggcagaggcggaggcccaagatccgccgggatcctcgttgccacggtcgccgtgggctcgaaaggggcacactttgcgaccgccagcgctccagagcgtgctctgctcacgctagagcgcgcccagcaggccacgtcgccatgcccgcctctcgcggcaccgaggatcctttgccgcgggctctccctctccaccgtcgcgggcgacaagaaagcgcggcgcttttcgagcaccagcagcgccggtgacgaccagtccaagtcgctggagaagaaggagccactgagccgtcgcgctcgcgccgacgacccggcgccggcggtggaggagccactcgagccgctgaaggagatggagcactcggtcctccgtgctctcaaggccatacaaaaggtcatcttgaggtcgttcagcgaacaggagtaagtaattgggcgtacgttcttttgggttaattgtttgagaggaaacaaattctcctttcttcttttttttccctctttctttttgggttgttatgtttgggggtattaatcaagtgatgataatgattcatgcatacagggctttcatggaggatctgatgaagagggcatccacacaaatacttcgagccggcggcttctacaacgccaataccacagttggcttcatcattgccgtcttgctgtgttttgccatcatcctgggggttttactcttcatgagtgtgctgtttgcagagtggagagccaagcaattcctgcacagtgaagagtgtgacaggctgacggatgggatgatggataaagctgagatgaagacccaggagtttctcaggaacaacaattttcatcagattgtcgagggctacgtgagcgaggggttggaattggcgactggggaggaggtgcgcgcgatccggaagcgcttcttgaaggaagctcttcaagataccggggagtacatcgtccacaagaccacatttggttctcagagggacaagattgccagctggtttcgccgcgacaagcagcaagaggcgccatcaccatcagcaacagcactgaccaaggacagcgagtccactgtgggcgtggtggagaaggtgaggatgagggatcgagtggctgcctggttccgccgcaacaaggagacgaagccagccgagccagcgccgagccagcagcagaagatcgccggcaccgaggggagcggcacgccgccgccgccgcagtgaccgaggtgatcattgctctacgtgatctccagtggtgaagaagaagaagaaaaagaagaagcgctgccgcaagatcgatcttctgtcatgtgatgaaattttgttttcgttcataagagagaaaaactctattagaaccgatgcaccttttgatctttgccatggctgtttgtgccgcaagatcgatcttctgtcatgtgatgaaattttattttcgttcaactgatgcaccttttgatctttgtcatggctgtttgtgacctgcagtgaacatcaaaatgctattggtggagatctaatgatttgactacaaaacaaattcgtggccaaaatattatttgaagaagtgaaagaaagaagtagcaaccgacaacacagcagatgtgacaagttgtcaaattgtgaaatgaattgttagattactatcataatataatgactatacatagtactgaatatccgatttgattttcttgctagagacaccaaatagtttggtagaaatgaatttagccaaaaaattggtaaaagatgaatattcagtttttactaaagcaaaatgcaagatgaaactgaatgcttatagtacatgtcagctgcatgcaatttcctgggcggttgttcatctaatcatcttagactctttcaagcaaattaaccgctctcacttttgactaaaccccgaaaatagataatagcagaaaggaaagaaaaggcataaaaattaatgtgtctacattaagcatttgtaacaaccacattctgaagtttggtgccactaaatgaacaaacctgaaggctgaagcttagactcatcacaagtctacaagcttgataaacatatcaaccattcaaacaacttcaattagaaacaacagggggaaatgaaggaatagggaggaattggatttttatcacctcgagcaccagcttcttactggacatttcgtcaaacatgtggcttgccctacattcccatcttccttggcccttgcatcaagagttggcaagaaaaattcaaaaaaaaaacaaaacaaaatagagagctgcatacggtgcggcaacggtgttggctagcagctgagtagaggcgggaggtgctggtgttggatgcagcagtggcggcgacaaggtcatggacgccgcgacggcctgggcggagcagagtcatggacggagcctgacttgcgctgcgatgcgcggaggtcgaggacggagacgcattgtgggcgtggacgacgatagggacagcatactccctccttcctaacggcctgtttggttggagggagtttttacaagggattgacggcttgtttggttggagggagtttttacaagcgattgggagttcagatggatgaggatattaagtgatttatttggttgggagacatgggaattttggtgggatggggatgaggaattgaggaagaaacttcctccttttcaatacctgggtaggggcaggtaattgggagggaattcctcctttactttgtctaagcaaatctcagccatccgtttctattaatgatctaatctccaactaaactccctatcaattttcatcacctctaccaaacaagatattgggattaaaaatcaaattcccagcttaatctcgtcatcaattccctcgtgtaaactctcaatcctcttccctcgagttaccaaacaagccgtaaatgtttgacgctattgatttttttaaacatgtttgaccgttcgtcttattcaaaaacttttatgaaatgtgtaaaactatatgtatacataaaagtatatttaacaataaatcaaatgataggaaattacttaatttttttttgaataagactaacggtcaaacatttttaaaaaagtcaatgatatcaaacattttgggatggagggagtagatggatgctagtatcgacggctccttcggtgacggggtatcggcggcgagctataatcaacggcgcagtggaaatagggggaaaccgggaggggaattggtgtaggtagaggtggaggcggagacgtggacgacggggtatcggcggcagcggttgtttgatttggaggtcgacggaaggcacggtggccgagctcctgcggacggcggcttctgtccgcctcgtcgcgtgaggaaggagctagactgaggggttggtgaggtaggggagaaatttgcactggcttagaatgccatcgttaaaatgggattagctcgaatgccatcctcaagctgtgagcattcactaccatgccattttcgctatttcttatacacttataaatcattttccatcaattttattttttctcggacctttttacccctggttgcatcttctttcttctcctctcatcctatcttctttcttctctctccttcacttgcaaggaaccgagagaggaggcgacgacggcaccggcacgagtgagggaagcgggcccaacggcacaagcgcgcggaaggagggagccagcgcggaaggaggaggcggaggcggtgacaggtgtgcagaaagagggaggcggcggcgccggccgctggtgccgccaaggggaaaggagccgctgccggcgcacggagcaaggaaggcggcagtcccggcagtggagctcgagcggcgacgaggagtggcggcggatccggtgggagatgggcatgcgagctgccggcgtcctctcaccttcctgccggcgccgccttgccctctctttgcccaggcacaaccttggctctcgccgccgtcacctcgccttctccctccgagaagagagaagatgtagccaggggcaaaaaggtccgaggaaaaattaaatggatggaaaatgatttacatgtgcaagatatagcgaaaatggcattgtagtgaatgcccacagcttgaggatggcattcgagagaatcccattttgaggatggcattctagcgaagccagtttttaaggatggcacatatgtaaatagggagaggatggtgacggttgagggaattcggcggccgccagcgtgatttagggtacaagtggcggcggtggcggcggaggaggaccgaggagagcgaggcgacaactgctgagggggaggcggtaagggagaggattggagtgtcggcgctcggtgtggaggagacgacgcgtgcgcgaaagagagattggagcgtgatccgtaggagtgcaggaggagggcgatctagcctggaggttggtggcgtggtaatgtggcggagttgggggtggcgcggaggagaccaatgaggcggcggttagagtgcggtgtcggaggtggcagagggggaacatgagggcatgagggggagagaaaccagggaatagggcccgtgcgaatgacggggatggatgcgggggcgtgcgacgcgatctgaggcattggattcggcgatcgaacgattcacattccatgggtctgtctgggtgagcattcaaagaccaccactacgtcttttttaagtagtagagatttcttatacgactcctaattttccaaaagcgaaaaaacttaaaaactgactcaagtgcggatatgtatttctaaaagcgaatgaacttaaaaaccaacttatacacgaatgacatacaaaagtatcgacaaaaacatctatagtttttataaagaaaaagtacgaattaccccctgaaccattgggtgagtatgaattacccccctaaacatgaaaaccggacgtttttaccctcaactatcgataccggatgaacccccccgagcagttttgaaagcggttttggtctacgtggcagtccaattagcaatccattatttttaaaatcagcgggccccacatgtcagtctcccgcactctctttttccctcacctctctctctccaaaatccgggccatggagcttgggacggcagcgggaagagcccgagatgacggtgggtggaggggacaggggcgggtggagctcggggtggtggagggggcgctcgtaaccgctggcgctcgggacgatggtgagtggaatcagcggtggaggggacagtggcgggcggagctcagggtcgtggagcaggtgctcgcaaccgccggcgctcggcaaatcggcgggggaagcttggggccgagggggcgtcggacctcaggacggtaggaggagaggacggcggagagcggagagggggtggtggagggggcgtttgcagccgcccgcgctcgggacgatggcggggggagcttggggtcgagggggcggcgggagctcggggtggcgagaggaggggatggcggagggcggcgaagggacgcccacagccgccggcgtgtggctcgtcgaggcaacggaggggatgctcgtagccagcggtgctcagggaggtggaggggcgcggcggagcgagccgaggatggcggtgggtggagctccagctgcggaggaagcgcccgcaaccaccgccgtgtggctcatcgaggcaatggagccgtccgttgccgtcggcgctcaagccgcaaccgccaggatttgagagagagaaggtgggggagagggaaagagatagagtggtaagatatatgacaggtaggccccttcgtttttttaattaaaaaaattgctgactagactgccacgtagaccaaaactacttcgaaagctgctcggggggttttcatccggtatcgatagttgagggtgaaaaacgtccgatttttgtgtttagggggtaattcatactcatccaatagttaggggggtaatttatactttttcttttttataataatagagatagagatagagatagagatttcgttatagtttagtatttttcagcactattatcaacagaacaacaagagataacacagggaggcgtattttttgtgcgtaaaggtggactcgaaactctccaaaatatcgcgccgtttcgatgggagggaggaggatgcggctcccttcattctccttctcgcggaagactcctcttttttttcgaagcttctcgccgaagatttcaaataccgctacttgtccaacccgagacccctaattccccgccgcgaaatccctaaaccctagccgccgccgccgcccccgccccggcatcggcgacgactccgacctccagaaggacctggacgagccgcgccgctcctgcatcctctccgggaacgaccccgacgccgcggtcgcgcaggtctccgccagcctcgccgccggcacatcaggggcggggggcggcgaagaatggctttgtccgatgatgacgaggaggaggaggacgatggctttggcgctcgtccgtagcatccgtgagaatctcctcaacaaggcctcttgccctcctcacccgatctgcgtctggccgccctccgacttggaggaggacgacgacaacgacctcgagacgctccgtgcgatacagcacccacttctcgcactaccattccggtgagtaaattctatctcaccctgtttgttcgtggcattgctgtaagataagcaatccgaatttatgggatagacttgcaaggtagtcgactcttgatcaaaacatgaactatccaatgcaaatcttctatacaatatgctattgcaccaggacacacttttctttttgaatgaaattctctagggtctatactgtttctgaattgttgaagctgtagtgagaaattttaaaaaggctgatgcaaatttaatttgaacattgaagctatggaatgcgctttactacatatggtggtaatcatcggaccttataattctatacgtgtgaatgaaacatgtttaaactactgtaattgttctttagaactgaaccaccaatataggtgaataaatgtgatgtgacaaaaccccagattctagggcatgcgtaacacaaaacaccagatattgtgatttgtttcaaggaacctcatgttttgaggcaaaatgtttcaaagaaccttaggttcagctttatattgtcgatttgactaatatatttgtgcctacttatacgcatacttataaaaggtagaatatgatatttttaaaatggaaaaagtatgaattaccacccgaactatcgcagtcgaccgaattaccccctgaatccaaaaaccagacattgctcaccctaaactttcaataccgaccgaattacccccctcgacccaattcagaatggtcttgtcctacgtggcgtacgcgtggcaatccaatcagcattttcttattaaaaaaactggtggggtccacatgttgtactctctcatctccctctttctcctcttccccacttcctatctctctctgtagcgctagccgtcgggagcggcgacaagtggccagcgacggccgtggaggggtcagcgagggcgcgcagcgcggcccacgatggaaactatggcgagcggcaacaacggcggcgactacggcgagcggcggcaatggtggtgagggcactcggtgaggcggcaactgcggcgaggtcctcctgcgcctctcccctgtcggcgctcgagcgacctctgccttcttcgccgggggaggccgaggatgcggcgcaccctagcggttgccgaggacgagctcggctcagcggggttggttgtttcgcgaggagatgcaggggcggccctcgtcggcgtcgtcgtccgctgctgttgctggataggcgtccctgcaagctcgctccactccctcccactccgtcgctccccgtgtcccctcccctcgccgccacccccactccaccgccctcgggatgatgagaagccgccagaagccagggtggcctctgccaaagcagggctcgatgttgatgccgccgctgcgcctgaggccctatatggcgcgggaccgtgtgttagtgaagagaaggaggtgatggcgatcggtttggacacgaaggaagcggagagtggaggagtggaggcgacggctcgccgcccgtccgcatctccgccgcgccgtgcgtgccgccatgagcgctgcaatccgcgccgaccgcccccgcctaccgcctgtccctgcgccgctggggctcaccatcgacgcgccgagggggttgctgctcgtcgtgtccgccgtggacgtggccgcccacaactccagctccctcccggagttcgctgccaccgcctctgcgtcctgcgccgctgcctctgcgtcccgccgtgctacccaccgcgcgccgaacgcctaccgccgctcgacctgggcgtgagagagaggaagagtgagagagggagagagagagagagagtgagagacaaaagagaaagaggaagtgtgagagataggaagaggagtatgacaggtgggacccactttttttataaataaaatgctgactggattgccacgcgtacgccacgtaggacagaaccgctctagattggggtcgaggatggtaatatgtctggtattaaaagctcagggtgagcaatgtctggttttgtggttcggggtgggggggcggggcgtaattcgtactttttccttttaacattacctgcattttcaacatgtgttagttatagatagtataacctcttttgtgtaaatgtaatcggttaatatgttattattagtgaagatcatgttgagcttttgctatgatgcagtacaatagaaaagaagaagataaattagactggtggtttgttcatcttgagcctacttatctgaatatgtatttaaaacataccatatataataacggaatgagtattttacataaatctagtgttccttgaaacattttgcctcaaagcatgggttgccttgaaaccaatcgtacttcctaagatgttgcgttacccatgccgcaaaatatgggggtttgtgaaattacatgtggagattagccataagatgttttctgtgtttgttctttttaagctgcacatatcaatagttcagtacataattgaaaataaagcatgtagagtcgttgtgtacttgatccagcaaaagagtgtcacattacaattaaatgagagcccttagtatgttgatttgcttaatgcaggtacctccagtgggtcagagacaaatacaaaaactgaggaaatctttttcgaaatagacttgatgaagaatttgatgtggataagcaaaataaagaggcaattaccccaattgggtttcctaaagctgcctgctgttagtggatgctcttaagaagaacagagcatgccagaagttcattagaaggtagattacaattcaagcgaaattgaagaaaataagaatcttaatcttaaggatcatgtaaaatgccttttggattatcagttaagccgcagaaaagaatttggcaaaattttgtgccaaaatgaggatcattatgttagattgttttcctctcaaaagccatgtgcacaatcagcgaaggtaattatcattttgtgtctacatctatttattggatgtttactaatgacatgttatacctgtggatacatatctgacatggaccttctattgcctgaaagtcaccaagtttcgagattgacatagcagaatcgattctcctacattcatttgtagttaattcacggagatagttgtagtttcctgtatgaacaaaagttaattagttttgcatcacatgaactaaattagatttgacgtgtaacagctaggatcatttggtgtttccctataaagttcattgttgtcaacttgtcaacttatagattttgtacagtgcatttatacaaattttgttccactaaggacacaattctaaggatctatgttgcccaccggaaaacattaaggggcgcaccctggggcgatggagggaggtgccacgtcggcgatttgctacagtcctacagtgctcggggtggtcgttttgcaaaaataaccctccggtttgctggtaattcgaagtaagtccctaataaacagtaattcctccgtttcacaatgtaagactttctagcattgcccacattcatttagatgttaatgaatctagacatatgtatgtgtttagattcattaacatctatatgtatgttggcaatgctagaaagtcttacattatgaaacggagggagtaccactgaagtgatattttatgtggaggccctt

SEQ ID NO: 64126 - DNA, 15206 bp, Oryza sativa
actaggacatatatagttctagtcatatgtgagagctgatttaattgtggcctacctgttgattataaaaatctcgaagaattatgcttataaaaatgcacataccttgatcagtgcccattcttttgggatgcacagattgtgatgcacttttgactctgagaagtaagcagctggtgaccttggctcaatgttatatcttttgcagaatggtagccatttctttgcaaatatggaggcctcccataaagcatagaaagtaagaattgaacctccatcatcggaaaggtacacacttattttttctgatgggtaattgtatgccataactgataggatggtagagatgacaaggcttggtggctctgattgtggatccgcagtgcatacaaagatatccacaccaggtagattttgttcatatctgcttcaaaggatatggtaaatgtgttaaattgtgggaaatatatgttttctcaatgatggatataaaaccaacctctacgtcaaaaatgttttggccataatatttttacaataaagaaacatttttaagttgtgaaaagaaaaaaacaaactagtgaacatagctaagtaaaaataagtttaatgcaaatagataattgatgaaatagccctactataatagatggcagagggtttgtagtacacgaagcactgggtgatctagtacacgggaagggcctagaagtgcatacaccacaccacacggcacttggctctaccttcacttccttgggcaaagcggtgctttgtttcgtgaccaaattaagtatttgtgattgattgtgaaagatatatggataaagatatatccatccatgtatcccgatattgaaaaggattaattgattccataacaccttagattcaaagaaatgcgtttagccccattcctgcgccaggctaaggctacttttttgttgaagttcggaactttttctttttgaccttctaactcatacttgatcatactggcatggctccactattttgttttcgatcggagcatcaagcagtacaactcatttctacttaactaagcatgtgctaaaggaggagagagtttgctttaccgaagtccccttttttataagggtcctttgattcataggatcggcaaaggattttcgcagcattcaaattcctatgaattttttcctctctgtcactttgatttgtagggaaagaaaggaaactttacatagaattgcattactatgtttcgcatttcataggaaaaaacagtaagagagtatgagctctttgtaaactttcatttgtttttcctatggcactatcaaatagttcctatcttctttcctgtgttttttatattcttgtggaattggagaatcataccatttcaattcatatatttttcctatcctgcgaatcaatggagttctaataagagaaaacccccaatccgacattctattggtttatgtatgcagttcgatatttaacagaaataatcataatgatggcttgatgatctgattgagctagctgtgagaacacagagggtctgtttggttgctaccctgagcaccaagcctgagaaatttgtatgcctgagaggcattcgagatgctcatgaagcttgcctggccaggccgcctgatgctttccttgtttggtttgccactcctgcctgagaggaaaaactgatgttgggcttgagattattactgctaatactgatgttagagccaatacggttggtcttgagaaattgagatgattagtgtagatgctaattgcagacacaaatcatagaagacaactgaaatccatggggaaaaaatggggaaaaaggggaaagagaaataagaaagaaatcctcaaatccaagcatgcaccaaattaaatattccatgatttctcccagccatgtaaagcgattcaatcaatgatatttctctcagacacacgcagagcacttactatcaacgaatcaaatgctagcagccatggtggcatcttctcgaggctgcagatctagcaaggcggccggactgcttcgtgcgtgaaatcctttgagacgacagcatcgagggcttagcccagcggcagggggcgagatgctttacgtagcggtgggtttagcatgttggtgatgactcacacgccggcgtcggaggcaaaaatggtggcggtgggggtcttcgcgcgacgccgccgcccgttttttcttagcgatactgcgcctggagctcaggcgaccgattttggtcgcctggttcaggctaatgacattacgtgtttgctcaggccaggcaagaggaaaacagactcagggtggcaaccaaataggaggtaatcgaactcaggctagatccaggccagactagttttgctcagggtagcaaccaaacagccccagagtccctggatgagatcgtttcacacatcgagtataggttttatgtccgtgtcaaagtaaaatttgaatttgaaatacggaggatgtatttaaagtatcctggccagttttccatgtaccgactaccttacctgcttggtaagggtcgtttataatagggccatgtccaatacaactaaaaataaaaactaaccattttatcccatcacgtaagataaaaggatgggtgtttataatatctgtgcttgattaagcatcgatccatacttagcaggtgcttatgtgttctaaatcttgtcaatatgactcgccagtttgtcatcaattttcagaaccttaccagcaataatatattaatatattaagtattacttcctccgtcccacaatacttatctttttagattgtttaatacaaattaagatttgagaagtaaaaactatattgcccgttctttaaatggaagtaagagtgtggtgagggtagaatgtgtaaaaatttaaattgaaggtgactgatgtgataagtagtactcttaagtaatagtaagtattgtgggataaaatttaaatttataaaataactaaactatttggggacagagaaagtagtatgtagatataactttagatgataataataataataataataataataataataataataataataataataataatacatgcaaaattaaactaattttttgaattcaaacctctcggcgagcctgtccctgaaggtgcggcggcggaaggggcgccaccggacggactgcgcgatgacccagtagacggcgaaccagagctccgccgccgccatccccagccacgccgccctcccttcgccggcggccggcacgcgcgtcgccctgtagtagagcaccagcagtatcccggcggccaccgtcgccgcctgcaccctgtacaccgccctgccgcccaactcctccgtcgtgaacagcggccgccgccgctccgccgccgtcgccgccgccgtcgtctccatcgccggccgatcgatcagctctacgctctctctaattgctttgttgcttaagtgcaggagagagcagtaagcagtgagcagtgagcgcttgatttagttatatatatagctcttgatcatcgttaggctcctcatacaaatcaaaatttagctttagttatgtctgtttcataggcacttcgttgagctaagtggcggctaacatcgagatcacttgatatttttcgttattatattattataagtgagaggctgtgagagctcgcgccactctgctgccgaccaattctgagctccttccaaaagaatttattgctaacatgaattactgtatactccctccgtcagctggtatcgatgctatccaaataaatttgtagtactgtactaaattatactccctctgtcctataatgtgacatattctagtacgattaatctggacagatgaatgtttaaattcgtagtaatagaatgtgtcatatccggtactaggttggttttttataggacggaagaagtatgtaatgttgttactctctccgttttatattattagtcgttttatttttttctaatcaaaattgtttaagttggatcaaattaatagaaaaaaatatagcaatattttcaatattaaacaaatacattattaaaatatatttaattttatatttgatgaatctaatttggtgttataggtgttgctaaaattttatataaacttgattacaaattgaaataatttaactagacaaagttaaatcgaactatactataaaccaaaagtgagtatattttaagaatgaggaaatagttcaaaatgccaattcactcacataatcagattaattccgcaactgttactatcattcagctcatgcacgtctcttttctttgtcttgtgtgtaacgaccaggagtaagcgacgaatgaagtgcaactgttgaagaagatggagagtgagaagtggaaaacaagtactcgtgaactcgtccacgcaatcatcaggtagcaagtcaccatgggattcctacctcacacgtgagcgctaggaactgaagcggcacgcgtttcaccgtatttatagcgctttagcgcttagttttggataaaaaaaagctatatacatttcttctttaagataaaaaccgccatgcgtatatttcttttttttaaagttgattgcaactttcaactcagatttatcaaggatttgaaaatttttcaactaatatttgaaaactttcaaggtttgaaactctaattgaaaaattttcaagtcaatatttgaaccctttaaacttaaatttaaaaatttttgaactaagaagatgttgaaactttcaagtctgatttgaaaactttcaattcgaatttgaaaactttcaaaccaagatttgaaaactttcaagtcaggatttgaaaactttcaaatcgaatttaaaaactttcatctccaaattcaaaacattcaactcaaatttgaaaattttcatctcaaaattttaaaacttttaattcaaaatcttaaaaacttttaactcaaattctaaaaaaaaaatctaggaaaaaatcggcagaaaaaacgagaaaaaaacgcgtggagaggcgcagacgcgccagccacgcggcgtgcgcgccagcaaggtaactggtgcatcttcgccaattagcttttccgaagtcaccaagacacaattgggacctggaattattggcttctctagttctctttccaacttccaagtagtggcagatcagttttatacgagaaattcagagatgctttctcagcattcttgtagtacaaattcttgtgaaatttatgtttttctccttcttctgaatatctgtgctagccatctgtaggtagatgattatcagcgtgcaagaaatatgtcaggtagagtttatcccaacaaaaattgaaagaaaaggcagtgcaatttatttccataatcattttacaaggcatcgcttcccattttaggacctcaaactattggtaacaggaatgccaacattacaaagccaattgaagctagtgtgactggtaatggtattctccccttatcctttctcacaaacattgcctcataaattgggatattagtgatcactatcagtccacatagaatgacctggggtaaaaacacattccacacacctgccattattttgcttagccctgcaactaggcagacgaagttcagtaatgcgacagttgcgatgatcacaaattcaggagatgatgacccaaactcaaggatttcttgctcatacctctttgcttcatcgccatcacttacctttgctgtaatttcaaatgacatctttgacaatcctaacaattttcggatggtgtcaatgaagccatatagatatgaggtaattcttttcaccatccacatcctttgtccattccaccatcctttcaatgtatccccagataataatgcctcataaagactgtagagggtcttcacacaaaatacatatatgaagggtgtagcccatggactcataatctaaatgtcatgtaagtgtagtgttagtttcaataataaaaataagttttaatgacaaaaatgaaatcaaagtatggcttatcatttaatttaacggtaccttttgaaataagggaatggctttgacaaaacctagtgctggaatgataacatattagattgtaggcagtgaattggctgcccataatccatatatgcagtagcccatctgtaactgcaagctgatttttccatgtccaaacaggaaggtgttgtgctttgaaagaaaaattgtgaaattgccctcactccatctcttgtgttgcagtattgtctgggcaagtgttgctggagctacacccacaaatgctgccctttgaggttccatgtagactgactcccatcctcggcaatgtattgccaatccagtgatgacatcctctactgggcaaccatatttcactccaatctcattgccccattgtgtcctaagttcataagtgcaggttgctaaagattttgccttctcttcaatctcatctatgttctcatgtcctctttcctttattcctctgccccagtcttccttgtaatctttgctgaatttcttaccacaaaggatctctcttctatggaagcatcctgtgccaatatagagacatccaccagcactgtccaaaccacgcatctccacctttacagaaatttgttttgttagtgtagaaatatgatagcatatttcttttttttgcaagcatgggaatgtatttaagtacagtttgatttgatatatggaacttacatgattgataacattgagagagttcccatatatattatttttggtcatattgttgtagttctgaggatactggacaaatccaattttgtggctcatttcttcatcaaggaagaagcacaacgcatctctgattgaatcactattgttggaatacatgtcacagtccacattcaagataacagggctgtcacttatcagtgctgatacccttatctgcatttaacgaaaaaattaacatatttaaaatacttccaggaataaggaatatatatattgaacattaaaatactagagaaaattttgtgaccaatttgtgcaatgaatgatgcacaataaattgtatgtggtgatttaatggtgcgcaattgatacatgaaaaaattcttgaccaattattgactacatccacatagcatctgatacatgagaaaataacatttgatgaccttttggttagtggttacttgtagaacctactggatacttcatttttttaattcaaaaatgaaaacatggtgcatcttgttgcagtgtttttgcatttataagaagatatataagggcaacctaaaatgaaagtagggggagtattgttaggcttgttttaacataaaaataaataaataacgttagtgaacacaccaaagcgttcaatgccccggctttgaagttatggtgatactgagggctcttctcgcgcgccatgtataccagtgttggtagcacatttccgtcgtcatcaactgcattttggcttttcccatctatcagaacctaggaaagaagcaacatttagaacctctcaaatatatataaaaaagtactatttaaaatcataatcgtgaaaggcttacctgaacaattggctggtgattttttgaggtcatttccgagttccattcatcaaatcctttatgctttagtttaatttcttcaggaatttttcctgacatgacagccgaatcaattctctctctcatttcttcatacaggttctgaaaaaaaaaaagtcatgccagtcatatgagagttttgatttctcctattttaccgaaacctaggggaaccgtatatatatttcattatgtgagagctgattttaattatgtccaacttgttgaattacaaatgccttaaagaagaatgttaaaaatgcacacaccttgataaatgaccattcttttggggagcacagattgtgatgcccttctgattccgagaagtaagcagctggggaccttggctcaatgttatatcttctgcagaatggtagccatttctttgcaaacatggatgcctcccatagagcgtagaaagtaagaattgaaccaccatcatcagaaagatacacacttattttttctgatgggtaattgtatgccatgactgataggatggtagagatgacaaggcttggtggctctgcgtgtgggtctgcagtgcatacaaaaacatccacaccaggtagattttctttgtatctgctccaaaatacatggtaaatgtgttaaattgtgggaaatatatgttttctcgatgatggatataacttcatcctctacatcgatgtgtattcggccataatatttttacaataaaacaacattaagttgcaaaatgaaaaaaaaaactaatgaatgtcctcgtgatggtgtgatgatttaattgggttaactgttgagaacactcagagccataacctggatgagatttttttaacaaatcgagtatatatagttttgcatgtttctatcgaaataaaatttgaaattaaaatatggatttaaagtagtgacgcccctgaagaaacatgatgagttagacaagttgggcccaaaatgcgagttgtacccagggtttgcaattttgaaaccctgtttttttgccggtggaggccgaaaaaactgaaatcaccaaaatttcagaattttgggtattttttgaatttttaacatattttgactgaatttgaataaattttgaaaaaatttacaaatacttgacaaaaaattgaaaatttcagagagatttgtgcttgccggtgggggccgaaattaccgaaatttcgaaccaaaattccaagcactggttgtccctgttctgatcacctactcagtatgtggatcgtttaggatcatgcccgatgcaactatgcaaatgcttaaaggagaggagtgcttataaaaaaaaactaaccattttattctaccagctgtaactaagataggaaatgttcctttcaaataaataaaaaaagatagaaggtgtcctaatctgaaaaagcatatgtgcttagcaggtgcatatgtttaaatgggccttaagcacttaagagaaggtgcttgggttggaggaacgactctttacgcggttgtgcttgattatgtggacattccaaatgctacatccgtttttaaataatgatcctcctcaccgccgctagaggtgagtgccggaaatccggttgtcctagaggaagacagcggctggagattgcaacggcgatggcagcaacagcttctctctacctaaggctgtgtttagttcacgccaaaattaaaactttaattgaaattgaaacgatgcgatggaaaagttagaagtttatgtgagtaggaaagtttggtgtgatggaaaaagttgtaagtttgaagaaaaaattaggatctaaacacggtgtaaaagcctataaggtatggcgtgttaggaggcggtgtcaggaggcacagcaagacaagaaggatggcaacgtggaggtgttgggtggaagggaggacatccttgagaaggtgaaatagtgtatccaaaaatgttataaaaacggagttgtcatcttcctcttccaacagtgtatttccccaccacttaaaacccaccctgcctaaaaactaccacatctaaacaccagatagataaaactaatccctgtataatcatttgtcgtatttcttcccatcacgttccaaagcaccacatagtactatgatatttaaaaataaaagaaatatgtccatattttattaacacctccaatttgaagattcttttataaatccgattggagatgttctaagaataaattgtaataaaatatatctgacatggcgtgtttttattaaaatattataatgaagtatgtctggcatggcgtgtgtgttttttttaaagaagaatcaatcacttgcttaatgcttggccagtcgctaccagctttcaaaaccatacaaaagacacgtaagttatgttgatacaacctccgttttaatattaagggcgtccgtaaatctttttacccattacgtttttattcaaaaaattttacaaatataaaaaagatcaaagtcatactaaaaaacatttacgataaatcaagtcagaataaaataaaaacgaatgatcaacatatctaagaaaacaatgttgttatatattaaaaaaacaaagagagtatatttgatgccacttcagataataaataaacatgcaaaaaataaaaaataacagtaagttaaattcaaaccaacctctcggcgagcctgttcttgaaggtgcggcggcggacggggcaccaccggacggactgcgtgatgacccagtagacggcgaaccagagctccgccgcccgcatccccagccacgccgcccgcccttcgccggcggccggcacgcgcgtcgccctgtagtaaagcaccagcagtatcccggcggccaccgtcgccgcctgcagcctgtacaccgccctgccgcccaccttatccgtcgcgaacagccgccgcctctccgtcgtcgtcgtctccatcgccggcggctaactagctactctctctgtgtagtgagctcgatcttcgctagcataggatccgtagtaatatatgcatatatagctcgatcgatcactagctgacaaaatggactaaccaattctgatgcacagatatgtgcatatataacgtcatactatataaattgttttttactagaatatattttatatagcatatatctttagaagccaggttgatgagatttggttgtggtgctgtgtcagccactggagcacgtggtcagggagtgttttatccaggaccaaatgtatgggagacgattattgagtgtctttggattgatggtcctttacactttgtttctatataatttttggatactagccaagagtttgtgcgttgcaacggaaaataaattgtatttctagcttattaagttaattaagtacatatttagtctaagtgaagaattaggtgaattgtatgttgtctttccttattgcgtagtactcctgcacatgggaatttaaggaaggaaaggaatgcggaggacagctgataaaaaaatagtagaaaaggaaaaaaaaagaccctcctctccactttcccttcccctcggtttcttcggcaggccagcccctctaccagctgccaccgtgctgcccctcctctcctccttccctagccggcacgcagcgagctcgggtcgaggtgaggaagaaaccgatcgacgcggcagcgaagaacctagggaatggcaaggaagaagccaaggcgacccccgttgctcggtggtgttttggcgacaacagtagtggacagcggttccctcaggcggcgccgaggatgccgagcctctccacaatgggcattcccctctcatgaagagcagaggacgctgatgaggaaggggagagggcaccttggagggagaagaagggcgagggattgaggttgacgggcaccccgccgccagattcagctagcatgtacctcccggcgacactagccctcgatcaggtggcgctggccctatatcgagcgacgacagctctcgatccactgcttgaagacggaggaggacgacgatgacacggctgccattggattcaacatggcatgggacgatgagtcggtgaccgtggcagttgcctctcccgtcttctccggacaacgaaggactcggtggcgtggattggatcccaacaaaatccaattgttcctggtacgtttggatggattgccctcgtgtagacctccttggagttggtggcttggaccttggtcccacatgtcagatggtggtggcgttgggaaggcagaatggatcgacaccaccaccgagaacatttaaagaagtatagatgcttgttttctgagccctatggatctgagggcctcatcgtttgttctatggcttataagccgctgccaaagtttaaattttgaaactttatttggagtcgactttgatgttttttttaatgtagtttgtttttcagtattggcttttaagtcactaaagacacatatgaaaagttttatccataattattttttatcactaataaaccattacagcttatataatcaagccatatacaaccgatgaggaccttatttatatagaggccgaaaatgatttgaagatggttgtatgaccctaatgtaattatcttgatttcattaaaaaattacttatcaattatatataactttatattaaaattataatgagagtgttgctacttataatcgtctgattatttcttactattatgaatgtttttttaacaagtctaatgcaacatgaggatgcacgagcggtgtggtgatagagtagtcatgggtatacaacttcacccactagtattaatttaatggtgcctactaatacagtatattacacgtatgtcagggcgtcttcataggattttaatgacgttaaggatgtctttagtattatctttttagcgtatgttaagacatgtattcgctgtttgtgtgcgtatgcatcttctgatcgagaaattaatcagtctaatatatgatgtaagtctcgtaaataaactctaataccccttcaaatgcgtactagtatagtcaagctctagacaacacgtttttataggaaactctaggcaacaagttgaagttgatgtgacaacattatatttaacgccttaacagcagtttttcatgacaagaactgttgctagggtgttaaatataactgggttagtaaggttcaacgtcttacgtctctcttcgattctatattaattgacgtttttgacaaggttgagatcaaatttttataactttgaccatcaataactttaaaaatatttagtttaaagaaactaaaacaacatatatagatttttcttttaaagcactataataaaaataaacatgcatttatttattgtatatattataatagaaaagtaaggtcaaaagatatattttgtagaccgtgtcattgtccaaaacgtcaattaaaatggaaccggagggagtacatctgaatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatacatgattacatacctaactaattatatgtatggatgctatatacctacaatcaaaatctaacaaaaacaagttcaaattcagttcaaacttgctttaaactagttagtaaagtagttaatgttaatacctaggtaattgaaaaagtttcatactcatttgaattgggtatatactcaatttcaacaatggtgcccgggcaccatggagcaccaaacaaatatatatatatatatatatatatatatatatatatatatatatatatatatatatatatatgtttgggtagaatggttttaatatgcagtgttatttgctaattaatggtagtaggccagtcaccatcgtcggcatgcagagacgatacgaatatgccatatatatggctgcaaggacagttgtgtagcatgcagagacgatacgaatatgccatatatatgactccaatttaatttcaaattccgtagattaaaaaaaatatcgtatgcactagcacacatccgaatatattttttttggtggtacaaaaagaacaggaagatattctgttatatatcaccgtgtccacatctacatacgaatttcacgtacgtgtacacgcatcgatattgattccatgaccaagagactccatttctcaaacatacggattttatttttcccgttttgtttagcagttgttgtctcgctgtctcgcgtggatcatatatgtatattatatatttatatatatagatcgtgtggggtaagcgcacgaattaatcatagtgatgcatacgtgacatgacaatatcccttaatttgattgactacattttgccttcaacattccctcaactagataatactccgtgctttcttacgggatatatgttagatattagagaaatgatgaaataatttgaattaaaatattatgaaaatgatttgagaatgatgatttaacatgtgtatgtttagttttagaatgaaataaatcgtagacataattactatatgcttgcatgtgtgtttaatgggttgatgtggtatgcttgcatacaggtttttaggagtggtaataaatactatgcttgcatgttgagttttagatgtttagtggatattagctttataaaaagaaaagatttgttcgatgttgccttcagttcccttgtgattctatagtgttaactcctccttttttttatttttttttactgcatcctctttttttaaaaaattactccccatttcacaataaactattatagtatatatgatgtgacactatctaatactataaatcagattaaatatatagtgctaggtagtgtcacatcatgtattagattgatttattttgggataaagagaatagacacataggtgtcaatttaatttttactatgttgtatgcaattgtgtgcataaacctatatattaaactcgttatgggatatatatcttgcgacttcacgaacatagtttttttttaaatataagtacgataaatctttagctatgtgccaactactactacttctacttcttccgtcccaaaatctatattgtcaaaacaaaacgagattggatggaatatatcctaaaacaacaaatctagactgagatatatccagattcgttgtattaggatatgtcatattcagtttatatatatatatatatatatatattaggacggaaaaaacaaattcagagaatgaatttagatatagattttgggaatcctccattgattttttattggacaaaataaagtctaaggattcaggagtggacaagactgcataatctggttggtaaggaatatccggtcgccaagcgcagccaaaaatagtaattcagatggacatataagtagagtactagtaattcagatggacagatcctactgctcgcgtacagaccttgccagctgcttgattggctact

SEQ ID NO: 64127 - DNA, 6873 bp, Oryza sativa
tcatatccctgtatgaagtataccaagcttagagcgaaacgttgactgcacatccagtgggcgtagctatccttaatcctttacataactgtgcaattaatcttgagttaagagctaagatatatatcatgttttgactccatatttacaatgctacagcagaaaacttgtgtggagcgccatacattttatctagagacaatcatcaaactcaataagaattagagatgctagagacgctttgtgacaccaccttgcctcaagaattaattttctatgtatacataatgagaaaagatacattttactatagtgtagactttgaggttttagctactcgatagggaaaaactcctgttttggaacaaagcacccttagtagcccacagcagccggatatggcacttccttggcctatagccgtaagatctagtgctccctcaaggcccggccggtggcatagttgcctaccgagccggctgcgaaaacgcacaaacgcacactctacctctataagcaccttcaaaagattggccggcatattctgaaattgacggagtcatcacgagcgtaacacgtcatctatcaccgaaagaataattagccgtaaatgtgaacacctgtgtcaaatctagaatttcaacctaggtgagttattccacgggaaggaacatttcagtcatgcatatgaaaatttttgtacttccttgcgtagttgtgcatacccatgggtgccaacactactacaaaacccttaataggtgttagcaaaaccgacacctataaaccatttaccaccctcacgggaaaaggctcataggaaaccttcggcaactataggtgcaagttctatagtaaaaatcaataccaatatcataggtgtcagttttttaattaaccggcactaaaaaaccgagccaataatttttcattgtaaaataggaattagatagggagatcctttgtctctagtgctcatgtccttggagcagaattgctacaggccataatcaacaaggcaaatcttcttggacttctgtctaaacctatccctattgaaagtgacccaaattttcagttgtttaacatgccgatgacatccttctgtatgtcaaagcttgtggaagataattgtggaagagaattgttcaccttggaggctctactttagacttttgcacaagggacacgtctcacggtaaattatcataaatgtctgacactaataaatgttgatgaagagaaagcacaaatgttggcaggtgtctttggttgttagattggtacactacctttcacataccttagcttaccccttggaactactaagactagagtggttgatgttgctcccattgttgatagaatcgagagaagactatatgctaattcagctctttcatcctatggtgatagactcgctttggttaattgagatcatttcttccttgccaacctattacatgtgcacttttgtcacgcccggaaattcactagtaattttcgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactctcacaggcagctcaactggggtataagccaaacgtcttctccttctggatcctttatcttcaactgaggtttgattgattattgcaagaatgagcatataacatactcaacaagccacacagcaaatatgcaagtgcacaaggataccaaaggatggcataatataggctcatttgcgaaagcagcatttagcaaagaattaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacatttcctggatcataatcacccccttataaacaaggcatggactccccagcgacccccgtggacttctcgccacttctcagtctggcgcactataatgaatcatgctacacaaaagataaagccgttgcccacgctggcttgtggttggcacgataaatgtttcacagcagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagtgatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgtaaaacgaagaaaaagactaataaaaaccaaataaacaatacatataaaataaacaaacatgtagatcatgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcaccctcgaaccaaacgacgaacgacgacggccggcgacgaggtctattggcggcgcggcttcggtcggcggtggcgacgggactccggtgaccggcgacagcggggagagagcggccgggcttctccacacctcggcgcaccttacggcggtgacggcgaccggcggcgacgacggaggcggcggcgcgacgcggatggagctcggccggcgacgacggcggggtggagcacgtggcggcagcgctacgaggcacgggagaccacgggagagggggcaaacgaaagaggtggactagggggtcctatttatagccttggattgaagagatcggactcctcccgcaagaaatcgatccggaaaatcaaaaactcggttttggagataaactcgaaaacgagttcgattcggataagatactcaacgattagctccgattttttgggggtaaagatagaggaggataagaggaatatttcccctcaactaaattggaaaaaggagcaacggggaggcgagatttaacggaggaagcggcggctgcacagggcacagcacgggcggctcggctctgtccagagctggaagatgaacagtgccagggaggtaaattagacttttccggctaggctgagaggagaggaggcggctcaggttgggccggcggaagagagaggaaggaaaggaaggaatgggctgaaaatggctcaagctgaggaggaggattttattactttcccaattaaaataatcacttaaatgatctttgagttattaaaaatacttccaatgctcaaataatttcaagaaaaatcgtgaaaatacttggacactcaaagtacttaacaaaattataattagaccatttaatgattaatttaatatgtgggtaattactgaaatgctctttgtatgattaaaattaggaattgagctccgaaaaatccgagaaaattccagagagtataattaaccatggagagtttaataaaaattaaatccatccatgctttatatttaggaaattttatttcccacatttaacttcacttgtaaattaatgaacatttaatataaattctaataataatttattaaataatttataaatcctgaaacaaaaatcagggtgtgacaactttgcagctgcctaaaacattcattgacaacattgatagggaaaagaggcattgcttatggaggggttctgatgtgaactcaaagaaaaaaatatttgtctgcatgggataataattgcagacctaagaataagggaggtttgggagtcatagatctttccattcagaatcaagccctccttttgaagtatcttgataagttttataacagaagaaatttacaatgggttaacctattctgggactcttaatatggaaatggggtacatcacttaagcactctcaaatgttctttttggtggacatatgtttgcaagttaacagacttctttaggggaattgcaagatgcttagtgggagatggaatttcttggtcattcagggatgatgtttggaatgataaacctcctctgtcctctcacatgctatgattatattcttttgctggaaatactaagattttggttcataactttatctctgtagacttgaaagataattttcagctgcctctatctcttcaagcctttcaagaactgcgagccttatctgcaatgttggaggaggttaacctatctcaggagaatgatatttgggcttacatttggggaaatcttaaatactcttctcagaagtattatgccttaaactttagggccatgcaaccacctcctcatttcctttggttatggaagataaggccacctcaaaggttaacacaaaattatgaggacatcactagcttggataagaccacggctatattatatattcataaaccaaaggtgcatgctttctatgtaagatttacatgttatatatttaaacaaatgttgctacacaacgagtttggtgtgttttcgtttgcagtgatacttgcttgggtgaaagaaaagagacttgagtgtaatgaatgcatagatgatcaaagaagttgactagggatcgacctaagatcatcttcaagtccactcctatctcaccatgtcaattttggtccatacaagacaagagatgaatttctatatgttttggattcagatttgggtctcttaacagcatcaatttcaaatgaacctagcccctgatctaaatggaatattggggcccatgagtactagttggaaagcttatggagtctttgttcaaatggttttggtcccacgtcaaaattcttactgagttgtcaggaattttcaaaacaagtcacataccttatctagtccaaatctgatttaggctttgggccttgtaattgtgttgtgggctaagcccaaaggggtgtgtgtctagggaaaccctaggatgtcccaaatcatattcatttagtagccttcatagtttagactcgggttttgcttagatttatttctgccaatgtagttccgccacttgttcagtttgtggaaccccaatttctaatcttaataattcatatgcaatttagttgcaatctagcttgttcttacttgtgttcttcaattctcatgcagggattagccttctcgacgagatcaaccgggcaacgcacgtttgataaccataggagagatggtgctacgattgcagggttcagattgtgttgatcggaagacagatcgtctgtgtcaagtttccatcaaatcaagagttatcaatacctatcagatgatcatgacctaattcaccaccttgagattgcatctctttttacagtgtccctttgcaacgtcatgctggtatgttcttggtatctcttgggacacatctttgagcctggacaatatgttggtgcactcgagaaactgttacgaaggccattgtttcatgaaaaaaatttctttatggggcttggaatatttggaggcaaaggaatggtttcatctttgatcataaagccccctccttagattcatggggcagctccttaaggcggatctcctcatgttgttgtttcggctgaatgagatatacaaagatgtactccctccgtttcaaaatgtttgacaccgttgactttttagtacgtgtttgaccattcgtcttattcaaaaaatttaagtaattatttattcttttcatattatttgattcattgtccaatatactttcatgtacacatatagttttacatattttacaaattttttgaataagatgaacggtaaaacatgtgctaaaaagtcaacggtttcaaacattttgaaacggagggagcatttcttaattggatctctttgttgtaatttcccttttttatgtacttattctttttttaataaagtcctagtatgtgaagtttgtatattagatatacgaaagttgatccgcgttgggataattttctatcttgtaagactgctccttcgcttatataaggagggcaggatgcctctttgggggtagattcacaatcatattattagatcaatacatagctcggcagattcaaatccccaaataggagtggggtattacctctcattgagggcttaaacctatctaaat

SEQ ID NO: 64128 - DNA, 1717 bp, Oryza sativa
gtgcggccatgcgttcataaaccttccttgccaccttctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccactgtgacgtacatagttcttggcggcttcggccggggcataggacgtccatcttcttccacttccgttatgatgtgccgaccctcaagcttcttcgctgcacctcgttgcccgcgtgccctcttctgtccaacggagggttgattaccactagcctcctcctcctggttcccctccacatccctttccaagtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattaccaaataaagtaatattatattaaaactcaaataatattacatgcctaagactaaaatagtaatgtatgctaagtgtttcgtgcgtatatgctaagtgtaattaagactacaatactcaatt

SEQ ID NO: 64129 - DNA, 5340 bp, Oryza sativa
taaagatcttttcccactatttccaaattctttttaaacccggttagggttaagaaccgggagtaaagataatagcactgaattttgaatttcattatatttgtgtttctaaaatagtaaataatgcattacgattatttaaagtcgaaaaattaatgacaaaaccttcaaaaaattattgttgtctgtagtaaactaagtggataatatataattagcacatgaatgatttaaaattgttaaaaattctaataatcctatataattagcatatgcatgatattaaattgttaaaaattctaattaacatatgtaaataccacatgcatgatttaaaattaataaaaattctaataatcgtatataattagcatatgatgatattaaattgttgaaaattctaaataacatatgtaaataccacatgcatgatttaaaattaacaaaaattctaataatcatatataattagcatatcatgataataaattgttgaaaattctaattaacatatgtaaataccacgtgcatgatttaaaacttttaaaaattctaataaccatatataactagcatatcatgataataaattattgaaaattctaattaacatatgtaaataccaggtgcatgatttaaaacttttaaaaattctaataatcatatataactagcatatggttgatttcaatttgataaaaattctaataatcatacataattaacatatgccatacaacaattgatttgtatggatattcaatacatccaaaatagtttacatcgtgtacacaacaattacagcaatacatcggcggtgacggttgaccgcacgtactttctcctcactattgttccttccttgtgatcgctacgcgagtaaagggtgtcttcatttgataggaggatgctagggtcaatcgtcaccgtgaaagggggttgcccatcaaactgatcgtaatcctcgtcagtcttgtactctactccaatgatttttctttttcctgggagaaccacgtggcgcttcggctcgtcaggccctttgccctttcttcctttgctagacatgtccttgacgtaaaaaacttgcgttacatcattggcaaggacaaaaggttcgtccgagtatccaaccttgttaaggtcaaccgttgtcatcccactgtcaatcgttacgcctccaccagtcaacctaacccattggcaccggaacagagggaccttgagaggtccatagtcaagttcccatatgtcctcgatggcaccgtaatacgtgccagttgtaccatcgtgtcccatggcatcgatacgaacagcactgttctggctcgtgctcttcatgtcttgggctctcgtgtagaatgtgtacccattgatttcatatccctggaatgtcgcgatcgagctagatggtcccctcgccaggaaggccggttgttggttaatcgtctcgttacccatgagatgttgtcgcagccacgcggagaaagtatcaatgtgatactgtgtaatccatgcgtcggacttaccgatgtttctggcacgaactagagccaagtgctcctcgatgtaaggagccaccaatgaagattgttgcagaaccgtgaaatgggctttacaaaataaattgttgtctaccgtcattattgctttccttccgagagtcccctttccccgtagtctcccttcatggcgtgatttaggtaccccgattgggcgaaggtcttcaataaattctacgcaaaattcaatgacctcctctgttccataccccttggcgatgcttgcctctggacgagcacggttacgaacatatttcttcagaacgcccatgtacctctcgaaaggaaacatattgtgtaggtacacagggtcgagaataccgatctctttgacaaggtgacaaagcagatgcgtcattatattgaaaaatgaaggtggaaatatcaactcacagctgacaagacattgcaccacatcattctgaagggcttctaatctatccggatcgatgaccttctacgaaattgcgttcatgaaagcacatagctttgtttttgttgcctggacattgtctgggaggataccccttattacaactggtagcagctgtgtcatcaacatgagacagtcatgagactttaggtttgtgaacttcttctccttcgtgcttattattcgctttatattcatggagtatcctgacggtaccttgatgctctccaagcattcaaacatattgtccttctctgccttgctaagagtgtagctggctggagtcaagtaatggcttcctttcttctttggttctgagtgaaggttgccacgttgttccatatacttcagatcattacgtacttccagtgtatctttcgactttccatatacacctaggaagccaagaaggtttatgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcgaaagactgttttcccactgcgatgtttaggcttcgtacggtggtcggccttatgttcgaagtgcttgcctttctttcgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtccttaccaggttgcttggggccttgaataataatcggcatcattatgtacttcctcttcatgcatagccagggggggaggttgtagatacacatcgtaacgggccaagtgctatggccactgctcatctctccaaaaggattcataccatccgtactcaaaccaaaccgtatgttttgtgcgtcctttccaaattatttaaattttctgtcgatgtttcgccactgcgaaccatcggcagggtgtctcaacatcccgtcttgttgacgctcttcagcgtgccaacgcatcattctaacattccccttgttcctgaacaaacgccttagccgtggtattatagggaaataccacatcaccttagcaggaattctcttctttgttagctgcccgtcaacttctcctggatcatctcgtctaatcttgtatcgtagtgctttacaaacaaggcatgcttctaggttctcgtactcctcaccgcgatataggatacaatcattcggccatgcgtgaatcttctgaacttccagtcctagaggacagactatcttcttagcctcgtacgttgtcttgggcaattggtttccctccggaagaatgttcttgacgagtttcaataaatcgccaaatgccttgtcactaacaccatttttttgccttccattgcaagaactctagagtggtatccaactttttgtgcccctgctcgcaacctaggtacaacgacgttctgtggtcctctaacatcttgtccaatttatgggccaccttttcactttcgcagtcctccttggcatcctgcaacatctgaccaagatcatccgcaacgctgttaccatcagcatcactttcctccttgcccgtttgatttccttcaaatccagcgtattgagctaagtccggaatattgtcgtcttccacttcatcttcttccatttcaaccccttgctctccgtgggatgtccaacagttatagcttggcatgaaccccgacttaaacaagtggaaatgaatagtcctggatgcagaatactccttttgattcttacacttattgcacggacaacaaataaaacccttatgcctgttagcttcggccactctcaaaaaataatgcacgccgtcaataaactctttgaaccgccggtcagcgtacatccattgccgatccatctacatgaaatgaaaaaaaatcgtacacaaataattattcgtacaataataacagtcatacaataatgataaaatagttacaaactctttcaacactcgtacagtaatgacatatcattattcatacaaaaattataaaatattacaccaaataattcttatttactatttctaaagttttaaactaatattaatgtgttgtacttcttttagttttcattttagtttgttttctattatttaatattaactttcactatattttccttctcaactattttataaaaccttctttagcaaataaactaaatttctatatattctttcttccccacacaaattttctctctcatcaacttacaacaaaattttggagacaaaaaagtgtgcaaaacatagctccaaatgtaatatgacaaaaaaacattggaggatgaagttactaagcttttaggcaccgtgatttgtatataatcaccaaaataaattcactagaaattttggcatgacctcccctcttttttgaagaaattttgaagcttgctcggggtggaggaggaagaagacatatatacaggggtgggactttagtcccggttggtgttatgaaccggggctaaagatcccgaggggcttaacaagccctgacagcatttgaaccgggactaaagatgatcttttaccaaccgggactaaagatcaaatatgcccgttaccctttttaaccgggactaaagatcatctttagtgtatgtatcgaggtccctaaacttggtttattatgtctttccggtccaaagtctcatttgaccgtggtcttgcctatgtggcatgccatgtagacgacgacatcgcacattattattattattttctttttttctcccttctttctcttccatttctctcttctatggcctcttcctccgacagcagcgacgcttggtgatgacagtggtggtcggcacgagggagcttgaggtggctccagtagaggaagaagataaaagaagaggaggagaaaaagaaaagggggaaaaagaaaaaatgccatgtcattgttcacgtggcgtaccacataggcaagaccatggtcaaaggacgctttggaccgagatgatacaacaaatcaagtttagggacctcgatgtatgatttgcaagttcgtggaccaaagtgaaacctcatgacaagtttaaggaccgatagt

SEQ ID NO: 64130 - DNA, 1123 bp, Oryza sativa
aaattggtttacactgtatagataatttaatctcacacaagttccttacatgtaatcttattcatggaactacagctaaatcatttcactactacacctatcaaagcaagttccttacatgtaatctgatgccaaaacaattagaatagttcagctagagggccaggaatttatctcgctgacgaaaatgcaagcgtgcgttaatatttttacagaattgcttcagcaatacttgttcctgaaatacaaaggaaatagttggtaatcatataccttcattcttctatgcaaaagtggtatccctgtgtggaactgaaattgaaataagatgtataattatatgaatcccattaatggtagattacatgcttagcacttaaaagaatgcagtaagccaatgcaaagaatctgccaagtacaaaccaattaataacataaagttgaccccaaaaccagtttagattatatgttacacccagaataaagtattgctacaaacagagcacaattgttcagcggtagctttgagtttctcaataattcaaggttggaaaacttttagtaaagaaacatacatggattttctgtcttctatgatgccagagaatatatggtgtaggcaaagtacatagcggaatttgaccaatatcatgctatgatcaccacctgtgaaaaaaaaaatgtagcgtaaaccacttagcgaaacagttcataggcgaaccaacaatttcaatagaatcttacatgtgaaagtgaaacatgtaacacattaatagaaaatttggacattataaaatataatattttaagcacgataaatatttttaaacggtatatgactttccctattgtatcaatagtagaagcatcagaaccataacacataagagcataataagcaggagaaacaatattcaaactaatgcatgtgcttaaaggttcaagcactcccttcctttacatgatggtcgtgtaagccggtcgttacatggtcgttgctcttacatgaccagatcttacatgaccatattcaggtgtagccttaactcgaccactataaataaaggtagtgggagtatcgctacacctctggtcgagaaccaggtgtagccttaattaactc

SEQ ID NO: 64131 - DNA, 1653 bp, Oryza sativa
ctcctatatccgaaggttgtttccgtataagacatggatgtggtgggtcctgccgagatttagtcaactactattaggtatgtgttatccataaccctgacaaattccccctttatttacattgacaattcaccataagtcacttataagatattttcacaaatacctatactccattataaagcaccattacaaagctatttaaagtgtctttatctctactataataaaaagaagatatttttccggtattttggtacgtcatccgtgtatgagtcggtttttaagtttgtttgcttttgggaataaatatccgtatttgagtctgttttttaagaccattcacttttggtaatacaaaaggaatcatataagaaatttgtttaaaaaaactcgtatgctaacttgagacgatcggactcctaactgcagctcatgattttctaaaaatatatatatatacatacgatctcccacggtgaatttcatcttaactaaaccatataacaataataagattaaaataaacttcacccgttgcaacgcacaagcgttttttctatagaaataaaaaaaaggccttacaaagacattttgttcatttgttgtactgtggtccttgctgtccctgcggcagatgcacatcctctgcaatactgctgatgcagtagcagacactgatgtgtgggctccgctactgcatcagcagtcctgcaaacaatccctactgccctgcggcaccccttggactttgccgtgagtacgtacgtattcacttgatctagtaggttttgaagttcctacgttgcctaaatttacagatagggttgatcaatcgtgctgtatggtccaaaggctctcatctagtttacttgtcataaatatctattaaagtttatcctaataattgtagttaatgatatttatctcttctctcaataaaccgtatcatatcattttttctaacccttagatgattaatctatactccaaaatatcttcctccttttttcccaataaaattatcttacattagattagagttatctttagatgattaacctattttatcttcaatcttttccttctgtcattaagatacattaccttagttttacttttgaataatcaaactacatataatttaaattgttataaaccttgtcatcttaattgtttataacttttttcatggtcgattaaatatgaaaattatataaagtatataaagttatgtcatctagctatttttcatgttattttatagggttaattggatacatgccattagaaatttaccggtttttaaatataccactagtatttatgtatttggaaatatgccattataatttcacacatattcaaaaatatcactacttacctcttatatgcatttccatagaaaattggaccaaactgccatttttccccgcttcttccttcttcccctttctccttcctcctcttttcgttctcagcggcggcgagtggtggcaacagcagcagcagcaacgcggttgcgagcggcagcgcggcggcggcagcagcagccgcagcgacgcggctgcgagcgggggcggcagcagtaaggttgtaggcaaagcaacacgagattttacctcctgctgttcaaaaccatgtataactcga

SEQ ID NO: 64132 - DNA, 3165 bp, Oryza sativa
aagaagaaatcggaggaatttcggagttgtcgataatctcctcttactttttgtacctttgtaattactctgatttcatagaaatattcttccgagtaattaagattttgctttgtgagaattatctcttagttagttccttttagcattctaatcattgttcgctatatttaatatgcagtgtttatgtttactttagtgagttatagacactagagtagaaattaatttcttaaacatggtgtttaggtagttattttcagagattgctgcgtatcccacatatcattagaggttggtatagagatagtgacagcccacaagagcaccacagtcctcccagtccgggtacggagtagagcgcgttctggtagcagtgagcaagttagcgcctgaagttttgctataggattaaaccaagctttctatagacattgtttatcgctaggaaatcctctctatcatttgcctatctttgcttcgtgcccttggatgaacctagagaatagctgagcacacacgttcctcatggaaattgataccttggaatactcccgagtgaagtgttatatcggcatatccgtgcgcttgcagattttatctgtgaccgtaagaaataccaataagcatttatagtgccgttgccggggaacaattgctattctcctccgtaccttgttcatcctcatatctttgatttttcttcttcctctacccctgctatccgttgaaattacctaaaatacaactctcgaccctggagcaacctatcttcaaattgttagctcctacaggaaaattctatgaaccacctccttcattgaagccaatttttataaccgactacgaaattcgccccgaattaataagtatggttagggagaaatccttttttaggtttcgaccaagaaaatccctaccatcacctatgcatgtgtttggtttagggacaaggtgggatgggttggatccatccctgtttttgggaatgggatgatcccattttctgtttggttgaagggatggaacgaatcctattttttgtttggtttgaaggatatgatgggttggaatgatcctatgccttgtttggatggagggatgaaggtgggatgcctggagtgtacacattgtaaaataacatttagacatgaaaattacactatttgaaaattaaataccgttaatatcgctacatttttagtcagtatacatcaattcttgtatcaatccattcatagaaaataacacatggccatcatctactgtcaagaaattcacctaaaaaaataacacatttttgaactaattatactgctgttggttcaattgctactaactaattgacttcatccatacttactcataatactatgatagcgatcaagcgcttcggagatgagaattgacaaatatcagtctctctgatcaataccaattattggatagagaaatttacagaaggatagcagagtagcgaccggcaagagaagaggcatcaccagctccctgctcatgcgctcccaccgccgccttgcccctgtttgcaccgcagctcgcccttgctcatgcgctcccgccaccgtttcatccctgctcgcgccgccggctcgcccctgctcccgtcgccgcctcgcgcgctggccgccgattcgcccctgctcccgccgctaaccctagaacgtagtcgtgaggaggagctgaaaagagcgaagggaaaaaaaaagggatgcggtgaaacccgggatgggccatgagggttaccgcgcctcacacgcatgtggaggtgggatgaatctgtccgccagtttttggcggatgagttggtcccgaatattgaaggaatattcttttttggaaccatcctatcccatctagtctctcaaccaaacacatgtaaaaatgggatgatcccatcccatcccgggatatcccttcaaccaaacacatgctataggaatttgagcagttgtgttcatactttaatattcgaggcattaaagaagaaactgtacggtggaaattgtttccgttctctcttcaagagagcgcaatacaacagtacacatctaccatcaagtgcgcaaatggtgactggcccaagttgcgagaaatcatcatcttccagcagatgaataaagaatccatcggtgcagcttagtccagatttaataatttagtatgatctggtccaaccttgttcatacctgaatatgtgctattacaacattttcatgcaggtttagacaaggagtatgcattataccttgacaccattgtcggaggatcattcctgcataaaactccttcggaaggacaaataattctagatcgaattatggaaaatacttccttcatagagcaatataatgaatccctccctaaggcatcgatgcgtaaaattaaggaaccttcgatagctgaatctgagactgaaccgcctacatcaatagattcggctaaggagtcctcctccaaaccatcaccagcaaagagcaaagaaattcaaactctggaatgtgctataatgttcaggaatgatcttgatgaagattttggaaacacccagaattatttcagtaaaaagaaacctcctatggccttgccacctcctgatctaatcgaagatgaatatcttaaagaaatagtctgggagctgaccacagtcatgagcaacgaatggttaaaagaggcagagctttcttccgaagtaattcggaataattccactcctcgaaccatcccttgcaacttagaagggaatactgttggtattctatatagtccaacagtcggagtcaaccttgtctcagaatcattcacatttgcttatttgagtgacaaggccattactccgatgaacaaattcttcaaacacccgaataggaagttaattgaaggatttgggattgttcaagatgtatctgtccaatacaacgataaagaggccatcttggattttcatgtctttgaaatccaagactttgacgtcctaattgggcatctgatcaagaaacttctcatcaactgccctcgattaggtagcctaaaattctctttagtagggaacaaattctctatttcattttcacaatcaagatttgccttgactgattccctgcctgaagacgaatatgcaaaggaagtaacaactattattccttt

SEQ ID NO: 64133 - DNA, 1916 bp, Oryza sativa
ttcgcaggtgcataataagattggtaggtgtaaattaaagatgagaggatcaatctgacaagcattggaacacatacatcaaatacatttttttacttatagtgtcatataactgattctcaagcctcaatgtacagtgctatatgtgagatgatcgaagatgtcagagtgttcactagtacaaaactacatatctgtgacagcctatcccgtgtttggtctttcgcactgtcacaacgtcgtcatctttaataggctgaaataaataccgacacagatatacccgtacagacatattccatgagcatctattgcgagcccgtcaccgatgagacctattgatgacgggcttatgtttcggctcatggaataggtccgtcactgataggtctcatctgtgatgggccctaacttaggcccgatgaagatggttgtttagccccgtcaccaatgtgtgtcattggtgacaggctcagttttaggtccgatagagatcactataaaactcgtcacaaatgttcattgtcattgtcatgtttacgatagcagagatatgcgcattgtcattttttcaaacatagttatatgcatgctaatgtacttatgaatacatggaaaatccaaacaagccaaataaattccattgcagatgagtaccggagcactgtccattaaatttattctaagtttacaaatttgggtctgttagatgtaatcagcttatatagttaattgaaccattttatttaatttgttataaattctaatagatttataggtgggctgcttcaagcaaaagcttaaagttgataaggaaacacagctaatacaactaattcaattaattataacttaacaatcccctcatatacatgtttgaggtttcccttaggccttgtttggttgggccattcccggccgggatcggggcccaatccccgtggatcaccctggcgaggaaacaatctcggcccatccgaaattgtgtgttcggttaagcccagtatgggttttaccctggcctatcccggcctttccccctcacctaggcccgggaaaaaatcagcttctcgtgtggcgtggaaaaattcctcacgacgggagccgggaggcgacgtgcaacacgcgcagtggcagcacgacgcggaggcaattcgaggtggcacaacggcgggagcggcgcgacgcgaggcgacggtgacggcacggcgctctcctccggccaccattttctttctagtgagcacgcagccttttcccttctctcctcctcttccaaagctagggttagggttttcttcttttctccctttcccttcgtcgccgcaattggtcatcgtcctcctcatatcctgctcgatctggtgagtgcttgatttgggtgaggattagtgagttcttgatcagatggggaatgagctttttttcttggttgggtggggatgagttattgattcgccgctgccgtcacacgtcctaaaccatctcattagttcttgatttgggtgtggtgtgttcttgattgctgcatttcccgctctactagaaaaatgatttttagcgatgttagccttttatttttccaggcgggtatgactctcgaagccaaatatctgcctataaaaatataaaccagggtgggttttcatcatccacctacgaaaatcaatttttgcaggtggaccacttaagtcgtcattcgtcggcgctcgaaaaacaatttttacaagtggtccgcctacaaaaattatatttttacaggcgaaaaaatacgtggtccgcctagaaaaatcgttctataaaatcttcttccttatctactcttacagcccccatccttatcttctcatccaccctccccccaccactcatttccccctctcctctctccctatcctctatctccctcgcgcgca

SEQ ID NO: 64134 - DNA, 2721 bp, Oryza sativa
ggtctcggggaggggagggaagtggaggggagggaagtcggcgacgaggagaggagacgcgacgatgacggcgccgaggacgacgacgacgatggcgacgacgcgacgacgacgacgacgacgacgacggcgacgacgcgagtacgacgacgactgctgcgatgacggcgctgacgcgacgacgacgacggcgccacctatggaggccggcggatggacgacaacggcgttttttttaagtttacatgttgattgatgttgattgatgttagcttgcaagttgatgatgttgatttatgatttgaaacctaggatgggtggggtgggctggcgggaaatttttttgttgcgcggtgaatgtagcgcctgcaaagaatgaactgctgcatgcgagaattatttttgcaggcggtgctttggtccatctaaaaaaattaaggatttttacagtcgtttaggtacctgcggaaggtttgtccgcctacgaaaacgtgttttgaccgcctggaaaaacatttcttctagtagtgcggtgagttcttactcgtggtgaataagatcagagctgcgaatgcgaaggttgtccatggcagtacagaatgtaataactctctggaggtgaagatggcaactcggaccttaaacgtatgatttctctgacataaaagatgcaactaataatttctcatgtgaaagtttgcttgaaaaatgtggttttggatctgtctacaaagtaagttcagatttcaaaatcacactctattaccattagctagcaagcaagtgtttagtgttgtcaaggctaaattgtactcccacacgttctaatttctagagagagaaactagaaaaaggttgaggtggtcatccttttctacattcatcatatatctgttatacacttagtctgaaactttgtgcattataatgttcactggttttatttttatgggattgaatgtacaacaagaaatggattgttgcattagttcagttcaacatgttttcataagattatactacatgtcatctccaacatgtttaagaatgctgaaagttgacaagatattaatttttgcgatgtgaatataataatccctctgccaatttgtttttgtctaaagtgttattatgaatattaatcatgcatgatgaaaatgatcatttacaactagcttatatgctatttttagaagaaaaaaatcattttttgtttgtgtggcatggcaaaaggcaatgcttgcataagttcctcgaagtactgtagattaaagttaatggtatttgtgtataccaatgtcaccatatggatgcatgggggaataggagcatgttgcttaatttctggatcaatgttctgaacatggttaaacttcagaaaattgcaagtaaactatattagataatgcttaatttttagttgttataatatacctctctttggggttacccacaagtagttgtcaatttatggaattttaaattccatatacatatcctcaatcagctctactatggtcttacataattcttcgtaattctcctatgatgacagttggagaagatgctgatgatggtgtaaattatggaactggaaggctgtaaggatctttttgttgcaggggcggtgaaggatcaattatgcatttgcacttcacttctttcaataggcctaaaatatttattaagcatagactgtagaagctaggactgtttggactgaaaagaaaaagtgacatttgatgttcattggagattacagtaattactccgctgagtatattttgtttgtacgataagatattatcaaattccgttgctatgtttgatgcttcctccgtttgatgctctgaagttgatgcatataaactgccaagctaactcaatagcagcgttgaagtagcaaagcaccaatcctgctattgttgatcttgatcaaaccgaacacatggatttgagagggggattagtgggtagggagggattcatccccaacagagattgagtgacatgacagggcttcactcaatccctccctggattgattccccttggggattaaatccctagtaaccgaacaaggccttatggagcgttgtatcgatgtggattgttattttctatagttatatactatatatatatacacacacacacacacacatatatatatatacatatacatatatatatatatatatatatatatatatatatatatatatatatatatagaaaaactattctacacccagggtatagaataggcccccctccctccaacccaccttccctccctgcagggggcaaaacccactccacacctcagtcaaagctcccccacctcggtcaaacccgcccttcattttctccaccacctccactcttctcaactctcgtctcagaacaacgtagtaacgcgatgttcatcgtgcagtaacaccatgtcttacgtgcagtaacaatattgaaatatagtcataatatagtcatgacggatctacttttgataagcacttttttctaacatcatggtccaaacggtttttaaaagtagtacatgatgtgagagatactaccctttaaagattggttttttataaatttgactctccacgaggagtaattctatatcataagtatcactgctgatctgctatgcgttactgcaatcacataatatcgttactacaagatgtagtaacgactgtaagtttcata

SEQ ID NO: 64135 - DNA, 1861 bp, Oryza sativa
aaatggattcagacaatctgtaggcctattagaactgagagcagaaaaaccaagaaagataaaagagggaaattcacaactcccatatctgcgtggagacgatggccagaaacctgatcccggtgttaacacgatgtggggcagcaggccgccagcatgggtagcgtggggtcgacgcggacggcggtggaggcagcgacagcggcggcggcagcgcgtggacgaaggatcggcggcgtgcgcagcgtggggtcggtgcggacggaggttgtggcgtcgtcgcggatggaggtggtggtggcgacgtcttcccggccgcggagggggcggcgtcgcggacggaggggccaagagaggagagcgcgaggaatgggccggtctgcagcgggacgacggcgcccctcccctccgctcccatgctctgcttgcgactcgcgatatggggatcggagcggaggcggcgatgcgggtgacggcgccggtctacagcagcctggaaggggtggcggccttgcgggatttgagcggagatcgcgggcgcggcaattagggcagcgatgcggttaggggagggagggaggaaggtgagacggcgcgcgggttgcgggatgagggggagatcgatgtgcgtggggctgggggatgcagaggtgaggaggtggagatgatctgatgcgttggattctacacggatgatctgaacccttgagtgttgaatgaaagaatgaaagaatgagtgaaactatttgttaaactatagggtatatatacgagctgtctagggttgtgaaagtaatcgtacgccttagacctattaccacccatatataactgcatcaacgaaaacatgatgtagaggtgattttcgaattacctctaaaatcgtgagttctatactacagagacaattctagagccactttaaagattgattagacaacttcaaccctagatactttagagacaatttcaatatattttattgaattttatattgtagaatattcttttagtaaacaatcattagtacataaccttccatccatgacggcctctcacatgccgaaaaagcgggccgtcacaaagaagtcacctcaatcgggccgaaaaagcgtccgattgatatatggtcgcatagacacgttagataggcataaaactcaggcccgtcactaataacacctatccgtgacaggccgtagtttaggcccgattgagatatgaaatcatatctcaatcgggcctcaagttagcgcccgtcacggttaactcctatccgtgatgggtcttagtttaggcccgattgagataacattccatatctcaatcagacctcaagttgacgcccttcatggatgaccatcatccgtgatgagcaccaacttggggcccaattgagataacaactaggcccgtcacagatgactcatccgtgacctattgagataataactaatgcccgattgagatgacttagtatttttcaacttttcatatgaaatgtttatatttgtgagttgaccagtagcaaaagaattaactgcagtataataacattttattagtcaaaataattttttgggtagtaaatgatttcaaatggaaaaattttcaacaacaaagttgtataacttatcaagatttacaacttttattttggtcatttttctatataacttgaatttgaatttgaaaatatgacaacttcaaacaacattttcaaatactaaatgatttcaaatgaaaaaattgtcaacaacaaagttgtataacttatcaagatctataacttttattgttgtcatttcttcatccgacaaagtgttagtaacattgttcacacaatttacatatatctgtt

SEQ ID NO: 64136 - DNA, 2173 bp, Oryza sativa
aataaatcatccgaagaaatgatttaatttaacctacgaggtgaatccttaattaaataaatgcatttaataatcagaatcggcatgggaaatttctcttggattctacatgtcaaaatatgctaataggattttcagtggaattttcagagccttggaaataattttaaccaattaaaataagcaaagtgcaatatttaatccttgggaaattccttttctttttctctttttcttttcctcatttttctatcttgttgggccgtcggcccctcacctcccgcgtccaccccttccttaccgggtcggcccgttttccctcctcctcccgaagtccaggctacctccccctcactccctcgggcactgataggtggggcccacctgtcagccctttccccaacctccagccgctcccccgagccggcaaccgccgccgcgcgcacgccgcccaccttccccgccttccccgcgtcccgctccagcacgccccgccttccccgcacccatgcccccacttccgctcgcgcccacggcacgagatggccgggattcaaatttgaatcccgcctctctctctctcctcctccaacttccccactaactccgacgaaatcgaaccactcccggccgttcccgacctctccgcccctatataatccatccccacatcctcctcctcatttttccttgttccgccgacctctcccgagctctccaccgctcccgcaccgtgcacccatccgctgcggtctcttccactactccggtcgcctctagccgccgctagggccaccgccgcaccacaccgtcgccgccgtcaggtttgcgcggccaaggtccacctcgtccacccctcctccgtcgaattccgccatcgaaggccgccatccgccgcgcgccggtgagcctttccataggtcaccctagtctagtctaatgaaattaattagtccaggtgggtggttgggcctgttgcaacgtggtgtagcgttggacagtggatggttaatattgattaattattacaactgtttactgctttcaactactgtttataaatgctcaatttatgcaaatgaaccgctttagctatcctttggttatatcctgcatcataccccctgttccggtatgacttgctgagtacggtggttgtactcagtcttgctctattttccccaaaaccccagagtttgagtatgcgtcggatggtgacttttccgaggagtaggcttcgtccgtgccgtcgaggatgcctgtggagtggtgttcccactgcaatccaagtcaaggcttagctccatttatcttttaattttccgctgcatttatgtaagacttttataatgtttttaagacgtggatctgtatgtcaactttgtcgtttgtgtaccccgggcggtcctggacgagggttttaatgcacattctgcatggaattctattcgggaatttctgggcgtgacacttccccaccgcgccattgttggcgactgttaaagcccattgtataccgctaacatctgcataaagttcacataataaaacatccaacatactgataggtgcttaatctcacatattccagaagtgttggtgtatatttgtatgcaggtgataaaccctgaatttggtttctcattcagggagtgcgaactcccagcggtgggtatggtaagggcttgctccggcctttgacggcgttggagaaggaggggacagcggaatcccatagccctccacctatgaaggtgaagcgtcacttgacgcaccctccaattgtaagggcggccggccaatttcaaggagatgaagtaaagtcgccggagccctcggttcataagctagcatcgcaagtaaagaagctccgcaaggagaacattgagcttagggaccgaaatgcggagctaggggtagaactttttgaacttaggaataatgttgatacccttagtcacggtttttgcgctaaaatcaagcgtgcatttgtagaaatggggaaggagaataagtattatgctaattagatgtctcctctcccatgaataaagtagtagtaggtgcttggtttttatcttttccaattatgtaagaacttgctataaataatttggctcattggtgttaaccccaatgcatgctaagtttgtttttgtttttttctaataaa

SEQ ID NO: 64137 - DNA, 6821 bp, Oryza sativa
aaattcttcatatggttgatattgtatattcattattctcagctgaacttgtgcttgtgaacaaccatccatgtttagggaaccttatgcatctaagtaattgctttatttgagatgattaaagatgaaaggaattcttgcaacttctgttatgactcttgggagtttgttttcaaaaataaaattgttttaagaagctcattcctccaattgacttcattttatacctaccaaggccatatgcaagtatatcattgataaaccttattatgcatatgattgcttgacattatattgagttttgtcaaatttatgtgactcgtgttagatatctttcatactctcatgatcaaggggtcatttccatttttgtttccacatatataatacaactaagcttctacactggaagttggcttcccacaaaaatttccatccaaataaactcctacattaaactatgctttcttctcctcgaaaagttcttggtaaaagaaaatgagaaaaggagggaaaggcatgactataagaaaaaaaagagaaaaggaaataaagcttgctctcaaaacattgagcatgatgaaaagaaaatatagccatgccccttccatattcatgccaagaaaacaaaaatggaggagaaagtatagggaaaagggagaatcatttctttattccaccattccacaaaatattttacttttctatgttctaccacaaataaagactcttgatctaggagtatgactgatgatcttcttgagtccgtatttttggctttgcaatatatatgatgcaggtatgtcacaatttgtccctaccgaactccacatatcagccttagaataggggtaaattctggcacattttgccttggtgaagatccaaaaagaaaatatatattcttgagagataagagagaaagtcaatatgaggaaaagagctggtttgcgaaaattcattaaaatcccataagtctgacagagaagcaagaaggactggaatcgaggtcattccatctatcaattgcttaagatggtaagatagccactaataaggttcacaggtgcaagtatggttgtgaatgatttatattcctgatttatatcttgaagaaattcattctacaataacctttactcaaggacgagcaaagagctaagtgtgggggcttttgttggcgactgttaaatgccgattctatactgccaacatctgcataaagttcagataataaaacatccaacatagtgataggtgcttaattaatctcacatattccacaagtgttagtgtatatttgtatgcaggtgataaaccctgaggttaggagaaaatttagagtaaagtgaggagaattatgtatccatacaaggatgggttgtgaacttcatcaaaacactagagaatcagccaaaaataccaaagaatggatagaggaggaccaggggaggacatgggccaaagccaaggccagatgggcccagcccaggtttggtcgaaccaccatcctcaccgtttgatgtggggtttggcgtggatgtcccagatgcatccttgatgacggttggagggcactttggaaatttccccttcaccaaccgtcacacctacctctatgtaaagacatcactccctcacttcactcacacacttccaagcttgagctgaattatatgaggctctattggactatattgtatactagaataggaagagagtagagtagaagaagtcagaagaatttcggagttgtcggtaatcttctctcatttcttttattctgtttttactctgaattcaatataatattcttcctcagtaatttagatttatctcgtgagaattatctcttggttagttcgtaaatagcatacgggatcattgttcactatagtccatttatttatagtgattgctttagtttttgatttgcactagagtagttattaattgcgtagacgcagtgtctaggtaattaatttccagtggttgctgcgtatcccgcagtacgtttgaggtaggtatagaggtggtgacagccctcaagagcacttaagtcctccctgtccgggtatgtagtagagcgacatatgggaacaacggattgccagtgcttgtagtattgcattaggattaaagttaagctttccctaggcactatttctcagtagtaaatcctctctgtcctggcctatcatatgcttggtgtccttggatgaaccggaggaagatctgaccacacacgttctcttggattcgatacccattggaatactccgtaggggaagtgctacatcggtatatccgtgcgcttgcggattctatctatgattgtaagaattacgaatagccatctgcctccatggcggacagcagatgcggcatcaggaagaggacgcgaaggacgagaggtcgttctcgcgtcagccgtgcccgccgcagcaccctcccgaccgcccgccacgctcgcctcccctcccagccacgccccctccatggcacctcctccacgccacccgccggtgtctggagcccacctaccagtccccttcctcgttgcgcccgcccccgcttgcttggcacgcctgacgacgtgccgccgcccaccgcccgcctcgcgggccgccgtgcgcaccaaccgctcgcacggccgcgcctgatgacgcgcgagagagagagagacggaatgaggggaagaggaaaaggaggaggtgggagagaataataggtgggccccaccatgtttttttaaaaaaaaatgctgactgggttgccttttaggacaaaacggccctggattggatcgaggggggtaattcgttcggtattgaaagttgagggtgagtaatgtttggcttttcgagtttaggggggaaattcgtacttttttcatagcaaaattgttttggtatagggtaccggttgctagtattggtgccggttgggaaccggctccggcacctatgatggtttttttacttgtgtgcatatatattgtatcaatgttgttaatatttttcctttttttacaagtatttcaatgtatttgagacaaatgagatataacatccttgaggttttaaaacagtttcgcgcgccattgaagaaaaatcaaggaattaatggaaccgacagtaacaagcatgcacgtgtacgtgttaccgtgaacagtgaccggagcgtgtcacggtccagcccggccgagtcattgtcccgcgccgcgacgtcgagaagcacgtcgaggaagtcacccttcctggcctcgccggcgtcgcgctcgctcagcctctcctccaccaccgcgtcgaacacccggtggagccgcgcaaacaggccggccatccgccgccgccatccctgcaggtccgccgcggcgatcgccgggaagaagtccgacacgttcgggcaaccgccggcctccatgatctccacgaccacctccttgaactccatggactcgccgtggtcgtccaggctggtgaggttgcgggagaagatcgtgctcgagaggaggttcaggctcgtcgcgaacgcgacacggccgacgtccaccgccgccgcgccgccctcgcgctccgccagccgggcgacgtggtccacgagctcctgcaccttctcgcgccggagacgccggagcgcgtcgagccggtgcggcgcgaacagctccgccgccatgatcctgcggagcgcgcgccaccgaggcgagttgggcagccaggcgacggagttcgtggcgtggtcaccggtggcgtcggggacggaccggctggcgaaggcggcgttgtgcctctgcaggaactcgcgggcaacgtccggcgaggagacgaccaccgtggtgaccgcgccgaggcggagcgacatgagcgggccgtacatcttggcgaggccggcgagcgagcggtgtggctggtcgccgagcaggtgcaggctgccgatgagcggcagcgggcggggtcccggcgggaggaggcggcgggagtgtgcaaggaggtcgaggaggtagacggagaggagagcggcgagaagccatggcagccatggaagaaaagaagccatttgttattatttttggttggtggggtgacacacaatgccggccgttttatgtatgtatgcggcctcgcgagggtgagagcttgttgtatttttccaaattatgtacatcattcactaccagtagctgtccaagtgattctccctgtgaaatagctgtcaaagtcgatgtcgacgtgtgctgaatggaacgttcgggaacgtatatattctagtggattttttttcctatttattactgatcacaaaaaagattaattatccattttttccggatataaagatataagtggtgaagttaatttggatctgtttttaatattcgaatttaatccaccaccacatttttttacatcactattgtacagtcaacatataatatactagacttgcgtacccacgaataagcccataacatacgctcataggaccgccacttttgtaacaattacatgacacatgcgtgttcatcattaatcatataacgttatacttacacacccacgaatatgccccattacactactacaaaacacctaataggtgctggtttaacaactatttaccatttcctatctccacgagacgacaaatctagatgaaaactgtgctaaactgggcctaactaaagcgtaaagaacctctagatttagccccgtcaataataatacatttattttcgcatggaaataatatgaaaacactattaaaattaatttcctagctgtgcgccctctccctcacttttcctccacttctctccctctctctctcacttttcctccctccctatccctctactggacacaacagcagcgccgaccacaaccagcgatgacgaaagggccagccacaaccggcactggcgacggaggaggcggggcgcgcgacccctcaccctccctctctctctccggcagagaggaggggcagcggcggtggcgtggccatagagggaggttgccgatggcgtgcggaggaggcaacatggcccccccttcctctcccatatttggctcccctcccctcccagatctggcagagaggaggggtggcggtggttgcctgagaggagggtggcagcggtgcggctcccctcctctccctctccctcttgcctcccagatccaactgaggggaggggcggcggtggcagctcggctagaggggggaggagggagggaggtgttgccgggggctccggcgatggcggtggcagcggcggcacccacccatggcgcagcttccctccctcccttttggatctctccctcctagatccgaccagtagggggagggggatggagggcggttgcggcggcagcggctcccaacggctctcctcacctcccctctctccctctccctgccaaaaccctaaccctagatccggacagaggtacgagggctacggcggcggcgcagccggagacggtagggcgagcacgggtggggttggtggtgatttttttttgttcgcccaaaatattttcgctggcgtctcgctatagcgcctccaaaaatgaaaatgccttctacgaaattgatttttacaagtctttgcatattggcgtgtctttccctccctggaaaaataattttttgtcgactgggacaacgattttcctagttgtgggagggtggccggctcgttgcaacctcgagctctcaacgctgggctggagcaggttgttggccgctgtggcggctgttgccgggactgtggggcggtggctgttgctggcattgtccaggcaaaagcagagaaacagccagcagatggagcaacagctgtaactacaaccgctgtgtttttttcacataatatctttcaaacggatgttaaaccattgaatgcttcactgagcttttttcaattttcgttttatataaggtaaattttgctacatgacatcgtgactttgcggttttagttgtaggacaccgtgcgaagtgacttttggggaaagacactggcaaaaattggatatttgctggtgaacaccgcacccattaaaataataattttcggtcgaagaggagaaagaaatcaggtaaaagttctaaaatacacttggacccgctctctcatctcttttctctccatccccgcaccccttcctcccctgcgttggccatgtcagcggcgcctcgcccttggtgcggattatggcggcgccttcgcggatgcggcggagcgcctcgccaaggtcgcggcagccgcagacgaagaggacgcggaagttgtgcctcgccgatggcctccaagatccgggcctccacaaagtgctcaatgcgggccttggccatgactgggatggtgacgacgcacttgatgtcgtggatgagcaccgggtcggacatgtgggcgacgctgcctgcgcgcggatgtcggcgaggatgcgcttccagcgccatgaccgcgcaggtgccatgccagcctcctcggcgaggcgtgcctgctcgggtgtgacggcgcttgccgccattggaggaagcccctcctgtggattttgcctgtggcgaaatgaatggaaccgccttggcggcgccattccccaccaagaatgtgcggccaggtggttgctgaccccaggacgacaatgggcgcggtcgtggtggcggactgcaatgggtgccggaatggtctcgggccggcgtggtcaggccggcaaaggacgacggcggacgcgattcgcgcaaggacggcgtgggtaggccgacgctggtagggcttggtcatcggtatgtccttggtgtgcagc

SEQ ID NO: 64138 - DNA, 1621 bp, Oryza sativa
aataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaatgcaaattggccataacaaaggaacagattcacaccacccagtgacattcaaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaacgtaaataaacatgtagatcataatgttagatgaattatgagacttgaacggcctcattctgacttcaaataaatttattatgaattttacaagattaaatctatttaaagcccatttaaaaagaattaaataaatttaattcaatttatggataattttaatatgtagatctttattttatacaacttttgcatcttgaaccacattaaactgagctaagatgaattagttatgaatttttaaagattaaatcggattaaaacacttatatggattttaattgaattatgacgcaataatgaattatttttgaaaaggaaaaggaggattattgcgtcagcggctagggtttgcggtggaccaggggcacggcggcggttcaagggaacggacggccgagatcaaccctatccaaaacggactgccgagatcgaacggtccacgaccggctcacggggaacggcaacgatgacgtcagcgatgacggcagcgatgacgtcagcaccggcggcgactcgggcggctcggacgcgcatgctcgccggcgaatgacagcgcggcgacgcgaacggagggcaccaacgggtagagggcgacgcggcgaactcaccggtgaccaaaacaacggcggaaaagcaacggacggcgccg

SEQ ID NO: 64139 - DNA, 1390 bp, Oryza sativa
aaagcatttttatttcggtggtatgggtgatcctgcctgaggaacctccgatggcgcatgtacatggtcttccgacagtgattcagccacttgcctcctgtttgggccatgcaccttacacatcgctttcatgcccttcaccgtttggcccgacgtgtttccaagtgctgggtagtctgttattttccctaacaaaatagcccgacatatgaagtgttctcgcttgtacgcatcccacatccgcatgccttccgtccatagtgtatgaagatcctctaccagcggcttgaagtacacatcgatatcgttgccaggttgtgtaggcccttgaatcagaagtggcatcatgatgtacttacccttcaaatagatctaggaagggagattgtagataataacagctactggccatgtgctatgacgactgctcatgttaccaaacgggttcatgccatcagtgcttagtgcaatcctcacatttccgatgtcgtgagaaaactctttttggtacttcctatctatctttctccactgagacccatcagctgggtgtcgtatcattccatcttttttacgctcttcgtggtgccaacgcatcagcttggcatgctttttgtttgcatacatacgttccaaacgggggatgattggaaaataccaaacgaccttcacctgcactcttttcttatttccaccctcatcatccccgtctccacacttatagcgggaagccttgcataccgggcattgctccaaatatgcaaattcaccacgatacaaaatgcaatcatttagacaagcgtgaattttctgtatgtcaagaccaagggggcatataacttttttggcttggtacgtcgattctggcaagacattgtccgtaggaagaatttctttcaagagctctagcaactcagtgaagctcttatcggaccatccgttgctcgccttcaggtgaagcagcgataggaccacttggagcttgctgtgctccgccttacatccattgtaaattggagttttggagtccttcaccatggttgtgaacttgtgatattccttatcatcagtgtcaaatctctccccgtcgcgcagcatctgatctagatttggttcaccgtgatcgacacatgtttggtcctcctccttgtagccgacatctgcatcatgcccgtgacagttgccggcacttccctccccttgctcctcctcgccaaggaagttgtccataaaaccctttgtaaggagatgtgaatggacccgctgagctggaagttgtctgtctttcttgcccaatttttaaaattatggcatggacaccaaatatattctagtgcatcgactgagtttgtgctggtggccgcggcaacgagagccgttactcccctga

SEQ ID NO: 64140 - DNA, 2939 bp, Oryza sativa
accagttagactatttatattgtttttttatttttaaactaaaacgttagtacgttctttgagaaaattttgctatgtaaattgagtttttggtattttgaaattttgtagtgtggaataagaccacccatgatttttttttggaaccaccgtaccactggcggttcccatcctctctcggtggagggcccaccatagacaacgccgacacagagcaacctccccttttattcaccgacactactacaaaacacctcatagctaggtatcggcaaaaaggtatcggtttatttaaaaccgacatctattaccgttttccacctctatagactgaaaaatatagataaaatatggtacctatatttatattataggtgtcggttctagataaaaaccagcacctataatattagtaacagtttttttttaaaaaagtacctaataaattgtaggtgccgatttaaaaaaaaggtacctatagtttattataggtaccggttttataaaaccgacacctatacagaggtcagaggcagacaagctggccgacttatccagctacctgcccatacttatccatatattatatctcgccatccatccccctcctctaacatctcttctctcgctcctctcctctccctttgccttcctatctggcagagcagcggcggtggccctctcccggcccaggagcccacccgctttttttcccttttgcttttcccttcccaactttggcaggaagtggagaggtagcggccgcccctgggtggtggcagctgacgtggaggccggtgagatcgcagcagagggggccgtggtggtggtggaggaggctcgttggccccctccctctcggcgaccctcccccttctcctacagatccagagatggcggcggtggagaagactgcgggcgaggtggtggccgacgcagaggctggtgcggcgaggtggtggcggcggcgacggtggtggtggaggcttgcgagcatagtacaaaaaaccaggccagaggttgacccgctctggccgtcggttcaccggtcgaactgccggattttatttatttatattatatttgatttgccttattttaaatatagaaccatcacaaattggtgaaaatatgcataaacaaacaagtatatcttttattatatggccacaacataaaaataaaataaatgtagtgtggtaacataataaattcatagtcatagaacaaattaaaaaccggttcatttcttaaaaaccgccactggttcactggttcccatgaaactgtctggttcagcgtttttgaccggttcgattgcagggacggtctttttgctaaaccgagccgccaaggttgtgccagttccggtttttttccagttcaaccgctagtccggccccctttttttttttttactatgcccccagcgcggcgtggggtggcggccggcacagcgcgtaggccggcgcggtgaggtggcggcgcagtcgccggatcggctccatcggcgatttttaaaaagaaaatactataggtgctggttgtgggtgaagaaccggcacctatattctctataggtgctggttctaaaaccggcacctatatctatgagtattaatgccgaccaatagatgtcggccgaaaaccagcacctataatgatttatgtactagtgccaccatcgatcccccacacctccacaatcgagcagagagcaggataagaccaagacgagcgtataggggtgcgtggagcgagggcatgagaaggaagagcagcggaacggagcgaactgggacgcaaggggtatcgtcctgatgcatggggacgggatcccggtgtatagttttcccgttattttttgaccgagggcaagaaataaatggccagatgcggaagtcttgttttcgcaatggacaatggtaagtcgttactcgttaattggcagcagaagcgaaggatatgaaagttgaaactagctagccagctacgtacgactcgattgaatacacctacgtcgttgaaatagagaatacgacgttctagtagccacttttgcagtaacaagcaacctctcaccttagtcagctagctagcgcatgttaatttgcagatatcggaagcaatcaacttgagcagtacatgtagatgtagtattcgtactgcctgtgttcgctgttgctagctctctcgacgagatgacaacgaggtatccatgcatgcagctagctcagtagataagggaggtagctactacgttgcagcactatagccctagctatagcttggcagctactaaccatgaaggagaaggacacgagcaagcagctgctgccgacgcgggcgtcgtcgtcgtctcgctttggcgggaaagtgggcagcaatatcgcggtcgtgcttctcctcgtctccttgggcttcgtcctcggcctcacctcctccaacgccatgttcctcaaatccttctacccctcctctctcatgccatcatccatggcgccattgcggctagtgctatcgtctacttctacttctccgtcgccgccctcgccaccgccgccgccgccaccgccaccgccgcagcaacctgcaccgatgcacagcatgggagatgaggagctgttctggagagcgtccatggcgccgaaaagccggcggcggctgccggacggcgtggtgccgaagaaggtggcgttcatgttcctcgtgagaggggagctgccgctgaggcccctgtgggagaagttcttcgaggggcagcgaaccgatcactactccatctacgttcacgcccacccgtcgtacagcttcaccggctcgccggagtccgtgttccacggccggtacgtcccgagcaaggcggccaagtggggggacgcgtcgctggtggaggcggagcggcggctggtggcgaacgcgctgctggacgccggcaa

SEQ ID NO: 64141 - DNA, 4261 bp, Oryza sativa
accgcgcgctggcgctggaggtcgccgccgacgacgagctctgcttcccggcgttccgcgacttctgcgtcgggcgccgcgagtgcctcatcgacgagcactacctcgcgaccctggtcaccatgctgggctggggccgccgcaacgccaaccggacgctgacctacgccgactggtcgcggccggtgaaccggcacccgcacacgtacacggcggaggaagtgacggagaaggtcatcggcggcatcagggcggacaagcggtgctcgtacaacggcgccagcagcggcgggatctgcaacctgttcgcgcgcaagttcccgccggagacgctgcagccgctgctccggttggcgcccaaggtcatgggcttcggctaataaggtgacagatcgacatgcatgctcgcttcattccttgcgttaattggaagagatatggcaaagcatgctgcaatgcggctaagctggctgcatgtagttgaggcccagagaaaaataattttcgtttaattatatttcgttcgaaaacatgttgatcaggtatatataattaatctgtttctggctgatttgtgttgttacctgagaaatacacagattggctttgacagaacgaatgaacgatattttgttttgacaaaaatgataacttgtcatctttgcatgtcttatttatgtgtgtatcagttgacttcgttgcaaattcttggtcagcgtaaggttaaacaacatgcatgtatattgatcttcgagccacactataaaatcatggtgatcactaatatatactagttgtgatgaagatttcgctaagaatatattgagaggtatagttgtgaaaaattggttttgagaacgcagtgtttgtgcagcggctgtcggcactataaaaactaattttcataggcaccatatattttactttacatgtgcatcaattaaaatccgtttgtaataatagcaataagctcatgtggtccaaacctgcatgaaatcaaattccctagacggttggtcacccgcctgtgaaaatatgcctttgatcataggcaatggggccggccgacgacagggcctgccggctacggagatccattttatccgccaccaaaaataatgttcgtagtagtatgatcagactactatggagaaacctggtcaaaccaagcttcgtaggtccaactataagtgtgagggatgtagtcagcttggaggatcgactagacatgctatatgaagtcagaccaagatgagatgcgccagtcatactagatctagagaggaattggtttcggttaaatctttgagcatcaaagttgtatcgatgttttcatgccttaatatgttgaatgttgtttttgggttaacatgttagaagtataatatgttagttagagataagagtcaaaaacaaattatagagataagatatatcctaaagataagatagagttttagagatagaatcctaaagataaatctactcttacgtactccaagtctctatcccctatgtactcctatatataccttatgagagggtcgatctaatatatgagaaaacaacaaaatacaacaattagatttttctacatggtatcagagctatagactagcgtctatcgatcctcggtacgatccatccatccttcagctgcccccggggagatgagttgaatctataagctctatctggggcaacgcattagctagctagcctcctattcattagatatatttcctaataattagtattagatcaatttatttttagccacgtcgaaccctacgatctccaggagccaacacgatttcgtcagaagccgtccctcactagaatcattaagcagaaggcgaggccatggcgaatagcaccaccgtccaagtcgccctgaagcccgagcgacgggaacaccagaccgcatctagtcatctactactgcatccatctactcaattgagaggagaagcacatggtgcacaggagaataatattctcacgtccaacaagcatcaaatcaagcgtcaaaacaccaagccatccccatcgatcatcatcgccaataacctaccaacggccacgacctaagccgcaactgcttcctcctctacaccagccatatatttgtcttcaccgacaatacagcaccaatggtcttcatcaacacgctgccgccgtatcgtccacaagcatggacacatgcgtgtcctctgacagattaatctgcaagacgcttcatcgacgacaacatcgattacgtcctgtacgacggcaacgaccgcgtcaccgatgacggcatcgatcacgtcatttacaatgataacgactgcatcaacacggcatcactattgtgattactgctacacgacccagaaggatcaaccaaaagtggtagcctcattgccaacgacgtcctttgacatatgcaagacgtccctaatgtcatcctttgacatatacaaggtgcaagatgctaaaattgcagtttttgtcatcacaccatggcgtaaatatttttttttgccttcggctatttgtggctacaccatctaccatgactaccacgaccgcagctactacatgatcggctacatcgacgaacgtctacaacaactccagttaaagcgtccgtgtcatcgctatcgtccatgacactcccgctatgactacgggagggaataggggagagtcaagcgatgacacagaaggggacgtaggcaccaagtggaggaccgtctatcagagatgcaattgatgatggtgacttgaaaaagatgaagaaatagaagatttcaaatccagtcgcaatcgttcgcttcgctcccgttacgactgagggggatgttagaagtataatatgttaattagatataagagtcaaaaacaatttataatagaatcctagagatagaatcctagagataaatctactcttgtattgtactccaagtttctatcccctatatactcctatatataccctatgagagggtcgatctaatagacgagaaaacaacataatacaactacataacataagtatgaaaatactttggaccaaacgtccgacgggagacaattcatcggatgctacacccaccgagcccacttcactcccaacgaccatccatccctatccccacctctctcacttccctcatctctcatctctctatccaagcagtccgctgtgataaacatgataaatcgtgcgtcgccgccactcctgctacacactcctgagccgttgtcaacctgccgtcgccgtggagcagctgctgaccttgccgatatcgaggcatctcctgagctcgtccaatctcctagcaagcaagctaatcagatcaaacagtagcaaatggagagggagcagtagcccgatcgagctaatgtcgtcgagcgtgtgcctctctgccgccactgatgttgacgaaattggtctcctacagcttccaatgaaaatgaagttaaaatctcatgctcctgtcaccaacaaaactagcagccaaggtcacatgttgcttttcatgctatggagcacatgctgctcggtcctcctccatattaatggcgtattgatcttgttgtaaaagcttccgaggtcagggttctgggattcaatagcgtaaaaatttcgggacctaccaaaatggatgaatctcggaaatttcagatgaaatttgaccgaatttggtgcaaaattcaaacaatcattaaaaaaatgggtaaaatgatcagagaaccatgacaagcatcaacacaccaccaaaataccatttaatacgcattaatgcatagatctaacaaccaagttcataacaacatacatagacttagcatgcaaattcataactgtgtagtccattagtctaattcatcaccatgtctaaggtctaaaataattacagtctatccatacatacacccaaaagaatactaaacatatatccataataaatattagtcatgtaactgtcgtcaattgctactgccactagctccatatgtgtagatgaattcaatcaccatcatacatgcattcataaaatactttgtcggtgacatggaaccgggagtagcatgactagaggcttgaggcagacacaatcgcccacgtggcctggcaccctcggggggcgtcgggcccgagggtgatgcgttcgccctcctcttagtccccccgagagggtcgggccgcacccccctcggccccgagggccgaggcgccccgacccctcgtgggtttttgctccgcgtg

SEQ ID NO: 64142 - DNA, 1688 bp, Oryza sativa
ccccgtgcgtgcagtgtgaccgtgccagtacatgcagccgttgcaccaacttccactgttactactagctaaggagtagtagagagtactgtagtaaaggttttctgcgagaattcgttgacaaattaaatccatcatcaacttctacatgaagcacgcactgtacatagcggtggaactagtggagtgcatgtacgagagacatcatgggcaactaatctcgcgcgctaaaacattttgtatagatcggttggttgttaatgcgagtgacacatgtgattgctcaaccagacatgcaaattaaatccactgttccaatcacaaatcatcaatacagaacacagtgaaatccgccgacacgctccgctcgatccgagctcgatatggtcgatcaacaacacatctgcgttgcattcatccatgtttgcatcgtcttcttcttttttgttttttgaaagattattcatgcatccatgcttgctcgttcccggaatcatggcatcgtcgtgcatgtgagccagttaatcaacctgctggtgtgacgaagctcgaatccacatttgctcctgaagggcaaagtatagtgatagacgtacgtgaggcttgcttgctcgtatatgctataataaatttattattaatggtcagcgtggtacctgtaattattgtcagctgcacgatactcctacccccaacgccaacgacctctctatgcatgtgcaaggggaatttgcgagtgagtttactaatccaaagtcaaattcctcatgtctccaaatcatcattccttaattaacaacgcaatccgatcatttcgtgtataatgagacgaaaaaaaaaattcccgtattagattaaggccttatctagttggggaaaaattttagatttggttgtcacatcggatatacggacacacatttaaagtattaaacgtaatctaataacaaaacaaattacagattccgccagaaaaccgcgagacgaatttattaagcctaattaatccatcattagcaaatgtttactgtagcaccacattgtcaaatcatggcacaattatgtttaaaagattcattttgcaatttatacacaaactatttagttgatttttttccacatttaatactccatgcgtgtgtcaaacattcgatgtgatgggtaaaaagtttatgttatgggaactaaacaagacctaaattcccccgaaattcttgtgttacgaaaggaggctctgaactccgattcatgcaccatccaaagctgtggctaatcaaccgttcaacaaattaaatccaacagttcttaaaaaaaatccgacatgagacattttaagtggagtgtagttttggagtttttttttctcccattggatacaccataaagtgtagtggatcaaggggccgacatggttgatgcgtgtctgatgaagttcataaattctcggagatgagatattgaaggcgcgtacagcatgcgtacaggaagcccattacgctggccacggtacctttgctctctctgacaacgatccacgccgttttatctagttggtaagaatacccaatgcatggattaaaatgaaagcaactttcaatgatctgtataaatttccatggacactatggccttggcatgcatgcgtgtagaaacagaggtacatacacgtacatgtatatatgtaccaa

SEQ ID NO: 64143 - DNA, 1817 bp, Oryza sativa
accgggtaaaggcagacggtgagccgtggtgagtattagaatttgatgggataggcccaatttaattgtagtatttttaatgaaaccaaaattaatgttaagggattaatatcatcttaaaaccaatgagaagggacctagacttaaataagctacaaatggatagcacctattgatagggtggtggtaggactgccacacacgcgtgcgcgctgagctaagctggggacggggacgggacgggagggctttcttgccttcccctgtttcctctgctggcaatgtcaaccagtaccaggaatggcggcaatgaatgagaaaacggtggcaaaggaggagagaacggccacaacaacggaggcaacaacaacaatgccttatctggatccaaagcgttctccgagcatgttgttctattcactttagtattgaatatgttagtagatgatgctattcctgttattaatatgttcatatttagaactatcactagatcatccttttattcacatgtcatatttattatcttatttttctgtattaaaatttacaagactacatttccaatagtgaggtaggcgatggcgggcgaaagggcggtggactcgcgcgaagggcagatggcgagcttgcgacgagacacgcacgcaaggtgcttgaccgcaggagtgggtggagcgagaggcgaaggttagggcagtatgtttgtggtccgctgaaggctgagttctttcactaagatccctaacttccatatctcgtttttctcattcacgctttttaaactactaaatcgtataaaatttgtgctttaaattttttcaaaaaaattgtattaatttattttcttaaaaatatttaatactacacttattaattaatcataccctaattattcaccccgttcccagccctaccaacggaacacagcccccagtcgcgcgccgcccattattggagcacgccggattcgtggcaatagggtgcgggtgacgtgagccacagtggcaacttggtgtggtcggcgcggcgattggttcgatctggttcgcggcggtcgagtgtggtgcgggagcgggagcgggagccggagcggcaagacggtttcgatcgggcgcacgggagacggcctccacgattcggtcagggcggcaaatgcggcgcaccagcgctatcgcgtgggccggtttcgcccggtgcgctgcggcgaagtcagcgtgcgcgtgactggtggctgggccacttcggccttgctgccggtctggaccagttaggttaggtcagctagcctgttgctgggccgctacgaatctgggcaagatatgggctgcagcatattgaaaggggagttttttgttttcaattttattttattaaaaaatttaaaaaatatttttttcaaagttttacagatctacacccctaatatccttccaaatgattttttatgacatggtacatattcattggtgtattctaacggccatatggaaatggtcggtcattttgcaaggggccacctacaaagtatcataggctagccatttacaggaaggctctagagaacggcaagtggcccgcttataaaatgttgtatgtcactattttatatagatagtctgcaaggggaccgccattaaaatgttcgcgtgactgtaacaacacaccaacgggtgtgtatcatgacaacataaagtgtttttaaaaaactttgaaaccaaaagttattttacgagagagcgttagggagtaaatttgtaaaactttaaaaaattgtaaaaaatatttaaataaataaaattagatattaaaaaaat

SEQ ID NO: 64144 - DNA, 1883 bp, Oryza sativa
ttatagtataatatagagtaaatttcacaaagctacaggtattttgcataatttatcacagaactacagatttaagagcttgtttcacaaaactatatatttagtgtctccgtttatcacaaaactacagatttaataacttgtttcacaaaattatagatttagtgtattcgtttatcacataactacatatttagtgtcttcatttataaccaaactacaggtgtagtgtcctcattattacaaaactattggtttaacaatgctaaaacctatagttctgtgagaaatgaagatattaaatctgtagttttgttaaacaattttttaaatatatagttttgtgatatattctgcaaagtacatgtagttttgtgacaacgaagatattgaatctatagttttataaaataagttcttaaatctatagttttgtgatagatcgtgcaaagtatatgtagttttgtgaaatttactcaatagtataaaatttgcagttttttttactgtaaaaacacagctcggtacagtggtggatctattgttggggcttgttggtgcgcaagccccatctgcatgattcccttcctctaattagcgactaatgactctaattaattagcatttagcgtaaatatgtactggcaaggaaagctagctcaagcactgaatgccaaaattaagttgccaatgtcaaatatgatgtaagtataccatactaatttctcgatagatttgtgtagatatatttgtatagctgcgaattaaaatggagaaagcaatgggatgttaattgatcatatgcatttggggtttcatccgaaaatacttagttgagcacgattgactaatacagtgacatcttctgtgccacaaatagtaccatgcgccgtcctcctccttgctaaaaatagtacggcgtgccgtctgccgcttatcgtttcttttgctaaaacaacaccgttctaccaagcttgttggctcgagattacacattcatcctagcaggcatgtatgcatcagctgccaacagtgcatgtcttttcttttccttcttataggatattctcttaaattactcatccgatttacgatccgattacaccgttttgttcataataatttaatctttataagatcttacatgattatattttttaaaaaaattacaaattattttcataatatatctaaattacttttagatttcattaaattatttcttagacatataaaagtaaatttaataaatcctaaaaaaggtaacttacatatatattataatagtaactcaaaataaaagaaagtaacttgtcacgacatcaaaagttaatttattgtgggggtaaaaacataagtcaaactaataattaaatttaatcaacataatatagaactaaccaatcaagtaaattgttcaccgaatgtctgaaattttttttaataaaatctaaaagtaattttaatacatgataaaagtaacttacatatataataaaatcaattatgtaatatttggttataaaaatttagttgcaacgaacatagtggtataatcagattatagatcggataaataagttagcagaaaattttataagaagaataaaagacatgcacgttgacaataataggttggcacaaaccccataccaacctagccttcagttgcataaactctggcttgaaatgataattttaccacatttagcaactggaccatcgctccttggtactaaaccaagagctctctcggttaagatttttcgtcaattgatatatcttagtttgtttcaatcacactttcatatttaaacacgagccctccctcaatttacatcctagattctccactggctcggtatcgtggttgacagtagtcg

SEQ ID NO: 64145 - DNA, 2240 bp, Oryza sativa
tggtgttagaaatggtgagtgggaggaggaacacagaaccaaccgttgagaaccaaaatgagttctactttcctgagtggatatatgagagagttatgaatgggcaggacctggtgcttaccatggagacaacacaaggcgagaaagaaatggtgagacagctagctattgtagcgttatggtgcattcagtggaacccaaaaaaccggccctcaatgacaaaggtggtaaacatgttgacggggaggttgcagaatctgcaggtgccccctaagccctttacatcgtctcaaaatcaacttgtgatttagatcatgagaccgcatcgccatggtttggactttggagaccagcaaagcaatggagcttggccagcatttcctataaaaaggcatcaccatggtttggtgcctgagtgagagatatgcttaatccacatatcagaaaatagttcttagtgagctgaagcatgcacatatagtgtttgattattaaactaaactgggcaaccagatatatgatatatcaccatgtactcttgtaatttgcaacatatctcaatggatttaatttgcaatataataatagttggaagatgacaactaaattaccttattccatcgttgatgctagtccactaatcatccttgctgaacaccaacaataaggtcatatttactcccagtgctgcattttcttttcaagataaaaaaagaagtgctgcatcatccagaagaggaaaaaaaataaaaataacaaaggaaggaagctaagcaaagggattattaccaaggcagcgaggctctggatggacatggactaataatgtgggagacggaggtggtgtgagcgacttgagaagacgaaacatgtggcatcaggcttggtggattcgaccggatctttgccggccgtcagcgccaccattgaagacacggtagcaacaacagatggcgccatggcggtacgggcgacggcgaggcttggtcacgcactctcgcatatgccgggaggaaacggcagcttacccatctgtctacggaggcgagaagcggcggcggaggcggctcgcggaacggcataccgccgcattaaccggagctctcgccgggaatagtggtgagggacggaggaagaagaaggggatttttttttttttgttggagagagggagaaggggatgattgctcggccacaggccggttaggatggcccacctaatcccccgcggcccatgaacggtggattgatctgacggttcacatgtagcccaattcacgagcaaatataatgcggaataagttcaccagaggtccctcaacttaacagcgtgatttttttgaggtcccttaaccacaaaaccagaaatgtctacccctaaacttactcaaaccgttcaccagaggtccctcggcggtatttttgcccggttttgctgacgtggcatcctagtcagcaaaaaaatttaaaaaaagtacgtagagcccacatgtcagctgcacatctttttttcttctcttttcttctccttctcttctcttttcttctctcccctctcttctccttcaggctggcggcggacgcagctgcgatggccgtgctcggccgccaccaccgccgtacccccgcgggtggccgacgatgctaggagaggcaccaccggcgggagaaggggaagaggcagaggaagagattgtttcttggtcgccggccgcctccccctccctcccaaactcgctggccgccgcgctcgctcgccgctgctctgccgcgcgctcgcgctccgctactctgtccgcggcctgctcgcgctccactgctcgacccgccgctgcgctcgcaccttccgctgctccgttgccacgctcgccctcgttgcgccgcccgcatccgtgctcgccgctccgccgccgcgctccgctgcctccgctcagccgccggacgaccgcaccgcgtagcctcgcccatggcgacgacgacggtagagagccgatgacgacggcggccacggcgcgcggctcctccgtccgcagcctgaaggagaagagaagagagagaaaagaaaagaaaagagaagaggaaagagaagaagaaaaagatgtgcggctgacatgtgggccccacgtgttttttaaaattttttttgctgactatgatgccacgtcagcaaaaccgggcaaaaatattgccaagggacctccggtgaacggtttgagtgagtttaggggtacacatttctg

SEQ ID NO: 64146 - DNA, 1511 bp, Oryza sativa
  unsure (1)..(1511): unsure at all n locations
catattttccccgaatagagatgtgtatgtaaaattcagtggtatccaactacttcccattgagaaagtataagtttcttgatacgagatcggggaatttcgtgattagcgttggcatgcttaacatgcccttttcataggggatcaatcggttctattttatgttttaaagaagaccataaaaaacaaatatcatatttattgatggacctattaaaacaaaatctcatatacatttatggacttatctgtcagtaagctaactccaggggcgtccttgggcccgtgcgggctgtgcgaccgaacagggcccctaaaatattatgtcctatatataataatattagaggctttaattttgttaatttgcagttcaaatagtagtaaaacaaggtccaaaacgctgcaaaagatgaaccaatccatcttccatcatactcctgtccaggcgtccacgtcgttgcgtattgccgaagtcctgacgccgcaactgcttcgtctcctctccccagtcccctccggcctccgcttctacctcatcgctgatgataggctgatcaccacgcccctttttaattttactataaaaaattactaggctactagggccccattttaatattttgcacacgaacccgatttggcctggacgcccctggctaactcaatcaaccgggcataggcccaggctccctggttcggtgcagggatgtgatacttggctagtatatgtggttcaattatttttatttctttggtgtttagtctctactattcttatctctttaccacattgagaaagtgctggaaaattccggaataccctcttttatccaatggctgagatttattttatctattttgtcacttcatgaatctaacggctaatattaatatgatgatgtggctcatcctaattgtattttaggattcactttacactagtagaaatttgaccaaatctgtaaaaaaaatcattccgaaaattaacagacatgtcagaaattttgataccccggaatataaaacgaaattacgtccatgatggttaattacacatgccaccaccggaaacatccaatcccaatcacaatttcactttcttcaatatggcgtgcaaaacgccgccttattttattgcaaataacatcacagtatcacatccaccaccttcattttatagctgctagaagtttgccagtttccagctcacaccgtacactcantaaaagccgtagcaatggcgacttggattcttggatggttgctatggcttcccgtgtttctcatctccctctacctcgtcgacatccttgcacactcctgccgccgccgccgcctggaccccgcccacttccgttcatcggcagcctccacctgctcggcgaccagccacaccgctcgctcgccggcctcgccaagaagtacggccctctcatgtcgctccgcctgggtgcagtcaccacggtggtcgtctcctcgccggaggtcgcccgcgagttcgtgcagaa

SEQ ID NO: 64147 - DNA, 7462 bp, Oryza sativa
ttatttatgaacgctaattgctagctagatacatcattttcatcacagcctaactactggctaattcagctattccatcgtcctcttctgaaattgcagaaagatcggaggagtgaaagtaagaatccatgacttgtggaggtggcatgccatccccatcgcagaaaaatggtctcagaggcacttgcagcgcatccacacccccttcgagcatctctattgcctcactcatcgtcggccgatcgtgtgatttcatctgaatgcaccacagcccaacaaggcacaacttcctctctagctcatgcatgttggcaaagttggatatctcatcaacttgttgatctgctattagcttatcataaacccatgatgggtagtatgccttacttgcactggaatctgcatttggatctgcattccttcgtcctccgaccatctcaagcagcaacattccaaaactgtaaacatcagacttgccagatatgatgccaaagctccgggaaaccatctcaggagccatataacccactgttcctcgtaaagccctatctgacacaaagctcttgtcccttgggtacagtttagcgaggccgaaatcagcaacttttggaacaaagttatcatcaagaaggatgttgtgtggcttgatgtcaaagtgtagaatctgcatatcacacccttggtgcaggtagttgatccccctagcaatgcctagagcaatctcattgagcttgtcccatgagaatcttctctcagatgagaagatgtgtttgtctagagatcccctaggcatgtactcgtaaaccaaggcccttctcatttcctcggagcagaaccccaccaaacgcacaacattaacatggtgaatcctaccaatggtggcaacttcactgatgaattcttcgccgttgcaattagagtagccattcagtatcttgatagccacatggagatcacccgggagcagcacacccttgtatacagaaccgtagcctccttggcccaacttttctctgaaatgccctgtgattgcgataatgtcggtgtaggcataccttgtcggaccgagcatttgttgcattcggagaaatttctcgactgcatcaattgttatcattcttttcaagtacttttgtgcaaggaaaatcaatacaaccaagggtgccaacagatacctgcatggtgctgcgtacacaagttcgatcggttggaatcaagaaattgtaacatgcgtatataactagatgaaacactagaaacaattgagatgatgtgggtttataagaaaagatagaaataacattaactattaatgggataaattatatagggtagggacgtagggtcctggtcgatgacttacgtacgtgcaagcatcgtccagaacatcaaggcatacaatattatgcccaagagtatattgtatggcgatggaattttagcagttgcgcaatccatgaaattttcagtcaccgaaagactaaaccaatctgaaagtttgcctataccagtcgatttgctgcatgcaagaacaaagacggatagattcaggcatatataaatggaggggaggtcggaggaatgtgcaatcagatattatgtcaagatcaggaactcacggaatcgactccattaggcaatccttgaagcttcgatttctatggtgtctgaaaggaaattggacgcggaatcctttcctcatgaattttactacgtcttcataacttaagctatcaactgctggtgctacacgacccataccatccaaaggagtcatggctaggtaaccacaggaaggctcgaggttttcaatgtaacaggacaatctgccagtcaagacataaacgaaggagctgctggtgcccatgcaagcaacaggactgtacataacattgttgtttatttccttggaacagttgacaaagaaagaccaccaacgtgaagcagggtccaattcgacttggatgttgtatggcgatgattcttcgtcgtcactactaacatcatcatagtaataaggaatgcgtttccagcgaggaagagggcaattgttacgtgaatccgagatgttggcgtcgacaacccagaaggtggaatcactgtagtcgatgcctgtcacaaagtatgttccgttgtcgatctgaattgtagccttgtcatcggtgcaagtcagctcatacgatgcaacaccgcactcgtagcctcgccggtggaaaggagacgcgactttgctaagatggccgcaggtgaacggagggcatgcaggtattccatgaattaaaggccattctatatccggatctgggacgacaaatcgaagcacacacaggacagagaaaacttgcagggcagtcgagcgacggaagaacggaccaggaatcaccatggtgtggtgtagcagctagcttagctagttcgcccaagcagagcatgcaggagctaggtagtgacacggatgatattacaagtgtctatctccgcgcggtgcgtgcactgtatgtaagcagtgtaactagagttttccaagcaaataaatttagctaaaaagcaacacttcatgtccttgactgtgatgctgttgacttggaagtctttgatgacacgaagcagattagtctaaggcgtagcattcagttccacaagagtctaccgtgctgcatcggtcaccgtttattgatgttgccgaaaaagattggtcaaagtgcacacattaccagtcgcccgctatcacgagccttatcattaggggaacagtgcttcacgggttaatttcaaaagcccccaaagctaacatagtgtattcttctaaaactatcttaacaggacgcgactacaccgagagtgctagctatatggtgctaaagagagacacctttctttccaaaaaaaaaaagctacttatacactcaatatctatgtatttttttccttcttagagaagtttctcttaaattacttatctgatttataatccgattacgccgttgtgtttattgcaattaaatctttacaacaagatctcacatgattatattttgatgaaaaatcacaaattacttttatgatatgtctaaattacgtttacatttcactaagttacttcttaaactataaaagtaaattcagtaagtctaaaagtaatttatatatattatagaagtaacttagaacaaacgaagataactttggcatgttatttgaagtaaatccgttgtatagataaaaacatgactctatctaaaaattaaattaatcagcacaaattatggaatttactaaaaagtcatattttatccctacaacgaatttacttctaatgtcgtgacaaagttacttacattttgttttaagttacttttaaaatatatgtaaattacttttagactttattgaatttacttttatgtctaagaagtaatttagtccaatcttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggtttataaaaagaaaaaccctaaaagaagtcttctttccccccctttcccttcttgggccggctcggcccacttctctccctccctctttctcctctcccccgcggcccatcggcctcccccgcgcgagcgccgctgacaggcgggcccgcccgccaccctcgctgacgggtgggacccacctgtcatcgcctacctcccgccgcgccgccgccgcgcccgtgccctagcgccgccgccgccgcggattccgccgcatcccgccttccccgcgcgccttaatgaggggggaatcattccccgcgattccctctcccgtttcccccgcttttccctctctctctccctcggattcgttcgaatcgcgcccgcaatcctcgccgacgtcatcaatggagcccgagaactccgcggccggtttcctttctctccggccgccttctctcccttccgacgctataaaatcgtccctcgtgcttcgctcttccgtttccgccactcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtgattgccgaccccgtccgccgctccgcttcgcccgccgaccgccggagcaccgtcgtcatcgtcatcccgaaccgcgccgccgctttcctccgctccggccgccgttctcgtcgtcgtcgttgtcccggggtgagccgaagaccgccgttcgctttcccccttctctccgctctctcgggcgccgctccgccgcgccgatggtcgccggcggtgaccatcggggcgcgggcgcgtccccctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtgcggctgacgcgtgggcccccactcccgtggacccggtccgcgcgccctccctcggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgtttctgctgttatgtggagtttagtagagtaaaagccttttcttttccgtcggtcgtgtagacgctgcagcttcggaagatccgctcttcgtggaagttgaagccgtcgtttgggaaagcgagcaaggcaagtcacatcacccttgagcatattgaatcccagtttataaaattattttgatttaaattattgcattatcgctttgtttaaattcccgcgttaccactgttttatttagccatgcctatttacctttgttatgacattattattgctattgttattattaccttgttcaccctaggaaaataaaaaccccaactagtgggtactctattcatggttccactagtataaatttaggtagatgcttcgctgaataattaggcaaccttaggtggttttataactttagactttgggaattctcatatcatttggacactatggaattgttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccaaactatcgtaggccttgggttaaggcaggttcgtgagggttcacggccttgtttaataatactgtgtagctctaggatcgtctttacaaaatggctttgggcaactaagtgacttttaaatgctgtttactgcaaaacctaacccctattattatccccttgtaccccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaatctaaaagtaacttatatatatatatgataaaagtaacttatgtatataataaaagtaatttacaaatataatttttttttcatcgtaagtgaagatttaattgtaacgaacataatagcgtaatcggattgtagatcagataagtaatttgagaggaaactttatttgaacaagaaaaaggcacccacgtgaactttatttgaaaggaaaaagacatccccgtggatggacatcatgacgacgtgcacagttagacggctctcagatgcgtcgtgctatagagctaaaccgagaacgctctcgaaatagatttcgcgatcttaatagtatacttcctccgtttcataatataagccattttaacattgtccatattcatatagatattaataaatctaaatatatatatgaatgtaaacaatgctagaaagttttacattattaaatggaaggaataataaatgatgtatactgcttatgcacgttcctataaaaaggcatcgccatgcatggtttggtgcctgagcgagagaaatggttaatccacatatagtaaattagttgtcagtgagctgaagcatgcacatatagtgtttgattattaaactaaactgggcaactgggtttgtgatatatcaacatgtactcatgtaattctggtagctagcaacatatctcaaattctcaatgtatttaatttgcaatataataatagctggaagatgacaactaaattaccttattccatcgttgctgctactccactaatcatccttgctga

SEQ ID NO: 64148 - DNA, 3019 bp, Oryza sativa
agtactctcttcagtttgataattcgtgttattttcaataaagatatggtttccaaagcatatatatgagtgtgattttctgttataactaggaagaaaggccccgcagatgcgcagacatcttatttactgttttatgaaataatgttaaaataagtcatatctcaccatttatacgctgtgagatagaccatagactttaatatatttaagaatgcatgttagacttaaaaaaacatcttgtcctagttccatatagattcttctacagtcacacaaacttattatcactattttaaaagttgagtaatatatgaaactatatatgtttatttccaaatccatatataaatattctaaaaacaccacttctaccgattaataggatacaccattaaaattaaaccattaaagttaaacataaatgctgggtgaagatagtcatagtcatcgagactttcttactctagtgccttgaatgatgggtctctcattaagatagccgtgcacgtgctctctcgagatcaacctagagcacaattttaatgtctaatttactatcacacccttatgtagtattgcattgtcatactggcaccgccttaactcagtgtatatacgcccctgttatacttacgatagcatagcaaacactgttgtttatgcttggtgaccctaggaaaggacaaagaaaagataaaggtgatcgacatagttgtgttttgaatcgatttgtggtacagagtagacacggtatgcttaagattttgatcattgctactcaaatttttatagtatagctagaatactctcattcataaagaagcaaggtccatcacccgatggtagttaaataattagccaaagagagacataccatcacaataatctccagagcactattgtttatattttgacaaatacctatagtttagcacctgatttgttttaacacctactgttggcaacaacatgataaacctttactaatttaaatgatgtatttatacttctaaacctatttatcaattacgtagtatatttatcatgtcatatttgacaaatatgaaattattttaaaattataattacattaattttcatatattagcccgagatgtggtgatgcatttagaatcggaatacaaattttattagacacaaatattttatttaaataaaggaatacaacaggatcacaaattggatatataatttaaaagataaccgtttcgagataattgattttatatttgatatttatattaccgatctaatttatatttctgcatatttgtggagtaatatatattttatatggtaaaaagttatattttaaagaccattgattttgttccaatgtacgtatgttttttattaagtatgtttcttattggctttatccttttttatggtaggtacgtgctttttttttcctcataatagttatatgtaaccttttttctcattttacatacgtacttatgtttttttgttctttgaccatcgaggtgcatacagatctactaagcacgctatgttttattttagcttttgtcgtacatacaggagaaaggtattatatatatagagagatctgatttattgtataaaattatgggtccaccatttaagtgaaaatcaacagcatatatctaatctaacattataaaataacgggtctaccaatttaaatgaaaatcgatggtgagattaaattttgtcacgtggcatcctaatagcatttgtatacagatctactaagcacgctgtgttttattttatctttcgtcatatatacaggagaaaggtattatatatagagagatctgatttattgtataaaattacaggtccaccatttaagtgaaaatcaacagtatatatctaatctaatataataacgggtccatcaatttaaataaaaaattgacggtgagattaaattttgccacgtggcatcctaggacctatacatgtaattcgaataccttctaattataccatattttgtatgttattgatagtcagagtttgtaatagtttgacctcaatattgtccataatttttctacttattagctgacaaaaatttcctcaaatccccgttatatgtgcctagctttcgcattcaatcctctagtgaacagagttcgagcatgaaggagggagccagaataactcaacggcagtggttttttctttcttggggaagtgtgtggacagtgacactgctggggaagcgctctttagtcctattttgcaaccctttgtcccgggttacaatcgggacgcctaatccggaactaaaaaagatgtccaatttttaagtcctggttggtgttaccattcgagactagatttagagatgattttgtcgataattttgtgaatgatttggtgctgcttgcatctattgatttcgagcaccaatgtcgtcacccccaaatccccacaaatcattcaccaaatcatccacaaaatcatccctaaatctacaaatatctacaacaaaatctacaaatcattcacaaattcttaaaaaaaaaccacaaagccacagccgttgtcggccggctggccgtgcaccgcctcctggcctcccatcccgccgcctccgggccaccaccgctgctggttccaccgggccgccgcccggctgctgcggccgcttccaccgcctccaccttctgcggccttgagtgccgccacggccacttccgccgggctgccacccggcctcccctcccgttggatctggcagaggggacgccaccgcccgctagccgcccgtctgtcgcctctgcctgctgctgcctcatgtgccgccacggtcgcttccgccggtcactgcctggcctcccctcccatcggatctggtggagggaaggccgccgcccgctgtcaccgtcgtcagaggaggggggagggggaggagggaggagaggagggggagaggttgagaaaataaggggaggaggagataaggacaagtcgcacggctcgaggcagctgtttg

SEQ ID NO: 64149 - DNA, 1418 bp, Oryza sativa
aaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttattgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaagggaataataataggggttaggttttgcagtaaacagcatttaaaagtcacttagttgcccaaagccattttgtaaagacgatcctagagctacacagtattattaaacaaggccgtgaaccctcacgagcctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaatagaggcccgagctttagtccttatagtggccggggtgctacttcccacatctggcatgcacccaaaccccaccgaaaacaggttttaggggttttgaaagaggaagagaggtgtgtgtccaat

SEQ ID NO: 64150 - DNA, 602 bp, Oryza sativa
caactactaccaatacaggatctgctagctaggtgctcgcttcttgcgttgattatgggaactgggagcctgggagatccttgagcttcacgtcaggtagagggcacggcccggaggagatgctccttggcgatgacagtagcgctcgtcgtagcctccgcaaattggggacattccccggtgcagttcaccaaagcatcaactatgcttgctccaatgcttcacgatacgcagtgcatggcagaatgtgtaggtcgagcagagcgcgtacggcaccagcagaaatcgagctcgagcagcaatatatggacggcaacgtactagtggaggcatgcgttcttgaacattttgtgtgtgtatatccttctcatctccttcctccgttgagcctgctctcatctctgcttcctcgtcgaccacaagtagctggccgtgattagggaggagaggagaggaagaacactatttgatattgatgtgtgggccactggttaaaaatgcaaagttcagtaataaaacccggtcaaaagtgaaaagatctgctgatagctggtccaatttacaacttgggtaataaaacctgccctaaagtgcaattcact

SEQ ID NO: 64151 - DNA, 1794 bp, Oryza sativa
cacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcactcgtccccagctggagctagcgtgttacctcccagagatggcacgttagtcctggtcagatatatgccaggcttcatcctaaccattacaggcaagatattgtatgaagaagggcgaacatgcagatggataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccatctgtttatgaaaaggtggggtaagtccccacaaaaaagagagaaatggtgcatgtggtatccccttaagatataaaaggaggaccttgcccactgagatggaggactggacttttccagattagaaacccaggacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctcccggagtccccggccgaaccggcaaaggggggcctgcgcggtctcccggtgaggagccccacgctccgtcatacttcataattgttggactgtcctaaccgttgccttgacaaccaacatcaccgctgccgcacaaaatcaccatgaggagaatgtggattggggactcaagtagaagatggtggaggggaacagggagaaatggagctgggagaaagaggaggacgccggagctgctgctccactcctccggcttggagtgatggagtctcttcaccagccgccactagggggagaggacagggaggataaagagtgggttagggtttttttgtgtgagatttgctcttttatactagggaagatacttgagggctgttttggaccatgggctgggcggaaaattcaaattgggccgaatttttttggccggtttagtgttgtctcgggctggaccgaaatgggcgaatttcaccgaatttcggcccactcggtccgtatcccagaaccctgtccgaggtagctcagttttgtcctgtggtggaagcccggattcggccacaggagcaaattaaaggaagaagatagatctaactattggagtagaggaaaagaatggacggtaggcttgttgcaattcattgtattatattggtgcactttgttgttttcgtgtgttccgtctttttctaattggatgttgcacgaatgtacattgtattttcttggatgttgcacacaatgtgttttcggtgttagaatcagtatctttaaatgttgcatataattggaaaaattttaaccacatgatgaaacatttttcattggacaatgaaacatatgaaacaattttgctgaaacatttcttagttaatggtgaaacatgtgaaacatttttctagatatggtgaaacactgcccggagtttcgactgggatcggacgtctgatgcctagtcgtccccacataagtagtcatttcttttgtggttaggacgttgattcccatgtgta

SEQ ID NO: 64152 - DNA, 726 bp, Oryza sativa
gtaatccgatcgaaagcagaaagaggaaatttgagttctttataagttttttttcttctgagttctgacaactggaaagtaaaaaatattagcagcaagtgacacaggtgatcgacgttacgcaaggtttggggccaaaaggagccgacgtttcgtttcgctttgccttttccttctcgttttttcttttgtgccgtggacaccaagcttgatcgaggcttgtacgagaatgctgtttgatgctgcaaccaagagattaacttgtagactgtcagagtgtatcgtgttaagtcttactgaatactgagaattatttgtcgttgttattctacctgcgtggctgtatgagtagtttcttagtttttgggccgtcctggtcaaggcccattaatattttcgacatctaataagtttgtgaaagaatcataccaacaacatcagagtggcgcagcggaagcgtggtgggcccataacccacaggtcccaggatcgaaacctggctctgataatttagttgagctgtttttctttaaactttctcggttttctttctgctttttggtttttatcttgcatctactgttttaatctttctcggtttttgttttgcatctactgttttaaactttatcctttttggttttgcttccgtttttgtttaaactttttcggtttttatttttgcatctatttggtttttattttgcatctactgttttaaactat

SEQ ID NO: 64153 - DNA, 796 bp, Oryza sativa
tgagtctgattgtcaaacacctgagcgattgttgggttctcgggcggtggagatgaactgctgtcaatgcatagcagacacgtgctccactgatctgctcttcactgccactgacgttgttggagtcacggagaccattccttatcttcaccatctagaggggattgggtagaaatatgagaaaaggaagaaaaacaggaggcttagaaactaatctttcttataaatttaagtgcaattatcttaatcttgattgaaacactgaaaaggaagcaaacaactcctaattaaggtagccataccactcacacatgatatcgaccgccgactaaccaacaagcaacaaacctaaacacggaaactagcaagcaaacaaaactaagaaggcgacgaagctaaaggcagtgactctgaagctcggagcggcgcttgcgatcagtgaacaggtttgacacctaagatggacaagggatagcaaccaaggcatgctcaaatccaaattaaacatggcaacaaatgactcaaatgaataaccgagcatggtgatttctatgcatagaacatttttcgtgaacccagataaagaaacaaatgcaactgactaaacaataacttaatgcataaaatagatgcatagttataataatatgcataaaattgccccattgaacatagacacgacctaatgcatatcacccgataaattcccgactgactttcgaataaactccgaataaaatattactaaaaccctagactgagctaattataaagatccgatccgaatgaatgacta

SEQ ID NO: 64154 - DNA, 3265 bp, Oryza sativa
ttaactgcaagggtgccaccagcaaaatcatgcacccacagcccaacattcagtgtattttaattaactaacaccattgcggtggcacaaatccaaagctatgctaatagtcaaagtatatgtaataatgtgatctccatttgtgtactagttgaactaagcacggctaagcatttcctaaaccaacatgtaatcattttgatacccaagttatcaatggcatatggtaaacaatatatggctgagtaataggacccataccacatgacattgtaaaagaatgcaacatttaatagaaatacgggatatttgtaaattgagtataatatgatcaaatgtaatgcatcactttccttgctctcgcactgatgagacctcagcaacgtcttcgagaaaccgtggatcgacgaaacggccgaaatgctataagactactgaaacaggaaacaaaaccatttttaataaattctagggatttttatgaatttactgagacttgaatagacttaatcggagctcggatgaattagttatgattttaagaagataaactttttttattaataaaggaaaatccttattcgatttattgcgcaatattgccccagggctgacgtcatcaaaggaggggggcgccgacaggtgggccccgcacgtcagcggcttgagagagagagggaggagcgccggcatgcgggccccacgggcagcggcacaaggtggaagggacgcggctggcggctcggcacagctcaagccggccggccatggtgcggtggcggcggcgcgcggccaccagcggattgcgaggcagcggcgatcggcacgaaggcgacggcgcacggccggagcggcggctcggccaacggcggcggcgcacgtgggaagggagagaaaaggagggggagggagtcctcaccggaggaagcggtggcggccggcgcgggaaaacgaggttggcggcgacgaccggcgatgccgaggtacggacaggcggcggcgacacgctaggagaagacggagaggagtcaggagaggggacgacgaccacggcagcttaaaacgccggccgaaaatggggaggacggcgcgactcaccggcgtgcgaggagataggcgctccggtggaatgccggcaacgcgaggcggaagccgggaaagctcttgcggcggcgaagctaacggcggcggccctagcagcgacggcgcgcggccggagatgggcggcggcggcggagctcggcgagcgcggcgcggcggcggtagagggcgcggatggaagcggcgagggcggaaaacgaggaggggtctcgggggagcgatttatgggcgcgggaggggcagaaacggccagggagggcccctattgcgccggtgacgtgggggagtggaaggagagaggggtgggattcaaatcgaatcccgcctccaagcgagcgcgcgcgagagagcgggagaggtggaagagtggggcagcgatgtgggcgcgcggcacgggcggagtgggggcacgaggtggagcggagaaggcggcggcgcgggcggttagagctccggctccaacggccggagataggagacgatcggcaggtggggcccacctttcggcgtcctagagagaggagggaggggcgcatgggccggcccaacaaagaggatgccgagcgcgggagggagtggggcgacggcccaagaagataaaaggggaggaaaaagaaaaaggaaaaatgagaggatttttcatgtgattaaatattgcacttgctcattttaaattagttaaaattattttcaaggctctgaaaattctactaaaaatgcatgcggaactcaagaaaaattccaccatgtcattttcgattattaattgcatttattaattagggattagctctaggttaattaatcaatttcttcggacaatttatttaacaaatttttaaagaaaaaaaagggaaacttcagggtgtgacaggagatggcggagacgatgcgatggtgccgctagccacgaaggccaggacgtcgcacgcggagagacaacgcccgtgaggtctgtgtgctcacttgctatcccctcttcccattcacaatttgattcggttcgattttatttactactagctcatagtgatctctgttcaatcccaaatcttatctatccaattcaatctgatttgtacctatccaatggaagcagagcctctctgtatctgtctctatttctccctctcttcaacttaattaatggataaagaacattttcttgagtgattggagtttgaggatgatgcgtgcgggtccggaggatgaacaggaccacaggagacgagatggggaagaaaggggcaattaggtccaaataatttagaaaatagagtgaaggagtaagtagtggtatatgtgaaataaccaaaaagttgtaatggcatgtctctaaatagatgaatagtaatgacatatttcaaaacagtgaaagttataatggcatggatccaattaaacctattattatagtcggttttttattgaacatgcacctataattaattaaaggtgttggtttttttattttcagccagtggaagtggggaaaacactctagctgttggttttagctcttctggcacctattgtgccgatctatatgtgtgtttttaagtagtgaaaagggcgatgcgctcgatgttgtggtatggtttactgtcaagaaaataaatgcacaacaaaaacacaaatttttacataaaaaactcttacatgaaaacaccatgaacatcgattggcaataatcagtttagaagatataatgacaacgtaggggatacagtagaccgtcgcactattcgcgtatagccgacaagagtatataaagaagaaaaatagagtcctaataggataaggaaactaattcaaactctaatagattaataggaaactactcaaaatatactggtaagtgaatctcagataacatatttaacatctacaacgatagcaatggcttgtacgtcaccagtttctagcgtcgtcggctggggacaagatccacagactggaaagggcgggtgtgctcatccaaatacggtgtgtttgtgtggaagaatctgtatatttgctctcttttatggtactccatagctcggtggtaatggcaaagaaaatattgcacattgtttgtctttatttgtcttatctaagtaaaaaaaatatatactcctcctcttgattaatacttccggtcctgaaatagttatctttatag

SEQ ID NO: 64155 - DNA, 1939 bp, Oryza sativa
aaagatcaatcccaccactccaactgatgctacctgccaagatatagccgtccacagcagtgtcattacatatgacagcttcccagactggaatgcatgcatctctccttgtaaagtcatccattcaccacttgcaaataacccaacaagagaagccaatgttgccacgagagctgtatatatctgcatgttcaacacaactgagaaggtctccctcttaataaccttctcaaatgtgacttgcatcagggagagaatgagcgagtatgtagctgatgcccctagtgtcaacaggaaacccaaaatgtacttcccatgtgatatactagtagttccctgagaatcttcatcaactccaaggagtgaagcagaaaacgtaaggaggactacggaattgaaaatcagaggggtgaatttttgagcattgaggaaatatgagaagacagcattgaaggcaagctgactagcacagatgagcgaatatgttgagaccggaagatatagtaggccataggaatacatcaagtcgtctgcagcaatgatgaggcccaggacaacatatatcagagtaattttggggatagaaattgtaggggcaggactactagtgactgtttgtgtagaagatgtctttgaatggaaaagaaatagggcaatgaacaaaatcggaaagccagcagtttggacgaatgtggacatccacttgctattgccgccttgattgtagtagaacctcccaagaagtgtagatgcggtctgaccggcaatgaggaagaacatgttaactcccaccatcagccaccattgccaactcttgacaggagagttctgtataggtacttcatgagttgacgaagttgcagctttggatgaatctgcaagttacagaaggtaggcagtatcaacaggttagcccaaacttcatgtgttaagcatagcacggccaactgaaactttcttttcctattcaaaatagactaccaaagttcccatagtgaagtgaaaccctcctctcctttttttccccccaacaattggccatataaaccccaaaagctctaaatttattgagagaaagtcgagcaacacaagactatagctccatccttacagtattgtccattggtgaaactatcaaatgaaagcgagttacttggaatctcagggaaatcctgcactaatataaaaaaactaatataaagattttacttttgttaaatgcagtgcattactatagctggtgctatcatcaaccacttatccagctcatgtacgcgaacaacaggggtttgccaattaaactcacatgcctactctgccactcgatgatgtcacgatagtctgaaaagttaatatggtctataaacaaaaaacaaatcccatatgggcatatggccatatccaacacgccacgcacgagaaggcaattcatcgaacacctcgcgggcttacttccccacaccatcgaacaccaaataagcccgagagaacgaacgagttcatttcatctgcgtttaccgccgcccatcgcaagacgactctaacctcctcacccccactccctcaacgaagaaaatcggacatagctaaacagtgaggctttcgacagaggaagggggggaaagatttgattgacctgcgatctgtatctggacctcctcatcccggttgctaccgccgtcgctgttgccgctgtcaccggccatgcccgtcgttgggggcgctgctccgcgcgagcgcgagcgcgatccgaggcaagcggagcggtggagagagagggagttgataggaggagaagatgagaagaggtgtggcgccgcacgggggaagacaagtggggaaataaaaagagtaggaaagggtggggcgctgcagtcgtgtgaaaattgaaaactgcctcctccttctttcgcttcgcgagccgccaaccgatccttgg

SEQ ID NO: 64156 - DNA, 731 bp, Oryza sativa
aaaagtctaatttccctccccctcttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgagtgtagtttcggagcccgaagacccgcagtgcgaggatttcgaggatcaagcccaagatctcgagcaaggcaagccacctttgaacttaattatgttgcttgaaaaatattatgcattgataggatcgcacttaatctgtttgtcccgtctgcaaggcagattggcagacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggattttcatccgaacataagacaagtacgaccacatg

SEQ ID NO: 64157 - DNA, 1441 bp, Oryza sativa
tttctaaaatggttactgatctttctccctctttcaaaattgtagatggcagtgaacgccagcttcagttcccacggttttggtgagggtcaccacgttgctcagcttcgtgacctcgcccgctttgttggcttctcgtgtccggagtacacggggtactccgtggaccgtgttccccctcgttgtgagctctctgtgtacctttaccctcgtggaggtatacacggagctggccttcgcccacaccacttcaccgtggccaggcccactctccagatcgcgtaccaggacctctcctggactgcgcttcgtcgcttggcccacgactacagccaccgtctcgggggctctgccttccggcagcttccacgccttccttctggccacgcagacgccaggtacccttgtccttacagcgagtctcagccagtgctgactcgcatggttgagctttcggaggctcaggccactcagcacgacctactccttgaggcttaccgctcccttgcccgccgctacgctgctttggaggcccgtctggccgaggagggtgtcacctcagttgacactgtctcctaggactcaggccgcctctgccacgccagccacctgtcctcccacagctcccgcggctctgcccgcactcccagtggcccgcgctcccccagctcgcgtgcgccatactcaccagtgtactctccctacccacacccagttagcccttcctacacccccggacacaccccagttgcttcctcccgccgaggcccacgctttatccgcactgcgcggaagcgtgttgttggttcttccaccgtgttccgtttcgactacccagctcccccaccgccagcggcccgtgctgctgccggccctcgacaggttccgccggtcccttcgcgtcagccgatcgacgtttcttcgactgaggagccgactacaggaagcagccaggcagacgaggagtagaggaggcagtcttcagcagccgtccgtgtgttaggcccttttgttccgccgccaactcttttggagtcgtggcgaggtagtgcgtgcgtgtgtttgttgtgggtattgtttggtagtctggttctcctaggtggtgtgcgcacagtcaagctcggcgtagctctgtgacttgtctacacccgttgtactaggtgtttttatgatatgaaaaatccagtttatgcctagtgtgtgctatctgagttgctatttactttgctccttgccctcctaagtgcttatctgactcttaccccgccctcttctgggagtttagatggttagccgcccccgccgtgctgctcgtgcaccagcccgctttggttttgaggatggtagagttgagccagaagcaaatcatgagtcagctaatgagcagtctcaccacagcaaccgttcgcaccgtactgcttcccgcaacgcaggggtgcag

SEQ ID NO: 64158 - DNA, 1657 bp, Oryza sativa
aggtgattaccatcaaagtgggatctcatgatatgccaataccttctggagatggagttgggaagtcatcaagcaacaaatccgaaattgggaccagctcatcgcagttggccggtctaaccaggccctctggccggtctgaccgtagctctgcggaccggtcagaccgggccatcaggccggtctgaccaccgacccaatgtcggtctgaccggcgcttctagccggtctgaccggtggtctacgtccggtttgaccgggcttcaacgccggtttgacaggaggtttgaaaggagtagtgcaggggcttcattgtcttcaagcaaaatcaatagggggcattatttacctcctggaacagagccgaaacctaggtggatccctaaggatttaacggctactcaaaggagaaggttgcagcatcttcgggcccaagagataagagagaaaaaggccgaagagcaaagagataagaggttcaatgaattgcgaccaccaccttttggaggcataaatccgtagagagggaagaaccggttgttgtagaggagaaagaagaacaatcggttgctaaagatgagtcatctccaaaggaggacatggatatcaacatggtgtgtatgttgcctatggagttttgtgctatggatgaagccgaggttgctcaattttcactaggtcctaaagatgcggtttttgagaagcccgatgaatcaaaccgtcatatgaagcctctctatttcaaaggtcatgttgatgggaagccagtctttaggatgctagtagatggaggtgtcgccgtgaacttaatgccgtattcattattcaagaagttggggcgtgaggataatgaattgaagaagaccaacatggttctcaatggcttcaatggtgaaccaatggaggcgaaaggtatcttttcggtggagctcaccgtgggaaacaacacactaccaaccgctttcttcatagtcgatgtgcaaggtaactacaatgttattttgggtcgttgttggatccatgccaattgttgtgtgccttctaccttgcatcaatgtttgattcaatgggacggcgatgatgttgagattgttaaaacggatacatcggccgaggttgcaatggccgatgctacatttgaatggcgtcatgggaatatccaatgcttatcggggagggatctttctagctatgatttcattagtatctccgatggcaaatttgtacttatctctgtaaagccggctagtgtagcacggctaggctatataaatttgtataatgagtaaagaagctaatttagagtggttgcaaaagagggtgcaagaatatcggtctacaaagaacgatattggtgaaactattgaagattttgatgaagtagagaagcttggacaagggtttacatcggccgatccattggaggaaatagacataggtgatggaacaaagccaaggccgaattttgtaaacaaaaatatgagagccgattataaggttaaaataatcgagctacttaaggagtatgtggattgctttggatgggagtatcatgaaatgccaggtcttagccggaagttgttgagcatcggcttccaatcaaaccaggttttaggccttataaacaaccacctcgtcgttttagggctgcaggaat

SEQ ID NO: 64159 - DNA, 1493 bp, Oryza sativa
ttaactaactaactaacaaacaaatggttaattgaccactgatatcttttaaaccgttcgatcaagttggatgggactaatatatttaaatttaccgtgtaacatactttactaatattacttgtagatttatttataaaacaagagtagtcgaactaaaacaatgataagttaaattttgagaattgttactatgaaacagagaaattagaagaaattcagaaagagaaagagggagaaggagagcatgtagtatgatgattgcacatgtgcagtgcaggtgcagggccccagtgtcatctcctgcacttcacttgtgccatcctcttcacttgtgcagtctttactgtaagaattttcttgcaagttgagaagaaacagacaaggggagctcttctttcataccgttgccagcacggctattcaagcaaagtctctttgactttgacctccacgctggcacttgccctacgctttgctatcccgtcccaaacgtttttctcctgtttctacatcactccatcaaaccgcccgtctaacactccgaagtacataatccgtacttcacgtcgatgcctaaaaacgtactactcccccacattccaatattaatatacaacggactataggattaggtttttttttttaacagagcagtaatatacaaggttgcacttatattaatatggtgggattaagtatttataaccatgacttaaattgagatgtacataaatcattttcttatagataatggattgtttcattagtcaataaaaacatcctacacctttacatcaactcatcaaggatgcacacatgcagtaaaaataaaagtgaaagaaagatgaaaaaccgtagtaggtaacatgaacatgtcatgttgtctagcgatattttgctctattacaatcatgaagagaatatcgggattatatgctatactttggaacaacgccttcagaaataaagatcttttgatgatgtcaatttctaaaatgtatttgaatttaatggcattgccttctaaaatcaaagtgaccaaagaatttttaaacttaattttgatttattgtatttcaccgtagtttatttttttagcattgacttttaaaccacgaatataaatataaaagctttatctataaattatttttaatatctttgtttgtttttctatgacataccagcctagcttaactgcttaagtgctcaaccgatcagacacttcgtatccggctttctataacaagcaattgtccttttaccgttttatctgctattgcttgttatagccgttacgctgaatttaccacaggtcactcacgtatagatactaatactgtagagtgagctgtagtagcagtaaacgtcgcttaaaaggcgggaaaagctaccgttgcaggcaacaacactgaactacatgccgccaattgcctgtcttcttcttgttttaatcattcaatcacctcgtcttttcttgcttaatccat

SEQ ID NO: 64160 - DNA, 998 bp, Oryza sativa
gacggcggcgcgcacacacgtcggctgccagggagttgggcggcggggaaggaggaacacggcacagcatcgacgcgacttggcggcgacggtagggcagcggcgacggtttcttagagaaggagaaaacggcggaggaggagggtaaggcacagcagcggcggaggacgaacacggcacggtgcaagttggcggctcggctgggtattgggccggcttgggccgaaggagaaaaagaatttcggcccaatttaggtagaattggtttctcaattttgaaagggatttgaatagaagattttgaaaggaaaatatatttggagataatttgaatagggaaggttgaaaggaaattatatttggatctaatttccaaaacagatattttctaatttgagtgcaatatttttggaagtggaatatggtggaatttaatgcactcaaatgagaggggaattaacaatataattcctcaatgtatatatatgtttggaggagaatggttggaggtaaaataaataggatttgaatcctaaatttgatagtagaagtatttgaagaattatttgtggctaatagggaaagttgagtgaagaatataaattgctattttcttagcacaagagcaattattcacaatatttacaataatactattcttgtgccgaagaggaaatcaagccacaggaattaaattggtggctagatcaaaaggaggaatttggacatttggatcgagaatcaaaggatgggtttaagaacaaagaatgggctaacaattaattataataaaattggaattactttgttttaggttctaggacagtatgggaatgtttctttgaccataattcataaaaaaatagaaagagttttcaaactaaatttgaataaaagaatcttagtctaaagaaggtttttaaattaaaaccaaatcaagaaacaccttaatttaaccaactatatttttaaatgaaaaacacaaaagaagttaaata

SEQ ID NO: 64161 - DNA, 962 bp, Oryza sativa
taaaaagccgccggttggaactttacgccttccatggggatgttcgcggtttactatcctcgacgtcggaccgttggttgtaaagcccgacaaaaaccaaacctaaggtcgaagtgctgctcctagcaccccacgccttgatgcgtatagcggtcggagcttcactattccctcgacctccacagcacgccgcacagttagctctcgggctcttttgatcttagccgctccgccgccactcacggttgtcggagtaacacttccgccccaccaaacctacaccaacctcatattcctctagccgatatactgtcggtcgacaccggctagagaagacactaaatctagtcattatgctgccaactctagcaacgactagcaaacaaccaaaccctagccgataccttgctagtcaaatcccagttgtcatccaaattccatactgtcacgccccgaactagtaccgaccggaactagcccgcgacgctccaaattaacctgttaattgataccagtcccaggaaacagtgctggtatcacaggaagacagattatcacagcaacagaggtctctttattatagagtagaggtacagtcatgttgggccgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggctacaaagaaagggctgctgtttttgcaattgattttatttgaactcttttctgaaaacaactaagtgagtgcttctcaaacgacacggatgagacagtg

SEQ ID NO: 64162 - DNA, 13719 bp, Oryza sativa
tatgagttgttttatcactcatagtactttaagtgtgatttatatcttatacatttgtataaaatttttgaataagacgaatggtcaaacatgtgagaaaaagtcaacggcgtcatctattaaaaaatggagggagtaaattccggcagagctcctgccgtcgtcttcctcaaaaaaaaaatctctctcttcttagctgcaaaatgcatggaatttactgttgatgagtatatttaacggtgagtagctcattcactaaatataagctaattatgtttatttatcaatctggacacgtagaacatccggctggtgattgacgtacatcagtaagacgtacatgaccgtcgttcagaacaacggccgccgggctgccgcagccgccgccgccgccgtcgcggtcgccggccgcaaggacacgtcagccagccggcggtgtcagtgagaaagccggtgaagatggtggcggcggcggcggcgagcagttgctgcaacaacgacaggacgtacggcttgttgtgtgcatgcgcggctggctgatagcggtgtggccatgctgttcgccgccatggcgttcgaggcagcgctgcgggccgggcctgcctttaagccatatcggagacgcaattcgtatagacagaaacgaagttttgtaccatacggaaaatctacagcggtttaaacccatataaaagaggagacgaacgagttgctcccgccgagctcggtggcgcgagcttgtcaccccagccgtggggggtaggagttggcagtgtttggccgttgttgtggggatcgagggtataggagatatctctctccccgggggatgctatcatgatgttacatccggtctcaattgagttgagttgccactggttgaggtccctacgttctaggctggatagccctcgtgtcgttagattacaatgtctaggtgacttctcaattgagttaccgttctaggctggacggccctcgtgccgttagattatgatgtctaggtgacttctcaattgagttacgttctaggctggacggccctcgtgccgttagattatgatgtctaggtgacttcccgctcacgagagaagccctactgtctatgctgctaactcctctttttttttttaaagcacaaatgcttattaactgtttttttaagcacaaatgccattttgacggccctcgtgccctatgctgccaactcctcttttttttaaagcacaaatgcttattaactgtttttttaagcacaaatgccattttgacggccctcgtgccgctgactatgacatctaggtgacttcctgctcaagagagaaacccaactgccctatgctgccaactcctcttttttttttaagcacaaatgcttattaactgttttttaagcacaaatgccattttaccttcttattaactgttttatattataagtcgtttgatttttttcctaatccaaatttattatgtttgaccaagtttatagaaaaaacgtagtattatttttaccttcttattaaccgttttatattataattcgtttgattcttttcctaatccaaatttattatgtttgaccaagtttatagaaaaatatagtattattttcaacataaaacaaatatattatcaaaatatattcaatgttagattgaatgaaactaatttgatagtttaaatgttgctaaatttcagatcagtttacctttaaattaaaacaacatttacttcccatagccatgaggtgacaaggaggtttggccagttagaaaaaaaaaataaaactacatttacctcccttaactgcgaggtgagtttgattaaaacccggtataaagacagctaactattaaaatcggatcaatttatctttcaaggaggattggccaaagttagaaagaaactaaaacaacatttatgtgggacccacatgtcagggtgctctcttccctacctgccttgcttccacggtctctatgtgatctcttgatgcaagcatggaccatagaggcagaacggagacgaaggcgaagcttttcggcgatgtgcatggtggccgtgctaggtggaggaggaatcggaggcggtgctcgatgtcgggaaaaagtcgaggctcgacagccttccgaggtcttcccccatgctgtcccaggtcagccccgacatgacggatgctggccactctcgtgcgggttccactgttgttcctctttacgacctcgagtccgagctcctgcatcgagcccacccatgtcatcgcccctgcgacaccactaggtcggcatctcacctaccaagctcgggccctagatcagcagccgcctatgcttctcgacaaccgctgtcactgatgccaccggcgccccaccgcacaatagatttctccttgatagtagcgacctctcacctacctcttcctccctccctccagatttgccactatggttgagcttgtgcttgtgactcactcatcgagtagccgagttcgccaccaccgcttcctcgctcctcagttacagtgtgctcgctcacctccgccgtggttcggcagagtaccctctagcctctagagcctatgccttgctccgactacccacaccacgccacgctatagctcgcgtccctcagttcactgcccgctccctccctatcgaatctgaggtgctgatggatggccatggccaacacttgctggagctcttcctccactggcgtctgggacaacagagatagaatggggaatgttgtggagagtggagcttgataggtgcggccaacgagttttttttaaaaaaatttctaggtagatgccacgtagatcgacaagtcaacactatgtactaggtcaatatctacctcatccgaaattgttgtaaaaactgggggtggcaatttccccgttgggtccgaggacccgcccctatggagccgggacggggtagtactcttacccgcgggtgagcgagatagggacctcgtaacattccagatgggaacagggattaaaagtaacccacgggtgatccgacagggccatgtgttgggagctacctctttaaaatatcccatttcaagagaataggcccctctggcctattctaacttccccatataaaacctcctaaatcccctcaccctctccctcacccggcgaggcgtggccgccaccactcagctgcggctagaaggctggccgcagttgctcctctgcgctggatccccttgacaccaattttgactcttcaccacgacgccttgcctcctatttgtcatgccgccatgccttatcgttggtcgttgactcaacggcgtgcctccttgtcggccgccgactcttcgcggcgccgcctcgcctcctcatcactgagtcgcctagacaccgcactaccagccgccatccagcccctagccaactttgcagcccctgatgtggtgttctattttttattgtgttgaacatattttggtgctcaattgatttcattgtgagatggggttttctagcttgtatttgtaattagatctggctctttccctagtttcaaaatatgtattgtttatcctagtttgttgtgttactattgctcattgtgtttgttgattcaaggaagatttgactcagtgcggggccgtggatgagcattgatcgatttcgccccgttcatccctctggggctggggtcgcggaaacccgcggaggagcagggcggggatgttcatgtcgaacccgccccgttgccatccctagtaaaaaccatcgagagagttaatttgcattggttttaatagttgagggagtcttatatccggttttatggttgagggacgcaaatcaaactcagcctatagttgagggaggtaaaatggaatttttttctttttgttactatgctgcgttggacttcggcctaggaggattgtggatggcatctaaacccagcccaattgtggtgatagattgcctcaacagacaagccatggctctatcctgccccaactcctcttttatttttatgattttttttcttttaactagcaaggtctggtaatggtaatggattcttaccaccgcaaaaaaaaaaaaagaagaattccatgttggttagataacctagctctgatgttagatgatttgtttgctgtaacatcctgaaaatttccgataacaaaaatcactaaaatttcaaactttttaaaacttttacatcatgctggttgttatgattgctattgcttgccaaaccgtaaatgatcacaaagaaagtaaagaaaagatctaaatttaagcaatagatataatttatgagaatatgttatttattattaaccctaaaaatattagtgcacaagaaagcaagtcaaatattaatttctattataaatcacagatcagatattaaatattcgaaccatgattgatagcttgatgtcacaattagctaaagaaatagtaaaatcaaatctaattcatttgaatcatatctaacatgaaatataagaacacatgaaatgatgatcaccactataatgatcgtgtttataaataagtaattcaccagaatatatagattgatacttagaacattacgccgagttcctcatgacatgaaaatcactcatataaaataatggtcatataaataaattaagctttatatataaataagaatatgtgagtgtttaattgaacaattagattaatgttgtactgagtctcaatttatatttatagaatgaatagacccacataaaatgcattgttatacaaataagttcattcaatgtgctattataataatagtggccacattaggatattttaattaattttagaaccctcaaagcctccaaaattatctaggttaattttagaattagacctcatttaaataatacaatagaaaaatatatataagaataaaatatgggtaatattaaaatttggtaaactttcatctaaattaaaacatatattgggtaaactccatttgtgtgaaaattagggtttatagaacaagatctgaaaaggaaatcaatcaaataggcaaaataggaaaaagtcactattcattagcccctaggtgttcgatgtggtcccctagcccttcccactcctctgccacaccgcgcctagccgcctcgcgccccgcgccaccgttgccatcacgtcccgtcgccgctgccgcgccgtgcgccgtcgccgtcgcgtcccgtccccgctgccacgccgcgcgccgtcgccgtcgcgtcgccatcgccgcgcgccgcgagccgtcgccgtcgcgcttctgcgccttcgagccccgcgccctgtcgctgccgcgccgcttgaccgtcgccgtctgtctcgcgccctgagccggcgcgcgctgtcgccgttgcgtcacttgtcgtcccgtcgccgtcgactcctctgccgcaccacgcgccgtcctgtcgccgcgccgcgttccatcgcgacgccgtcgcccttgagccccgcgccgtggcttgcccattgcgtcaaccgccggcgccatcaccgcctcgtgccccgcctgcgccgcgcacagtcgccgtcgcgctcgccatcccaacgctgctccgcgccgtcccatcgccgcgcgtcgccatcgccccgagccccgcgccgccgcgccgtcccgtcgtcgtttaaagccggccacccctcccccgagccgtataagtaccccctcccttttcccttccctccccacgccattgccccttcttctccccttttcccctttcttccccaccaccgacgccacattccgccaccacgccgccgctgccgtgccccggcgcctcgccgccgccacgccgcacctcaccgccgtgtccccgccgccgtcgccgccggtccggtaagccctccctccttccttcgtcgctggtagtcgcgctgtgctgctcggtcgtgagagggagagaagaggaaaacagagaaagagtgagagagaaaagagaatagagaagagaggttagagtgggcccacctgtcaatggttcataggatttgctttagaaaaataatccggtaggaaagcaaatacaatcctaaaccccacatgtcagtcacttggagttttggataaagtttaggaataaaaataatggattaggaacagtacctttttacaatttctcggatttattcaaatttgaaactttaaactagcataactctctcattttaactcggattagagtgaaacttgaacctaaatttatctaaattcataagctttccaatggtatataatccactatttgataaaatacatttataattattaaataattaatactaagataatgcataatagttaaaaatgtgctaataaataaaattgatattgtactgtaaagtagatgtcaaataattgcccttaacatgcttcctcactgtaaaacctatgtaaactaattaggagcattgtttcaaattaattaaagcataggaaatactagtgccacttattaatatatgtcaatatataattatactcatgacgtccaaattgtataaataatgtttagcctcatactttgtgactaaaagttgaacacacgtagatgagtctttaacttgtttatgagagataataacagagctagtgtgactaaaatcacccgcatgaaattaattaacggcatttcctatacagtagtatatgtttaggttggaaatcgacccttaagttgtatagacggtaactcactcataaatccacttaaaatcacatgtactgtgtagctcgtagtaaatagtaattattcaaataaatgattcagtattaagatattgtgcacacacctatactgtacattctattatagttatacggtatagtattaatttgcttgttgcatacattaaattggagggactatatgacagacatgaatattagataaatactagttataaatcttgatctcatataattatagttcaattgtaaattaggattattcattgtaaaattatgtgatgggataatctgtaaccataatatgattaacctaaacaactctaacatacaaagcatggataattattaaccttttctaatttattgtgacaagtaaaatattttcataattaaagcaaagcctccatcaataaaataataatacaaatggttccctgcgattaattgcttgatcccaaatccatctaacaacagaacctttggtatgtaaccgtgctatttagatagatgcatatatagccataatccttccatagccatttgatagaataaatcgccgattagccaaatatatatgtatcccataaatgctatgttggttaactcctaaatagaccacgatgacaatagaaagattaagaagccttagccctagcatgattgaaatccattagcaaacacgaatagtatgagcaaccccaggatcgaccccaacaattatcttttgcttgtgcatatttgcttgttgtttgaatattggtttttctcgcgtattatagaccttgtgtatcggttagtcgtgaggcaacgtctgcaacttccaggaggtgaaggttgatcaaattatcctaagcaggcaagtcatcactattccttgaacatgttggtcccaattgcgaaattattttgtttacaaataaaattacatgcaatgatgaacatcctacttgtgattatgccatgccttgattattgtttaccccttattccttcgtaaccatgtttacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgaaattgatgacatgatttgtgaaaggaaaataaagtgaaaacaactgttttcgactggggcggacggaggatttgggtggtatctggaaaaggctagtaccgtccccggtcaattaaggaccgagccatgaagttaagcatgaaacgacccccatacaaccgcacttctcgtatgggtatagacctagcggattagatagccgtgcggaggcagtatccctgcatagatggttcacccctgagtgaggcaggtgcgctacggtgggacagccgttgaggtagggccgagaagcgtgccctacatcagtgtcaccattggtagggctgccatgagtgtgtgagagagaaactaacttaatgagagtgtgagacttctctttcccgggagcgccagaactcctctcactgctagaaacatggacgtctagagtgcatgaggatttaagttcatggagcgggtactgccaaggcgaggttatcgaaaagctttgccgtgacgcgtctcatgtgttgggacgaggctcatgtgttgggcagtcgcggagtgcgggtaaagtgtacatccactgcagtgtgagtaaactaaatctattcgaatagccgtgctcgcggttattgagtaccgggacgtgtattacacttggctagactcaaaattcttaacttgtgtgggatgggatactgcatgatgatttttatgctgatggagccacttcctaagaggagggaaggtggatgtcctcagaaaaccatgacgactcaatggcgggaagctatccttgggatcacaatggatggtggacagaaccgtcgttgtttaatgtgaacactggtattaaaacttaatcagtctatgctaggtcttaggcttgtgaaaagaattgcaaagcttgctttacgcaaaagaaccggagcccttccttgaaataccctctatcatatgtattgttgttgtggtggtttgctgagtacggttggtactcacccttgctatttatatatcttttaggagagtgttgaagagaagcccttgtcggtatgcttgcgtatccaacaagatgatcggagtgcggtcttgttctaggtctcgttccctagtcgactgcctgtggcaagttaaccgggcctttatattattttgtcttccgctgttgttctctgatagttgttggcctacctggacctaatgtaagtatttaactcttttagcctgaattctttcgtgatatgttgtgatccaactatgtatgtgtgtaccaactactgatttagggattgatacggataaagacagaagatttccgatttctaaaatcgggggtctacatttgcttacttccattctagagggctgttttatgcaactgttgtatggacggtttacatgaagagaagtgctacaactatgctgctgcagcgctgctgttgttttaagctgacagtggttcattgcccatttattcttgataaataccagtctaccgaacaagacatggtcatgcttctgaaatatgttttttttttttgcgtgtgtttgtgcagctagtatgctgccatgctatcatatagaaagaaactaaaagacacaacaagggttgagcagagttctgtcgataccacaatcctattgttgacagttgtaagatcaaagtgtgttttgattcttattctgtgatgaacaattggcatctgtaattattggttttgatatttggagattactgtcgaagtagttttggagataattgattttcaggtgatgaacagggtttgctgttttgtcgggatcggtcagaccgggcggtggttgccggtcagaccggcttgtgttgagcggtcagaccggccggcccgcggtctgaccggccgacgctgtgtcggtttcggtttcgggttgttttctttggatatccgtgattgtttcatggttatggcttctagataaatactatacgtatgtaatactgttgtttgctactaatgagttaagttggggatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgcggaatactaaggctagagttgatgcacgtggttgatggagattctatatggcatacgatggaggtattgtgtgcgtatgggatgcggagtcgaatttggaaggagtccaaatttagtacgattggttatgtaaagtttctttattgtactagtgggtttcctaaggtgtttaggactcctagtatgagtttggttcgtggctttaggctgcctacctcatatataaataaagggggagcgtgaggcttcccggtatcgcttttgtatcgcttttgagagtaattgagttgctagtttagttagggtttcgagtttagttgagatttttgtaaggagtgctgttggtgcactttgtaaacacaaagagaagcaataaagttgtcatctaatttaagagttcttcgatttgcgtttaccaggtttcggcggtctaaccggcaactcaccggcggtcaaactggcggcattgcggctgtcagaccggcgggagcacggcggtcagaccggcggcggcgacaagcgcggcgagcagcttcagcggtcagaccggttgatctataccggtcagaccgacggcatccgagcggtcagaccggcaaggtaacttcggtcagaccaatctccatcgatttcgagggtaacttttatttccgctaaaagttttcggtttttgggtatatcaaccattcacccccctctgattggcttagttcttgtgattcgatcctacaacagtcaatgttaatttagggacggtttgagagtagagggttaggctgagttcctaatcaaattacaaacacctaaacaaacacttgggtgaaggtaatcagaggaagcagcaatgactaatgactaatgtggtctctagctctgtttcccattttatgtgctcaataaaaacacattttgcttattttcaggcagccacctgagtttgttatcctacttcaccaaatcttcacctattttataattattctgctgttactagtttggtattccttgccaaaactgcaatatcatatctagctgaactagctagactgtcacatgaagtcgagaacaagttacaatcgcagagcaggtgaagtacatggtgagtttgagtttggcagaatgagaaggtgtaccaaactgtattcaatcatccaaggtttgcatatcatcgaccggcggcggattcagagagaggtggagtctagagccaatctgtaggctcctgaatcatcatccaacgcaatggcccatggcctcaatccctgtttctcggttacaaagttgttgcatgattggtccaatactccaattcacagaaactctgtagtacatgctcttggtctgaccggtgacctctggtagaatactgtcagtgctctctcaaacactgtcaaaaccatcgccgacatcaaacgttcaaatcaagtataaattcactacatttgcatcatgcacatccatgcgaatttcctgttatttgtaagacaacacatcttgatcaaattcatatccaaggctgaaggctcgatctccgggctagtaccatcccatgttacgtacatcagttctcaaagggataaaccttgatagtgatgagtttgtaacactaacactacctaggatattaagagatcctgaacattgaaaataaattaaggtggcggcgatgctgtgttcgattgagcctctcgctgtcttttcttttccttccgatactcgatgatcttgggccatactaagctgataaagagggtataggagccaaggaccaaaagcacaggtaacatccacctgatgacagtccaatcactcgagatggccaagacaaaggtgcaactggtgctaatgatcaccgtgaacaatatggcattcatgagtctcatggaatgactagccaaggacctccctaccgccaccagcgtgatcagaagcgccagggcaatcgtgaaggtcaccgtgttgaacatgatataccaccgtatccccctcatttggccctcggtgagggtggtggcggcgtgttgttgaggacttatcggggaaggagcagaggcgaccgtggctcggaatattataccgctatgcttcatgttgtgggagctaaacgcctgaggccagtcatcggggaaccaggcaggcaactgtatcgccgcctggaatgccatgcccacgaacagcgtggccaccgccatcagccacccgcgcttgttgttcaggtactcattgtcttccctcgatgttcttcgcaccaaaccaaggaatgtttgagagaattatatttaaaaaaacatgaaatttggtatatatagtacttaattatttaagtcatagtatcacaagactacaaatttagtatttgagatagattaagatgaagataaagttagggtacgccaatcgagaaagcatttaacgcttgattaatcgagttttaattattataaatttaaaaaacaaatatatttaatattttaaagcaacttttatatagaaagtttcgcacgaagtatatcgtttagcaatttgaaaaacgtgctaacgaaaaccgaggtaaaatcagcatcttaattagaaaataacatactttagaaattgagtgtcatgttttttccttcacaaaactacagatggatcatcgtttttttttttacgcaaaactacacattttaaaattttacaatggtaagaggtgtagggatagcacatctaaaatttgttttgaaaaagacgatactaaatctatgctttgagatacaatgatttaaatgtaaagctttatgataaaattatttctatatctgtagttgtatgatactatggtttaaatatgtagttttgtgttaattttatcaaagtactagtttagtgaaatttattctttaattcatttttatactacttcaaactgaacacaatctcaaacaagttttttttttctcacggcagcccttgaagagctgtaggtaggaagatatcacaatttctaattatatacaggtaattgagtttaaaagagggcactaccaacaaaaacaagccatctatatcgaccattggtgacgacatcataatttttaaactatcactgctgacaaagactaaaacttccgcacattctcgaaacaaaaaaaaattcttgtcaacattttttttgagggaatcttcttaacatttagaccaatcaagcagaaaaaatgatactactagattgcaaacagaacctgaacattttcgctaggctcgctgccggctggttcatgcggctgatccatggtctgcccgtgcgcgcttgctgcactcctctactccctaaatatccgtgtatattcagagtttcagatagaagcgctagctgcagttgttctatcttaatcaggctgctgccgctgcttatatagactaaccaaagttaattagatgcttggagaccgttctctttggactggagcaaggaatattaatcaaaccggtgtactggtaagtactactatgattctttgctatatcattaatcaataaccctcctaccattacctttttctctgttttctgaaatttttttctcctcggaatagctgccacgttgtctttattggtacagagctcctcgattggacaagaaactggcagcaagctagtatatcaacggtcatatcactgtttccctaaagaagtactccctccgtcccataatataaggga

SEQ ID NO: 64163 - DNA, 23209 bp, Oryza sativa
  unsure (1)..(23209): unsure at all n locations
tcgtttgtgctcctttgttagtctagcggcagtcggtcacgcttagcagcggccggtccggtgttagccttctcccggagttgtgtattggcactgtcagtgtgggggtggtggtatattttttttccttttcctggttacgaccctccagggttgtaatcttgtaatttttttcttgctctatcaatagaatctaacaccgtctcgtgcaggtcgttcaaaaaaaattatttatgattcaaaattaaatgttgtaaaataaacttcaataaaatctcacaaagttaactgtataaatttaaaagtttagcttataaaagcataaaacaaatgataggactggacgagtgatcgcgcagctttttctttgaaagggagtgggctaagtaaggctgtgttcgttggttgtggtcttggggatgaaactaatccctccgatacataaaacgaagcgatttattagcgcataattaattaagtattagtttaatttattttaaaaaatagattaatatgatttttttaaaagtaacttccgatttgaaaaacgtacgatttccggaggatatgagttggggaataacacaaccccgatcgctcgttggcatcacggcggcaggttggagatcgccgttgtgtagctggaccacggaggagatgccagatgcgtttcttgaactccatgattgatcattgaaccccacgaccccccctgggcccacatgtcatctgcccactggcaccatggccccacataccatttgtccattgttgccattttgtcatggtcacctgtctcctctctctctccgagtcttcgtgcagcagtaatggcatggcagatctgggccgttgatcgagatgtcaacagccctgcggtggggccggcatgagacaaaaacaattcaaccgacggtgtggatccgaggggagaaggagaagaaaaataatgggaatcaggcgaagctgctgcctgcttgtacctgtagtgtactgttcgtccggtagtgggggggtggcccacatgtcattggcactggttaggctccctaccaacctaccgaacccaccacaccaggtcaaacgatgaccaaaatattagtagtactacacgtgtactagaagcaggacgaaatgggccaataggagagccggatctccgaacgtggaccagcgccaaaataccacccccacaccacacgcgaaccgacgaaatgcaacatgacctaaccccctaaggtgttgtttggttggagggactaaagtggggctaaactttagtccctcctacataaacataagtccctgtagttcacaaacacctcctaaatacggtttagtactcactccgtcccaaaatactgtttggattggatgtatcgtattactacaaatctagacatatcagattcatagtactaggttcgtcacatccaactaaaacttgctatattttaagacggaggaagtaaatcaccactggaacaatagatttctcattgaaaacaagcaccgactacaaacgggaaatctagtttttcctttcaagtcacccctggaaaatttttgataagtttgctaccatcgaatttcatgtaatctctaactcctactgtttgaatatattttttaattaatgacagctgaatcgagggatgacaaaacgttggaatttcgtaaaaatcgaccggttttcataaaaccactatgtcaacgatttatgaaaaccgatctgtattagcctgtttttgtaccatgttgattgaaagtcatcggtttttatcgattttgtgttggatttcggtgaaccggcgagaagcgatttttactttgaaatcgaaagttagaccctggttgaatctcaagattgatttggacataattaccacatcaaatgtttttccagatacactccatctgtcccataaaaaaccaatctagtactggatgtgacacatcctaatactatgaattaagacatatgtatgtgtcacgtccggtcttagattcgttttttatggaacggagggagtataccgtaataaaacagttttttttgtgagctgtgagggggcggccatgtcagggtgcatcagcagattcagcagacggctggcggtgacacgagcaatttaaaccgttgctttgccgattagttgttgtatagtagctctattgctgattttttttttcaactaattgccttgaaaggcacttcattttttttcctacgtgtctcttttttctatttgaccgtgtatacgcactaaatttaactattttatttttcttataaacacattacaatcgtaaacgctcacaatacgcgcgtactcatccatataaatgcacacaccctacctctttgagcatcttccgaagattgagtcggcatatcttaagattaatgaagtcaccacatatacatcgtctatcactaaaagaataattaggcataaatacaattcggatgggttggtttcaccacaggaacctaacgagttaagctatacttactttggtttctactgatactaagtatggacccacctatatttttatgtgaattcgctattggtcttggcataacgtggaccttaacctaaataaattactttaatttaatttaatcgtgcccaagggtggaacagaaaaaagaaaaactaaaaatctcagcgttcatcgaggatcttatatttatccccgtctccgcgctcgtctcggctccttctttgcccacttcctgccgccgattttgcatctcgcgagcagagcagggcgcgcggctgcttccgccacatcctggtatggatccggatcctcttttctcatccatctctctttatctccacccactttcgtctcgaatttgtttgcgttaacccttagcttctcctcctagatctggaagcagccattttctttgaccaagtagtagcagtttgttcttttcccccaaaaaaatatgtttggatccgccccttgttacgcgttttacttcggtttgtgatacgaagattcgattttattttatttttatgtatatgtataagatgagattaggagagtataaatggtttgaggtttcaagaaccaaattgattgatttgagtgttgttggattgatcgtcgcagggggtggaatgcttgccaagatgcagtcgtgccgatggatcttggcttacttgctcgtcgttctcgtgagcctgcacggtggtgccaatggcttctacctcccgggcacattcatgcacacctacaccccaaatgaggtgatctcagccaaggtcaactcgctcacctccattgagactgagttgcccttcagctactacagcttgccctactgtaagcccccggaaggcgtcaagaagagcgccgagaacctcggcgagatcctcatgggtgatcagatcgacaattcgccataccggttccgagtcaacgtgaacgagtccgtgtacctatgcaccacggacccactcaccaaggagcaggccgagctgttgaagaagcgggcgcgagatctgtaccaggtcaacatgatccttgacaatctgccggtcatgcgattcaccgagcagaatggggtgactatccagtggaccggattcccggtcgggtacaacccgatggggagtaacgaggattacatcattaaccatctcaggttcaaggtcttggtccatcagtaccaggcgcagggtgatgttgtgatcaccagtgaggatggcgttgccatggtggagtcggatcgcaagagcggattccagattgttggcttcgaggttgtgccttgcagtgtgaggcgtgatcctgaggcgatgtccaagctgaagatgtatgacaaggttgattctgtcaagtgcccattggagcttgagaaatctcaggctatccgtgagaacgagaggattacattcacctatgacgttgagtatgttaagagcaacattaagtggccatcaaggtgggatgcatacttgaaaatggatggtgccaaggttcactggttctcgatcatgaactcgatgatggttgtcttcttcttggctggtatcgtgtttgtcatattcttgaggactgtccgtagggatctgacacggtatgaggagatggacaaggaggcgcaagctcagatgaatgaggagctctcaggatggaaacttgtggttggtgatgtcttcagagagccttgctgctcaaagctgctatgtgttatggtcgctgatggtatccagatcactggtatggcagtggttacaattgtctttgctgctctgggtttcctctcacctgcttcaaggggaatgctcttgaccggaatgatcatcctgtacctcttccttggaattatcgctggatatgtcggtgtccgtgtttggaggacaatcaaaggaacctcagaagggtggaaatctgttgcttggctgacctcctgcttcttccctggcattgttttcgttatcctgactgtgctgaactccatcctgtggggcaagaagagcactggagctttacctatctcactgtttttcacactcctggccctgtggttctgcatctcagttccactcacacttattggaggtttgctgggtacacgtgctgcaagcatagagtaccctgtccgtaccaaccaaattccacgagagatccctgagcgcaagttcccgtcatggctgcttgttttgggtgctggaacattgccctttggcaccctcttcattgagcttttcttcatcctgtctagcatttggttggggaggttctactacgtctttggcttcctgttcattgtccttttcctgctggtcatagtctgtggtgaggtttctttagtcctaacctacatgcatctttgtgtggaggactggaagtggtggtggaaagccttctttgcttctggttctgtcgccttctacgtcttcctatactcaatcaactacctcgtgttcgaccttaggagcctaagtggaccggtctcagcaacgctctaccttggctattccctgatcatggcccttgccatcatgctgtctactggtgctattggcttcttgctgtccttctacttcgtccattacctcttctcatctgttaagattgactagaggcacccacactcttgctgcaataggatcacctgagcatggtgatagttatcccttagaaacatatcacacaataatattgaattgaaaagaaaaatgtaaacatggcaacgcccatggcttttggccctgattaattctatcatttagcatagcacagtttctttaagttcatgcttatgttttgtaggcatgtctgcaatgtttcagctatgttttttgactttgtaatactattatgttttgttttctctgggcatttgtgagcagcctttgttggaacactttgacagatattcaatattaaagagctattcgattacagtccttatgtttcttcccctgatattatactgttgaatgcttggtaactgctacttgttatgctgcttccgcttgctctgaaacttgtaacgagataatgctgttgagcaattttcttgataaacatgtatgtgtctacatgagttgctgtcaaccttgccgctgtgaatactcgttttctgaattctgaaggttgtaataaggtcacagtttttcagttagttgccacatgttctgacgtactatgtgacatgattcactgtttctggtaagctgtaacagtagaacagcatacacagcttcaaacccctccaagccctgtattctgttccctgttcatggtctgcttacagtattctgatgttcgcattatttgcatcctgtgttgtctggtattggatcaaatagattaataaaacatcaaactgctatatctggccttaacgcacggctctcccttatgtgtatttacaaatttaatttgaatttatatgtttatatgcatgatatatcttatcaatttatcttgttaatcttttttcatgatatatcttatgtgtatttacaaatttaatcttttttttagttaatcttccttgtcatgttaggatttcttttatttttggttggtgtgcttgtttaattttggactgcgccttttagtgtgctacttcttataataattggctgtagctctcatgagcaaaggtcgggatgtttcactccattatcttaaaaaaaagacatgaaaaacgagggttgtaaacactttcccctttctatcgttcctttcccttcgtggcaaacgtccaactactgctttattagttgtaatgcagtcgtaagatgcagaaaagatgttaattaattaacaaggttggttagagtttattttgtctaggtagtgggcactggatggtgatgttgtctttgtcctttagtaatcgcagttatcagaaggtagatcactgttcagttaatacagtcgtaaccaatgatactagagtgtgctaatacttagtacaaagatactagaatccttttctcatggatctagcatgtgcccataatttcttggatgcttgggcaatgttgcatttgtagtttctgttttttttttaataagatcaggacacacacaactaaattattaattaaattgtggaccattttattcagtctaattatccatggttcatactatgcatgtcaaactatcaggatgaccaaacttgattaacttgacatagtgattcttacaagcagaaagcaatgcgccatagcagtttaatacatacctcctccatcctagaaaaaccgagaagttgttggttttttcaaggatgaagatttccacaagaagcataaaaacacacacaaaaaaaatgcatcagacaaaatcatcacgcaatacatcaactgaagtgagttagtgacagtcggacaatagtttgctaaaaataccattctgccaagggaaaacctaatgtccatttctctttcctcttttcatgtcataatagctaaatcgtttgcaatgtatgtatttatacaagacaatccactggctcttgtttgaagttgaaagctcgcccatgaaatttgactgacaactcggtatctactgacagttttctgatcaatggacagactagtgtataattttccagctccttgtagaaagatcactcaacctttgcaaaccctccttccggtagactactgtcattaactgcttctcgcacaaatctacaaagcaaaatggtagcgtcaaataacacggatcagttccaattgaattaatccatccaacgccactattattctttaatgttgcgaccaaaatgggagagagcagtacatctccaggtaactaagctagcatgattatgatcaatacagctttaaaagatgatttatagaaattgggtcagtgttcaacctacaaaaccaaaagcatgcaggatgcaaaaaattaatgaattctcattatttttgttctacgtagccgtgaatagttcagtctcagcctatatacagaaaactaactgaaaggtgaaaaacaaaccttgtcaacttttcctgagatgattgcaggacgtagattgcaaggatgaaggatagaacaagccctgcatatataaaaagaagctattttaggacacaaatgtgaaagccattagaactagaaaactatcacactttgctatatcagcatagatggcatcagaacataaatgttccgttcatgatataagggaaatcgcaagagtagtatagcatggcaaacaaatgctatttgagttaaaacgaactcaccagatccaaacaacacatagaaacctccaggaacatctatctccgattgctcctccctgaatgaatcatttcaagtccttgaatcaatttcaccctagtttgttatggtaaagatctttttgaaaggtcatagtaaaattttaaattacaaagtaagtttttaccatgtatatctgaccagaacatattttggccaattctgttgatcccagaaattcttccttatgtcaggatgatgttcaacatctggataacaaaatgagcattggttagcaattagggaaatcgagaaacaaaacaacaaaatcagcctgtgaataaaaataatttactaggtgaaagaaaaaccactctaaaaatgatagctatccttgaaaaagtctagtctattggaaatttacaacatatgctatgtgcccttatacaaggcccgaatattgctgcggtattgagagagagagagagagagagagagagagagagagagagagagagagaagtcatgagcatttgctgataactcccaaaagggctgctctatgagctcaccattagttcactaccgaaaggtaaacaaagttgactacttgactacactaagataaatctttaaagattcccctgaactgaaaaacaatgctcataatgggtttatataaacgaactacgttcaggaaaacagacatgcaaagaacataacttattaatgaagcgctgctacacatgaaatgttttgttactatttggcaaacatatgtgtacatggtactgcttgcatgagaaataataacaatactaaatatgatagaattatataagtttagacatatgcaaaaagatatatcacgaggacaggtgataacaatacatacaaatgtgtacatggtactgcttgcatgagaaataataacaatactaaatatgatagaattatataagtttagacatatgcaaaaagatatatcacgaggacatgtgataacaatacatacaaatgtgaggcatgtccactactttagctgtgacaccaagtaaatcatttccagagtatttctgcgtaatcaaaggtagatcaaattaagcacagagacaagtcttgctggaaaggtatatagaaactattaagcaaggactcaccaaatggaaatcaatcattggaacttcagagcttttgcgatttatgacataaagccaaggaaggtggaacttttcgtgaccaatttgaaatgttctacagtgtcagaatcaggtaagattgcaaaacacatctccagaaacacactcatatacaggttgtaaatctcatatgttcataacatttccaaccttactaccatttactcttttagttctctacaacagtcaattgaactaaaagtcagttcgtcttaaccttacaatgagtattataacctagcacaaactatgcagaacaccataccttctgaattctctctctcaaaaatgaaaaataacaagaaaaagttttaacaatttatgatttcagtcacaagattctggtgtcacaaaatcatcaccgattatgatgataaccttcaaagtcatgccctacagcttactgaactcactgttctactcaaaattgtatagaacagaagtgtaaattttccgtctaaaacatgaacaacagcagaacatcttactcacatcttgtaaggatctgcaccggtgaacccagtcggcttggggatcggcatcataacctgcacaagagagaccaacccaaatcaccaaaaccactcccccacacacatgaaacgaatcagagatctcgacccctctctttccaagaacacacccccatctcacctcatggttgaccgcgaaggacgggcagtggcgtcccaccacatcgaaccacaccgacctcgactgcaaacaaacaaaaaaagaaaaaccccacctcgcagatcagatcgcgccgaagaacaacgcaaatcagcctcagaatccgaaggctaagcggctttgctcacttacgccgtggtactggccggagcggagcatggggacgatgtcgccggggcggtaggcggacgcgaggggggcgaggagggccgagaagaggaggaggaggaggaagaggcggtggtgggccgcggcggggctccggcgggcggccatggcggcgaggtggtcgccggagttgggggtggagggtgagattcggggtaaatgggttgggttcgatttggagcgtcagatttggcgatgcctattggacttttggcttcactaattttggcccattattcagcccagtaatggtgcatgtagtagggattttggcccaattaattactgggcctacaaacatatggaaattcggttctgtttgtgtttatattttttcttgttgaggttggaaatgaacctacgaaatttgtatggaataggcagcaggaagttacacaatttcatttagcatagtttttttttttacctctgtatgtatatttctgaaaaaaaaatgtgaggcatgtccactactttagctacatgtatcacactttcataatatttgaaattcattatatttttttttcaaataacagaatagacaatgctgagtgtagattagttggttaggtttcttacgatgaaacatttaaatcataaacttgtcgcagatgctcctatttacgaccaattgttctatcagtggtaggtgatgtacctatcaacaaacaggtcatatgtgatgattttgctaactttaagacatgctgctttaatcttcagaagtataattaaagtagctatagtttacatagggtgtaaatagaaaaccatgcaatacagcttcataaaaccgtcttatactgaactagtatgttccttttacttcatagaatattctatatttgactgcattgagattgtggatgcggttgaaaagtgttctggtgcactggtgctaaagatagatgagggcatacttgacgttgacatcccccagttccataattcactggtggatagaatgacataagaattagacctataatagtcccgcttttcatttagtttatgagaagatgaggttatcgaatttacaaaataaactaaaatttggaagttagaaaactcaacttttctatatctcagaagatggctaccaacaaaccgtttttcagaatcataagttctgccaaacaggctattaagctcggttcgaaaactcgtttatctttttaactctcttgatagctaggagcaaacttctaaacgatttattttgaacaagaagtttttacaaaagctttttaaaaataaaataaactcatttttatttatagtgattaatatttgattaatcacatgttaatgaatgcaactaaaagcctaccgccaaaatcactattgaactaagcataagccttagtaattattagtacactgcatgcgcttagtatgttatttattttcaatggttttgtagacatatagttataaaaaaagaagtccttttatatctactttaacccttatacgaatggcaaactttgtgacgatcgacagaacatctcaatttctttttaaaaagtaaaatgaactgtttatccaaacattaattttgtttatagctgatacacaactcttctctcccacaaaaaggggaaaaaaatgcacaactctacatgactacatcccagaatagattaggcagcattctgacgctattgcatggacaaaccattatccaaagaaaaaaaactaccgaaaaagtatagaaaatccacttcttaagctttttactagtggctagtatgattttacaaaggctgatgtaaaaagaaaagttaaaaaattgacgtaatttcaggtcgtatttgtggtgcaacaaccgttcaaccaacacagctagcaacaagagtagaaacaaaaattcccctcctattttttaccaatccccagccataaaaattaaaacgagaaaaaaaagaaataatccccacaaatattaattgtataaataaaatcgaaaagaaaggaaaaataaaaaaaatatccaaaaataaaaccccctccactcccatcccgtttctccccctttccccttctcatggagtcgtgtagcttccgcaccgccgcctcgccatcgccattcccctcgcttccctcctcctcccgacaagcgccgccatgctccagcctccgattccccgtaagaagttccctccttttacggcgggtttatggaaacttttgggttttttttttctgatgtttttgggattttttctttggttgttgcagagaccaagaaacgggaggatggtgggggtgcggaggagggcgtccggattcgaggccttccctcccctacctggtaaggtgttcgtcgaggaggtgagcttttcttggtttttgtttgattcatgggtgtaaagataagagttttcttggttaatttcttgtttggtttgaagaagtctggcttgccctaggcgcaaatgtggtattaacttcgattggggttggatttgctctgtgcgacctccggattaggcagggattcagcttgctctgatgcttctttagaatacaaactgcacatctttgggagaaatcaatgccatttaagtggttcatgggttaatttccatcttttcttatcttggttgtactagtggggtggaaagttagctcatgcttcttccatttcggagcattggcgagtttcgtctaaaacagggcaagtgactaagtgagtttcatttgagtttgatggttccctttggtgaattatccccagtattgctgttcttgtagttggtgggttcgatgatgtagtactcttagctaaggagtagatttttagttctgttgcttggaatcttggtagtcagttaattaccatattcatatacttggatcacttatgactaacatttctgaacgttcccaagctatggtttatattattccattacatgatacactcttcgaggataagagctgtttacctttcatttttgtaggccaggactaattagatgtgcatttgttttttaggcaattggagctgaatatggggaaggttttgagacatttaggatggatggaccactcaaggtcgatgtggtgagtatacgtcatttaacttacatggcaattttttctatatctagcatcctgtattacttccttaagttacattttgtataagtttcctttcattgtttcaggattatctgaacgaaaaattgcaagaatgcttccttcaaaggataagacatgctatgaagccagatgaagcatgtgggcttattttctcatgggacaacgtaattgtgagtttttttttttgttcttgtgctagtttgtaatagtgcaatgtctactagcctactagtgatatttatttcttctaagtggcacattaggccttctcgtctgcagttactcgttgtgaagatcattcaaacaaactctaccttacgtgttaataatttaaaatttgtttctgtttcaacttcattacgggatgctttgtttttttggtttgaactacactggttgattggtagagaagaacaagagtcagcttccttaagtccattcttctcagtagtttatagagctgttacaatggggaaacacttttaatcacctaggtggacatccacccatttgttgcatgtcaactaaatgggtatgaaaagaaaatcaaaaaaaaattgacaagatatattcatatgtaatatatcaccccacaaacatgcaagttcaaattcgacttctacaagttgtaataaaaataacaaatcaaactctgagtagtatacgcatattcacagttaaatttgttatttttgtttcaacttataaaagttgaattttaagttgcatgtttgtgtagtgatatattttatatcaatctatcttgtaaatttttttgaaattttttcatgatcatttagttgacatgcactaaatgagtggacgtccactcgagtgattagaatccacctccattacaatgcccattgttgcatctataattgactcagatttgtcatcctcttctgttctcttaggctgatacagactcactaaagttggatgcctggagacagcttgctttggaagaaggtatacctttaaaataaaaatattcagtgtaaagttttatgaaacatactattcctataatgttattgtatgggtccttttcttttttccgacaatgcaaactgtagaaatcattttcttactcgtttaagttcatattttgtcttcacattcagattctcagtggtatattgtctgcaaggtctgaggagcacatacattaacttactataaatataagattcttattgtgcaaccttttatgacttctcattcaattttgactgaataaaatcggtctaaactacttatttgtcattgaggtttgtgtttacctcactgccagggatgctaccttgatattgctaataaatttatttcatgcagggaaggatatcccaaatgctggtcatgtccaaaagagtattcttcatggtgctgccgaccatgtgcttagaaaggtatgagttttctttatacatacggaaggtctatgttttagagttgataccatgcttgcatcatcaattagctttggtactttttagtaacactaatttgccactgaaagttattttgctgcaaacaaaataataataataaaagcatactctttgttgggcacattctttctattgtgcatatggctttccttttgcaatttgcacccagtggcagttaaagtggcaactctacttgtccttattcaggttttatgttgggcaaaagatgaaagtcaaatggaaagactgaaggcacggcttatagagttatactacgaaaatctcttcaaagtaattatttctacgcttcttttgggataaaagatggcttaaattatacataattgtttctgattaagtatgttcatttcattcagcttgatacaccagtaaatggattgcgggaatggttggatgctgtccagacagcaggcatcccttgtgctgtcgcatcgtccctggataggagatgcatgattgaagctttggatcgaatggaactaagcaaatacttcaaggttcttttttttgtatcatcctaatttccaagttttaccaaaacattattttctgaaatacattcttcgaatacgatgtatatcagaagttaattttattcattcctcctttatatttcaggcaattgtgactgacgaggatgatatggagtcaatagcacataggttcctctcagctgctatgaaggcatgcttctgctccgcttcaaaatatttagctgttttcaggatatactgctcacatgtttgtcaaacctgtcttttctcaccagctggatcggaagccctcaaagtgtgtggtgtttgaggatgacccgagaggcgtaaccgctgctcacaactgtaccatgatggcagttgcactcattggtgctcatcctgcgtatgtagttctctcatttattttttcttttttggaataatattctttgaaattagagcacagtttgttccattgctttcagatctttctgttgaactacatagcaaatcttggctacttacctgcggaatatacattttgtatgacatgtaggtatgagctggtacaggctgatctcgccatcgcaaaatacagtgagctctcggttatcaatctcagaaggttgtttgcacataaggggttaagtttcatggacttgcagaagcagatcatcgagaggtcacctcccaagaggaagctgacagtagacaccatcttctaatgaattctttacctcccaatactgaaaaagagagaaaagaaaatagcaccatgcatcctccctactgtgctgtgtatatagcattccatgttggttagattacatagaaagctgatgttagatgatctgttgttgcatacctccattctggatgtactagatgtaaactgatgtttaaccattttaatcatgataaatactaccagtctaccaaacagaatcatgtccagggttatgaagggtgtgcgcttctgatgtgtgggcctatggagggtgggccccacctgttagggattgatgccccctcggacttggaacaatgcatattatgtacacacaagatacatacgtattgagggcctatttggtagagctccaactcctaaatttagctccaggagttgggtctggagtggagttgtgtagctgcctaaacccagctccaccactctagttcattttgtgagagctctgctcttatgttaggtggagctgaaactgtttggctgagctccagagctagagctgtgctaaacaggcaaattgaaaggcgcacacctgcagttagataagttaggggctctctaaaattgggctattactgaatatatgctcagagcaattacaatttattctattgcttcagttggataagatggaatacaatttgttgtattgcttttagatctttttgttgaaactgtaccactaatctttgcttcttactaccattttgcactccttacagatataggcaagagctggaacttgctgaacagcttgagcaaatattccagaggtcgcctcctagcaggctagtctttttgcaatgggagatttgctctggtccagcaaaaagtatctcgaggtaacggtacctcacggtaccaaatcgtttccgatcgttggatctacctggtcaggatgtacaatgttagatccaacgatcgtaaatgatttggtaccatgagataccggtacctcgagctactttttgttagaccggagaaaatctcttttgcaatggaacatagcgatgttaccgtaggtattaggatttaagtcagctgatagtagacaacatcttataaaaaacgagcgattccttttactgcttaattgtatttttcctctttgtttctatcaattatcttaaaaaaagggaacaattccatgctgtttaataacatattaacatagcgctgagccgctgatgttagatgatctgttgcgtagctccatttctggatgcagcagttgtaattgtatggatggtttacagggaaggatcaactgctagaaccatgctgctgctgctgttgacctgttgttgtaagctgacattagcagatgatccatttattcatgataaataccagttttccaaacacagacatggacatgcttcagaagtatatgcattcttgtgtgttcgcagctggtatatatggcagacgtacgtagtatcatgctaatgctagcagattgaaagagacgaaaatatctttattttttttcccttccttaaaaaaaaaaatgaagagaaagagactgaaaggcagcacggtagttgagcagagttatattcctgttgacagcaacagttaattttgggacagtttggatgaaaagggattaagcaaacacttgggcaaaggaaacaaggaaaacccctgttatttttcctttcttctcagccgagaaatttgataatttaacactttttttcattgtcgaattactttaattgatacttatgaggatgacatgtgagaccatctgagtggataaaattgagacaagatgtcaaataattgaagctctaattctgagccccctgttttgtgctccgttcaaacaccagttttcttttctaatattcagacacctgaatgtttttgctctctctcacctcaccaaatcttctctaatttgtcctaaatatttagctgttagtagtttggtagtatctcttcttaaagatgctcgtgccatacgttgtaatatcataccgggtcgatggcgactgctgcgtctgcttaataagaagagcatcaaagcaaaaaataattcattttgcgaagaacaataattagtactcccgtcccataatataagggattttgagtttttgcttgcactgtttgaccactcatcttattcaaaaaaatttgtgcaaatataaaaaatgaaaagttatgcttaaagtactttggataataaagtaagtcaaaaaaataaataataattctaaattttttttgaataagacgagtggtcaaacggtgtaggtaaaaacttaaaatctcttatattataagacggagggagtagttgatagctgagttagtaatagtattaggcagcttctcttgccaactctagtgagactgtgacatgaaaacttagaattgcagagcaggtgaagtcgtgaagatgcaggagcagagtacataacaatggcgttaggattacacgttcagagagtgagctagagcacatcgttgatttttgttcagcgatcatcgatggatagacggcggattcggcgagatgtggagatcgaatctgtcgccgacgactctgccaattctgtccaggttaaatctctctcttcttagatgaaaattgcatgcgatttactgttgatgagtatgtttaatggtgattagttcatggattaataagcttattatatgttcatcaattgcatggtgtagaacatcaggctggtgattgacatcggcgacaggacgatccaggtccctctcaatggccacaccgtcgcgcagaacatcggccgtcaggctgccgccgccgtcgccggcgattcgtcagccggcggtgtcagtgagaaagccggtggcggcggcgaggagtggctgcaagaacaggacggcttgttgagcatgcgcgggtggctgatggcggtggccacgctgttcgccgccatggcgttccaggcggcgctgcagccgccggggtggatgccgaggccgcgcgactggttcgcggcgctgctcgccgccgacccggcggcggccgccgtcacgagggaccaggccgggaaggcgatgctgtacctgatcgtcaacacctgcaccttcgccacgtcgctcgccgtgctcctgatgctgctcgccgtgggcgacgccggcggcggcggcggcggatgcgcgtcgaggagggtcaccgcgaggctgatcgccaacatgatgacggccgtggcgctgttcgccgcggcgacgttcgcgctctgcgccgccgacgactaccggctcatggcgttcgtcggcaccgtcgtcgccgtgtacgccgccgtcaccgtcgtgttcgtcaggtgcaaccttgctctgccgttccggagaggcggcggcggcggcggccatggttgttgtagctgggtgtcaagattgtaataagagcagataatactgggccggccatgcatttgattcagccatattactatacacgcgcggcgcaacgcacaataacggagtttagtaccacatggaaaatttacagcggtggagacctgtataaaagaggacgtggtcgtgttgctcccgccgagcttggttgtgcgagcttgtcaccccagctgtggggggcgggagttggcaggattggccgatgttgggaggatcgagggtatagataagatatctctcctccctggtctcgttgggttgttgaggcacagatgctaattctatttgtccgactttggacttagggggaggactataggtgtcatcaaaccccaggcccaatttgcggctggttgagagccctgcgttgtttaacgtcggtggcctcctggttgctttaacgatagaagcccacggtcgtatcctgtccaacttctcctcttttttatttttatttttaatgatgctactctcctcttttctttttatgatgctatttttcttttacttttcccttcaactagcaagtggggtgaagatgacaattagaattgcagagcaggtgaggtgaagatgcatgagcagagtacaaaacaatggcgttaattatgttaggattccacatttattttaggattccacattcagagagtgagctcgagcacatcattgatttttgtgcacagatcgatggatcgattgattctgtcgccgacgactctgccaattctgtccaggctaatcaactcagctcaagtgcttgcaatttactgttgatgagcatgttcaatggcgattaattagttcatcaggctggtgatcgacgggacgatccaggtccctctcaatggccacaccgtcgttcagaacatcggccgtcaggctgccgctgccgtcgccggcggtgtcagtgagaaagccggtagtgctcggtggtagcggcaacagcggggcggcttcggcttgttgtgcatacgcggatggctgcctggatggtggtggccacgctgttcgccgccatggcgctcgaggcggcgctgcagccgccggcgtggatgccgaggccgcgtgactggttcgcggctctgctcgctgtacctgatcgtcaacacgtgcactttcgccacgtctctggccgggatcctcatggctgatgctgctcgccgtgggcgatggcggcggcggctgcgcgtcgaggagggtcacggcgaggctgatcaccaattaacacgatgacggccgtcgcgctgttcgccgcggcgacgttcgcgctctgctccgccgacgactaccggctcatggcgttcgtcggcatcgtcgtcgccgtgtacgccgccgtcaccgttgtgttcgtcaggtgcaatcctgctctgccgtttccgggaggcgacgccggccatggttgtagctgggtttcaagattgtaaacgcgtctatgcaaaattgggtcattggctttgtatccaaaccacgcaaggacacattgattctgcaaaatcacgatgagacgaaacataataagaccggatatgataatttactgggactgcgggccggcctgtgtttaattcagccacagcccatattattacacgcgtaatgcataagagcaatgttttgtaccatatgggaaatctacatcggtttaggccagtataaaagaggacgcgattgagatgctcccgccgagctcggtggtgcgagcttgtaatcccagctgcagggggcgggagttggcaggtttggccgttgttgggggatcgaggtatataggagatatttctcccccgggtctcgtgccggatgcttgttctatatccgactttggcccaggaggattgtggatgttcatccaagccctacccaattgtggttaggttgcaactagtttgtgagtactctagcgttgtgttcgggtcggcccttgcgccgcctaacaaaaacgtctaggtcactccctttctactcacgagagaagccacaaccctatcctgtccaactcctcattttttttaaaaaaaacatggtacattcttattttcacaccctttccactcacgagatcatccacggatttgatcactacaatcgatcatgagagaagcgacggtcctatcctgtccaactcctcttttctttttaaattcatggtacattcttactttcgcaccctttccactcacgagatcatccacggatttgatcaatacaatcgatccaaactctaaatgtgccaaatgggtttaaagcattaaaacctatgtcttagaggatcaacctaaataaagattggaaagaagtagaggacaggttttagaaaaaaaaaagctaagttgttggaaaagcaaattattatctgcaggtagtaatccaactcttgttaattcaatgttgaggagcgtaccaatatttatgttaacctttttacgatcctttggggaatttttttttaaaaaaacctgattataatgattgggtattctaaacttgaatgagcaaactagatgtttgctccgcaaatggttattcaggttaataaatgaggaaggggtgtggcaaaatattctttgaaacaaagttgatggaagaaaactatttctttagttgaaaagaaatcaagcgattctcactttttgttaggtttgatggtcaaacatgagttttgtgtccaggttcttttctgttaaaaaatggaactcaaattcgtttacgagactatatgtggcttggacggaaaaagccttaaagagcactatccaatgctataggaaaaagtctgaattacccctatgtactattgtatgagtacgaattactcccataaaccacaaaatcaaacaaccttcaccctcaacttttcataccgaacgaattgcccccttgactcgctctagagcggttttggtcctacgtgacacacacatggcagttatgcttcttcctctcttggtctcctcttccttgactcatctcggtcgctgtcgatctctacccatcgctcgccacctcaccggccccagcccaaagctaagccctagcagctcgtcatcttcgtcatcgccgctgagacttgctgcacctgaggttggcgcttgctgggaggtgcccatggcagtgggggagccgacgctcgcggacagaccagagatggcttggagagaggtggaggtggccgacgggtgcgcttaggtcatcacggatgtggaggggaccgcctggcggcggccactcatggaggctgccgaggaggcccaacacaggtgatggtggggaagaggtacaggcctcggcgcaaagacggagggcacaactagtggcagtgcgacaaggagtcatcctcgccccacaaagggagagcagatctgacacacccgtgagctggtcggcgatcttcgccaccttgcgctacaagaggagcgtgtcacactcacatcccccacgaccaacgccatggcccgccattgagggtaggaggaggctgctgcctgcaccgtgttgacgagagtgtgacgggattgggatggtgtctatttttaatatcaacaatataatttatggggtgcacaggaccaagaaaagttggtggcatagaaattcctaatcaaacactttaggctaagggagtcagaggaagcagtaataatcatagtgatctctatctctgccccttattttgtgctcaaccaaaacatcaatggtgataattttcagctacctgaataatattctgacgcagctgcggatcgaggcagctcccgggtctcttgttaatttcacaactcgctaaacctcactaattctttactagagagtctcttgtcttaattattctgctgttagcagtttggtggctgggtattagtcagctactctgcttctctagacttgccaattctagtgaacaacttagaattgtagagcagatgaactcctgccgattctgtccaggtcggttaatctctctcttcttagacttgtgtagctggacgtttaagcctccttaagttgtgtctctatttttttaatcaaggatctgtttgtactctgttttccttcttaattactacttccgttttttaatagatgacgtcgttgnncnnttnntnnnttnntnnannnttttctctttttaaataaactcccctcactttttatctttcctctctaaactcttctataaaacaactccctctt

SEQ ID NO: 64164 - DNA, 809 bp, Oryza sativa
ggttttttccctttaaactgctgcttttatgctgtttcctattatatctcttgcttctctgtatttaatctcttgcatatatttaggtcacgctcctgctttaatcttggttggccacctgctgaaggttctaaatttttgcgcaagcctgctaagaggaaacgagtaagtagtcatccatagtattttagggctagcaatgtggctgtgtgagttgcaaacctatggaaaaatcagcctatgtgtgctttttgtatcatttgagattctcctttctatcagttagccaacagtactttcgcaccactgggattagtttccttagagatagattgtgtaacattattttttttccgtaatattagataatagatcagaatcctatgtattaatttggaaggttgtcggtttaattagtaagttagagatagggatgaaaacggatcggaaacggacggaaactagctttatcatattcgttttcatatttttttcggaattggaatcggaatcgaaaactcggatacggaaatgaaatcgaatattatcgaatacagatacggagcgaatatgagacggaacgaatacggtagcgaatatttaccggtatataaaaaacccctcaaattgagtttcttgatcaaggaagagatatcgcttattattttagttcaaaatctccaacatttatatcgtcaattttatagacggtcccacaaccatatgtgaaaattgattttcatggctgttcctcttaagagatccatatgcaaaaaagaattatcattttctattcccaagccctttta

SEQ ID NO: 64165 - DNA, 2282 bp, Oryza sativa
tttgctgtcagttgatcactgatgctatactgcataatgcatggtcaatgactgccccgggctaatgaacaatcatggacatgatcaggtcgctcaagaacaatgtggacaaagccacagggccaacgtcaagtacacctcccagtttgacaaacaagtgagggtaccatatcgtaggactgtagtaggctactcctatggctagtaagtagggtgcagcagcgcggcgggcatgatgctgcccccagtggccgtgacgccgcagccctcatttggctgtcagcgtccttggtcccaccggtcagcgtcccgtagggtagggttggctctagggggcggcttctgttccgacaaggtcgggccggttcggaggtcgcgtggggcccaccctgctggggcagtggattgtgcgctttggcacgcgcgcgctggatccgacggctgtccaccagaatccgacacgcccgggcctgcgccaccggtgcccacgaggacgatccgacggccacgatagcacgatgcgatgcgggctcaggcttttcagagagagtctgacctgtcgctcgtagcagcggtgcctggatttggctcttctgccaggacgcatcatatcctggcgtgcacgtttgattgcaccagaccagatcatccatccatggcagaggacaactggaatattcgtttaatttttactcatacaatggccagtctagatcctacaccaaaatttttcaccctatcacatcgaacgtttcaacatctgcatgaagtttaaatataggcttaaaaacaattaattgcatagattgcgactaatttgcgagacgaatcttttaatcctagttgctacatgatttgacaatgtgttgctacagtaaacatttgctaatgattgattaattaggcttaataaattcgtctcgcggtttactgacgaattatgtaattagtttttttattagtggccgaacacaccatgcgacaccctatataatacccgatgtgacacactaaaactctacacccttggatctaaacacccccattaatgttgtactttttttggtcctaatataaggccccgtttagatcccactacaaaatttttcaccctgtcacatcgaatgtttaaacacttgcatggagtattaaatataggctaaaaaataactaattgtacagattgcgactaacttgcgagacaaatcttttaagcctaattgctccatgaattaataatttggtgctacagtaaacatgtgctaatgatggattaattaggcttaataaattcgccttgcggtttactgacggattctgtaattagtttttttattagtgtccaaacacccaatataatatccgatgtgacacgccaaaactttatacccctgcatccgatgtaacatgccaaaactttacacccctacatctaaacaccccctaagtgcaacttggtgtatttgtgacatatcctaaaactagtcctagaaatatcacatatatactagattacatttatattgggattgagggagtaactaagatcaaacgattttgtacctggaccgaaggtaagctatttcgatattctgcatcgtttgctactccctccatttcaaaatgaagggcttgtttgactggcgggtaacgtacttcactcataaaatcagcagcgtgtagccatagcctagatgttgaacaggcatgtagttattattgttatgaatttggtagccaaaaatagctatattttactatagagagagtaatagtactatctctgtctcataatataagggattttgggtggatgtgacacattttaatataatgaatctagacagatgtgttgcatccactaagacggagggagtattaaactctaagggcgttcacaatgtacacacatggcgtgtggcaaagtctatccacctaagcacaatgcgtgtgtggagaagaaaagtaggtgggacccacgtgaaaaccaggttcgcgtggcttgttttggctccgaacctcagcgaaatttgtcagagaaaaaacatgccacacacagagcaggagagagagagagagggaagaagctcgccggagaagccacttccgcgccgaagaagctcaccggagagggagatgagtaggggcgccgacgccaccgccgtcgtccgcagtaccgcggccgtgagatccaccgcactgctcgacgccgtttccgtcttctgacgtgccactcgaaggccgctcaacgccgccgctatcttccgccgcgccgagctcca

SEQ ID NO: 64166 - DNA, 563 bp, Oryza sativa
  unsure (1)..(563): unsure at all n locations
agagaggagcagtacaaacaactgcatgcatatccatttagcaattattaattgctccccaactccaactccatcatctccaccaccacctaaacccacaaaaaactaaaccagaaaaccgcttaaccgcaagcgccgaggcggagagcggaggcagacgcagacgcagcagccgagcacgcggcgacgcccacgcccacgcacacagctcggcttcccggcggaaaccctagcgggcgggcgggccccaatggcggaggagggcgacaaggccacggcggcggcggaggcggggggaggagcagccgctaccgccgccgctggtggtggtggtgggggtgggggtggtggagcngaggagganagcgtnaaactgttcgtggggcaggtgccgaagcacatgacggaggcggagctgctcgccatgttccaggaggtggccatcgtcgacgaggtcaccgtcatcaaggacaaggccaccaaggcctcgcgaggtgcggatccgtacgccccggatctgggctcgcgggcgcttgctcgtgccccggggctcgatttggggg

SEQ ID NO: 64167 - DNA, 773 bp, Oryza sativa
gatcaatctcggtgatttcatcgattcaatctccaatgtcattggctttgtcgtttcactagttagattgttctctaactgcagactaatctcctattacctttctttttcttgttttcacgcaccggctgagatcaagacgaagtcccggtgtgtcttctcgtcgcccagtacgatctgtataggtaccggcgtaaccttcatacgacacgggaacaattcatgtccatgggatcaacagcaattgagtgcttcacatgcagatcaactgatatgcacggcttaatatcaaaccctagcttgatatatgtattacacagttaagcatgtaatattttaaggctaatcaaattatatttgtttattttgcatgtatactggagcgatgcatggttggtcgcatgcccaggatggcaattgagatcaaaaaatcgttcattaacgagtgatgggatttggcagtgctgcggttcctgacctccttgtaatttatatatttagattaattactaacgcatattaatcttctcatgattttttattgcatgtatggccgtcggtgcaatgcttcctactgtaaccatgttgccgagaggggtacgccaggacatagtgcgtggctcgactactgatgttgatgatgcagcgttcgctcatgccacacacaacacctctaaggccggttggctgcaccaagcccatcatgtcaacaaaatcagagagacgaatctacatgcaaatcagcctcgcttacaccattggcctattatgtc

SEQ ID NO: 64168 - DNA, 2005 bp, Oryza sativa
cccccttaatactatacaaaaatgcccagctagctaggtgtatacgtatacacatttaagctagctgcccttaatacctaatgattcataatgtatagccttttatttcttttgtccaaatagaacactaaacaattcaagaaatgataaagggacccacacatctcctatgaaggtttctgtgtgctgaaaccacgctgtttcatctcccagctagctaggtcttctgatgatatgaatatgaatcatttggacgtggaaaccgcagataattcagcacttgacctttgttttattcttaattacgcatgcaccctgtctaatcatctttgacaggattccagtgtaaattatctgataggtgaatatcagatagctaagcatatatatgcatgttccacaaagttcagagagtttgcacgcgtcatgggtgcaaatattgcctattggccataaaggatgcatggaatcaagggatatcccaacatatagtgcatatataattaagttttaagatcgacattctcatcccaggcaacttcaattcgtctttaatcttgcaaactaattaacacacaatatacaaatttgtgttctcgaaggtacttcccataaagatcaattatacatggaaacgacacatatgactcctcacaaaatggatcaacatctgagcaatatagtgtaagtttcaaaagtcaatttgccttgtgttgtggatatgccattgtattgctaactgtaatgctcatgatctcccacaacagagcgcaaatggtgctaagtcaaccattcatgtgtatgtactatatatgtatatatagttactagctagtatacatatattcttttttgggaaaattggaactatgccattataattttgcaaaattttagatatgccatcctgacccacatgtcattgactcatgtgggtcctacatgtcattgagataccgatggtatatctcaaactttgcaaaattataatggcatatttctaaattcttttttagataatggatgaaactaatacactcatatactattaagttcgtttattagcatatgcgattataagttttaaggtcgatcaattatttttttcattaagtataaattgatgaattaattagttttctttagttcatctacttgcattctaaagcatcatctttgtgagagcaaattaactgaggttgcactatatttaattatttcccatgcatattcaaattaaattatatattcgcgaaaacaaatatcacaataaaatcaatattccatacaaaatggatcaacatataattagcttgagctaaaaaaatcagaattcattttactatatgtttgtggtgaatgctcctatatataatatataatgccaataattaatattgggtagaatttgtcactcccatcccatgcatacgcatatatatagctacgcatgcgtgcatgcagttttcacattttggtccttttaaaaaacttatttcgcaaatagacccctaaaaaaactaatcccagaaatggtcctttttagggcgccagagtggctggcgctgccatccaatgggacggcgcccgcctctctggcgccgtcctcctgccaccgtggcgcacgcgaaccgacgtggcaggaggagggcgacagcatggctggccccgccgcctccattcctgtccattcctgtttctctgtatggagttgcaacggtgtcatttttttttattttttcggatgttttttcacactcaggatcacgatacaaccaaccacaaaaaaaatttaaactcgaactaccacttagctaagtctgaaaatatctagcataccacttagtctactttgcaccttcactaaaattagactataactcttttagtaaaaccctttgatcagcatgttaaacataatgcactctaccactatatgaaattacttaatctaattcaaaatataaccacatgaaatgacatatataagttaaacagtacatag

SEQ ID NO: 64169 - DNA, 1668 bp, Oryza sativa
ctgtctaaagactttgcagtcattggtggagtgggaaccagaattgtgccacttacaatactttcttttccctagttcctcagccgatgggattatgtggccagcaggaagttgtatttgcttctcccgaagtagcaagtcaaaaatttatcagctttagtaatatcatttaagcaacaccccatcttctgtcgatatataaccttgaaaacatcttcatcggaatcggctgcgtcacctctatcagctgtatcggctgtcctctgtccgatccatctcagccgatgcagactccagccgatgcattcgcagtcgatgcacactctgttcttcgaatcgatctctttatcgaatccgcctcgatcccaatgtcaaacctggttcacaatttaccaaatttgatcgtcaacaggtggcgctctccccttgcacagatccaacaacagctaccatatctcgtcacgacggcggcgacctcagcaatgacagtgggcgggagcaacgtgcaccgccgttgggagcgggcgaatctcgagagtggcgatgggcgggcggccggcgtgctagggtttgggattgtgcaaccagcagcggcggagctgggttttctttttgagaattttatttatatattttgtgattttttttgtttttgcatgtggttggcttaaatgcccgcatgcgaaaatcagattttcgcatgtagattttttagacctttgagctcatgtgggccattcacacgcatgcaaagatcgatttgggccatatgaaaaatgaaatttgtagtaggtgtctcttcttcaaattcagataaagatatttgttaaacaaaagtctgaaatgtgtgcactgaccaagtgaccatagagaataaaatgctcaattcagtaataaatatgggatacgtttattctaattcctaaataaaagataccagtctccaaaattttcagcatgcatgtatcaaatctacatgacgaaagagctaaatcaacccccattatttgtatatgacttaaatagttatagaataaattgaaaaaaatagtaacatagattgtgttgatattagtctatacataaacatgtatgactaaatttgatctacaactagagaaataaaaataataaaatcagacagtgaatagtactcatatagataaaatttgttatttttgtttctacatatgtctatcgaatttagacttgcatattcgtatagtgtcttatattattatagtccatcttatcaaattttacaaacatacatgactaaatttgttctacaattagagaaacaaaaataacaaaatcagacagtattcactacccatatagcgcaaataaaatttgttttttttcttcatatatctatcgaatttagactcatatgtttatatagtgtcttatattattatagtccatcatattaaatttataattttttatataactgtttaaattacatgcataaacctaggtttagaaaatactttccacagcacagttagaatctgaaatgttctggcaatgtatcttctgaaatgtaagaagctaacaactgcactaatttgaatacacaagcccagatcaagcgaactaatcaaatcaatattgcaattctgcacaatgctaataaaaagaaagcgagctgaagatgcacag

SEQ ID NO: 64170 - DNA, 726 bp, Oryza sativa
tgcattttgcttgcacgcgctcagtccggatcgcggcgtgcccttcttttcccaaaaaccgctactaaaattaggccgctttccccccttctctccctgcttgtgttcacagcaatagcagctcgggttggcttgggacacttaaaatattggagcagagcagcagcagcagtagtaggcaccactatgaattgcaagttgccttgtcccctgtttgcactctcacgaaaccgttagttctgtgcacatctttccgggcatgccccaccttgtgtggacaacagtatgttgtatgcaatgtgtgtgtggggtaggccaaagttggtggtacttgcaaacaaaaagtcgctttaatctcgcaccagttgcttgaccactacaggaaccgagatgcgttgccattttgcctattctgatgatgccatgatctggggtatatttctgatgtgttgttttggatttgtgatcgtgcaggccgagtacttccgtcaccttctcaagcccgtgacgtaggttgaccagtacataatcctcctcccttcttcacccgacgagagagctagctgcgcagcttctctcacaaggaaaaaaacagaggagacaaacagagtttggaagttaagagcagaagaagatgcagggagaccacgggtactacggcgggagggactcgccgccgcaggggtacggctacggcggcggctacggctacggaggggctgcagg

SEQ ID NO: 64171 - DNA, 968 bp, Oryza sativa
caattaatagaattaatatagtatgcacaccacaggtggtatatagtatattaataaagtatcattaaaaaaagaaaagaaaagatggtgtcctttagtttgttctctcttgctaattaagtttcctggctggataattaagttgtcaagcgtacgtgtcaacgcactatattgtgtacgtaacatgacgtccaaatcatgcatgaacttacttgatcagagaggtgtttttcttgtatttttccaagtaacacgtcgccctcgtagacgcacacacagtagaaaatattactatcacatcgatgtactagtatatatgtatgctaatgtgctggcctttttcacatctatctttgtacagtatctaccatgcatgtctttatacgtagaaatatatataccattatcaccatcatccttgcatgcatccacggtacgttaataaaatcgtacgtagggcaaagttatataaggagtatatacgtacagaagtacgtatatatatatatatatatatatatatatatatatatatatatatacactgatccttatatatactagtagtaatatatatcaattcgtatgctatagtattgtgagcttatattaatataattgtgcatgagaaaaataatgtaattggggggatcctaaataaaaccccacttgcattgggccatatatgtatatgttcaaaagtcccaaataatttaaggtacagaaagtacggaggaaagaaaaacaggacacaataagcacacgacacccagagcaaatgcatatcgatctaaccttagctacctacattgacaacatgcttaagcaagctggcccctgctctctgctgctttccgttggttcgttggttgcatgagctaatggctaatcacgatggacgtaagtctttggactaattgaagtccccaaattgaaatcaattagtgccaggcataacagtcagagct

SEQ ID NO: 64172 - DNA, 22665 bp, Oryza sativa
tgcgctaataaatcgcttcgttttatgtatcggagggattagtttcatccccaagaccacaaccaacgaacacagccttacttagcccactccctttcaaagaaaaagctgcgcgatcactcgtccagtcctatcatttgttttatgcttttataagctaaacttttaaatttatacagttaactttgtgagattttattgaagtttattttacaacatttaattttgaatcataaataattttttttgaacgacctgcacgagacggtgttagattctattgatagagcaagaaaaaaattacaagattacaaccctggagggtcgtaaccaggaaaaggaaaaaaaatataccaccacccccacactgacagtgccaatacacaactccgggagaaggctaacaccggaccggccgctgctaagcgtgaccgactgccgctagactaacaaaggagcacaaacgagatcgcccaaagtcgagaggctttggctagaggataccaaaaacgacgtcttcaagaagataagcgacggaaaaaccgtcatcgccgtccgtcggggctcaaaggagctaagatagggctttcgcccggcaaccacccttgagtgctgagacagcacgacaacgccctcaggagggataattaaccatcgttgtcggtccggccaaggccggactgggttttcacccgctactcaccacccgcgaatccacggttgatgcaccgatgctccaccatcactcaacctctgccgacatgtgggaccactgcaacagtgcccccctcccccctccccggcgcggccagccttcgtgcgccgaagaccgcaccacatccgccgacagctcctcctcgcaccgaggtcgccttctccaccgccggtcgcgcctctcgtgccaagccagcctcctccattggacgcgcctctcgcgctaatccggcctccctccatcggccgcgcctctcgtgccaagccggcctccatctccgccgcctacgcctctcgcgccgagccggcctccgctgccatcggctgcgcctctctgcgccaagccggtctctgacccctcctccaaacgctgctgcgcggccagatgcagccgtctgccacaccctcggatagccgtccgaggccgtcatgcctcctcccacctcagccacggtcgtcaccaccgtgccccctcccaccgcaatcacagccgccaccgccacgacgagctccgcgcctgcaacgacgctactgcgacggcctctgccaccacaccgtcagcgtcaccgtcgcagcgccctgccgccgagcagtcggccgcgcctccatcggagaggccgctccactgcccttggccggccaccacgtcacgcggccgccacgctgctgctcggaccctcgcgctgccgcacttctgctcggctgccgcgccgtcgccacgcctagggtgccgttgtcgcgaaaatagacaaggtgtatataaaagttatattcataaattatttttagttggtaaacatttgtataagcgaaatggaccccgtcatctccgaggtctcaccggtttgcggctgccgctttgcatcgatcgacctgccgcccgcacgttagatttgcaaattgcaagcaatcgtgtttggtggagaagagggtcggtggggtgggagaatccgcgacatgaacagacgaacagcccaacaccaagaaggcaaaaaattaaaaagaattctgatggaagaaaagagtttgcgttgcatcagcacggaaagggacacgtttcttcaggaaaacactacctgcatgtgatgtgcatactagtaccttccagttttgaagtagcccagatcgcaattctcacagaaaaaaaaggggggtaaaatggtgttgcatctggagcaagaaacaaaacacatgctagtttgccatacaagaatactgcttcaagccttcaatagatgatagaccactcaaaggaacaagcagtgtacagtttcatctctgtaagggtgtgtttagttcacgtcaaaattgaaagtttggttgaaattagaacgatgcgatggaaaagttaaaaatttatgtgtgtaggaaatttttgatgtgatggaaaagttggaagtttgaagaaaattttttgaactaaacacggtctaagtatcctgaagctgcacagaagaacaagtttgtcgaacactggtggaatcttgtgctcctcagtaacactcaccaaccactcagaactctagtgatcctggtatttgggaagtatggtacggacgtaatgtaagaattttctgttacaaagcagcaattaacggtggcatcaatcctagctaagatcaaggaggaaacgagagcatgggtgaaagtaggagtatatatttagactctaggagttcggaattttgggagaaacttattacctaaggactcctttgtacatacgagacaaagggtgtgtttagttcacgctaaaactggaagtttgattaaaattaaaacgatgtgacggaaaagttggaagtttatgtgtgtagaaaagttttgatgtgatggaaaagttgaaagtctgaagaaaaagttgggaactaaaccaggccaaaccttatatcctccctttaaaaaaaagcctgtgtaggtaaagtagagctgtagaacagtagaaaacaatgtggatcagtggatggggaggtaaacgctaaactacttaaagcaacccatatcgacatcacccttttgctggtgcattttgtatgtcatgactgttgtgactgacaaaaacaggccaacgccaaaggggacagaataatgcagaaaaccacaacagcaaagaatgagacttgcttccagaaaaaaaaaaaggtgaaataaaaattcagggattttgttatgtcattaactcaggaagacaactgagtactgaataaagcaccatctgaacttaagttccaactgccataataagaggagtgttcagaagttcctaatgacgaaaatgctcaagttgcctaacaatgcatttcaccagagaatagatccatcaacaatacatatggacactgaattgtgtgtgaagtattgttcaagctacccaacgatatagcatttgaaaggacacgctcacctagcaagatgcaggcagacaggcagagcgttgcaacctgtcattttcgcaagtaagcagaaacacttgcaattaataatggtttacaggcttacagcaacgattagaatgacataaattgaacgtgcctacatatggaagtactccctccgtcccaaaataagtgcagccatggttttccgcgctcaactttgactgttcgtcttatttgaatttttttgaaaaaaaattaaaaacataagtcacgagtaaattactattcatgttttatcatctcataacaacaaaaatgctaattataaaaaaatttcaaataagacggacaaccaaagttgggcgcggaaacttatggctgcacttattttgggacggaggtaatacttcctacgtttcacaatgcaagtcattctagcatttctcacatgcatattgatgttaataaatctagatagatatatatgtctagattcattaacatcaatatgaatatgaaaaatgctagaattacttacgttgtgaaacgaatagagtactgaactactaagaactaatcggatcggcggcggcgcgtcctcctgtcgagaggaaacagaattgggaatggggaggggagaagttaaggtaaattcgattttgggcccttttttaaggctattgggtcgttgggcctgaaataatgagggaggaggccttttgagtgggatttctttagatgaatgggcctcctttttttttctatatacatatgaaatagggaaatgttacaagatggtatcccattcgaacgagacgatacctcagagatatcgcctgatacctggtaggtccgttcggacgagaggtatcatcttgtccaaatgggataccatgcgcacgcactggcaagattcgacctcggcgtgcgtgggttgtcgcccgccgccaccaatccggcctccattccccacgtgcaggctaaggtgaagagaaagggggagagaaagagagagaagggagagagagggaggaggaagaagggaaggagagagaatgatatgtgggccctataatatttttttgtgtgaatgacaaatgagtctcacatatatttttttaattctaataccacgccaacgtcacgtgaagcgaagactaaatcaacaccgctgtgtcaacggaaccgccctctaaaaccatcgaagaagtcaagttgcaccgattttaatagtttatgggtcgagatatccggtattatggtttagggatatgaataagattcgatcactagttaaaagagtccaaatgaacttaccaataaagcctctcattttgtttgggccatcttgatcagtccagagaaatccatcatcagtgcataaacacaatcaacttgctctcgttctttctctacttttacggtggttgcatctatcgatagtttttttttctttttcttctctctgcttactctcgtcgctctttccactattttgatagatctggtaagcgcgcagctgcatcattaaaaagaaaatgtagtcccaaaagtttatatatgcgtttgtccgaactgcaagctaaagtgagcaggagaagtgtattactctctctgtgctatagtataaggcatacacacattccaaaattcaactttaaaaacatttaaccaacaataataataatataagttaaattttatttgctaaaattaatataattgaattgacatttaaatttactttaagatggttataattttgttgcaataaactttatagtatatgagaaattataattcaaagattagttttgaagattgtgccaagtttgaccatgccttatattatgggatggagggaatattgaattagaactgcagccgcctcgtcgaggtcttccctggcattggtagcctcgcggctagcgccctagccatgccggctcgggctcgtcgctagagatgttcgcgcagcacaggtgtcgggtacaaccgacgtcgtcctcgacgctgacggtggggatgaacatcttcggtgaaaagatgggagagggggtgaataagaagatgggcaatttgatccaaaaaatctattaagtgtacagaagggtcaagaagtggcatataactatgaaacaacagtgacatgattttaagtgcttaacgatttgccactaggcccacatgtcatagacacatgaggacccacatgttatagatagggtgtggcaaatcgttaattgccatgtcacaagagtggcaaatagttaaatttccctgattttaaatagttaaatagtaatggtgtatttcaaaaccatgaaaattgtagtggtatagatccaattaaccatttttacatacttacctctattcagattcgtgtataaatataagaaacttattttaggacttcattttactctgatggttacatcctctgatagatatgaaatgttgagccatcgtctgtacaccagtcatgaaaacccgcgagacataaaggataatcggttcatgcggcattcgattcactcagccaaaaatattgttttgaacatgggaaattacatgattgaagagaacaattgttccatgttattgcattgaaaacttgttggaaaagaacccctctttgcacttggtcctaaatatacaaaagctccatcactgggtccaaagtaaacataaacttacagtcacaaacttgaaccttgcagatctctagttctctggatctttggtacaaaagaatgaagtctatctgtggatctatgttcccataggaagttacagtgagaaagatgtggagcatatccagatacaatcatacaatatctgttgtctaagtttcaaggcagatctgctatcttgaaggtaaaatcctcccaagaacccttttactgctagtagatactagatagtaatgttaaataaacccaaaaatgtaactggaatgttcattacaatctgggttggcttccaaccctactatccgcctaccaaattgaatcctgtataatgccgccttctaaaaggaaggtattttcacgcccttgagtactttgagctccacatcggtaccttgagaggctcatcatcaaccactccacctccattctcaactttgctcagagagtctgagatcaaaggagccgaatcgccttctttcgcctgtaatatatggcgttttgaagagctgataagatatgtgggaacaattgaaacgattccagaactaatggtgaaccatttgcaagcaataaaattcagactggaagctacctgttgtggggagacttcggcgtttttttgctggccctccaatgtgcagaagtatgagtataagaccattccaactactgcaattaggatgccgagtatgtttctccagctaaatgggtcatgaagcaaaacataaccaaaggtcagtactaggcatgttttaagatggcccaggacttggtaagtgacaggagaagtctttccgatcacaaggaaagtgctgaagttcactgagacagatatcaagcacgataatacaatgaaaaactgcataagaaacaagggcaaaatcagaatcagataaaacaaggtcaaagtaagtcttcgaaagttgtttcactgcttaccacaacttgggatgtgtagtcgaatgcaaatacattttggttagtcaaaaatccatcaaggaatggaccaataaggaagagggtcagtgattgataggggcaagattggtataataattgggttgaagaaaccttgaacttcttctggatagtgtttgtcatctaatagctggttaaggatgacagaaaccaacaacaaaatagagtactacaaaattgtgatccataatagtgatcaaaaggaaaacaaaaaaatagttacactagtagcttctgtttatttagaaagggagcgacatcgcaagagatactgttggcaaatatcgagttatctaacattgcaaatgtaaacaagatgtattgcctacttgaatactcaaaccagaatcaagtgtgactgaccaaagatgataataaaagcctgaccgtgtatgaaaattctactttctcactacagggtgattatgcataaaatttcattttttgggaagaggaaaataagggctgaagttgaaggatacaatttgcgcgatgcaggttgtaataattgccagcaaggacaatacggatcccacagcattgagttgcagatcagtcactgttgcaacaccgacaccaaagaggagcactgaaagggacagttggatactccggctacagtgtcaatccagacaagggttagctcaagacatcatcacacgggcgcacaaaggtataaaacacaaacctgaacttcttcctgaagaaaagagtctccaaaataacagtgcatgggatgatagccagctttgtcatctagacataaaggacatttcggcataagttaggtggattgattagtgtggaagaaagggcacatcaattgaaataaatgcttgcaataaaatgttgtgctgtaataaaagccttctgtaataagtttattgtacaaacagcaatagataaaactgcaacacatcaacaagaagatatttactttacctgtacctctagctatcattgtaccaagggtcaaaaataagtatcactactagtttactactgtaccagacacccaataagcacaggactgcagtgaattaactaggaaattctggccggtacaagaatcaacgtaaagaagatcgcaaaccttgtacctggtaaaatccaacagaattaaaaccaagactcaagttgaggaggccaatggagatgccattgagcactccaaatcccatgacagttctcgagtcgaaaggcttgtgctcgaagaacttcatccataatgctacatggagggagcaaaatgtgacaagaagatgccaactcgtcaaggtagtggctgcaaaatacaattccatgtatggaaaaacagttggtgtcatttatattcatgtaaattctacaaacactaatacattgcaatgcatttgagaaaagaagtaacagaaaatggtaggtgaaaaaggaggctacaatcaacacaagtcaacctatgttccgcacaaaaaaggcacaagtcaagcttgacaataagttccacatacagtgcatgagttcataattcaaattgcagcaccagatcaaacaaggatattactcccctgcgtcaagcaacctggtagatgtgctactaaagcttgttcactgcactagtataaacaagtgaatctaatccacaccatcaaaaccatcaaagtttcatattcactactcctcttagcaaattttttttgttcaaaagcttcaccagaactgcatgagttcgagaaacattttatcctaccactatctctacaatgatgctctccccatctctaaattaaataccacggccaaattcacaaaaatcaaacactacaaaaaaaaatctaacaattgatctaagcacataaatcaataagcaatcctcgctgaaaacaacccctacgaaattcgcagagcatcacagatctacgcgaatcacaagcgaccaatcaagaagcttggggggaagcaaaggaaaaaaaagagcccagatctcccaacacccaccaaagttgaagccgagggagctcatgagcgccttgttgcagatgacaatggagacggatgacaccacggagaggctcagcgcccccaccgtccccagctggaacttctccccgccgacacccatcttctcctcctccgccgcccgccgcccgcccaccgcaaaaagggtacgaagatcaaagcttcccgatcgagggcgccccagccacgccgccggatgcacctgcacgcgggaagagatcccatttcgatcatcggagaggcaagaagcccaagaaacccaagaaatcgagcgaggccttacccggctgtggatctgggcgaatctggcgggggcgtggagggtgggcaatggcgccgaggcggagatctgcgggtggtggtgggattcgcggtggcgaatcgggggatgggagggaaggggggaggggaggagacaaaggtggagtttttatacgggggaaggtcgtccctcttctcgcgtcgtcggtgatgagatggattggaaatggagagagatgaatgaatggagagatggatagaaagatagagagaggctttcagatttgggagctattgattgactcagagtaaatgcatgctattttcttatggttttgtgaggcctgctttagttcttaaagtttttttcctaaaaacatcacatcgaatctttggacacatgcatagagtattaaatatagataaaatgaataactaattgtacagtttgtatggaaatcgcgagatgaatcttttgagcctaattagtccatgattagacataagtgctacagtaaccaacatatgctaatgacggattaattaggcttaataaattcatctcacggtttccaggcgagttatgagattagatttttcattcgtgtccgaaaaccccttccaacatctggtcaaacgttcgatgtaatacccaaaatatttcttttcgcgaactaaacaaggcctgaggttcatgctattttcttatgatttgatgagcttcttttcttcttctcgttaaaaaattttccttccattgagtattttctctctaagataaattttggagggttttttttatgttcagatgatggtttgttttcatgttgtgatgtttcttctttaatatgtaacagaagggtcaaagttaaccgctgaaacggtaatatacatctcgacggctttatgtatactcatttgtcggttttgtcataattaataaagtacttgccgcttacaatgatgtgttactttgactcctttttagcttctagcgacataacttgaggcttgcttcttctaacaaagaagggtgcgagagatagaggggctttcacatgtgggagctattgactctgagagtaaatgtctgccattttcttatggttttgtgaggttcatttcaagggttgggctggtggacctgctcaaccttatttcttcttctcaccaaaaatagtcccctccttttgagacttttatctccaaaattttggaagttttttctttaatgtttggggtgatggtttgttttttactgtggtgtttgccttcaatatgtagcaggagagtcaaagttaatcaacgggatgaatatatttcttgaacggttttctgtttcacttatttgatgttttatcatgattaattaataaagtgcataccatttatggtgatttgtaacttagactttactttgaccaaaaatacatcttgtcgatttgctacatttaattatgacttgtttcatactctcgttgataaaaccatgatgtagatccgtggatttgagttaagcgtacttcttttaacattttttttatttatagaatttgaatttatccaatcgaaaacattttattgctttcatgttgcggtgtttgtcctttaatatatagcagaagggtacatttaaatgttgaaacggtaatatatatctcgatggctttctattccactcatttgtctattttattaaataaagtatgtgccactcacaaacaacaatatggtactttgacttctttttagcttctagcgacataatgcatcttatggatttgaacgtatagctacattaaatcattatatatttatattagatttattccatactcttatcggtaaatttgtgatgagatatatttggttgagctaggcgttacttcttctgacaatttttaattgaattatttgaatttatggttttggcattgatatttattgttgatagatatgtaaataaattagtataatagttttattactatatcaatatataattttataggattttggagacttttttatagggtgatgatttgttttcgtgttgcggtgtttgcctttaatatgtaacaggagggtcaaagttaaccgttgagacgaaatcaaagttaaccgttgagacgaaaatatatcttgaacagttttctgtttcactcgtttatcggttttatcatgattaataaagtttgtgtcatttttgtcgtttatggttatgtgttacttacactttactttgactagaaatatgtcttgtctatttgctataatagaatcattctggacttatttcatacccttattgacaaaacaaccacatagatctagcattgcttcttttaacattttttcattgatagtatttgaactcattctactaataactttttattggctttagcgttgacattaaatgttgctagatctgtcactaaaaatcattatagtataataattttattactatatatcaatataatattataaaattcctggggaaaaataaaatgttgtaaaaggttaaatcaaaggcagcaacagttttataaacatgccaacgatgggatggtcctattatcaatactaaaccatattctattcatgttttaggatccttaaaattatgtgaggtcattatcttggcctaaattaaaaatagagccttagtgggctatgaacacatgcaaagaaatgtatagtgtcagtttataaaccagcctggattccctgatgtcagtttgtgcagcctcttccttgaaaagaaaaatgcagtgttccaatctccaccagaacaagcaggaactcagatcagggtgttagtattccctgtaaataaaatagtccaattcaaaaccagtgaactatcataaacactggccaaatcaattgtgaattctcttttctttgggatgaacatgcaaatattgtttagaattgtgcttagccccaaactatgatcatctgatgcaactctggactattatgggactttgaccagagtagtttgcttgaaagctgggtctaattatagaggagcacaagacaacaaatatgttggtaggtagcccccattggttagttcacttcattttagtttttcttcttggggtcatttccatgggaggaagacaggggaacagccaactagaagaaatcaaaagaccatgtggatcagttgaccctgcctaaattttagaacatttaaagctagattaaaaaaaaagacatggctatccatacatgaagaacacttctgaccgttagatcggcataatctatatcatcggatggtgaggtagtttagtttttcataatcactgtcttatcaaatgagaggcttctctagtgaagttatggggttctgggcatagatccaatgccactctttgttttaggcttgtttggtgatagtaccggagcagatcatgtgcctcataaacaatgttttggtgaggtaactgcagttcatttttatacttggggagttaatcaaagtacaaccatcattattagcattgtaaccacaatgtgatggcaaagctttatagatgcaaaggatcaattattttgctaattctattcctttgctttgctaaatgtgctgtttggtggtcctttttattatgcaagaaaagtggtttggcctatcaagaggaaaagaattggggtttggtatagtgtgaatggttgtcttctcataagccctagctttttggccctttgacatgtgagcaattttgcattgataccctgtccagctaggaaaaaggacacctttccatgtgctgcaagcaaaaacttgttgatgctagttaccttttccgattgttttttcataccaaaagcttcagtttttgggactatatatttggatctgttcaataattgagttcaaattacaatttttcattcgttggtgaaaataacaagtggccttaacgcgttatgaaacatattccgttagatttcatgaatgttttttagataatggattggtaaaaaccagacctctatattagatttcatgaatatgattaatccataatagcggaaataatataatacttcagcttaggtccaaaatgatatgccgattcttttgttcttggtcaaacaatggttgtgcatgaggtattgaggcagtagtgtctaactaactagcccaatcatactgacaatggtccacagatgtcaactgttagtttcttcttttgtgtcctcgcataattaagttggactgcaactacttaggcttcgttctatcctctaacttcaaattacaacttccttgtcttcgttttccgttagaacaattatcaaactacaaactatgcatttttacaaaaaagaaaatatagaatttccttaaaaaataaatattttttttaagtttgtaataattgcttgtacttgattaattatacgttgatgcctgtttcatattgtgtgcccctaaaactaacctagaatttcatccctcgaatgcagctgtagaagttactcttatactttaatcaattaatatatgagtaaattgcataaatctccggtattatgatccaacttgcataaaactatagggaatttgatatttgcatataaccccaagtattatggcattagtatttcacaaaacaacaatattaacaaattttatttaaatctgaacatgcataaaactcttaaatgttgacataactacagtggataagagaacttgtgtagaccgcacaagtcggattttcgttaaattggtcaaattgtgtggtttagtgaaagcatcatagtaaccggggctatatgctacgtgacaaaactcctatgattttgtacaacttgaatcactatacccatggttttgtgtaatttattcttaatatatgaggacacgggcacctaattgtgcacttcctaaataataacatagtcatgcatttgctgaatctgattttaattctagcatgcaaacaagtttcatgtgacacatgggcagatctcaagtacttgccaacaacagtaagtttgatagatggcagagagtatgaaaaaagcgatcatttttccagggtggaaagcaagtcaaggcatatgttcagaagttctctacctgcacgatatcaaccttcttgcttcatgtagggtgtacataggacttcctctagtcaaataaaaagatttggagaaactcttggaactttagtttggccattaatttaatatcagaatgactttaaaatatactaaattaatggtattatgacaatatttttcaaggaaatctacttatatctttttttttctaaactaagaaatcattgatggtcaaacttttaaaagtatgataaaatacagtcctaaacatcattgatggcaatttattatcgtaaatgactatgtaagttagaaaatcgcattgttgtcataatcttactgattatgcaggttgaaaatcgcacggtcaacctcacattggattggatgctactattatcttctaaaacaataatctagtttgcccaagattagaattgagggccaggaagaaactgccaaaaatttgacaatttgactattttgaaaaacttatttgaacaataaaccgtgcaaaaaaacttattacaaaatgaatcgcaaccttagtgccaacccaaattgcaatgagctataacgtctcagcgccaaaaccgttggcgcggagatcgtgtccggggtgacacgagttcgtcaatgacaatggcgttgagctctgtatgacttcaaatagattaatagtagtagcatatttcaaaagtatgaaaattataatgacatggatctaattaaccctaaatttaaatgcatcccttgatggcaaagaaaaaagatgttttcttactacaagattgagttatgcaccgctagtggtggaaataggagtagggcaactagggctgcaatcctactcctaagccagatatccattacaaattacattttaaaacccccaaaatgtataagataaaggcaaaattatgtaaattactctaattgagccctaggcttgagaaaattttgactacacccctgtgcactgctaagaacaaatatgagttattagagtgaaagaatgccctcagactggtgcagattgttagtgaaaaggtccaatgccatccttctgataatttatccttattgacatttaaaatcccaaaatcaaatttatatgctgcgtattgtgtactactactacacaatacacagcataaagtctcaaaatcaaaattatttaattgtattggttagtttatgttatgagaatgatgttagtctataaaatagcataaatgtttctgtaatccaaacgttgtgagttgtgaccatgccattttgtttatccaaagtctggctgctgctaagattgttgcctacaacaattggattagcactttgcagtgatcaaactgataaccttttgttatctttttttccaaaaaaaaaaagaaatttcctttcaaaaaaatttatatttcaataagtaggagtaaaaaccctagacaatatagatggtcatatggcccgaggcccggctcaaggcatgccattttggcccggcccaagcacggcacggcccgactcagggtcgtgcccgtgccggcctggcccgacagccgggctgtgcctgggttgcaccctcggcacggtgggccggcccggcacggcacgaccgaataaaaaaagtagagggacgcaaaatagacttaatgaaccatatcagacagggcctaaagagaagaggaatataaaatagacttattttcagtcatatggacccagcccacagagttgagggatgaaaaatagacttattctgtggaataacacgatgggccctcgtgccttcgggccggcccggcatagcccaagtcatgttgggccgtgcctaggccgtgtgtgcggcccgtgggctagcacgcacggcccgtattgtaggtcgggccgtgtcgacccgactaacctcgagccaggcacggccgggcctgggccatgccgcccgtttggccatctatactagacaacaaacgccaccacggctggctagacaaagtcatagcacacacaactacaacccaacaccagccacgaggccactaacttcagaccatcaacaggacccaaacacatgtcgtcgttgtcgagcttgtgcattaatgacataacatcttcgacttcgcggtgaatgcatgtcatctttactaaacgtgtgttatctcgttattcaacctgctaaaacgatatagcagctctgactccacaacgatgggcctcagcctttgactctgcagcatcacatccccgcaaaggccaacaccaacgccgagcaaatcaacacggacgacgtacattaccttcctgcacgacactacaaggttttctcaagaaagaatcgtgcaaaatagagaaaaggtcttcattccaattccctttgacagtacgattaccacttcttatattgtcgccactctcaattcctattccccaacaaactcgatctaactcaatcctgatttattaaaattttaaatacctggcttatctctaagatgataacaagacaacctactccacgatcgctctcgaggtcgtgttcctacgacgaggtcggcggtactgcagctctcccacatgacatgaattctgtgtttcgaaaaaaaaaagaaagggtattggcctaaacgattatgcaagttagaaaatctcattttttgtaattgtcttactgattgtgcaaattgaaaattcccatcgtttttaacctcgcatcggattatatgctactattatcttctaaaacaacaatttagtgcgtgaaagattaaaatcgagggcagggaaagaaacagacaacacatcccaaaaaacaacatacacacacatatcttagagcccatgatgacataattgtccattgggcacgtcctaccttttcagttgattttgctcaactatacaagagaaacattcccaaatgaacaacgtaccagaagcaaattacaggttaaaagaagcaaatcagagaacaaagttcctgctgtcaaactcatcattgattggattggaaagcacaaggataatccacacatttgacaaagttgacagctgatatgcatatcatctttcaaagatcaagcatagattgatagacatcactatgcccattacctgacgacagttataagagtacacaagaaacgatattgattatcccatcacattgcaagacacaacacagaattcttagtagccggagaagcaacagtgcacaagttatagagcagcagcaagctactggtagaagagagagagagagagacacaggaaagcatgcattgccattgacagaaaacatccacaaagcatccgagaaggatggcatcaggatcactagctttggttcatgttgccatcaccagtggtctcttctggtcatgcagcagctgccgcagctcctggtagccgctgcggtagtgctcgagtgagaagcacagttgcctgatcgcctcgcgcttcccctcggcgctctcagagatcacaagcttctgcatctctacctctttctcgagctcgcatacccgagcatgcagttctgacagggacttgcgggcaagatcggcctgtgccattagcttggaatgctcaagctgaagctgattcagttgatcatccatctgcttcatcttttcatcgcgagttgtgatgtcggttagtagagtggttactttgttgtccaccagggatttctcggataacagcaattccagatcggttttgacattggccagttcttgattcagcctggagatttccttctcgctgttgagggattcattagccttttcgtcgtaaacttgtttgagctctgcctccacggatgccaacttggcttcaagagaagcattggcttcagataattttgaaagctcagcactcagagaggacttctccagtgaatggttctgcaatgaatcatggacagcctgctccagctccttaatcctgtcctggagtactgatttctcctgtagtgttccctctatctgggctcccaagttcttgatggtttctggtagctttgcaacctccatgcctgaattctcaaagtcccccaaaagttgctcaaattcaagaacacgttctctgagcacttctttctcctgtgaaaccttttctaattctgcttgtgtatccttcattagttcttgcagattaaccatctcagaaaccgaataatttgagctgttaactgactgctcaagctcttcaacccgagattcgagcatcaatttctcctgtgatatttttgcaaagtcgtcttcaaaggttttgatgactccctggagctttccaatttcagcctcaagagcagatatatcatgcagatacttctccgaaagtacctcaagctcctgtttgcacttatcaatttcagtatcacgatgcgcaagttcaacttcaaactgcttggctgccgataccattgattccttcagcctatcaatttcatctttgttcaccaatacaacagcttccaatgcttccttttcacttttgacttcatcaagatccttctgaaggctactggtttccacatctgaaacctgttgcttttcctcatgttcagacagttctgagttagcaccaaaattacaatggcaacgcatgttcttttcctcggaagcatcaagtttaccccttacttcatgaagctcatcctcaagctcaataattttttgacttagggcataaaaaatgctattgccattttcttctttagcctcatcaagctctaaatcagattctgaagatgatgaagacccatcactccccttcttggatacgtcagaactcataccagagccaatagaaacatcaaagcaatctgatcgcggtttttgcttttgtgacatcttctcttgcaagtcacgctctggtgatgaaggagactgtgcctcagaatctgattctgagatgccaaaggagacagatgattgcagagatgatgggatatttttgcgcaattctccagtcacattgccatatcgcttggcaagaacacgatacatctgctgaaagttctgtacgtgagtaataagaaccccagccttttctgcagagggttctccttcctcaataagctccagcgtttcttttatctgtgtctccatcactgttcatttaaaagaataattatgttcagggaataaataactagcatactagttaaattggagactaatattgaaaccatcatgaccaagatcttacaaatctcatggctagcaaacgaagtatgttcttattccagcatgtaagacaagaaaaagattatggtctcattccttaccttctaagttatcggagagccacttagaactttttggactaatatggctatcccaccaccatgagctggatttccttgattgcgtcttttgcattttctccattttgataagataatgaaaacaattccctcaagggtgaagacctgactgcatttccaagaacaagtgagaaaatgagaaaaatgcacatacactagtaatacacttgagaataagaaagaaacagcaggaacattatctgtagtacaaacttaaagcagacttcagtgacccaaaatttcaagttaatcattgattcatctcaacattcatggaaaatgtaatctagtactacctccttttttaatatatgacgtcgttgatttttttgacaaacatttgactattcgtgttattcaaaagtgttgtgcaaatataaaaatatttgagtcatacttaaataacatttgatgataaatcaagtcacattaaaataaatgataattaaataaattatttaaataagacgaatgaacaaacgtatctaaaaaaaataaacggtgtcatatattaaaaaacaaagagagtacagaaagggcaatagtcagtagtaaatgatcttgaaacttgaaagccagaaatgtaaactgctaataaaacaatgttcttatattcagctcccattaagcgacttgctcatacaaaggggaaaacaaaattatccaatggtctaagacaacagaagagtaggtcttgcacactttgtaaaatagaatgctaaattctatcaaagaaggccaacatataacttactaatgaagatgtccaatatgcaaaattagacaaatcagatgcagaaacgcagggaccagaccattgacagctatggaggaggcaaaagtatcatatcatccatgatcttatcagtttcactgtcggaaagcccataataacatgtactagcgaacgatagtgatgtttcttcttttagaaatagaaagaacatactacttcgagaatatcactatattagaaattgaataatatataagaaacgtctttcaaactgaccaataatagatttatagtaaagtaaattgccagtgtactgtacgactattttctgaaaaaaaaatacattttacataaggagtgtaaaaataacacagcatccgtaacaaacaaatcatgtgcttctataacccagtcttctcaagtcaatatagataagaaaatataaggtttgtatttgcatactccaaaaactggaggagtcaaagttggtcaaatcttgcaactacaaaatcgtcaaaaacttatttgcacaataaaattggctggcacttggttatctatcacatatcacacgtccaactgcaaaagacacagcaactacaggcctgttgctgatatgtaggtcaggcaacaggataactccctccagacaagaagaatgggcaacacaaattctgccccacatcgatcaaaactctgtgcttcaagcaagatgtcacaagcttgcaaccaaaaaaatgttcttgtcgatgtctatccaccaaagaagtgataaacaggaccggccagttctatattattgaaggccggggatccacaacacatgcattgatcagtgcttacacctagatagacgcatcacgaggtgacgagtgatgaaaagtgtcaccaccctattatctgccaactttattgggacaacaattgattaaatggtctacggcggaagagaaaatcttgatcaaacatatattgctcatttgcacttcaggttcagagattcctaagtctcaacatacatataaacccatatacgtgatacgaatactgaattgcttgctcttttcttttccattttttaatccaagaacaaataaatctatctgctctaaacaagccgaaaaaataaacattgaattcaagaaactgagatcacattcattactaggtgacatgcgtaataagaacaacagatgaatgaatcgatgccattcaaatcatataaattatacagaaaaatggttgaaaagagtcaactagtaactttttactggatttatacgcacaacatagcatcaatctctgtacgacccccaatcgcaggtctccctaaagaataaagtttttttaaaaaaaaaagaaaagaaagaaagagtcactgcaacacaagcacaaaccgccactcattctcctcgcgaatcatagatcgaacacccaacaggcaacaacagacgaccgcaagaagcacgaactcgcggccggggacgagaaaaaaaatcttggcgaaacgggacgagaaacccgcagatcaggtacagtaacacacaacccatcatccccgctcccaacaatcaaaaaggtaagtagcagtagactagtagactatagcagcaggcaccaagaaccaaaccggagatcacacacgcacacacgaagaaagaaaaaaaaagaaaaagaaaaagagagagagagagagagatcattaccccgacgtggagagagatcaatcagagcagcatatcccgcgtggcttgtggaatctggagagatggagaagaggaggaggaggaggaagaggagagatcgatttcgatccggggaggagcagcaggaggcaggcaggcaggcaggaatggaggctgggggctcacacgagcagaggcggagcagcagtggagcagaggaggagagagccagttacgaaaaaggagcagcacaaaaacccaaaacccatcaaagcgtcggtttcttctactgcctcgccctctaattttaaatatagctacgagattttacgtttaatgtttaatagtccatcttatttaaaaaaatttaaaaaaaactcatatttcttctgttctataaaaaatcaataaatctgaatatacctctgtctaaattattcattatagtaaaatatgtactccctccgtcccacagtataagggattttgagtttttgcttgtaacgtttgaccacttgttttattcaaattttttttgtaaatataaaaaataaaaagttgtgcttaaaatactgtggataataaagcaaatcacaaataaaataaataataatttcaaaaaaaatgaatgaaacgagtggtcgaacgttgcaagtaaaaactctaaatctcttatattatgggacgaagggagtaacatctaatactatattctctttttatataaaaaaatacataaagtactccctccgtttcaaaatgtttgacaccgttgactttttagcacatg

SEQ ID NO: 64173 - DNA, 14587 bp, Oryza sativa
tgccttacggtgatatagagtcgccaaccaccctgatatagccaaaggccaaatcaagatgggttttgtaggaagaaaagctaaaccggctagcggagccgatttagaggaggctgattttgatcgatatgaggataattacctgtcacgtgggcaaacggaaggtttacgggacgaacctacaaaggggtaatcgtactctcacagcgatggcagacgatttatggcgcaaatcaacaaagatggactaaaattagggtaaagtagaaaacatggctaaaaagtaatgaaaggtaaaagaacgattcgattaattgtatagattgtttgatattttacaattgagctggccttgtcccttaaatagggattggtcttgccctctacaggccctcctccacgttcaatttgggatagaaaccaaaaggaacccgaaacatagccccctgagtaaggaatcccgacacccgacgaaaacagagtcggcctcggactttgacggtcagaccggccacatgccgccggtcagatcggcccttctggaggaaatcggtagattaccaaatcttgcaattttccctatttcaaccccaagtgccaaatttgggtgtaaacaccaacaacaaaccataatgatagagagagaaacgtttgatcaacataatattttctgattttttaaggatactacttttattctacaacgtaatctacaaagaggaaccaacccatacgagctcagtttgattgttctaaagagataagtagatgaggacgggctcacgttgctcccagtgtcagggaaaccaggtgtccccaaacgcccggccaccaccgccccctcctcctccttccgccttgccaccgcccgagcggaccgctcgcaagctaattaattggggcacctaggcgcccatgatgaagacgggccagattagggccaccgcggttggattcgacgaggagaagttggggaggggggcttgggaggaggggggcggttgcgctagttgtggtgggaggccgcgaggcaacaggaggtgacgggtaagatggcgggcagcgaaggaaagaccgcggacgaccatggctatcgaggccggagccttccagatccgctcagcgggtaaccggcagtggcaaagacggtgtggtcgggcacctctgtgcctagacgatggcagggacaatgatagtggcagtggcagaggatgtggcggtgcagtgggtggatgtgaaggatctagaacgtacgtccggatctggtgttcccgtccagatcctaagtggtggtagggtggtcggcgtcggggcgatgcaatgagcggtgacagcgtgcaggcagggagtggcacggtggccgcctagacgtaatgtccccagagatgtggctcgtggcaacgataggcgacaacgattgtgggtgggatggggagtggctgcacgctgttcaggtgtggagacgaaggtggcagtcctcccccaaagcccccatccccttctcctttcatgccgacaggagtgttggcgacgggatgacagcgacggtggctatgtttgtggtctgtgcagaaggagggagaggccatggttcaccggatggcggcagctctcctccttcgtagcaacgagctacgatgtaggcgatggtgggagattgcgatgttggtgcagagtggtgttgtgcatggacttcggcttcttcctcgagaaggggcctcctgtatggtgtccgctggcgattggcacttgtgcggtagccatgcgttgaagggattttggatggtagcggctgttgggagtgatggagatgtggcatgggagggccaaaggttctttgggagaaagtccaggctgtttagggttggcagcggcagcgctttctggcgccgcaaccttcttggagacgttggtgtggagtcttcttccttcctaggggattattcgggtgaaaattgccctgctcctgggacaggcgatggcgacacccttggcgtcgtaacctcattggaggtgtcgtttgaaggccctttcccactaatctctaatctagatgatttgtcctcctatgccggcgcttttgggatggccatgttggcgggtctgcgcgggggagagtggatgcatccttctctctcgccttctccctctcctacctaaaagcatggatagatttgagtgtggtggagtcatagacgtgcggtgtggcgtgttgtgtttttttcctaaatatagcctttcagggctagtcttgaattttttttagagtaaatttcactttgcaccacctaaagtgaccaaagtgtcacattggactagaactaagcctataatttcactttgcaacacctatctttaccatccattgcaagttggactgggcttacagttttgagccatttggttggcttcagcttgatccacgcgaggagctgagcgtatgctcgtgaatcgtgatgggagcgataccaagcacgtaaagcgcatcagtggcggtgtgcgtcaacgcatgggaagcgtcgtctcagtgtcctataccagcaaagcccatgccatcaccaagtagctgcgcctccatgactctatccatgggcttgtgcttcaacaagaagaataagagaggaacaaatgttgcgctcgctgtgagttcaatggcggcaactgcacacagatgtgaagaagaagaagaagatggggagtttccttggcatcgggacatacaggacgagctgctcacgtcaatcgggccaaagccaaataggtgactcaaactataaacccagtccaacttgcaacgggtggtaaacataggtggtacaaagaagtaaaaatataggcttagccctagtccaatgtgctactttgatcactttaggtggaccaaagtaaaatttactctttttttatgctatatcagtatgagacattgcactgtcttacgtggttcgttggttaaaaaagatagaattttaatttaatagtaatatttgagaaaaaacaaataaattactacctttattttttaagtatgacgttcattgaccttttttatcaacatttgatcattcgtttattaaaattttttgtgtaaatataaaactatttaaatcgttctaaatgaatatttgataataaatcaagtcacaataaaataaataattattacatatttttttaataagatgaatgttcaaatgtatctcaaaaagttaacggtgtcctacattaaaaatggagggagtaattgttataaagctttgtttttcaaaaagcatgtaagtagtcctacaaacctttctagaaacttactatttaaaagtttaaaaaaacttactattttaaaagtttaaaaagcattcccgcaataatttatctataagagggaaaagcttgccagaaatctaaaaaccacaatgaatgagttttgggctgtgttcggcatggagagttgaaaactaaaccaccaccaccccccacccccccccccccccgccaacacacacaactaagctactcattagcacataattaattattaagcattagttaacaaaacataaaaattgattaatatgtttttttagacaactttcctataatcttttaaactgtttagcctcctttgattgaaaggaaatccataggaattttagaggatattattcctataacaatttgtttctatatagtcctttgaatcaaaggaataaatcatatgaaatcctatgatatacctaatgccatgcaaattttgaaggaattctataatgaggtagaacctcatggaaacattcctatgagtcattgtatgaaacatgctacgtttttcctatgaaacattcctatggaaatatgctacgtttttcctacgctccaatcaaacgattattattgtgtttatcatgtgctttgtaattctctgtttcagacttatattcataccaaaatcttgtgttttttctatttatatattttctcaatcttgtgttattcaaaatcttgtgttcttgggtgagggttcccaaccctcacctcaccttttgacacgaaaaacagagcaatggattaatgcgtgattaattaatattagttttcaaaaaacttcaacaatgaattaatatgatttttttaaagcaacttttctatagaaaaattttgtaaaacaagtactgtttagccgttcgaaaagtatacgcacaagagtgagattgggaacttggactaataacacatcctaacacagaaacgtagggcctatttggttctctaccctaccaattaattggtagtaccaaaatctaggcaaattttggcactaccaattttttggtagagcaaagttagctaatctatgtttggtttaataccaatataaagccaaaatttagtatgagagtgaagaagattctagaatgtagccaaattgagcgtgggcgctaccaattgtttggcttcaatccaaactagcatgtttactattaaagttaccaaaattttggtagggtcacattttggtttcaatccaaaacgacccgtaaagttgaagctaggagaagtgccgaacacactaggtgacacgtagataatccatgtcatcccatgtgcaccgtccaccccgatccacgcggccatccgtgcatgccacgtgttccgctggcgaatgcgacgacacgccacgtacgctagcaatttagcaacgggaataccgtatacgaatcgaaatatattaatataatactaacatgtacgccgttggccgtacatatcgaccacgaaacctccggacacttcccgcgaggcttgtttagattaaaaaaaatttaggcatcacgtcaaatatttcgatatatgtatgagatattaaatgtagaaaaaatcaattacacaatttgcaagtaaattgcgagacgaatcttttaagtctaattacgccataatttgataatgtgatgctacattaaacatttactaatgatgaattaattatgcttaataaattcgtctcgcaatttacagtcgaaatctgtaatttgttttattattagtctacatttaatacttcaaatatatgtccgcatacttcagaaactttacacccaaataactagacacacattaaatcgaaaaatatatatgtcgtcgcaacaagctagtttggcctcttgcctgcacgtacagtctgtttaattaagcatctgcttccacttcgtatactagttcgtaggagtatataactttcagcttgatttgttgttcaaaatatagtaatccattatacaagcgcgagatggccaacagtacagctagtttggctttggcatatcgattagccacagtctcaatttttaaattttaaaacttaattacagagctggtttaagattttgtttcttcattgtagtttgttttctgatatttacctttaaattaaactactaataatatattataaagtttcacggatcaaatatttttctgtaaattagatccacgataggtaggtgagatcaatcgtaaaaacgtgagaaatgagtatggcattgcaacaacttaacatataaatgcaatctattaaaacctaataagtgagtgcacaagtgcaataacttacatgatggatacgattttggtacatttagaagtgatgcgatacttaattatttagagcattttttctaagtatatacctgcgtcgatttatataggcatacttgatctttatcattccagtaattaagattcaattaaattttacactgttagaaaattttgtattttggttgagatttgagaaggtgaaggaaaaatatctaaacatgtggtgcagattggatgagcaacttaattcttatatattacatatccaaggttgtaaggtaatattggcaccactctttaaattgttgcacttgaaaattcaattctcaagtttttttttgtattacatcatacccatctactaagttgtgtgcaattactcttacttttggtaagctttattcatttttcagacacataggtactacttacatttcaaaatatagggcgcaactgtttttttcgatatttcataatacgatgcgcatatacatgcgtgcaattaactagatccttcctcctctctaaaatttgtttttttaaatcattcaaccttaagatctctaatctcgttaaaccgtctgtctttagtatcacttagatccatgatcttgtaaattcaacatctagatctatgatcctgtttaagtgaatcatcacatgtccaaagctcgtctgatccggttgacctttctacgtggcggtccagcatgaccgcaactttgcacttagcgccctccacacccggttgacccacttctcctccccccccccaaatatctcctctacccgcggccactctcactagaacccccatccctccaactcgcaccattgcaacgactccgagggtagcaattagggtggcgtcagcgatcatgggcggtccgtggtgaccagagacgcgttaagggcagcagcaagttcaccgaattagcaggtgatcaagctttttcctccgtgaacttgaagaatacgtgctgcttcgagtagctatggccttccctacaggcgcacttcagaaattaaatccccctagctgcctccctcgtcagcaccaccctaccgcctccctcgtcgtcgccgtcatagccacgtctccactaccacccctgtcactgtcaccacaaccctaaatcaaaacaatgaagatgagaagacatttgggagagaagtgggtcgaccgggcgtagaggggctaagtgcaaagttacggtcacgctggtcagacgggccttggacctacgataattcacttaaacaagatctaaacaagatcataaatctagatgtcgaatttacatcatagacttaagtgacaccacgccccaactttaagaaccgatggtgtactttactatatatttattagggtgatctaaattagaagataataataggtggttgcccctcatactttggaatggagggagtactacttctctctttcatgaaagttctgtttttcctaactattattttccgtgattgatccaaataaaatcacctaaatattttcacaatttaagaccattgtaaaatttgatttttcttgtttacaataagatatcttatttcaataaaaaatcataattatttgtaattatataaatggctaaaaaaactcttcccacaccttcgcatgtgtcacgcccagaaattcccgaatagaattccaagcagaatgtgcattaaaatccccgtccaggaccagccggcgtacacaaacgacaatgttgacattcagatccacgtcttacaaacatcataaaagtcttacaaaaatgcagcggaaaacaaaaggtaactggagctaagccttgactaaactgcagcgggaacaccactccacaggcatcctcgacagcacggacaaagcctactcctcggagaaaccttcatctgacccgaactcgaactctggggttgggaaaagtagagcaagactgagtactacccactgtactcagcaagtcataccggaataggggtatgatgcagggaattaacaaagaagagctagagtggttcatttgcataaaacgagcatttataaacagaaattgaatgcgaaaacagttgtaaattaattaatattaaacatccgctgtccaacgctagcccacgttgcgacaggcccaaccatccacctaaactatccaaattcaaaagattacactagggtgagactaatcacggtgaatctggttgaccgcccataaccgcgggcactgctattcgaatagttttactctgatcagaggtgtacaactgtacccacaagacacagccccacgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttaattaaccaacaccaaagcggtgtcactaatccaacattatcataaaaacctatagtctaggttttaaatgagatctccccattgtgtgctagttgaactaagcatggctaagcaaaccctagtcctaactctaatcatgttataacccaagctaacaaaggagcatggtatcaaaatagcatggctgtaacaataggtaaccatcccatagtattattgcaaaacaaatgcggtatttgaaagaaaacattaggacatttgcaatataggatcaatatgatcaagtgacaagcatgacttgccttgctctgctgctggaggtacctcggcgactatctcaaagtacaccggagcgtcggaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagatatgaattttagaagattctctgtgtttattactataacaaaaatccttaaataatttattgcgcaatattaaccagggctgacgtcagcacggggcgcggcgccgacatgcggggcccaccggtcagcgactcgggagagggaggaaggggcgccggcacgcgggcccactggtcagcggcgcgggagagaaagggcggcggcaccggctcggcttggctcacggccggccgaccgaccgcggcgacggcgacggcgcacgcgcgaacgggttgccggcgacggcaaccggcggcgaaggcgacggcgcaaaggcgatgcggaggcggctgcgctaacggcggctaggaaggggagggaacgggcggcgatagaggcggccgccggctcggctcggcatcaaaaccgaccggccggctaggtctagcggcgacggcacgcggccgacgacggcggcaaccggcggcacgggaggcggcggcggcagtcgaaggtgacggcgcgcgacactaagaggagaggaaggggaaaaagaagggaggggtgcctcaccgagggtggccggcgcggaggaagacgatggcgaacggcgacggcaagccacgggaggacgacgtcggcgagcggacgagcttcggggtgccctaaggaaggagaagagagggattagagagaggatgataaaccacggcgaccggaaaccatggccgaacgcggcggtggaggtgatgctcacccgtgcgcgagggggtgagggctccggcgacgaacctcgacggaggagaggtggacggggtggatctcggccacgcgaatccgacggcggcgacggcgcggcctggcggcgagcctagcggcggctagcggcggccggagcagcgaaaatggcggcggcaaagggttgcacggcgcgggagcgatgggaggctcgagagagtgcggcgaaatggggaaaaagcgagagggagcgacggcgatgcttaaatagggggagagggaaccggacgtggccgggagaggcgggaatcgccggccgacgtgagggagtggggaagagagagaggcgggattcgattttcgaatcccggccatctcgggcgcgggcgcgagcgggagagagaggggagtgggcgcgggagacgcggcgcacgcgcgggcgtggtcgacgtggcccgggggaggcggaggcgagggcgcggcggcggttgcggcgcggcggcgcgagcgagatcggcgggaggtgggagacgggcccgacaggtgggccccacctgtcggcgacccggagaggagggcggcgggcggcctggctgggcctcggcctgcggccggcccagtaagggggagggggaaggaaggagggaatgggccggcggcccattcggaaaaaggaggaaaaagggagggaaaagaaaaaagaaaaaaaggaaaaaggattttccctggaattaaaacattgcttgctcaattttaattggttaaaattatttctagagctctgaaaattccactaaaaatccctgttaatgagtttcgacatgtagaactcaagaaaaattccacatgtcaaatccgattattatttgcattactttcttagggttttctcctgatttcacctgcattttcttagggtcatttatcaaaattacaattttggcttgggaggaaaacttcggggtgtgacagcatgccactaataaaaaaaatattttcgcagacggtcaaaatggctctatatggaggcagccaaacacactgcctgcaactaaactttgcaaaatacaatattttttaagcggatatgctcgtacatttacgtgcttttaatcatttgttattcaatatccttgattcatagtttcatatatagtcacccaattataatataatccatatgagttgcaatgtaattacctcacaattacattataatctatctattatatactaaaagtccattaaatttcctataagcgctcctaagccaccacgtgtcctcctacaaacgctccaaagataccaagtggcattctaaaagtctaaccgttgattttcctttaaattggtgggtccaatattttcaaccattagatcaaataaaaaaataaaatcctcctctccacaccggtccccacctcctctacgttcccctcctcctcctcctccagttggtacgtaacgtacgtactccctctctccccacatatcctcttccctttcctaatcttcaatctatctattatctattatctatctattatctactaaaagtccattaaacttccaataaatgttcctaagccgccacatagcacctctaaaaacactcctaagttattatgtggcgctttaaaaaattttagaatgcagtggacctatatttataactattagatctattataaaaaatacaattaaatttacctcaaaaactcacattgtatgtgcacgtataggtataaaaaaacaagtacgtccatactttgatacgtacgtacaacgttgggcccacatcattctttttttttctttctcacttattagatggaaaaccaatccgcctatatttatcgtctcactttcccaaaaaaaaacttaattacatacgtcatatactatggacaaaacaataaatcacaaaaatatatcaatatattaatagtaaaatcagaaagaaatactaataagaaaaatcataaacgccagcacttattgttgtcaatagtctttaaactacgattttattaaaaataataccacacagaaataagtaggaggcaaaaattataattattttcatcacctcctcttttttccatccctgtccttcaatgcagggtgtagtgtttactatgccattgtaaatatcacaggcatatgcatatggttgagttaagatggtgtcagtaaaagaccaatgtagacaatgtatctaaagtgacattcttactaatgcaatcctttgtgggtgtgcctatagtgaactaagtgttaaaatggtgcgataggatggtctttaggtgcacttctacatcaatgtgggacccatgtttcagggcattacataagaaagcttttgtagttatcgacttcatccgttagagagacatttatgtctatttttaacggtgctatcgtattatccggtagaagtggtatgtttagactatttatacatagatgtggaaataagtcatgggcatcgagttaagcagtgttgatgattttttaataatatacaatgcagtttcatttattaaaaatgcacatagcttttaaaactataacaataggggagtttatatatgaccacgacaaaatgatttttatttaaatatgagagatattcttattcttatatttagtagtatattaaaatataccatctattttacagcaaatatatttcttttttattggaagataatttacattcccttacagtgtatataatgatatatgatttattttactattctttttctagaacaacaaataagtgtcagtgcatctatgcggcctttatttccagtttatattttaaaaatattttctaatttatatttcacccttatagtgtttgaaatacaacctacgatacatgtccgcgcgaatgcgcgggctaccttcctggttacatttagaagtgtttcacctaaaatacttgcaaagtttcttagatagtcccttttcttgtttgatcataaaagaagacaaaaagctgactaactgtttttttgaaaaaacaaaatcgtgttagttgtgctgcttgtgcaacgtatgtttagtcgaatgatgtattaaaacgagtcgaatctttaattggagaaaatgaaaccaaattcggctttatgcacagatgttccatcagcacgtgtatatgatgggttattatatattcataatatattttttcttgacagggatacattcgtatcattatctaaaaaaaaggatacattcgtatactcaatctcgattgtcagtcgccgtgtcattgatgttgccttttcccgtacacgtgttgttgataactaaattagctacggttacaggtacacttttaacatttatattaattaatttgccatttagaatgaaataagtttcatacatatatgtgagtaattcatttggacccagataaaaaaaaaacaagatcagaaaaattgtaccaccgtatctgacataaaacgataagttcatactcccttttctgttctaaaataaatttatttttcacatattccatacataccaacactaaaaagactagaatacctccattttattaaaatctcaatgcagatatttcccattttatctattttcaacgtacttattccctattttttacaaactccaataataattacttaaaaataaagttattttgggatgaacaaaaggcaccaaaaatcaacttattatgcgacatagggagtatcacacaaatactatccggcacattatccatctaagatatttatccgatatgcatattaattatccggactgtttggaaccacatctcctatttttgcacatgtatccagggtacaattccctgtatacatctagccagatacgtacggtgtcgaatcaattgaaaattacttttaacatttccaaccagtctatactgtctgaaaatgataaagacagatgaatcaactggggccagacacatacataggatcaataaacatatagtataatttagcttttctgcaagatatcacttaactggaaatgttatcccatataaagttgtcgcggttctttttcctgttttgacacatatctgccactttaatggagatatctgtcccgcactaactctctactggtctttgtaaaactccctaactgaatttgtttaatttcaaacattagaatcaattggtgattgtgtatcataaccgcattaaactaataggcatccttaatctttaggtaggtcatcctggtttccacctcggcaactaggttagtgccatgacagcttctagctagtagcacgtatgtgaaaaacattgcatgttttgcaatccaaatatgtaatataatattcatccgactcctatgcatgttcagggtttacacttttgttttccaacaaattttcggaaattcagtggctcctgaaattttgggaatttcggtgctttttcgcccgaaatttattggttatttgacaagttttgaatgatcaaattcacaaaaaaaaattaaaaaaaaggggcaatatatgtcatccctgtgcatgtctcgatgttggtagtctctcaccaccaggatcgaaatatcacccgtgttcatatgtaatctgactcaggaatgcaaggtcgatccttctataagacggccataccgttggacaatagaaagctagagagataaatatcaatcttattctaagcgatcagagttatctcactttcctcagcagcatgcttttgcatcaccttatcacataaatttcgagggaaagcaagcaggaacaatgtatttaaattgtaaaaaacaaaaagaaaatgtatttgatttgtatttggatcgggccctaaagttccacttcaacctgttgatcgaaggcaaggtgacatatgtataacaaaaggtaagaaaaagtaaaaaaaagaagaaataatatgagtgataataatttgctcgttgagttggataacacctcgatgggtgcatgcaccttgaacagccaacggttatgcaatatcagaatattgaaaaagaatgaatattgcaaaatcaggagtctatatacttcctccg

SEQ ID NO: 64174 - DNA, 20440 bp, Oryza sativa
  unsure (1)..(20440): unsure at all n locations
attaaaaggtttgcacacttgtctaatcaatttcttttttgaatactaattaattatatgtgttgctccttttataatctacagtactttaagcataccttttcgtttttaaattttgcgaaaaatttttaaataagacgagtggtcaaccgttgccagttaaaaactcaaaatcccttatactatggactgagggagtagtatagctaagagcaagtttaatagtaaagccaactaccagctccaattcatctatagccaatctaatagctcattcatacaatagttatatactactctattaatacctggtcccacctatcatactcacactgtgtcttggagtccgtgctacaactggctacaaatctgtagcccgctgctcttctctctccctgtttaacttcttaaaatatggttgcagccagcttatagcctgttattgtacatgctctaactactagcttgaatttatctatagccaatctaatagtttatccatacaatagttacatactacactattaatacctggtcccacctgtcatacacacactgcgtcttggagtctatgctacagctggctacaaatctgtacccactgcttttctctctccttatttatctcctcaaattatgtttgcagctggcttatagcctactattgtacctgctctactaactccaaatcatctatagccaatgtaataaccaatttatataatagttgcttgttatactattaatacctggtcccacctgtcatacacacattacgtcttgaagtctgtgttgcagctggctacagatatgtagcctgctgctcttctctctcttcatttatctctttaaaatatgtttatagctggcttatagcctgctattgtacctgctcttagaaaagcccttagatgcgtcagagtggaggtgtccggagatcgaggtggctgttggctctgaagtgcgtggggtcaccgactgtggtggtgtcggtgaagaactcgttgttgccgaagtcgtagctcgagagtgtgtcgctactggggtcggtggaggcttggggactggggtaggcaccctcgatgaagaggagctgcctactcccccagctccctcgaagtgcacgtactcgacagtgaagtcgtcgtacgtcgaatagctgtcgtccaccgccttgtctcatgcccaccctcacccttcgtcgaacactacgtcgcgcgccgtgcgcacatgctgtgtctctaggtcaagaatgcggtaggccttcgagccctccgcgtaaccgatgaacacccctagggtgttcctgtcattgagcttgccaatgtagccgagctccttggcgaacgcgaggcagtcgaagacccgtaggtgggggaccgccagcttgcgcccatgccaagcctcgtacgatgtcctaccgtcgagggccttggtaggcgagcggttgaggatgtagacagctgtcaccaccgcctccccccagaagatggccggcatccccctctgcttgaggagagcccgagccatccccacaaccgtctggttgcgctgctcgacgactccgttctgctgtatgctgtacggcgcacagtagtggcgctgaatgccctcatcagcgtagtatgacgagaattcagccgccgtgaatttaccgccgttgtcggtgcacagcacgcgcaatgtcacgcctagaaattcccgaatagaatttcaagcagaatgtgcattaaaacccctatccaggaccggccagggtacacaaacgacaaagttgacatatatatccacgtcttacaaacattaaaaaagtcttacataaatgcagcgaaaaataaaagataactggagctaagccttgacttggattgcggcaggaacaccactccacaggcatcctcgacggcacggacgaagcctattcggagaaaccaccatcggactgtaacgccccgattttcgttcgggaataaaaatcaattaataatacattttctagaaattaaataaaacttaaatcaatttaatcaagtaaaataatgggagaattaaaattttcccttaaaaatcattggccgggaatattttgtaatattctttgcgccctaatgtactctccggaattttccgtgaattttcggagctcgagaaatagtttcaataacacaaagatcattgcatcaattaaaataaaaagaaaacaaataaaatttcccccttcctctctttgggccattttcggcccaagtcttctttcctctcccgcgggccgcgcgccttctccctctctcgggccggctcccctctctcttggcccgctcgcaaaagtctgttttgcgtcccttcttctctcccttcgccgacaggtgggaccggcggtcccacccgtcagctccttcttctacctttcgccggccgaccccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgagctccggtcgccgtttcctgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgtttcggtcgacgtcgactagcgccgttgcctccctcagctccgcaaggacgaggaggacctcggccgccgcctctcttcgccggaaatccgccggagctcctccttcctcggtcgccggtgagctctacctcttgtcatcgccatcggtcttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtgaggatctctcctcccttccttttttcccgtcccctttcttgccgactgccgcctcttggggtgcgtcgccgtccccgtgcgcgccgctgtcctccggccacccgccgccgttccacgtcgccggctgctgcagccggttgccgcctcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgatgacgtcagcacagccttttcctttgagaaaataaataataattgcgcaataattcgtgaataattctagaaattcattaaaatggctcaaaaccttctaaaattcatatctaattcattcgaactccaaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgtgaggaaaagagttcggaagattgttttgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatatgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggcggcatgtcggcgcacggaaacgtgtcgtggggctgtgtcttgtgggtacagttgtacacctctggccagagtaaaactattcgaatagccgtgcccgcggttatgggcggtcgaccagattcaccgtgattagtctcacacttaataaatcgacccaatacactgtagtccaggtgggttggttgggcctgttcaacgtggtgtagcgttgatcagtggagattaatgttactctaattactcaacagttttattgttttggcaaataaaatgttttacaaccgcctttatgcaaatagccacaaaccgtccttgtgttccccttgcacgtccgcatcgttggtgtggcttgctgagtacggtggttgtactcagccttgctattatttcccccttttcagaagtgtagtgcttctgagctgaagacgaagttagaggaccaaggctcagaccccagttgagttttgcctgtggagtggagctgaagccccgctaggatcgcctttttccgctgctgctgttttcatttcggtgcgaggactaagtgcctcttttgtaagtattttacgctttatttacgtttggaactgtgtattacttgtcgttttgtgtaccctggctggtcctggacagggatttaatacacaaaatagtctggaaatttgggctaaatttctgggcgtgacaaagtggtatcagagccaactcgactgtaggttgagccaaacggtcaaaccctaaggacaagctttctgaaaaccctatttgaaaaatgtctcccctcgcccttcggcttttctttgcgaaacagtttttcaaaattctcctccctgtccctccaattcttatagttgttaaaccgtggagggtaaaccgtcagcttcgtgtctgttcggaagtcaagtcaagcatcaagcttcatgcagcaaagagcgggaaggtccgttcagagtcgtcgttccgcgaagatcaaggagagttttcccggagtttacctaaacccaatctttcctggaagaatagtttcgttagctgctaggtcgtgtgttgtttgcttgtgtgtaggggtatggtttgcatcattggtggggatgcgaccatactaggttgtttgcttaagcaacctgaacaataaaagtgtactcacaacagatcagtaggcaagtggtttaaggtcttatctttagcaacccctctcttccacctctcttccgccctggcagaagatggtcagtgttagagagaagagcaacaacggtgtatgaaagtcacagatcaatggatcagtcgaaagctacaaggtactcccgatgctagaagaatccctgctcgtgatcaacatttggtatccaggatcagaagatgggtgtattgatgcaggagatgcaaagctcgatgcaaggtcgaatgtagcggaagcaactctagcagtagtgtgttgcagtcaaagtcagtggatcagttcaagacaacaagctaccagctgagtcggagcaccacactctggtaagatcctggctagccaagatctaatgatggatgtgtcagatgttgataccgcaactgcagagtccaaagcagcaaatgcaacgacaatgtcttcaccaacaagtacaagctcagatgcaagccggaatcaggatcagagcgaaagtcagtttgttttccaagagcaagcacctgcaacctcagacagtacgccaccaagtcttcagcagactagcacagctaagtcaccaccaatcccagaggcaacaagtgctacctatagtggttatggtttacaaggtcagttcttgcaaggttgttcgtcggcaaggcgttagcgtcatcaagacaacagctctattcgcagcaccccagttcctcaagttgtgtcaattccaatgcgagtcggtcagtttagttttgagatatcaactacacaacccatttaggtggacgacaccgaagtcgggcctgaagcatgctagatatgccagcaatagaactgatggggaagtagtcaagagttagtaagatcacgagctaaatgagaatttctttatgtggaatttcctatcgacaaccaagggttaagttccaagtcttgtcctggatggaagtgcatcgtcattgctttattttgattgatcgttgaagttttctattttcaaagccagggccattcgtaaattcgagaagtgtcgatttttcttcaaggacaatggttcaattattcccggtcacgcgaaagtatgactactctctgtaagggggggtaggtcgcagagatgagttttggttcacctcgttgccgttttccttaaagattcaacccagtgcagcaagttggctagtacttgaaagagccagctgcaaggcgtcagcagagtaacactgatcccaagttgtctaattaaattcgaaggtacgccggtgaggccaggtcaaccgtttggcttaaagaagtagcatcaggaacagccgcaatccagacaaggacagaccaagccagtttcctgaaaatacttgtggtttgaatcaagagcaagtcgagcaaagtcattgtctgtgggttacggaagtcagtttcaaggtttcggaaaaactacaccgatccccggtcagcaaagtgaatcctcagtttatctaattgccagcattagcaattcaatcaaaaaaaaatagaagttctatgagcaccagcagttctggtcaaggtcagactaattagagtcggtccgtcagtttatgggaagcaacagaacagcaagcttatgcaggtttggttcatcgagcaatcggtcagatgaatcagaaagaggcagcatgtgtaagcagatcagtcagaccgcccgccagcaccagctttctttctagccatcccagaatctcgggacgagattcctgtaaggggggtagatttgtaacgccccgattttcgttcgggaataaaaatcaattaataatacattttctagaaattaaataaaacttaaatcaatttaatcaagtaaaataatgggagaattaaaattttcccttaaaaatcattggccgggaatattttgtaatattctttgcgccctaatgtactctccggaattttccgtgaattttcggagctcgagaaatagtttcaataacacaaagatcattgcatcaattaaaataaaaagaaaacaaataaaatttcccccttcctctctttgggccattttcggcccaagtcttctttcctctcccgcggcccgcgcgccttctccctctctcgggccggctcccctctttcttggcccgctcgcaaaagtctgttttgcgtcccttcttctctcccttcgccgacaggtgggaccggcggtcccacccgtaagctcctcttcctacctctcgccggcggaccccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgagctccggtcgccgtttcccgccgccacagccgtcgccgcgccgagccaccgccaccgccagcttcgccaccgcaaggggaagtccggccgcctcttatttccccctctccacccctcgagcaccactcccaccgcacacccgaggccgccgcccctttcaccgcctccagccgcgtcgcgccgccgcttcggtcgacgtcgactcgcgccgttgcctccctcagctccgcaaggacgaggaggacctcggccgccgcctctcttcgccggaaatccgccggagctcctccttcctcggtcgccggtgagctctacctcttgtcatcgccatcggtcttcgtttccagtcaccccgcatcggtcctcccctccctaactccctcttctccttctgaaggtcaagggcgaccccgtccgccctccgtcctcgcaagccgccattgggcaatcgtcgtcgccgtcctcttcctccgcgtcggccgccgcttccggtgaggatctctcctcccttccttttttcccgtcccctttcttgccgactgccgcctcttggggtgcgtcgccgtccccgtgcgcgccgctgtcctccggccacccgccgccgttccacgtcgccggctgctgcagccggttgccgcctctgtaacgccccgattttcgttcgggattaaaaatcattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgataaatagttttaatagcacaaagatcattgcatcaattaaaataaaaagaaaaacaattaaaatcccctctttggcttttggctcgggccattctcccttcccttcccttcttccctcctttcttcgcgtgggccggcccatctcggctcccccttctccaagtcacataacccccatccttcttccttcttcccttgccgacaggtggacccgaagccccaccttgttattgtctccccccaaccgtttccgcctctctacttttccccgagccaccgacaggtgggccccacctgtcgggtccttcccccacctcccgccgatcccggtgcgccgccgcgccgaaaccgtcgccgcacccacttcctccgctttccccgcgcccacgccacgtcgccgcgcccacgccacgtcgccgccctctccccgcgtctcccggccgcgccagcgcacgagaggggcgggattcgattttgaatcttcccccccaccttctctctctcctcccccacgtcgccggcgaaatcggagcgccttccggacacgttcgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgtcgcaagacccttcccggccgctgctctgcgtcgccggaataccaccgaaaccccatttccctcgcgtcgtcggtgagttctctctccccttcgactccggccggcgtggatggtcgccgtgggggttttcctccgacctaattcctctcctctctttccctaggtgtcgccgtcgctcgtccgcacctcggcatcgccggtcttcgccgcctccctcgtttttctccgccggccattgccgcccctccggtgaggtctccctccccttccttcccttctttttttttccccgtgcgccgccgccctcttcgcgcgctcgctggcgctttcgggcggcgccgatcgcgccggcgacccgccgtccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccccttgagccgctgccgagtgggcccgtgtaccagcgccctccccctttgactcgctgacgtgtggggcccgcctgtcggcgccggccctttgctgacgtcagcggcagtccttttcctttgtaaaaataaataataattgcgcaataattcgtaaataattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctattctttgtcaaccttgggtaatgaatcgactagcttgtgttacttatgtgacctagctagaactatatgcttagccatgcttaattaccactagctcagttgatgggataattacagttttagacctttctagtatcttgttgagccgcgtgctcgagacatctggccatgtttcatggtcgtaattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttagggaagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccaccttaataaatcgacccaatgcactgtagtacaggtgggttggttgggcctgttcaacgtggtgtagcgttgatcagtggagattcaatattactttaattactcaacagttttgctgttttgctcaataaaatgttttacaaccgcctttatgcaaatagccacaaaccgtccttgtatccccttgcacgtctgcatcgttggtgtggcttgctgagtacggtggttgtactcagccttgctatcattcccctttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacagcctcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgatgacgtcagcacagccttttcctttgagaaaataaataataattgcgcaataattcgtgaataattctagaaattcattaaaatggctcaaaaccttctaaaattcatatctaattcattcgaactccaaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgtgaggaaaagagttcggaagattgttttgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattacccaaactctgaggggagggagatagagtaagactgagtactacccactgtactcagcaagtcatgccggaacgaagggtatgatgcaggatataaccaaagaaggcgaaaggggttcatttgcataaagctagcatttataaacagtagttgaaagcagtaaaacagttgtaatagttaatcaacattaaaccaatcattgctcaacgcgacaccacgttgagacaggcccaaaccaccacatgcactaatcagttccgttagggtgagactaatcacggtgaatctggttgaccgcccataaccgcgggcacggctattcaaatagttttactctgatcagaggtgtataactgtacccacaagacacaaccccacgacacattcctgtgcgccggcatgccaccacgatataccggaaagaggtcgtgacagcacccttcgcataagcccctccaaccaaacacaccaaacctcaagtttcacccccactcctcgcaaggcagcgggcagtcccctctcgtgcttaggtgaatccggaagcgacaaaggccgttgtagggccaatcccgctccatcacgcccacccttgcatggatgcgtcagctagaggaaagttatactacaagcccagccgttgcccatgctggcttatggtaagtacgaggaattcttccagagtttcccgcgaaccggtccttaattgccatgggtgcgaccatcaaaaccatgcacccactacccaccatttaatatattttaattaactaacacaatagcggtggcactaatccaacatcaatactagagtctggaatctatgcattaatgtaattcccccattgtgtactagttgaactaagcatggctaagcaatccctaatccaacatctagtcatgttacaacccaagctagcaaagaaacaagatatccaataatatggctgagacagtaggtaatcatcccatagtaacattataaaacaatgcattatttaaaggaaaacaatagagcatttgcaatatgggatcaatatgttcaagtgacaaacatgacttgcattgctctgcggctggaggaatctcagcgactatctcaaagaacaccggagcgtcgggagagccggaatctatgcgatatacaaggcaaacaatgcaaacatgctataagactactaaaatagagaacaaaactatttttattggattcttagtatttttcttgatttactgagacttgaatgggcttaaacgaagcacggatgaattttctatgaattttagaagattcactgtatttttacagtaaaagaaaaatcctgaattgatttattgcgcaataattaaccctggcgacgtcagcacaagagggggtggcgccgacatgtaggccccacatgtcatcggctcagcgccgccggtccacggtggaccgagtccacgagaccggggatggggagcaccacgtgacgcacacgtggcgccgacgtggcggccacgtgggctgccatgcgggcggcaacggatggcccccgatcggacggcggagacggcgcgcggccgggcgcacgcacgggtgacttaagctggcccagcggccctggcgcgcggcgggcggcgtgaggcgacgagcggcggcgacgtggctaggcggcggcgctgggcagtgcggaagagagagggaaaaaaggggaaggggtctcaccgacgacgattgacgacggcgagcggctacaggcgaaggcgatggcgggacaaactccggggcaacctaatgaggcacaggagatggattagagaggtagagagggagcgaaacgggcgaaaatgccggccgaaggcggcggccatggaggggctcaccggcgcacgacggaggatggctcccggtggcggatttcgatggggaagggctggacggcgtggcccgtgggcttgcgaacccgacggcggcgacggtgaggctcggtggcggctctaacagcggcgagcggcggccggaatcttcctcaattacccaatccctcgattcggtaaatgcgacggtcatagctcccgtaaggactccacatccgggccaacgaaatcggcaaatccctgtcgattcgatctgtaactatctatccttgcaattttttttgtgcatttgatatctgtgaaaaagatatccccgttcttttttctctgtttctgaactcaagcatcttgaccagtgacaaacatggcgcaaaaaacacaaacacacaagctaatcatcagcactggcaagcatactaaattcaagacgcttcttctgtgggagatgttcgggaatggagcgagtgggttggcggtgctgctcatcgccaccgtgtccgtgcagatgggatgctcaacgggcaaactgttttaacagctctgattgacgttcacctatttattacatgtcatctaaataattattaaaaaattctatctatctatctattatatactaaaagtccatgagactttctacaaacgctctcaagccgccaagtgacgctctaataaaatagagaaaatcctagaaattctaagaaaaaagaaaaacaactaccctttaattttcacttaaattggtgagtccaatattatacaccgttagataaaatcgatcttaaaacaaactaaatatcatgggtcccacctatcttcctcctgcacgttggcaggtggcaggtggagtatatacgtacgtatacattatacgtacgcttccttccttttttttcttttttttctttttttcttttccatttatatatatatatatatatagtgcatatattttttaaataattataattttacaaaacaaagaatctaccatcatataacaaaaaatcttcctttcaaataatgcactattttaaaataaattttacacaattatattatgtacctattaaataaacaatatctatattaactaatttatacgtgcacttaaactgatggccccattatataaatcatcggatctattttttattacattggtatattattctcaagtaatgtactgtttcaaaataaggtctacaccattatattgtgtacccattaaattaacaatttaaaatatatattaactaatgtacacttacactagaactggtggacttattattataatcatcgtatctattgtttgctaataaataaagcgtccgaaattcttttttttgcccgctgcacaatgcacatttgcacctttgcctttcgcatgggtgacaaggtgtagtgtttgagacatataaggtgatcacaaccactgtagagctaccgctttgccatatatcaaatcatatatggagatgattaattttgttaataacatgaaaagaaaattaaaggtgtgatgcagcgagagaataattaagcaccatgggttatgtttttctcaacgctaattagctctgtttaagttgaaaccgaaagttgattatataataattataatgtatttgtgttatgtcgtatttggattttgtactatttgttcgtaaatgtgaaagggatcattatgttataaatgtgagcgtaatattgacgaatattaatagaactcttactatgataagggtgataaagggagtttaaggccctttatttttttcccgattccatattttggatttttgtttgcacactttccaagtttctaaatagtgtcttctttaaacaatattctaactttttagaagtcaattcatttgttatacccttaaatagctatcacataaattatataattcattaatttcagctatcctaaaccttaagtactacatattttttttcatgcaagtcatggtgataaatcattaaagtcgtaaaattaatatgtaagagttactctgaacaattgtaaataggtgtcaaaattaattgctattaattagacatctaatggcttgcaagccacaaaattaatttcactctacatgtatataaagatggacgaagttggaacaaatattaccatatgtcccatacatatatattgcgcagttaatattctaattacatgtgttaagtcatttaaaattcatgaaaatgctctcaagctgcgacgtggtgctctaataaattagggcaaatattagaaattctaaggaaaaaaaatcaaagtatatatttcttgattttcacttaaatcgttaggtctaatattataaaccattacattaaattgatcctagaacaaactaaatactacgaggtcccacctctcctcccgcggcatacgtacgcacctacttacatgggtacgtacgtttcccctcccttttttcattttttctccttcttttttttttaccatgcatatgcttccctccctttattcctatatcatacgccttcatgagacgatttaatcaaaagaattttgagtatcttgcactcgcatttttcatttgtagccatactacacggtatatatatagatggactacttcatatgataattaactagcaatacctttcaataatataagtgcccgtgcatacgcgcggaccaccttcctagttaaaaaaaatatgaacaagatagatcaatatgtaatatattgatccacaaacatacaagttaaaattcaacttctacaacttgtaacaaaaataacaaacaaaactcaaattactatatgtatatttacaattaaatttgttatttttgttacaatttgtagaagttaaatttgaacttgcatgtatgtggagtgatatactacaaattgatctatcttgtcaattttttttaaattttttcgtaattatttagttgacatgtaataaatgggtggacattcactcgagctattagaatccatgctcaacggtgctgactgggtgcactacagcagctatctgcttcctcgcatcaccaaatccaaatagcaagaaacaaggagatccagcggcaaagcagtcaaatctacaagcaagcaagctgccggtacacgagcaacagcaaagcagtcggatcgatccagtactccgtccgcacattggtcgccgcctgcgctcaccgccgagcagcctccatcgtcccctgtcgtagcccatcgtccgttgccacggctcgcaggggcggcgctagagccaaattgagaggggtgcccggcccctttataagcaatgttatactccctccatattaaaatatgtacgatgccgttgactttttgacaaacgtttgaccttttatcttattaaaaatatttatgtaattataatttattttattgtgtcttgatttatcatcaaatattctttaagtatgacataagtatttttatatttgcataaaaattttgaatcagacgagtggtcaaacgttggttataaagtcaacggcgtcataaattaaaatacggagggagtactaagtagtgatatttttggcaacttttatagttcatcacgagtaacggtgggagataaagcccaaaaggatatagaggttaccaaaataataaaagtcacagtgaactagtgaaggagaacttcataattaccaaggataacaagtattagcaaaatatataatctagggtttgcgtgcgtgcattcttaggagtgaattgtctgcattgtactgtgtaattttaaaaaaaaattgtccacatcaatttgcatgctctacaacaagaggggaataaaaaattttcattttcaactaaaaactaaacaaaaaacagaacaaaataaattcatcaatttcaagttctccaaaatcacaattcaatgtttaaaccctaacattgcgatcttaaagcaaatgccaattaagagcataatcacataatccataccatatctatcagactcgagggtttcttcttttgttaatcaacactagttagcagagaaaaatcataaagggaatgggggggggggggggggggagagtataagcccaaaccttgtggtgtccttggacactgaggtcatgagggacagcagtcgcctgaacaaattccggtgaagccaagctagccagcggcggcgagggcatctactctcgacggagggtgagccacggtccacggaggcaatgaacatgaaagcggacaggcgtcatgtcgcagcagtgattaaagcggtgtgcatcccaagtcccaatcctcgtatagtgtgcatcgtgcgcgcgtggccggcacgcccgtgggcatcacaggctcgcaaccacgattgggccgcacatctgtgagcttcttgggcttagcaagtttaccaacatgggctattttgatccgggttcctgggcaccccccccattgggctccgcccctaacggctcgtcatccaactccgtcaagctcctcgtcgcgctagcggagaaggccagcgccgctctcgtcaaggctgcggcggtggtaccctcccctgccggaggccgtcgccgacggggcgcggtggcgccgctcgtgttcccgctcctcgatgagggagagatggttgtggcagcggaggccgcgcccaagccagcggtggtgtggaagcggcaggtggcgtgccgaggcgggagggcgagcaagcggcctgctcggcgctcgcggaggaggcatgggctccccgacagacctcttttgtcagctctccctcgttttcgtcgtcttctttctccatcgctgccatctctctcttctctcgaatcctctcgctctctctcatgtcgttggatccaccaacctccactacccaagaaatcaccactgtcctccttctcgtcatcgccttgtactccgctgtgaacaccgcgtcggcgccggtcttgataccgtgggagcaaacgccgcaccggctttgcatccaagcagtgaggaagagaagacagagagagaagacatggagagctaacatgtaggtccaaggtatgacatttcaacaatttctctctcctctccaaccgaaaattattattttaatggatgcggtatccaatagtaaatatccaacttttgtgagtgtgttccctaaaattgacttcacgcagtgtcctatagctaaaatcacaaagtcgcgaagttctgtagcaaaatttttctatcaataagtgtatgcatgcatgtaatcaatgaatattaagatggcttctcgggttacaacgaaacatttaatttatctctccatttatgtcatgaattcacagagattataaatagaaacaacttactccctccgttttttaatagatgacgtcggggtacagagatcgaattcgccttataatgaggngttgatctactgtaccg

SEQ ID NO: 64175 - DNA, 898 bp, Oryza sativa
caccaccccacagtgccgaccttatccatccacccaccacccccacgcagcgccatccatctgtctgtctctcctccccccctctttctcacgggctggccaatttccctttacgcggcgggtgcgacggagtagcggtggtggtgacggagaatgatggcccggaggtcctcacccggcccgggggccctcccccttctctcctcctccagggcagcccgccagtggagaaggccggccggcgagggcacggacgcggctgaagtagcgcctgtggtgatggagaatgatggcgcggcggtcctcccccggctctggggccctcccccttctctcctcctccagggcggcgcgggtaaggtggagaacgacgcgacgaggtgacagtgccggtggtggtggtgaagcccgggatctcgccggcctcctttctcccggcgcggcgttgggtggcgcccgccggcacgaaggccggcgtggcgaggtgacggcacgaaggcgggcacggctaggttccggcgcggttgccgggcaaggtggtggtggacggcggtgaagaaggccggcagcaatgttggtgccatcttttttttaatagtatagatgctggttttaaagcagacaccaataagattaaggcaaagatgccagctgggaaactggcacttatagccagttcccaaccggcacctataggattgtagtgacagaaggtcatgatgggctgtttagaaactccatactcttgaggaacaataattatttaggatattgagtactccttccatctacctagctacatgacgtggcatacatgctaaggaaaacatattttatttgtactacgtacatatcaatggagttgtctcatcgataagttattaggaccacattgttt

SEQ ID NO: 64176 - DNA, 664 bp, Oryza sativa
ctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattatagatgaaaactagcatgaacgcatcattagatctacacatgtgaactacacagtttaacatga

SEQ ID NO: 64177 - DNA, 810 bp, Oryza sativa
cgacggtcgtcgacgtccacgctcgactacgagcgaaggtggcagccggcgtcatcacactgcgaggggaacagaggaggcggtgggcaaagccattggcaagctggaataaaggccggtatatatgactgggcaccgacgaggcaaaagtcatccgctttattatgatacctgatccacgtatggatgtggtgataatatattgtgaccaggtttcggcgaagcaaagccacccatatcacagttatcattaaatctacacaaacctcaaaaccctcggtgagcaaataattttgaagatgatgaccaaaagcgcagcttaatcagaggtgttccataggctcatcctatggatgattaaccgacagcctcattgctacgcgctgggtttcagcggactgcacgcaatctctagtcatcatatctttctattaagcattctcgcaaaggcaaaacgcaaactcctgtaggagccctcatgtatttgttaatattcatgttaatgaatcgtgattaataaaatatagggtttccctattttttgtgtgttcgttgttttgatttcatcaaacatggagggaggcggatcgggagaaaggttaatgcgaatgtacaattctaccctttcaccaccttatcacaattggtaccgcccctcatagagacacggtaccatgaggtaccaaccaatttcagtcgttggatcctcccagatcgacagctaggatatggtattgcatgccctcaacctcaattacggtaaaaaacctccttgtagttttcttctccaactctttttatatcacgtct

SEQ ID NO: 64178 - DNA, 566 bp, Oryza sativa
tcaacaaagcaatgcttgattaagccgataactgacacctatccaacaaagcgcgatgcaattcgcgcctggaatcggaggccatcatgaccagagacgagataacccgataccaggccgaaagcgttaagcgcgccagcatgccgccaatagtaaagcacagccagaccaaaacccaccagccacagaaggaagccgcataatgaacctcgaatcaatcgctaaatactttgcgcctaaatcaccgatgttcagtgactctcctcgcgcaaccgcatcagacagtctcaccggcactgacgttatggcggcgcttggccttgctggccacaagtgcgggtttggtttcgatctttacctctcgaaaatcggcattagcagcccagatatagcactggagagactctatgagcaggcacgtaagttatcaggtaaattcagagcactgtctgaactcgatgaatcagctcggtcaggcgtgcttaaggttctctgcgcttttgcataccaggattattcaagaagtgctgccagcactcgaaaatgtgattgctgtgatggtggcg

SEQ ID NO: 64179 - DNA, 546 bp, Oryza sativa
aaatcggtgccgccggccgccacagccggaagcaccgccggctgccgtcgcgacacctgaccatggccgccgcctaccgaagcccgcaccacggtattccaaaccgtagaggggagggggttggaatagccttgccatcgttatcgtggttgccgtcctcggcgcggtagacatcgttgtcattgtggcagccgccgccggatccacctccttcacggttgtgaaggacagcccgagcaacgccgccaccggatccgcacccaccctcctgtcaccgtcgctgccctccccgccggcctcccccattgtcgcggcggctgattcggcgtccacggtcactgcggcggctgatccggtctccccgtcgccgcggtggtggatctggccacccccatcgtcacggcggtggatccagcctcccccgttgtcgtggcggccagcagcgaaggaaggccggtgggagaccggggggggggggggagggagaggaggcgtgggccatcgcagtttgccggccgcctgtcaccgcgccgctgctgagccacc

SEQ ID NO: 64180 - DNA, 1678 bp, Oryza sativa
aaaagtgaaggaatttgaaaaccgactcaaacacggatgacgtactaaaatattggcaaaaacattttcaatttttataatagtagagatttggtaatattttattcaaatttgaccaaattttgttcgaacttttggaaatttcggtatatagacaccctttgctagaaacgccgaaaacaaaagattgaaccctgccttttagtagtacttactaactacgtattactacactcttcatcctaaaatataaatatttataattatgaatttagacatgtatttgttcaaatttatagccaacattattatattttaggatgaaggcagtacatcatacaattcacaaactatagtagagttaatacctccgtcccaaaataatggtcgctttgacttttttcttgcgacatttgaccatttgtcttatttgaaaaattggtgcaaatatataaaaaaaataagccatacttaaagtgcttttgataataaagaaaatcacaaataaaatagataataattctataattttttgaataagacgaatcatcaaaagttaaaaaaaaacttaaagggacaagtattttgggatggagttagtagttattattcagaagtaattagtaattgattttgtgcaatttatcactcgcatgcattgccattgcttaattaccttgtcctaatttgtatttgcaatgtacttagactcgatattcgattgaattcatggaaaaaaaaggatgcgcacgtagcatctgatcggcaatcaatcaccaaattaacataggttatagagatcggacagcttcttcgccttcgtatcgatattttacggtgccgatcgaataaattattttagttaggattgaataaattattcggagtcatgtgaccccgggtaatcgaacgtgggaacaccactacccgtatccgatgggaaatgtagctcttgatgtttttggcgccaagatatcaatatatggccattatatatcccccatagaacaatcacatatactccctccgttttgaaatatttgacattgttgactttttaacacatatttgaccgttcgtcttattcaaaaacttttgtgaaatatgtaaaattatatgcctacataaaaatatatttagcaataaatcaaatgataggaaaagaattaataattacttaaattttttaataagacgaacgataaaacatgtgcttaaaaagtcaacggcgtcaaacatttcgaaacggagggagtataaggaaaaaaaatctaatacacttaattgtctctgtaggaactactagagggaattcagttctaataaatcgtcttggtccattataaggcattattatgcttcagtaataaatatccatataagtcgctgcctttctttcactacgctgacaaaaatgcaaatgtttttttgcttctggcaactgtgcttctgttccgcaactaaagctgtatcactatgtgctattttattctgttcttgtctgatgattctatttttatgggggaaatgagctggacatgcttgtttctatggtttacaactgttgtatgtctattttgtttatctctattagtatcaagagcaatttgccaatggtctatgttataatcatcatggtttatacatctttcctatgggattaaattgaatggtaatt

SEQ ID NO: 64181 - DNA, 1529 bp, Oryza sativa
atgggattatatggagagaacaacagattacaaagggaataatagaactcgatggtaccgacgagatcgtagtcgagttgattcgactagatcacccgtcgacctggctcctgtagtttccggcttcgtaggctgtggttgttgtgttggctatgagattcaatccttaggtccccctaggggtcccttttatatcgcaggtcaggcggtctccaagtaggactcggagacatcggaccctgcacgatatagtaacgacccagtcctatacgggtaggaacctttccattggtgaacttagtgatggattccttagcgtgtacagagaatgtccgtatatgcgccgatgtaccgtattgccgtatagtgtacatccaagggtagagggtataccttatccgtaaccctgacaagtctattttcccttcctcctctttgggctaacatatgtatagctaaaataagtctatttttcgtcccttctctttgggctgacatatgtatagataaaaaaagtctattttacatcccttttctttcgtccattgtatacaatatgtctatttttactctcctattttttttgtatcgggcttggctgcttgcccgtcgtgtcgggccggcccaacgtgccggtggaggggcccaggcacggccagatggtcgggctgggctggcacgggcccgacctccgtcaggctgtgccgtgcttgggccagaccaaaatgtcgtgtcataggccgggccgtcgggcctcgggccttttggccatctatactcgtataagagagcctaaggaaaaaaaaggtggtttaataaggagatttagccaaggtctggtctgcgtgtcagtaaggttagaggaggatttagggagaggattactgtagggattagattagaaatctgttgggcccactttgtcggtgacccactcctctcccttttcctctcctctttctcgattcttcctcaccgctctactccctctcgttccccttctcacatgcgtgcgtgcccgagcgggaggcggctggcacgcgacggcatgggtagcggccgagcgatggcggcttagcgcggcggtgcgggagggcggcgatgtggggaggaaggcggtcgccgcggcgttgctagccggcggtcgggaggaggcgcctaggcggcggcgctcggcctggcgcaccggcggcgggaggcggtgaggagcagtggcgtgggaaggaggttgccgcgggagcgaggcaggcggcgttggggatggaaagggtggctggtacagcgatgagaggcggaggaggtgatgcggtacggaaaggtggtcgctgcgggagcgtcggccagcggcttggaggaggaggcaggcgagctggatggaagtgaagatggcggtgctgcggctccctggccggaagaaaatcaaggcggtcgagggaggagctcgcgcaggctggcgtggccgtgcgcggcggtgtcggtggcggggagaggatgttggtggcggctcggcaggggtggtggtggtggat

SEQ ID NO: 64182 - DNA, 548 bp, Oryza sativa
gagaacatctttgccaatctcttttatcaatcatcttccggcttatctctaacaggtggtattctttgatgtggattgcggacgcttctggggacgatgaggtcctttggcttgctgcctttccgtgaaaccttgatgtggttcgtcaaagactagactgacgattgttgcctttgatccgaagagacacatctgaaactcttagtccaaacaaatgcctctttggttgatcacttgattttcttcgccatcaatcgctagactatttgattcctaacagattttgggtttacggaaatgagaccctaggtctccctaatcaacaacaaaatgtgcacaactcacagcacttgcactcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgtatttgctccagtgaccacttggcgattgg

SEQ ID NO: 64183 - DNA, 1083 bp, Oryza sativa
caccgccgccgccacgcgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcagcatggtgagtgagtgacaagattcatcggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcggttggggcggcgagctcgcctccccttcttctctttctactacaccataaatttttttaaaaaaataaagttagaaaaatttatgtatagaaatattatatataaaaatattgaattcaaattcaaattttaattggatatataaacttttgacttataaatattcgctatacaaactttagatgtgtaaaatttaggtgtataaacttaataaaagaggaaaagaaaaaaaaaacgatcgccgctagcgatcaatagctcagtaggactttcgaacaatttctccgtgcaaatcggttgctagcttgcttgacagttaatgtcatctatggcggcggcagaagagaagaagaagaagaagatgatcaaggtgatgagctccgacggggagaccttcgagatgacggaggcggcggcgagcatgtcgcggatactctcctccacatgatcgaggacggctgcgccgacggcggcgccggcatccctctccaagatcatcgagtactgcaccaagcacgccgccgtcgaaggccgcagcacggcggcggcggagctgaagaggttcgacgaggagttgatcgacgtggacacggacacgctgtaccacctgctgatggcggggaactt

SEQ ID NO: 64184 - DNA, 5111 bp, Oryza sativa
cttgtatcagatgctacacaaaataaaaacacttgcactagttactgctcaatgtgctttcctcacaaacgatccagtgggaaagaacacatcaaggttgaaggtgcaaaggaatatgcaggaagtcaaatgatgacaacacgaagagaaaaatggcaagtaaaacgaatgtaaagaaagtgaatataagatgtcttttcttgggagctcttcccaattacgagccaagtgatatgttcaaggataatctacggaggtcagaccaaaatcatatcaatgtttagatccaacaaggaagcttcatctttggtaggttaacaatcaaactaatataagccgctcgtaaagttacatgacaagttaccaaagtatgacaagttttataacctggttatcttgagaaacattgtatgatgagagagttgttgatcctaaagcgattattgacgtgtaccccaacttttcttgggacggggatcaatgcacaagcaattgggaaaaggtagttttctgatcgcgacagcgcacatgtccggtcgcgtggagctcaggaacaccagatctggtcacctggagctcgcataccaccggatctagtggtggtgaccacggtgcggagagggaccctagcagcgacatcggcgtggagagggacccggcggcaggcggtgacctcgcgcagagagggaccctggcagattgacgacaggctggaactagggagttagtgcatctgattgttgttcatctgtgattggtgatggattggattaaggattattattgttgttgatgatgattagtgatggatttgatttgtgatatgtaaaagcatcggctcagcttgagccagcttttttttttgaatctgggatagcacaaaggtgccggttctatgaccggtgtcattggtgccgactgggaaactgtcacctattgccagttctcaactggcacctatagctgtttgtgtactagtgaaagtgatattgcgtgcagccccattaacagtcagtgaggcatataaaagttgctagattctaggctatgcaaatcaagtgagctgcataaaaagtcaagacaactagaatttcatactatcaaaacaaaaggaatgcatgcgtttatcattgtgattgtaatggttatatgtcttctccaaacccttcggttatatatatgtttcccttgtatcaccttagaggaaaatcccaaaacctcaaaagaaaagaaaggattagaaagtagcagctggctccatgctcatcatatcatgatgaaaagaaaaccacaatgacaatctgccataaattgctaacgttaggagtagagatcatgtagatgggtgaaatttgtagacaaaattgaatttattctatgctagaaggtttgcatgggtgcagaagttgtaaatattctcaatatgaaaatgttcgttctgcttccacgtggatcaacaaagtgagaaatcattgatcaaatttcctttacacggagagtgatcaaccaggaggaagaaaacaatagctagccaccgactccaagtcatgaaattagttcttgatgagtattagtagatcggctggattagctagcttgctcccctattataattagtaatatatcccaaagctatacatataaactgaagtagggctattatctatttcagaggcttgaaccaatataaaaatctttctctcctatctactttactgcaatctcgcgtataacttagtattaacgtcccccatgaaatacaaataccgttgtcgagtatagccatttgacacattcgtatcacataatcaaaatttatcagtttttacctcatcatatttatcctcggctccttcctttctgctgtggtattccaatctctacaacatactatgaggtgtagtgccataaatattataaaaaagatgctcccttttgaactagctagggaaatataagaagtgatattcaaagatggggtgatatatagaactgttgggaggagagctgtattgctttgtgcagtgcaaatcgtgggagagctctccttatctcattatgtttagacttacattattttcacttggtatggtgcatgaggctgttttgtagcatgcgcacacagcctcacaaggaatgatatggtctttgaaaggaaaaccgttcttctcgtgaagtgagcatatatcttaactgattaggtccccccccctgctggaaaggtccgcggtagcggcgaaggatgcagggtcgtggagctgacctagatatggagttcgtcagagggtggctgtcgccttggtcgagctcctcgtctcgtcttcgtgagctcatctattgtctgtggccgagaacaagacaacatgagcatgtgaggtcatctgttgtctgcagcgaaggagagagcatgtgaggttgcctcacgtgggcagtattttcgccgttcccggatcccacaacatgagcatatcttgccaatgtggcaaagtatgtgcacactcagagattgtactgctatatcctacttacaaaaatcgtttccgggaaacaacaagaaataattatttttaatcaaatcccgatctaagaatagtttgatgaatgtttatccacaagtttatttggtagagtatccatatacaaccttgtaattaactggctatttcctattttatggaactaatattttctcttatttttctattacatgcacttgctttgttctgtcatggtctcatggaggccgagacattcattgcctgcacaattacaatgagatttaagactactacgcccaaggaacactcaacctcaaggttaataatatacaagtgggggtcttgtgtacctacaagttcgtgggtatcagagctcaatatatatctctactggagctgaagttagagctttgggatacacatgccatacaacctagagtgtttgccaggcaaatcttttgcttgtggcaaagaattaaccttgatgttcttcgatgtaatctcattgaacttgactcatatgctggtatggccacccttttcctgatgcctcttattcatattgcgctcttgagaaaaacacaaaactctctggaattcttgcctctgttaatccccagcaccatcatttttagttgtggattgctcgtatgtttctaccaatacaaagctgaattgtgaggaagagtaaagagtggcacctctctgtctgcttttttttaccagcaaagtaatacttgttgaccaaaagactggtttatgtgtatatgaggataaggtatccattatttatttattctctctgcatgactgttgaaaacgtaagtgtttgatagtataggagaggaatactgcataacgtgggacgattgtatcctaatataactctaactaccatatactctaatagtaaggaaatgtggactacaatattttcaacagataaaaaaataatatatatcattaagcagcagaacaaataagatgtgtcacaatgagatgtatgaaaaaaaattcttttactcaggaaacttcttccatgctaaaatatgtatagagcatatgcctgaagaatctgcattttacttgaacttgtttagacattggtggttgtcagagcattcaaacataagtggaaaggggtgatagaaaaaaggggaaattattgatgatggtaccgaaggcgattattgtgatgtagtgtgaatgttcataattaaaataaaatctattattgcaaagtgcaaaaccgaagaaggaccccaaaggaaaagcagaggttctgctcaccatgcctgtagaatgaaacgatggatccagtccagcaaacaacctggtttcacccaaaaaaaatttaaaagcgaaacttgtacttgcaacttttcatggtagacagggtttccttaacttgtgatccaccggatattaattcatatgcttcatacactctgctatgcatttgtttttattttcattatgtcattcgcatctgcttgtattacgccaatagcacaaggaattgttaacatttcaaaactttagatagaacataaatttttttgagtaaattttacaaaagtacatgtattttgaccatactatcacaaaactacagatttagcccgaagtttatcagagaactatagatttaaggccatgtatagttttatgataattttgttactaaatatgtagttttttatactctatcttttatgaaagatttggtgctagatctgtagttatgtagcacctaactgcatgatcattcagctggggagattatgtaggagtagtcagggcagaaaagaagacatgtactcctgtgcatgatggttcgagaagttggtttctatcagttgttagcacctatggagaaacaacctgtgctgatttgggagactcttgaccagtttggtgcggtgcctcctaaaagatatctctgactctggcgataagattatttcatgacatattgcctgatgcctcctatccatattgcatatattctactttgttttagatatttatcaaaaacaacaactccatgcccctacaaccgagggtgtgtatcacagtctctttgatttctctcacattcttagatttctctcacaacctgaggtcttgttggatggcaattgctaattgcttcgttggaatgatgagtcgatgtggtggcaaagtactgttgcatgtttatatatactgaaagatgaggttgtatttgtactattaggagatggataggtgaattactgagactgccttgtaaatttggaaaaaagctgtttagggggcataagtatcatcaacctacagaatttctcatgccattagaatttgtatttcactttcagagagtctcatactctcgtctcaggtgacaattagtttgaagattccatctgtattatatatgcaaagtgagtaactgtttgtgtatttgtaatgacataccgaatttcttttgccttcaggacaagaaattgcccctccatgatccccacataattaaacaattctggggtatcagatttattttctgaaaggttggccaaccaattttattaagaatcaattttttttttgtgggggggggggggggggggg

SEQ ID NO: 64185 - DNA, 754 bp, Oryza sativa
tttagggtagacgtgtcacgctatatgagtgtacgccgatttttcataactttcatatacctaaatcaaatggttgagacgattattagtaaaagtttagtaataaaaaaaattagtccgtgtagcagtgctcagtaaatgaatgcaaactgtgaaagccgtggaaggggtcgttctccggcgatggctccggcgacggctctggctccggcggcttgtccttgtccttgatgagctccgccgtgcgctgcgcggccacgctgagcatgttctccacgcccatcgagctggcctccagcctgagtatgtccgtctcctcctcatcgtcgctggactcgccatcatctaatacttcctcttccttaccttcagcttcgccggcggcgtgcttggcgcagtactcgaccatctcagcgaggggtttggcggcggcgcagccgtcctcgatcagttgccgcaacaggctcgccgccctctccgccattgatgatatctccccgtcggagctcatcatcttgttgatatcttcttccgccattgatgacgacaactgtccagcgagctagcgaccggtttgcacggagaaatcaattaatggcatgaaaccgatctaatccgagtctaatttcaatgcgaactgttgcgatgaatccgtttttgaaacatgcacacgggtgcagttgagggatttgatctttcttttttttttgcggggagtggatttgatctgatcgagaggggtttatgtaaatct

SEQ ID NO: 64186 - DNA, 1468 bp, Oryza sativa
cgacgttgaggacgtgctggatgaattcgatgctgctcagctcatcaggaaccatcaatccaaggtacttccacatattgtcgtgtttgaataaatgttatatgcttcaactttacggatcagctgctgcacatgtgtgattttctttgtggaacttttttgcatcataccagcccgattaatttctaaaattaaaaaggaaattcatcttttccactaccatgccatttcccgatccatatcggactatcagagactagtctgagtagatgaaaattgatctacaaaggacactaatatagacagtgactttgactccaattttatttttcagctcaagttatacttttcctggaacaatccgctcctccagaaaatgaccatagcacgcaacatgaagaacttgagggataaaatagttgcaatagaaaaggatggcaagatgctcaatcttgtgcgtcatgaaccacatgcaaaagggagtagaagcaacgaaacttttactgtcagtgatgatatggagattggaatgctagggagggatgctgaaacagaaaaaataatcagccttctattgaaaactgaagccaaggaggatatctcaattattccaattgttgggcttggtggactagggaagacaaccttagcccaagcagtttttgcagacaaaagggtccgtgtctttgatatgaaaatctgggtttatgtttcagaggattttgatctgctcaaaattgggaaggctatcatcagaggagcaaacagaagtatcaacctggacaactgcaacttgcagtttgtaaacaataatctgaaaaaagaacttgccaacagaagatacttgattgttctagatgatctctgggaagaatatggagaaaatttggaaaagttgaagcagatgttacaacatggcggaaagggtagcaagattatagcaactacacgtagtggaagcgtagtgcaagtactatacactggttatcttgcaaatgaacggaaagtatgtccggtgcctgagcctgatcatatcaatttgggtgttttatcaccttacgactgctggagcgtcatgaagcggagagtatttgggcctgatgatggccaaaatggcttagaggaaattggaaggcaaattgccgagaagtgtggaggactaccactggtggcaaatgctctcgggcaagtaatgtctgaacataggacggttgaggcatggacagatataagggatagaaagattgttttggatttcaaagcagatcatcagcaagacactatagagcgcctaatgttgagctattactatatgaagcgagaattcaaaatgtgctttacatatttggcagccttttcgaagggtttcgtcatggacactgatcgcttgatccagcaatggatagcccttggatacattgagcacgagataatggtcaaaggtgtgtcaactatcttttgcggatgt

SEQ ID NO: 64187 - DNA, 2799 bp, Oryza sativa
attcctgcagccctgatattttcccgtcggagctcatcatcttgttgatatcgtcttccgccattgatgacgacaactgtcagcgagctagcgaccggtttgcacggagaaatcaattagtaatatgctttgtcgatcatctattttattagtatatattaattaattgcatgaaaccgatctaatccgagtctaatttcaacttattacgaaatcgtaaaccaactgttgcgatgaatccgtttctgaaacatgcacacgcgtgcagttgagtggatttgctctgatccagaggggtttgttggcaacttttcgtaaaaagtcgacaagcacgatcgcagcaactaaacgacttgcggtgatatggagtcgccaaccacctcgatctagccaaaagctagaccaagatgggttttgataactaaatcggctagcggagccgatttctagataactacccgtctcgtgggcaaaacggaaggttttcaggacaaacctataaaggggtgtcgcactctcgcagcggcggcggacgatttacagcgcaaattgacaaagatggataaactaagagaaaattaaaagcaatatgaaaaacgattcgattgattgattgtagattgattagttacaattgaaccggccatgtcccttatataggggttggtcttgccctctacaggccctcctccacgtccaactcggggtagaaatcaaatgaaacccgaaacatgccttcccgagcaaggaaacctcgagacccgacgaaacacagtcggactcggacctgccggtcagaccggccacatgccgccggtctgaccagccctaaaccggcggtctgaccgcccaacgcacggcggtcagactggccctactcggaggaaaccggcagacttccaaattttggcaattttttctatttaatctttaggtgccaaatttgggtgtaaacacatgccccccctaccttttttatgaacaacgtgaatccaaaagcatagaacatgtttttggtcttagggcgataatccaattactggccatagcacctcctaagcgtcttgccaaacgctcgggaagtatttcttcaagtatttcccgttgattgctcgctgaaaaggctccccttgaagtgtctccaaaaaatatgcgttccctcgaacaatgccgcatattcgataaggaccttccctactaggagaccacttaccgaatttccaaaaaatatgccgcatattcgataaggatgccgatacaaatttccagtatcttttggtttgaacccaacctgctccctcattacatcggcaatcatatcagcccatgatgtttgctgaggtactccttgtgtttgttgctgcattagctcaaactgattgaactgaggagcaaactgaggttgaggcgatcctgcctgctgatactaaacatgaggtgacagaggctgatattgataattcaaatttcttccttgatagttctagaagttcggttgaatattacgtaccaaatgttcagggataatctgaggcacaactgattgatcggcctgtacatgatggaccaagtgttcagaataacttggttcacagtatgctgcattggccgattgtcaagtgttctcaatctcgctgacgcatgttgtaagttttgctgctgagtcggatgaactgtctgctacctcggctgtgcttgctgagtcggcaacggctgtgttgggtcggctattgtcggatttggcaagaacattgcagcaacttgctcctgagtcagccgattgacattttgcccagcatgttgtggttgttctctggtcaacaatctggggttaaccatctgtcttggtgctgattgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttccaacttcgtcttcagctcagaagcactacacttctgaaaagggggaataatagcaaggctgagtacaaccaccgtactcagcaagccacaccaacgatgcggacgtgcaaggggatacaaggaggggtttgtggctatttgcataaaggcggttgtaaaacattttatttagcaaacagtaaaactgttgaataattaaagtgacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaattccatcacgcccaccttggccacgggggctaaggaaagggtcaagtatacttcagatcaagcagttacccactcccggct

SEQ ID NO: 64188 - DNA, 1622 bp, Oryza sativa
  unsure (1)..(1622): unsure at all n locations
ttatatagtttttaaaagtcactgcaatttctaccccttacttctgccatctccttctttatttgcttgctagatctaccactttctattcattctccttgtaacctttaaaaattggatcttatagtttttagagtctattgtcttgttaggtttctttttataatttctagaagtcacatcaaacgctgccattatactattctacggttcgtccaatgtcttttttctgtttattatcattgggattttaaaattcgaatataataatcattcgggttcatttttttttactttttagaagtcccgccaaaccgttaacggctttgccactaaactcctctatggcttatctgctgcctctcttctttattgtcattgagattttaaaatcgaacatgattgtcattgggtttttttttactttttagaagttccgaacctttaaaaattggaccttgtagtttttagagtttattgtcttgttgggtttcattttttataatttttagaagtcctgttaaacgatgccactatactcctctacagctcacccgccgcctactctttattatcattgggattctcaaaatcgaacataactaccgttggaattcattttttattttctagaagtcctaccaaccatcggtggctctgcaactatactcctatacacctagtccgctgcttctcctttttattgtcattgagattttaaaaatcgaatatgattatcaatgtggtntattttttttactttctagaaatcctagcaaccgccttgtccgtttgcttcacgacctatatgttgtccctccttttaatcgtcagtaggattctatttggtgttttatcaacaagtatatgtcgtttcaacgaccaccactctactcctttataggcatgttacttaatttatcttgtcatatgttttaggtggtatttctttcaatagtccttattttctatcaccaattagttatcaataaattgtattcctaatggaaatctttttattccttttctaatttcagaatttatttttttttcaaattttaactaatattgtatagtgttcttttaatatttttatttttcaattccagttgtttcaaaattgtattcctactcaactctcttttactttttttaatttttatattattttattttttattctgaattttaattaatctcgtatcgggttcttatatggattcttctttcaatattgcttatttttaatttagaatttctattaattttaaattgtattcctactttaactcttattttctttttgctaattttagattttatttttatttttcttccaaatattaactaatatcgtattgggtttttatattgactattctctcaatattcattatttttaattccgaatttcagctatttttgattttgtatttctacttggaatctccttttctttttctctgattaatgtgggaatttctctgattaaaaatcgaacatacctatcgttggaatttattttttattttctagaagtcccgccaaccatcggtggctctgcaactatactcctatacacccagctcactgcttctcctttttattgtcattgagatttt

SEQ ID NO: 64189 - DNA, 1055 bp, Oryza sativa
gagcttatgctttgcgatcgacttgcacgcatactctttcctggttgccttgtccacgcacaagtatgttgtgccaaacaggccatgcccaagcttgcgcccaaggttgtacctatccttgagattctccgccttttgttggagcactgactccacctgcaacccggcgctggagatgtgcttcttgacctgagactgatgcctctgctgtggctgggtgctcgatgacggcggcggtttggtcggttgtttcggcctgggatgtggttgagttggctttctcactggctcagagataacaattggtcttggaggggcagtagaggtgagctgctgctgtggcggtggcggctcggaggtcggtgaagagggggaagagggctggacgacggggacagagcgcgagatggtggggtgggatggggtggaggaagtggtggttgatccatttcgccagatggcgcaaagaaggccgttcttcgacaaactacaggttgtgccaacacagacgttgcccattagaatggtgctgttgtggtcatgctggtggttaaggttaccctcatcgatgtcctcttaagttttttttttcttgtgatcaagaaactttaaggagttgggtatatgcgtagttgcagttgatttcgtacaacttggctggtagtatagtcatcattttcttaatgccccttgttcacatcacattcttggaacatataactaagctctatggaattattggctactctgttaattaatcctagcaggaaagacttgcatccctttagggatgtcctctcatttttgcatcctatccaaattaacttgtatagaagggctgcgtttgacaaagtaagctagagtgacatactgtgtctatttttagcagtaaagtatccatcgtttgtttgcactctcagcatcatatacttaaaagtaatgacagatggtctaagatatttttcacacattaaatgtacattattaaacagcaggacagacaaagatttgtcacaaggaaggaaagaacaaggacatccaatttgaactttgtt

SEQ ID NO: 64190 - DNA, 523 bp, Oryza sativa
agaggctcaattttagatgaattttgcaagttgaatggctcaattcggaattcgaatgaattagatatgaattttggaagttttgagccattttaatggatttctagaattattaccgatttattgcgcaatttaaatcaattatgacgtcatccgacgggggagaggtggcgccggcaagcgggccccacctgtcggtgactcacgggtggcgggcacaccgtggaccgagtccacgcacgcgctggtccgcgggcgcaccacgtggcagacacctggcggccacgacggacggctagcggaggtggcgccgacgtggcgccacagaggcaccgactcgggcggcacgggagggccacgtggacggcccagatcgccccgaagggggatcgggcggccacgggcgaacgggaaccggctgaccgatcggccggccgggaacgacgggcaacgccccaatgttcccggccaccgaccccgggcgcgacagcacgcgcggaaggcgacgaaaagggctgcagga

SEQ ID NO: 64191 - DNA, 887 bp, Oryza sativa
ttaaagtattaactaatactccagactgattgatcaggcatgttgcacggcatagtcgatcctatcttgaaaattattgaattgcagtggctcttggttgccatctgcaccaggtcttcaactgtaccatcttgaggaatatcacttttgttacctgagccagttgcagtacctttgtcaccctgagatgaacttgggctgacctcatcggctgcgaccaccttcaacttgtacttttgtacgatggttcctctgcgggtctcctgaaaagaatccatgaatttgttcttcacgttgctcatcatctgttcaagttcatccctttgctcagctgtcagcctatccaatgtgattggaacaatattggttgggtccacttcagctgatggatttttggcccccattttatttacgggaggtttgactcctgttcccggtgatggtggtggtttttcggccatcgggatgaagtcgttgaaaactcaggtcccaccgggcgtgccaagagagtgttgatgtaaaaacacgaggcctgggagatctgcttaactctagtgcaggtccaaaatcttgcctttgaggttcatgagcatgccagttgatttgatcctgcaatcaacaagaaataaagacaaagaaatagtagttagtccataaatgatagccgatcgaccagccgccgatgacgtatcatttgtactcgagccgatgtcatctttgcatcgatcggctgtgcgaggcaataataaagaaactaaatctattcaatcggctgtagatatcaatgataaataatcttcatgtcgatatatacttaaatcaagtaattgggatagatcggtcgccatgccgagacagtataaatcccttagaccgaaatatatatt

SEQ ID NO: 64192 - DNA, 1976 bp, Oryza sativa
aaattgtattcctaatggaaatcttttttttctttttctaatttcagaattttttttttcaaattttactaataccgtatagtgttcttttaatatttttatttttcaattccagttgtttcaaaattgtattcctactcaactctcttttactttttttaattttttatattattttattttttattttgaattttaattaatctcgtatcgagttcttatatggattattctttcaatattgcttatttttaatttcgaatttctgttaattttaaattgtattcctacttgaactcttattttctttttgctaattttagattttatttttatttttcttccgaatattaactaatatcgtattgggttcttatattgactattctctcaatattccttatttttaatttcgaatttcagctatttttgaattgtatttctacttggactctccttttctttttttctgattaatgtggaaatttctagcacccacagcgaacatggtgccttctttcaaagctgttttaataatataatagatcacttctaacatttgaaatttgtatcaaaatataagtagttttatagtgttcattagtacaggaatgatgtcctggatgggactcattttagattgcaaacgaaccataagtggtcgcgtctataaaaatcgagctctattttcacgtgcggctctttaaaatgaccacactgaaaaatcaattttcgcatgcgggccactttaacaggtccggacttgttaagagacccgcacacgaaaatacctacccatatttttaatgccgccatctccgcccatcgcacactctcatctcttcccacctccctcctcctccctcgactcctctctctcctccatctcctcccacctcgactcctcccttgactcccatctccttcctcctcccttgactcctctctctcctcctccccctcctcccatctcccaatctcgacaacgacggcggcctcagctagggctgtggcatcggttagagcgacgaaggcggcggcatcggttagagcggcggaggcggtggcattggcgcgctagggtggtggctgcggagcggatccgtcgccagccaccgcggggaggccggatccgtcgcctgccaccgcgggaaggccggatccgtcgcaggccaccgcggggaggccagattcgtcgctggcgaccgcggggatgacggcggtgggcctgggcaaggcgtcggcgacgacaatggtggtgacggctgcgacagcggtggtggccgctagattagggttcaattttttttatttttttgttttgattttttattctcccatgcgggcggcttaagaacccacacgcaaaaattgcgattttcggattttcgttgacacctcgttcccgacgagtgaaagttccgcatgcaaaaatcaattccggctgccggaaaaatcgttattgtactagtggtttgcgcttgtgtcatccatcacatttaattttatttatatcttactccaaaacgatcctctcattttcaactcaaatttaagcgcttcattggaatagagtatccttaggaatttaaaggattcaaatcctaaggaaattttggttgtttgcaacgtaggaaaattcctttggattacaatcctatagccaaattccatagaaaattttacacgtaagctgcaacctcattttaactttttgtttaagaagtccaatacttcctcctccttttttagggtgaagttcaatactacttcttatctctttgtctctcttttcttttaaaatccatccaaattccttttttcctgtgagctatccgaacacacagtcttgtaaatttctgtgttttgcattcctgcggaatttgcttacacacgacatttcatttctatatttttcatattcttgcatttctaaattttatgttccaaataagcagtaatgtattcctataagg

SEQ ID NO: 64193 - DNA, 670 bp, Oryza sativa
ccaaacttatctgtaaggaaattacataaaatatcctaattaatagatacaattgccttcttaaaactctatccatgtgtggcaatccatgtgaagcacattaactcagctcgataatgtaaaccgattcatattgtcggaatcggctgtatcggctaaccctatctgacttggactcagccgatctggtcgtagccgatctggactcttctgttccctgggcacaaatgtccgaattcacagctaattcggtctttgaatcaattgcggcgtgccccccatcgctctgtccagaatcggtcagaccagccatacaagaccgatcagaccgcccggggtggctggtcagactggtggcatgtggccgatcaaaccgcccctgctcaccggtcagaccggccgtgcaacgccggtcagaccgcccctggtctccagttttgccaattttgcacaaaggtttaaaaatcaagcaccggctcttctagtatcagaaataatcccttcttcacattatagccagatgcttgttgtgccaaatcatttgctctagaattatcgaaattagcaataatgtccaagcatgaatcaagatacctatttagtgatccgtccaaacatttgtagattccggcgacttgttgcaccaccaattcgaatcaccaaaagcttc

SEQ ID NO: 64194 - DNA, 49536 bp, Oryza sativa
cggcgtcaaatatttaagtaaggagggagtatattatttgccgtattgatttcaactttcaagtcgtgtacaacgaacgagttgtctagtgttttaccctgatcgtttgagacatggctgataagtcatggaaaaatgagcgaaagcaaccgaatataatttatggtgatgattttattttatatatgtgtgttgtttgtgttttagaaagcaatgctggaaaatagactataatggaataaaaactgaaatcaacgttttataatttagattttagctggtgcctgttttaacagtcataaccggaagtggttcttgccatccattcatgcatgaacgtgatttgctccttttgctacagtccaattctattccttttttttttgctaatcctctcttctctcttctatccaatggaaatgtgtgcggcgatattcgagtcataatcatattgaaattaccatcagtagcatcatcatgtgcatacattttcaatctataggacgagctagtctacaaacatactccatccgtcctaaaaaaaggcaaaccctaggtttgcgtgtccaactttgactgtccgtcttatatgaaatttttttataattattatttttattattgttagatgataaaacatgattaatactttgtgcgtgacttgtctttttaatttttttcataattttttcaaataagacgaacggtcaaacattgggcacggaaaccagggtttgtctttttttgggacggagggatgggacggagggagtactagtgttttgttgaaatttatatttttcaaatcaaatcaaaaaatagcttgcaatgctttgcctcggtaaactcttttgatccctcgagatgatgtctcttgtttgtcaaaaacccattcaaataattatgaaaaattcttttgacaacattcatacagcatatatacaacacttcacaaaatcaacttacaaactgagatataaaaaaagggtcaaatttaaatatcctcactcagaatctgttactccctccatttctaaatatttgacaccattgactttttagcatatgtttgaccgttcgtcttattcaaaaacttttatgaaatatgtaaaactatatgcatatatataactatatttaacaatgaatcaagtgataggaaaagaattaataattacttaatttttttaaataagataaactataaaacatatttaaaaaagtcaacggcgtcaaatatttagaaaactgtaggagtactgatgaagctgcatttgcatttgcgcgaatgtgacgcagctggtggaggggatcgaggacacggtgggcgtgggcaaggggacgagcaaggtgtacgccaccatcggcctcgacaaggcccgcgtcggccgcacccgcacgctcgccgacgacaccgccgcgccgcgctggtacgagtccttccacgtctactgcgcccacctcgccacccacgtcgccttcaccctcaaggccaagaaccccatcggcgcctccctcctcggcgtcggctacctccccgtccgggacgtcctcgccggcgacgaggtcgaccgctggctccccctctgcgacgacaccgacgcgcgcacccccatcggcgacggcggcggcaaggtccacgtcaagctccagtacttcgacatctccaaggatcggagctggggccgcggcgtccgcagcggcaagtaccccggcgtgccctacaccttcttctcgcagcggcaaggatgcaaggtgacgttgtaccaggacgcccatgtccccgacgggttcatcccccggatcccgctcgacggcggccggagctacgagccgcaccggtgctgggaggacatcttcgacgccatcaatggcgcgaggcattttatctatatcactggttggtcggtgtacacggagatcgcgctgatcagggacgccgaccggccgaagcccggcggcggcgtgacgctcggcgagctgctgaagaagaaggccggcgagggcgtgagggtgctgatgctggtgtgggacgaccggacgtcggtggggatgctcaagaaggacgggctcatggcgacgcacgacgaggagacgatgaactacttccagggcacggaggtgaactgcgtgctgtgcccgcgcaacccggacgactccggcagcatcgtgcaggacctgcagatctccaccatgttcacgcaccaccagaagatcgtcgtcgtcgaccacgacatgccgtcgtcgcgccacggcggcggcaatggcggcgggcggcggagggtggtgagcttcgtcggcgggctggacctctgcgacgggaggtacgacacgccgttccactcgctgttcggacgctggggacggcgcaccacgacgacttccaccagccgaacttcgcgacggcgacggtggccaagggcgggccgcgcgagccgtggcacgacatccactgccgcctcgagggccccgtggcgtgggacgtgctctacaacttcgagcagcggtggcgcaagcagggcggcaaggacctcctcgtccagctccgggacctcgccgagacggtcatcccgccgtcgccggcgatgttcccggaggacgccgagtcgtggaacgtgcagctgttccgctccatcgacggcggcgccgcgttcggcttcccggacacccccgaggacgccgcccgcgccggcctcgtcagcggcaaggaccagatcatcgaccggagcatccaggacgcctacatcgccgccattaggagggcgcggagcttcatctacatcgagaaccagtacttcctcgggagctcctactgctggaagcccaacgacggcgtcaagccggaagatgtcggcgcgctccacctcatccccaaggagctctccatgaaggtggtgagcaagatcgaggccggcgagcgcttcaccgtctacgtcgtcgtgccgatgtggccggagggcatcccggagagcggctccgtccaggccatccttgactggcagcgccgcactatggagatgatgtacaccgacatcgcccacgccatccaggccaagggcatcgacgccgaccccaaggactacctcaccttcttctgcctcggcaaccgcgaggccaagtccgccggcgagtacgagccaccggagcaggccgagcccgacaccggctacttccacgcgcagcagaatcgccgcttcatgatctacgtccacaccaagatgatgatcggttcgtatatatctcctgattgatcttaccacgattgtttttggatgcatttcttgatcgatttggttgtgtgttcatcagtggacgacgagtacatcatcgtcgggtcggcgaacatcaaccagaggtcgatggacggggcgagggactcggagatcgccatgggagcgtaccagccgcaccacctggcggcggcggggcggccggcgagggggcaggtgcacgggttcaggatggcgctgtggtacgagcacctcggtaccgtcgacgaggcgttccagcggccggagagcctcgactgcgtgcgcaaggtgaacgccatggcggacaggtgctgggacctctacgccggcgacgggccggagcgcgacctccccggccacctgctcacctaccccgtcggcgtcgccggcgacggcaccatcacgcagctccccggcgtggagttcttcccggacacccaggcgcggatccttggcgccaaatccgactacctcccgccaattttgaccacttaaagaagagctaaattaacctctctgtgcgctttatcgtcaatgagaagagatttattttggttttttttacttttgaataagaacaccacactagtttatggcttctgtatttattttggacaataacaactgcattaatgcagtgaaacatcatgatgagttgctatttgttatgacagatttgctagtttcacactatggatttgaactttgttgattttgttgcatttctgctatatactccatccgtccctaaatgtatgatgctgttgattttttttcataacatttgataattcctcttattccaaaatttagtataaacatgtaaaagtataagttaagattatagttttttttataaaacaagtcacaacaaaataaatgaaatttatatttttttaaaaaaaaattagacgaacgattagacatcacgtaaaaagttaacggcgttacatatttttgagactgtattgttgtctgtcatatcatcaattagactgcaaaaattcaatccaggaacagtttctacaccagatagtaatagtagcacccttgaaattgggattttattcactataacaataaacattttatttggtttcaaaaaagaaaagaaaataaaataaacatctagtggtgctaggttgaatagttggatagaccaatcattgaagcgccatccttctctcaacaagaagtaggacaaggacctcctcagcttctttgcttcatgttctcttttcaacattttcctttcaactttgatcttttttatggtgaatgtattcccaacttctcatccacaaaggagtcatcttctgttgactggctagtatggctgtcaattaccagctagagtatcaatccagtctggttcacccattaccaaggaaaaaaaacagagagagaaggttctacagtttcatggcctacaaaaaagaacaggcggaagatagaagcttctaaactttctttttgtgtgatgcaaactgtagtctgatctggtgagcattcagccaaattcaaaaggaatgaataaaaatccctactcacattttaagtgaaccagtaaaaaaggaggcaatattcttggacaggaatttcaaaagtatgtgccaaaattcatttctcttgagaaatcttctgacaatgttattttgttattttggtgccggtccatcactaccttcctgagaaaaatcttatacacaagcttctaagacccagacaagctggcaaaagacaaattggagagaagccaagtgattgcttggcggcccatttcacctcaagaagagataaacctgaatcttctagttaaattgcagctgtgtatgttgactcatgcagtcttagcctttggtttagcttttttgaacctagagtacaggaaaactccagctagagcaacgccagttcctgaatgcagaaaaaaggacaaaattcagtacgggtaaattgaaaagcgagctgttaggatcagttgaatttggttgtgaggttaccaagggcattaataggtgaaatcggagttctgaagaagagaacggatgagacgatgaccacaactcgtttgacacagttggcaacagaatgggtcacaggtgatactctagccaataaactataagaaacctgcctcagaaacaaaaataattttggttaaggtaattaaacaaaatccgaaagagattgaccatggtaattaaaaaaacttgcagatacactcatgtattactagccaccactagaaaatttggatccatgcagacaaaccataaaaattactacaaaattctaagaaccgttggacaaccataaaaactatttttatactggaatttagcccacctgttggtaaaaatgaaaacaagtgccagcaagagcagctttcatacatagttcctgtagattaactccctacatgcccaaaaagacagtgtttgaataaaacattggttagcaaagataatacagaacagcccaaacactcacgttgctctgcaggtacgatggggaaaacttgatgccttccacagacagcatcagtggggcagataataaaaatgacataacagtcattatcgagaagaggtttatatcatccaatgtttcctgcgatatgaacaaattgcgtaaaggtatacagtgcttcacggtatttaccatactgtaaatgtccgaatatacattttgtgctgaaaaatattcttgtaggaggaactacacaacttcatgggttgggaaaatcacctctttatcagccagaagtttcttgctgaaaacatttcgcgattgattggtaagattggaagccatggcactccaaaatcctatcctgttttatcaaaagttttgcacgatactacattacaacaaaatgcattgtattgcttaaacaaatacgaagacagaagtcaaagcatcaaggactcctcagttcttaggcattggaattaaagataatagataccactgaccagttgaaagaaacttcggtcatcgatgctagcacgacgccaccaacaattggcacgagggaacctaagaccaagaaagagggtgtctgccgaaacacacgatttgtttcaaagcataaaccgatcagtctctttggttatatgtctcctctttttaagacaaaatataaaaatcatgaacaaagcatgtacctccccaaggaacaacacggagagaaggacagagaagaagggctccatggccttgatggtgtgcgtgaaggaaacggcgaccttgcccaagctcatgttggtgaacacattgcccatcgtgtgcaccaatgccaatggcaggatctttgcatactgcactaacaacatttttttttaccacaattcattacatttctagaattgtattgtagtattccaatacacaaacttttgccacaatataagacatttctaataactaggaaggtggcccgcgcgtatgcacgggcacttatattattgaaaggtattgctagttaattatcatatagtccatctatatatataccgtgtagtatggccacaaatgaaaaatgcgagtgcaagatactcaaaattcttttgattaaatcgtctcatgaagacgtatgatataggaataaagggagggaagcatatgcatggtaaaaaaaaaagaaggagaaaaaatgaaaaaagggaggggaaacgtacgtacccatgtaagtaggtgcgtacgtatgccgcgggaggagaggtgggacctcgtagtatttagtttgttctaggatcaatttaatgtaatggtttataatattagacctaacgatttaagtgaaaatcaagaaatagatactttgatttttttttccttagaatttctaatatttgccctaatttattagagcaccacgtcgcagcttgagagcattttcatgaattttaaatgacttaacacatgtaattagaatattaactgtgcaatatatatgtatgggacatatggtaatatttgttccaacttcgtccatctttatatacatgtagagtgaaattaattttgtggcttgcaagccattagatgtctaattaatagcaattaattttgacacctatttacaattgttcagagtaactcttacatattaattttacgactttaatgatttatcaccatgactcgcatgaaaaaaaatatgtagtacttaaggttcaggatagctgaaattaatgaattatataatttatgtgatagctatttaagggtataacaaatgaattgacttctaaaaagttagaatattgtttaaagaagacactatttagaaacttggaaagtgtgcaaacaaaaatccaaaatatggaatcgggaaaaaaataaagggccttaaactccctttatcacccttatcatagtaagagttctattaatattcgtcaatattacgctcacatttataacataatgatccctttcacctttacgaacaaatagtacaaaatccaaatacgacataacacaaatacattataattattatataatcaactctcggtttcaacttaaacagagctaattagtgtggagaaaaacataacccatggtgcttaattattctctcgctgcatcacacctttaattttcttttcatgttattaacaaaattaatcatctccatatatgatttgatatatggcaaagcggtagctctacggtggttgtgatcaccttatatgtctcaaacactacaccttgtcacccatgcgaaaggcaaaggtgcaaatgtgcattgtgcagcgggcaaaaaaaaaagaatttcggacgctttatttattagcaaacaatagatacgatgattataataataagtccaccagttctagtgtaagtgtacattagttaatatatattttaaattgttaatttaatgggtacacaatataatggtgtagaccttattttgaaacagtgcattacttgagaataatataccaatgtaataaaaaatagatccgatgatttatataatggggccatcagtttaagtgcacgtataaattagttaatatagatattgtttatttaataggtacataatataattgtgtaaaatttattttaaaatagtgcattatttgaaaggaagattttttgttatatgatggtagattctttgttttgtaaaattatgattatttaaaaaatatatgcactatatatatatatatatatatatatatatatatatatatatatatatatatatatataaatggaaaagaaaaaaagaaaaaaaaaagaaaaaaaggagggaagcgtacgtataatgtatacgtacgtatatactccacctgccacctgccaacgtgcaggaggaagataggtgggacccatgatatttagtttgttttaagatcgattttatctaacggtgtataatattggactcaccaatttaagtgaaaatcaaagggtagttgtttttcttttttcttagaatttctaggattttctctattttattagagcgccacttggcggcttgagagcgtttgtagaaagtctcatggacttttagtatataatagaagattccattattccagttttttttgacaagaacagtgggttacctgtccaagggagagccttggcttggggtgaagattaagcaaccacatgagggtgatgaagaatgatccggacgcgaattggaaggtggtgatggtgtacgggaagggcaccgatttcagaacctgcaagccatggattccaacaagatccgccatgaacaaattagagacgaaaaagaacatgtcgagaaggagaaggaaattgacgaattgggggaaaaaaatatatgtgcagaccagcttgttgaagatgttgaagtagatgttgaggaggtaccagacgaggatcatggcgccgagctgcaccgtccgcgaaatgccgccggcgacggcgccgccgttcgccttcccgccgccttccgccggtggcgaggccgccgcggccgtcgccaccgccgccttcctcgccgcggcgccgctgttccacagaagtgggggcgcgagcagcatgcgccccccgcgaatgccgagcggcagcaccggcgcgcccgcgccggcgaccgggcatcgattgagagacgacgtagtcgtcgtcgccgtcgtcgtcggaggaggaggagaagaacacgaggcgacatgccgccgccgccgcggggaggccgcccaggctctagaggtcgccgccgccacggcctgcatctcgcctcgccacgccgcgttccacaaccacgcgtccacggtttcttggtcacaacaatggcgccgcctcaaatcaaatcaaatcgatcgaacgccgccctggagtcgcggaacgcgcgcgcggacacggacgcgagagcgcggtggaggagacgccatctgctacttatggaggaggagtggctgcggctgcggctgcggcgcgagtgggcggcgaggcgagggcgcgagtgagaggccactggaagccgcgggaggagagagggcgacggcgacctggccgtctcgctctccgcctctccggctccgcgcgcggggagcctctgagactcagagagagaggaaaaaaaacacttctttttttttttttgagactcagagagaggggaaaaaaacttctttttttcttctgagactaaagagagagggaaaaaaacttgttttatgaggggaaaaaggcttctttttttacagtgttttttttcaattcttttttcgtggtgggcactggcagagtggcagggaatgggcccggcggctatggcgttgtgggccccacatactgaatgcgacgtggcatttatgtatggagttgtacacctataccgggatctctgcaggagtactccattaagaaaaaaagggaaattacaaatattgaggaggaatccggataagtgctcatccaaattcattattaaaaattaatttttttctaaaatagatggcgtgttttggcattgcattaaaagaattctaaattctgagttgtacactttagaagagtacttattcaaattctgaaattcatcgaaggttttaactcagactaaacgcattaaggtaggagtaaatcatttttggttggcattgaaaaaatggatggggtgttaacagtgaaatttggtccttggacctgcactgaagctaagcaaatctcttagatcagtgtgtgtatttttttcatcaacatgaggccatcatcttgagccttttcaagcaagacaaaagagttgtctgttttgaaacaaaataatatgatggaacgttttatttttagtaaatttattttaggctacttattcttatagaatatttttattttagattagttaatttcataaaaggttcaatttcaatcataatattgatcccatcctgcttttctacggctcttctctgtgcttacattctttcctcttcatggaggaaaagatgccatcaggtgagtaataagtattaatgttctcagttctcactcctcatcggttgcctccccacgtatttatgatgtcgtaagttgagctatacacccaccaccaccacattttagcactgatagtggtaacatatttatgatgccttgagctatgcactaagagcaagttcaatagtatagccaactactagctccaattaatctatagctaatctaatagcttatttatacaatagttacatactatactattaatacctagtcccacctgtcatagacacactgcgtcttgaagtccgtgctacagctggttacaaatctgtagcccgctgctcttctctctcctgatttatctccttaaaatatatttgcagctggcttatagtctgttattgtacctgctctaataggcgttgctgacttgcttgagtaggagtatatctatgagtcaatcatatcactcaagttaggtcgcatgactaatatacttcttttattttactcccctccaaatctactcaaggttaagctcaggttaataaataaagattgtgcttgaggtcgaacatggtggcggggccaagggcagaacttgagtttggggctaattaacacatacgtgcctgagcttgagagtaggaaaggggcaaacctcaagttagaacttagaaggtgtcaacagctttcagatcaacaaagaagataagaacagtccaacgtaaaacatatgtacaattatctagttcaaagtctaaagatcgaatattcttgatctaatatacaatattggcaacaataagtagcccaatatgcaatatacctttcttttaacctaagtgtgtggttttaagaagtgatgatggataaactcattctatttcttaaaccaaatcttaaacccactgtaacaagtattcacttgatcatctaaatcatgagccaaccaaaacttaggctgtgtttagatctaaagtttagatccaaacttaagtccttttccatcacatcaacatgtcatacatacacaacttttcagtcacatcatcttcaatttcaaacaaaatctaaactttacggtaaactaaacacagccttagtggcattctagttcatggccatggtgagaactgagaagagaaccttctctatgatgcagacctccactttggttatttggtagtagtgtgtcatctggtctacaagcaggggcggatagttgtgaccttcatgagtccaatctattggacaattttattatcttttttttatcatggacattcacaaaaattgtgttacgcttaagggcaaatgtacttcctatattttactagtataatcatatatattttaaacttaaattagtttgactgcgtgcggggtaactagactgataaggttgagttaaccttgcctcctcacatggaaacacaaagtaaaagattggcgcaacattaattaagtattagtaaaaaaacttaaaaaatatattaatatgattttcaagcaactttcttatgtaattttttttaaaacacacatcgtttagcagttaaaaaacgtgaacgccgaaaacgagggatgttagttgagaaatgagtgggaagaacatgccggctgtgttcggtgctctaagttcccaacccctctccctcgttttccgcgcgcacgctttttaaaatattaaacggtgcgtttttttacaaaagaaatttctatatgaaagttgcttaaaaaatcatattgatatagctaatacttaattaatcatgcgctaacggactgcttcgtttttcgtgcggaggagatgggtttccaatcccaacttaccaacacaccctaaatctagccacataatcaaacacacaaaaagaagctaagagcaggtacaatagcaggctataagctagctataaacatactttaaagagataaagtaagagagagaagagcagcggactacagatctgtagctagctgcagtacggactccaagacgtaatgtgtgtatgacaggtggaaccagctattaataggatagtaagcaactattatatgaattgaccattacgttggctatagatgatttgatgccagtagtgggctatactattaaacctaacactaacagcatacaaaacatttcctgttgtttttctccgtcgatcgcaatcgcggagtcgtggctgcccctgtgcccacacccaaaatccgggatctttttcgtgcgattccaacatgtcgatcgttcttatctgatccaataatgacgcgccaatcgctaatccgcaccagttaagcccaaacatttcttttcttttcttttttttttctactcctctccctctcgtttcttggcggcgatggagatggagagagccacagaaatgggggccaagagcggcgcccatttttagtcagccacggcgagggaagaggagccaatcttggccaagccaccctctccaagaatcctcgctgatctctctgcgtgaggcgctcaattcgatttcttggggggtcgattcggatttcttgggatgcagtgggcggcgctgagctcgccgccggcaccggcggcgccggcggcggtgtggatggggcggagggcaagaaccgcgaggttgccgtcgccggggccgcgccgggtggtgctggccgccgcggcgtcgtcgtcgtcgccgtcgccggatgcgaactcgagctcgaactcgaactcgccggggagtggtggcggcggcgaggaggtggaggaggagagggaggacgcggcgcggatggagaaggcggcggccttcctgatgcggagccagaagtacgccatgctcaagcagcagctcgccgtggccgcccagttcgaggtaacgagacgagacgagctccattggattctttcaacaagcgaacttgcaatcgaatccatccgaattggggtttactgcgaattggaataatttggttgcaggattacaaggaggcggcgaggctgagggattcgctcaagtcattcgaggaggaggagccagttcttcgtctccgccgatcgctcaagaaggcggttgaggaggagaggttcgaggtattggacatccatagcaattgtttccttaccatatttgcttgtttcagttgatacatttccatacaagaatcttgtgaattgtagtctaaaaaaagaatcctgtaaattgtgatatccccattaggcattagcaaagttggattgtgagactgtcccaatccatccttgctaacgatgtttgtggattgacgattaatccaaagacgtgcagcctcagttagttgctgcaatgtctctgccgaaaatgccaaaagccgcttatagtgatgcctgatgtgtccttttgtcgactgcacatgcaacaattttgttgtatgcttgattcttttctctccgtgctgtatattgtatgataacatcggaaaatgagaggaaatctcaagtgtcaagaaatcatctcaatacacatgtttcacttacttccttcactgttgacttttctacttgtaatagttggagttgtgttttcatgaccagaactttgaattcatcattacatagtgctgaatttgggctccttacgctaatcatatgccaatagtgatttgtgtagatattttcataccccctggttgtcagtctagaaggcattctttcttcatcttttattcaccatgtttatgatttttctctgttttcatgctttccaggatgctgctaagtacagagatgaactgaagattttggctccacacgccctcctaaaatgttctagtgatgctactaccctggtatcttacaatccaatgatttagtgatgttatactacaactctggcatgtttctttcactcgataaagtatcatagttttgaatgaaatggtttggtcatttgaaaacttgaggctatgaaacattatcattgtctatggcagtatattagtgtttaaaacccccagctggtcacgcaatttcaccagggaacttgggtatcaagtagtgacctaaaaaaatagctaaggcaggatatggaaaataagagattaatacgtgaaggtcatcaagaatctatttgagttggttataactgtgtgcgttggcccttgggcaccacttcatttctttcatatgttcaggcgccccattctttttttccacgaaaatctcatgcactacagatgaaccacctccgttggtttcgtcacctgttctgtaataattctttagttaatgtagatcaaatattttctcagattcttcattgagcttaactagatttcctgatattttttaatgttgaatttaggggattagagttcaagtcaggagtgtttatattgaaagccggagccagcctttgaagggccagttcttctttgcctacagaatcagaatcacaaataattctcagcgccctgttcagcttctcagaagacattggattgtcactgatgcaaatggaaggacggagaacatttggtaagtctctattgtactctcaccttaccaaaagaaccgtatgttaaagctaataaagacttgctccattgccatgccaggggtgtaggtgttgtgggagagcaacctgtcatatttccaaggactggttttgagtactcatctgcatgcccattaaacacaccaaatgggagaatggtaacatctaaatcttccacaacctatgttgtcacacttgtaaataggttattgtaaagtaatttttagattctagctgtgcaagagattcgtatggttctaatatctcttgattgcatatagctggcatcaatttatgcccaataattaacatggtatctagatcaattgttttgattgaagctgaaagaagaaatagtaatgttcaattaagaaagactagttatatcctgcaatttatttattgtttaggttgtttgcgtgttgcatgtctgcaaagcaaacttacctgaattctcttttggatttaggaaggtgattttgagatgaagcacatcgacaaagctgggtcgtctacattcaatgtcgcaattgcaccattctctctgtcaatccttggagatgacaacgatgatgttctcctctaaatgtgattgggtatcagaatgagtttgaataagatgatgtcaccagcaaggaatttgcataatacacaaacacgagtagtgctgttagtgatgtggctagagttctctactggaaactcctgcgaatgcaaatttttgttaagctagctgtgaattgggaaggtaccaaagttcaagatcagagtatcagacaggcaaaacatggtttggtgaaatattagagttaatttagacacacacacaaaaaaaaactacactactgtaaattgaggtatatgatggacttgtgtgtcatctaacttttgaatgtacagcatagaactatatagagcttgttgagagtataagctgcatggaactcttgtattatctcgaaaaaatgattttgtaatgttatagtttcataaatatattgcactaggatttactggtcaaagcagtagcttggctctggcatttttgtcttcataaattcaaccaggttggccttaaatttgtctcaacagcatgattatgctcagggccagatatgaacaaagttcagagcaactgatcagtttatttttgttagccattgcctgttgcaaaatgacgaaatttgtgaaagttctcaaacggatcaattcaaatagtttaaaatagtgctttttatatctgtttattatcgaatttcaagttgttgtgtttagccttaagaatagctatgcttaccaactgaaccatttcaaatcatcattaaaccgtttgcacacatgtgtatacgtaaactttccttttgcatgtggttttgcttttcccaaaaaaagtgcaccttttttccccttcaataatcggtagattcattcaattgacccacagttgacactccgggtatcatcttagcataaaccacatgaaaaaaaataatccatacctagaaagtttcttacatgtattattaacctccatatccaataccatagcttgcgacaatttataacatcaaaactatgatgtcttggagcaaattttaccaaaaaaatacaataacctttttttaaagaaacaaccaaactataaccttgatgacttggtatagagaaaagatataaggttccttacaactcctctaaagacagacgtgtgttactgattttgtggggcccactttctatgggcccacatgcccctctgatgcctcatcactgtgctgtgtcttcactaagagacaattgagtaaaagatagagagatatgatattaaataacctactcactctattatcattttgtatatagcaaatttttaaaagtctcttgatgatagtatagacaacttaagtgaatacagtggactcaattggtgttgcatgagtgaaagattctaataattttttttactgtttaggcctacatgcatatgtggttttctgatcttccatgtttgacaaagaccacatttttatggttgtatgctcaggagatatctcaaaccggttttgttcaagaaaggaaaggaatttacaatcttgatgagacattaaattttacattagaaaagatataaggttccttataacatgtacaacaacaataaagacgtttcttagctataccatgcagttgttttgctaacatgatgatagaataagtgagaaaaatgagcgaaagcaactcctctaacaacggagaagtgttactgattatgtggggctcactttctatgggcccacatgtccctctaacatgcgttagacgagtctcatcgctgacctgtctcttcactaagtgacaattgtgtaaaagatatagagatatggtattaaataacctactcactcaattatttttaaaagtttgttgatgatagtatagacaacttaagtgaatacactggaactcaattggtgttgcatgattgaaaaattccaatagatttttttttactatttaggcctatatgtatatgtggttttctgatcttccatgtttcacaaagaccacatttttgtggttgtatgctaagacaaaaaaaaaatatgatcttgaggagacttttttaaactttacattagaaaatgcagcacatcctgatatctcttcatgactgtaaatctgtcggtaaagtaacatctgtacagttgcatcaaaaccagattgttgcaacatctgaatgttttgacatacctttccccaaaagtttcagttcagttcaccccacattttcatggctcatcacaacagttacaatttccctttaacaaaagacaagcaaacacacacaacatcatcaatcaccagcttgagcttataactgatgcagtgagttaatcacaagattacaccaacaacaaaaaaaatcacaatctgccagatttgctcctcttcatttttactgaagctccaaaagtcagaagagaagtccaaggctgcgcctacgtcacgcatgcgcgcatcgcccccggccatggcgtcatcgcagcagccacaggctatggcgccgctcacgcgcgcgcggcgcgccaccggtaaccgacgtcgctgggggggcggcgcgccatggcgcgcccgggcgggcgcgcgcggcgctagcggacaaggcgagcggcgcggccagagcgggggagcgcgccaagtggccagctagctagcgcgcgcgatggcatcaaccgcgtctctctctctctctctcgccatcgtcactgcggctgctgctgctctcgcttccgtttcatgtcgcgtccagtagcgggcgcgccgcgcgcggggccttggaagtgttcgatcgcgagcgtctcgtctcctccttcgcacgagcggttcgctttgggctatagcctatagcgcgctctggacgcgacgacaccgagtcaccgacgaacgagcgcgacgccgacgaacgagcgcgcgacgccatggacgagcggagagctgctgcttccttgctcgccgtgctggttctgagcctcgtggtgtccgcctcctccgccgccgccggcgtggcgcccgcggcgccgccggatgtctttcttccccagccgccgccgccggcgaaggtgaaggtgaaggtgctgaacacgcaaaaaaagaaaataaaataaaaaattctttgatcgcaagccttgtcttctcatcttagtttgatctttgattggtttcttagctcatgctattctttcttgcttgaatcatgatgataaaagttcttccaaatatatcaatcttttcttgatatatatatattgcgaatttgcaactgaaaaattttcagttcttgctgcactcactcacccggtttttcttgctgcattcgcgtgcgtcttgcagcggaggcgttgctggccgtcaaggcggcgctgcatgacacggccaacgtcctcgccgactggaacgccggctcaggcggcgtggtcgtcgccggcggcggcggcggcggcggcccgtgcaactggagcatggtgacctgctccaagaccggccatgtgtccgtgctgtatgtgctgactagctatctagttgtccattttcttctgtgcttgtgcttgtcgccgccggccatggcgggttcgccggagctcggactgatggatcgatctctctccgtttttttgttcggttttgcagcgatctggctcaccggaatctgtccggcacgctgtcgccggcgatcgggaaactcaggcggctgcgactcctgtacggattgattctctctaactgtttactcgatcggtgcccgttccgtttgagacctagaaatttcaagggaattttgggaaatttaattttgttctgattcatctggaattcgttcttcccaaccgaaagtttacagaattttcgccgtgtttagttccaaaatatttcttcaaacttctaacttttccattacgtcaaaactttcctacacacataaatttccaacttttccatcacatcgttccaatttcaaccaaacttccaattttaacgtaaactaaacacagcctggatctacagtggatccattcaggaagtggctcccaccagaaatataaaatttgttttgaactaagtgtgagtttcttcaaattcagcaaaaatatgtacatgtttcttttttttttcttggaaaattcgttagatcttctgaagttttggaatcctccagcacccccccccacccccatttttttcaaggccctctatttatttcttctttccaaaatgtgaaaccctaacctgtatatataatctttagattactagcctagagcccgtgccttgcaatggaaaacaaggctgagttcgctggttgtagttgggaactatttcctcgatcacgtaaaacggagcgactcattagcgtatgattaattaagtattagctatttttaaaaaagtagattaatatgatttttaaaacaacttttctataattttttttttgcaaaacacacactatttagtagtttgggaagcgtgcgtgtgaaaaacgggagagaggaggagttgggaacattaggaaacaaactcatcccaaattgaatttctagcttattaaatcatttaataagcactcatttagtctaagtaatactatgatttttttattgaacaagtaagtaattttgaaatttgggggagcctatagtgaaataggggaggacttattaaaatgtggtgtaatattatagattatggggctcagatgttactagtagggatggtgtgcaaatgaacaccaccaataccaatattttaagtagtataaattatcgatgcgattgttttacccctgtttggaacaagagaattttggacaaaatgtgaaacatcaattctcactgagcatgggtctcttttcgaatccagacattccaagacaaggcttttttcactgttatagacagataatctcaggaaatgaggaatttggtttgaattttgtgcaggtttttgcaacacaatgcaatttctggccctattcctgacaccataggcaggctgaaggtgctacaaacgctggacctggcatataatcacttcacaggcactattccaagcatactgggacattccaagggcatcttcctcatgtaagattagcatttatgattagactacttttatagtggtgtctgctggaagtataatcaatctagacattccatgttttttttttcatccaatggactatatctgtttctactatcacctgatctactggttgtagaataaaggtagaaattgtagaataattatttctaccggtagtagaacgtataaatcaacggctcggattgcttgtactagagatgatactggtagtagaatactattggtagagaatacggtaaaagtactcttatgactattgatttgaaggcattgttattttgttgcataatggctctgattgtttgtactagtgataataccggtggtagtacaatactaagaatgcctcaaaatactcttatgttttttgatttgaaggcattgttattttgttgttgcataacagatatgaacatgaattggaccacctgatttttttttctgcttgcctcattcctccaggagattgagccacaacaatttatctggatctatacctgattcactagccactgctcccagcattgtcctcctgtataattctccttgccaacttctacttattgcttcattgtttttgtaaactttttttgttgtgatattgagcttgagctgaactatttcagggatctatcctttaacaacctgagtggtccagcaccagtttttagcgcgaatagtgtattgtaagtgatttagaatgagtttttctttcttggtctaactaaatagtgcaacctgtctcaacattatctctcaggggttaccactaatttgccttctcttttctctgtttttctcacttgtcatacttgataagccttcgtggaaatcctttgatacaaaacttcagttgtgaaggaacctgtacttctgtgatagaagagacgattgctgtcccttctgcagcagaagaaccagttgctgtcagcatagaagaaccaatcagtaatacaaattgttcaccacccaaattctgggacatttaactgcatatgaaccattatttaaacaaatttgtgtgaagcaagcaagtttgggcattcatgccctcctgcatgttctaattagagtcattttctcttcccagttcacaggaaaggcttggcaggaactgctcggcgtgtttcattctacatagcagctgttcttctaatagttttcttgattgctggatttgtcgcgtctatttcgcagtggcgtaggcgacaccagatctttgctgatttcgatggtaatgacatctcaagtagtactgcatatatgtgcaagatttgttatgatatctacctgcaagggggcagtataggtcaaaatatcaataggttaactttggagtcaccctgattgttttttttcttttgggagtgcttgccatttttggcacttatatacaacataataatgttttatgttttaatgttgttggtggagggtttgcactgtgatattagaggaaagtttgcattaagtccaataaagtggagagttctcttgaggttctacatgttagctaattttgttacaggtttagcgcattaacttctgtacaaaaagtaatcttgcgagggtctgaaacatttgtatcaagatactcaggccacatatttccataccaaagtgagtaggagcacataataacatgttcctatgaacgcgatactaagttagaaggaaaacaataatgatttatgattggaactctgatcgcatacataaaacaccaaggtagctagaatgaaaaaccttctcacaaccagccttcatgagatcacaacaagcactaggctcgcctacaatgctgccttagcatcttcttcttcttttttgccaatgcatcaaaagttacatgccaatatatccaattttctttaaacactaaaacaaatcatggagttggacaataccatcatacgtgctattgacatatggatctagtgccacgtgtcattctcgcacacaatggtattttgcaattcacatatttttatgatggtccatgatgatatctttcattatttcattctcttattgttatataattataacattttatttaccaaaccttacttggggtagaattaaggaaaatagagtacatgtctttgaaatgacggtacgacattgtcgtggttaacggttattcatgattcaatcgggctaaagagatcaagccacgaacattgtcatggattgacatgcatagcagaggtaggcttacttagagttgtttgccaatgcttcctacactatatataaagataagactgaccgaaatagagttgtatattcttttgtgtcatagtacaggttctagggtgttttggttagtggttacccaactttggatccttagggtaagtagcatggggtgcagcaatatgtgacgtcggtgcttgtgacaagtggggatgttgactgtgcttgagttcaccaatgatggttcaaagtgttgagttattattaagtgccgtagagcgtgtgatatgaaagatggtgatggttgaggtcatgttcatctgaagtggcaaaaggggaatgacaaaacaatacggaagggtatagagcatgagagttgtatgtgcgaaaccaagacttaggctatctggactacagtacaagttggaccatgatcaaatgggcaaacactagcttggcccatggctggttcagcccttatgacagagcagatggcatgtcacaatatagtcttgatttgccaacgagcacccccccgcccccttctcgacctcgcgtttctagctaacaaaacccatggatgcacctttcgcctgtgtgaggcgacagcgcaccatatgctcatgggtcgtgggcctggttcaatataggtattatatatgatactagtttgtgggccatgggtggtaggtcagagcaataagtaccaaatcctagcgccgccatatatagtcgagaccgagcaggggagattggaggtgcttgtggcggctaggtgcggcggagccaaggagtggccggcggcacgtggcacagctgcataaggtgttcgccgttgagcgcccggtggtgcatgctagggcacgtggcacaaccacacggggtgtttgccgttaagcatcattgtggcaatgttgtgtcagccatcatgccttttttcagtttatcctccgccactgccctaggatgggtggcctggtcacgaggagctaattatggtgttgaagatgagataggtaggtgggggaattgacaggtggtgccgattgtgtccgaagagaggcatgagtgggatatgggtggccatggcatttttttatgtgctgaaaagtataggtgagggagagatccagagcttgttaatcttgatctgcagtaggacatttagatattagactttctagaaaaatatattataatctttctgcacctttttttaaagatattctatcatgtgcactgactcgaaaagtttgatattcatatttttgtgtggatctctttccctttgaccattgatttagctttgctaccatttggtacatggttaacaactggatataatatatgagaaccaattcaatgctgataagaaaatcctaatagtgcagaggggtcgaactgcattaacatttcacataactaatcatatttttgtgttgatactagtcatgcccatgcatggttgcttttcatatatgcttatgtatagttttcccatttttgtctttttagattaaaaacaccaacaatttctaagtatgatacaacatttgggctctagccaaataccgtgttttcctcagtttaggcattttaactatttcttcaatagcatgactatagagttatgttaattttactgtgcagtactctgattcctgaatgtgatcatatttatccaggaccagaaatatacctaggccatctgaagcagttcatgatcaaggagatcaaagaagctaccaataacttcgaccgaagaaacattttggggcagggaggatttggaatagtatacaagggtcgcttgcgcgatggcacaattgttgctgttaaaaggatgaaagattgtttttctgtttgtggggatgatcagttccacacagaagttgaagtaataagcttgattgttcatcgcaatctccttcgtcttactgggttctgtattacagacactgaaaggctccttgtataccctttcatgccaaatggaactgtttcttctaaattacaaggttagtcccatgcttcagtatattcttttgtcatttatgcatgatgtacactgacacacatggggcatgccaaagtcctatttttctcaaagtcctatattttctaatggatgtaaagtatagatgttaattatacaaggcagtaatatatttctcaaaaatatgtactacatgttagtttttttcattaaaaaactatagtgcactttctgaatatatcaaagttaaagttggtgtgtacttgagatttgccttgatttttcaaaatgaaaagaaaatattgatagcctaccaatcaaagatggaacactataataacataatataccttagctaaccatatgtaaggtgattatacatgttgtccttgccttatttgcaaatgtttatgtaaggtggtctatattttaccatcacatttgttttcttggtctatgcatattatactgttaatggtacaagtgctaaaaactatgtgcatcttgtgtactgtcattattgtctccctccaaaggatgtataacaaaaggtatctattagttgatacatgatgtttctaaacaatcagatgttttttttttaagtgtccttgggatttaccctttctctgacagactgacattcatgtttattttcagtatttttagaccgaatataaatacattgacccggcatttgggagaaagccaaaagatatatagtacagagttctttattttcagttgttctgttctttctttagattagagtcatcatgtttgtttttgtttgttcctatagacttcattacatatatttgtgttagtatgaaactgagtcaatagggcattgactggtgaaaagaattatatgaaaatgatgtataagttcttcattcattgccacacacaaacaatgttttctgaactaagtattttcattttctatgagcaaattgaactaactgtttttcctcactttgtcagaatatgtgggtggtaaacctactctagactggacaaggagaaggaagatagcgctaggcgcggcacgcgggttggtctatttgcatgagcaatgtgatccgaaaattatccaccgcgacataaaggcctccaatgttctccttgatgagtattttgaagcagttgtggcagattttggacttgtaaaacttttggatcatggtgagtctcatgctgtcacagcagtgagggggacaatgggacgcattcctccagagtatttgatgactggccaaacatcagagaagaccgatgtttacggcttcggattcttgttgatcgagttaatcaccggtcggaaaacgatggagcttcatgaggatgagtatcaggagggaggaattcttgattgggtaaattactagctactccctgttttttttccctctacaagttcagcttattctgttccataattaaaaaagtgtgatgttttgatttagttcatttccacaagttccatagctttaactcctaatattgtacatacttggttgtgttcatgccaatagaatacaatccaatggtacaaaatagtatatcagcaaactgaaatatgacaaaaaaacacatttatgaaaatattatcttggttgagagaaaaaatatcaatggagaaaaaaattgaagattaacatttgttaacacatataccagtgtgaaactttggccaaatatggaaataagtaactccactgtacaagatcttatttatgcacatgcacttcaataattctcaaaaacaatgtttcttagtttatttcaattgccatgaactgctattaatcacacacaatcgtgcatacctattgcaggcaaaggagcttcttgaaggaaataagctaaggtcatttgtggacagtagactgagagacaactatgtcattgctgagttggaggaaatggttaagatagctttgctctgcacaatgtacaaccctgaccaacgaccaagtatggctgagattgctggaatgctgcaagagagtgatggttcagttgtggagaaatgggagactctgaaagatgccgagagatcgaaaccgagcacgccggagttcatgctgtcatcccctgtaaattttgcttcagatgagtgcaattcaattcagttggaagctgttgagctctcagggccaaggtgatgaaatggcctgtttgttatgctcacatacaataattttcagaactccaaaatagggagatgaggatgaactgaggaagaaacggatgtttcagacattaactcagcttttttaactagagtattattttagttatattagttgatgacaaaataagttactctttgtgtgccctaccgaaatctctgggtgactctgatgattaaaaataaggaggatacattgctacaatctgggttgtactttgcatctgtgacttctctatcccctccttttttatcttttggtaagatatagtctgttgtgtcagagagtttttcttttctccagagtttttggtagatatgtttggtttgcttctgtcagaagtcaaatctggcttggtaagtttaatgtgtaggttagtttggagtaagtaacatgtttggttctggaagttttgtcaagtttataaaatgtatccaagaaagatgctaacacaatagcatgctacaaaaatataatgcaaaatttaaaccttaactttttactgctaaactggctcatctgtaatcagaggacctagagtcttagatgaatcttttgctagagacaataactaacaattaaacatcatgacaagaacccaatgcgtgaatctccatgcacagagccacaaacttgttaagacttcagactcttaactttgtctctgcctactatcctgcaagaacacaatcctgaattcctgatgcagcacaagcagcagagccatgaaccatgttcccctccttaccaccgaaggcaagctacagccctacacacacgatgtctgaacatgatgcatcagaaaaattcagagctagcaatgggacaaggaggatgcatttcggctagctaagctcaaaaaccaaaatgcgatgcatgtgttcaagctgcaggcttgcagtgcacacagtgatggtgctgtacatgcagactttgtaataaccggaatttctgcgattttaatggccgtcagtagctagcctccgatttccagttctgggacagcaagcaagcagccaagcatatgcatgcagccatgagtcagctccatggactgcagctgaccagtgagactgaagctgcaaatgcatatgagaaaagtttggcagatgctgctgctgatggatggaacgcttcatggttgcattgcagctagctagctctgctgctgttgcaaaatgtgagctatctagggagagctctggatttggccggcacacactctcatgcagcaatgcattggtcacttgctaagttgtagtactcctcagtacaatgtagttctcactttgtgcagagattatgtagatcctcgcatcagcttcgctgttcatatacactgttgtagctcaaggggctctcttctaagcacactttgttactttggcccttagatcccaccccaaaattttacaccatgttatatcgaacgtttaaacacctgtataaagtattaaatataagctaaaaaataactaattgcacaaattgcgactaatttgcgagacgaatcttttaagcctaattgctccatgatttgacaatgtggtgctacagtaaacatttgctaatgatgaattaattaggcttaataaattcgtcttgtggtttactgatggattatgtaattagtttttttattagtgcccgaacattccatgtgacaccctatataatatccgatgtgacacgtcaaaactttacaccactcgatctaaacacccactttcttaaggtttcaaccaaaggagatgattataataatctactactataagacaagtcgacgcatgaccgggtcttcttaatcagacactgctggtatcgtgatgaagttgtcgtgatggagttgtgggtgcatgatatcctatccgtcaaagttgaaataacgagactcttaaatgagtgtgttgttagattgtgttgaatatgtgtacaaagtcgattacagtgtaaaacttgaagttataataggtattaggatagcaatagagttgtactctaccctaggctctctcttaaatagggaggtacatcagttgtaaccgcatggtgacttagcataggtgagagggaattaatggctaacaccggccaaggatcggggaaaagctcatgtaattaatgtcctagggatgaatgtttctgctgaacctcattaataaatatggtgcctctatatcatcatcagtttggatcttctatggtgttcttccacgttcggcacaccagttgtaaccacatggcgacttaaggtcataggttctctcttaaataaagggacataccggttgaaaccgcatagtgacttagcataagtaagaggaaatggctacggacaacatccgctagaggatcattgtaattctgatacgctataattatattggatcggagagaactcagagaggcataagcaattagtgcctccagggatataggttttagttaaaccttgttaacaaatattgttactcgatgtcgtcatcagtttgaatcttctatggtgtacttccacgttcggtttccgatgtactccctccatccacaaaagttagacatatttcacatttgagtttttctaaataagtagttttttttagtctttatgcattcaagacttaaaagaagagataaattaaatgtttaattagaatccaaggagtcatctaaatactcattggttgcatgcttgcattcactccttgattttgtaatatccaagatgatttaatttctcctttgtcttggtgacaaaaagtaatagatgtaacttttgtggatggagtatatatatgggccatgttaaatacatgtgtgtccataatgacattttgaattcttgatgattcagagatgccccaagcgtgtaagcatggtatttgtcctttgagtgcaaaaggcaatctgcggtgtactgttggagctaatgatcttgagagtttgtgggtcgggacagcttaggcccctattcctattcctagtgtcctttgatctttttttcttgattaagtggcgcgtctattttaacttgtcaacgtgggttgtaatgtattattggttttttatttactaaaatgacacgcagctctctgcttgtttaaggaaaaaaaaaagagaattcttgatacatacataagctttcttgacatacagcgagctggagcatatatccgttggatcactttgccgcgaacatccgttggatagaggggtagttggcattatcggctcaggctgtgtttagtcctttggccaatttttttaagaatgtgatatacatttaaagtattaaacgtagtctaataacaaaacaaattacaaattccgcctgtaaactgcgagacgaatgtattaaacctaattaatctgtcattagtaaatttctactgtagcatcacattattaaatcatggcgtaattaggcttaaaagattcatctctcaatttatataaactgtgcaattgattttttttcgtccatatttaatgctctatgcatgagcctacatattcgatgtgacgtttttggtaaagaaaaaaagaaaatgaatctaaacacggcctcagtcaattggttccggtaaaaatttcaaggaagggacggatcgaccattcatgagtcatcacacgtccaatcgatcagagctgttgcaccggcattacatgcattcattcaggaatgaggaggcctttttgtcagcagcaactagctatctagctgccttctttgttcgtttggcccaaccacacaacaaaacggcttaactctcacagccacattctctctccctctctcccctatttgagggctaaagatttcatgtttagttcccacgtaaaaacttttcaccctgtcacatgaaatgtttgaacacatgtataaagtattaaatatagacaaaaaaataattacacgaattgcgtgtgaattgccagatgaatcttttaaacctaattactccatgatttgacaatgtggtaaacatttactgatgacggattaattaggcttaataaattcgtctcgcagtttacaggcagaatttgtaatttgttttattattagtctacgtttaatacttcaaatgtgtatccgtatattcgatgtgatacgtcaaaacttttcacctctgatctaaacacagcctaagtagttggttagtagtgggtgagaaaagaaactgagttgctcagcttttggttactactagtttatagtgatattatgatagtttgtactgatagtattcaattgtgtaagtatgttatcagtcgaactgattttaaccgttaattttatacattctactatcaatagttcagactataatataaataaattactaataaaaagatgagccgactaaatttatttctactaccggtaaagatctttgtaaaatatcttagtaatggtctcgaaatttggacgtgagcatgatctaggccgagtttagttccaattttttttaaaaaaaaacttctaatttttccatcacattaaaactttgtatacacacaagttttcaacttttccgtcgcatcgttctgatttcaaccaaacttctaattttgccgtgaactaaacacacccctatttatgtagttggagattttacgagtagttacagaagctgccaacacaaagaaggcctatgtaagactgtatccatcattgccgagtatttcatggccacaacgacgaagtagctagcacataatttgctatagctccatttctatctcttctcgagagtgtacgtgtgtgagagagagagagaggctaataattaagtaagagagagtgccatgaactgcatcaagattgccatggtggtgacactgatcatcgtccctctcgcgctgaggggagcctcgcttctcggcaatgccgtcgccgccgccgtcgtcccgtcgtcgtcgccggagcagcagcagcagcagcagcggcggccgcggccgcctcccggttccaagaacggcgcctcgccgtcgtcgtcggctcatgggcagcactggaaggatcagagccgccacgccgccttcacccgacggcggttcggcaccggcaccggcggcggcggcgacgatggcttcttcagcgacgacaagaggttctcgccgactggatcaaatccgctgcacaacttgtgagcgttaatttgagtacttaatttctctctcttttgctgtacatatatttgtgttgtttaattactaattggcaataatcatgagctgagcttaattatataattattccgcgtgtacataataaggttggtgatcgaaattgctaatagttgtttcatttggtgaacttgaaagaagggtaaattttcgtctggctgctcatttatttgtttgtttgtttaatttgtcttccttttgtgttcaggagcagtttgtggttgttgggttatgtattagtcgcttccgatgctacttaattagtgaatctttattggttccagtaataatcttttgttacagatccaaattttaattttttaataatggattaaaatctcgcctctacttcctgaatggatgtacacgggcaaagttacagctccaaattagaagatgcttctgagtttcaagtttcaactaattctctgaatccaaatccaaaatgagttggtgcttttgaaaccactacgatgccaaattaattcttaatttatggttattaaattggttcgtaaggttgtgaaaaaaagttattcctttcaattaataatactcgtcattcattttggataagaatgatgtcaactttcaaatcttttagctatgaataatttgtaaaatatttatcctagaaatatgagaagcatatgtatagatgatggcatgcatgtcggtccaaaatggacacttcggtaaattaatattggtatggtattttctaaattccttgatacgtactatatgaccgtacaaatatgtatgtgtgccttaatttgacaatcgcttaaaccagtattttcagtttcttatgcaaatagtacagaattatatatgtaagcactgggaatttttatactgaatgaaagcacgaaaatactggaattttataaacaataaatgagtatcactgggaatttttattattaaaagaaaaaaattacaataaacatacacagctcctgaatgaaatttccaggactccacatattacactaattttataaattcacccacatcaaggaattaacttgagaaattcaccaactttttgggcctgatttacatgtactgattttatacacaggaggtgacgacaaggaacagcaagtgaacaaaacagttccatatattggaatccaaagtacacaagaccccatttaattggctgaatgcatatccaggtgacaaaatgcaaatgacagccagaaaaggctggtctgcatactctgcaggtaagtaagcaggagaaaagattggcctccaaagctacatcaaaatgcagccatggatgaaatttctggtcaaaagaacagagaggaagcatgcaacaatctgatgggtatagcatgcaatgcaaactcatgtacttctgctgaaaatgctgttctgcctatgccatgtgaaaatgtatggatctctgtcaggtactgcttttgagttttgagcagtcacgttatactgacacgcagatggtagtagagcaaaagacaaagttcttggtgtttttttttttttaatctctgatcatgttgatattgttggctagctaggggaacttttttgtgttatcctctgaattcttgtggggaattcagttattgtgcttgaaattatctttcatttcaaatgagtgggactagcgtagatgtaatatggtgtccaatgtaatctaaactcggcgtgcttgatttaatttgtaggtaaataatgaagttgacctacattgttatatcaattaagctcttctcatatagaggcttcatcgggtctttcaagttctctggcatttttttttatcatattgatttacatgccccaatcagttcactttaaaagttgaaaatgataagaaaagatgaaagattcacttatattctaccacataccgttagtaaatttaagaaaaaaaaaatccatggtaccaacttgatcttatgggctactgaagctaggttcgattcgagctcgacttagagcttggaatgatgctattattttccgttacccctccccttttgttaatatgatgaatatacattactttactctttatattccgctaactaagtatcctgatgaagataaaaattaagttaacacatgtaaaatgagaaagccattagcgtatgattaattaagttttaattattttgccttgataaattgatttatttcacatttttaactaactttgatatagaaaattttcgcatgaaccactctgtttagtagttaacagagtttgaaaagtatgttaacggaaactaagagaaaatataacagatcaagtactacacacaattaagatttggcaaaatttgctacaggacactcaaaaaacgtgtaattagccgcgagacaccgcaaaaacataaattggctgtaggacatcgcaaaagagtggtaattagctactggacactagagacattattttattattttcggtagaaacggagagagaaagagcgttaaaagtactgaaatgtccccggccgcaagcactccctctccagcctcctcgccgccctccccgccggtgctgcgcacgccggccgcctcagcctcacccggcagtagcacgtcgcacgctaccatcgtcccgttcactcccacttgcgatgttctcggcggcgacggcgacagcgacgcacccgccgcgagtagagcgcactccaccggggcagcatcgcagccacggcgggagcatgcaacctccggctccgccccggcggcccgcgtcgaccgttgcaggaagcgaggacggcagggaggagaggcggggacagggtgaggtgagctggcgctgtacgcgacataccaggtgttggcgtgggtgcgcgtcggcgggcaggtggccggcaagccgcagaacacatcaacgtcgccatcgccgtcgacagccagtggctcaacggcgggcaggtcctggcgctggacgagatcggcaggtcgttccgcgtcgagtccaagccggcttcgcgtgtgatgctgtacgtctagggccccgaccccggcgtcgacctcatggttgctgtgggatatttctcccaaacggatacggccaaaccaaaacaccttggacgtatctcagaattaaaagggggattagaaggtaaaacacaaacaaatctaacaccactggatccgtcatccaagcccacctcccaacgctgcatcgcggagggggacaccgtcgtggtgtacgagcgccacgacgccatgcgcgctgtgggcatgcatgctccagaaccgcttcggcgtcttccgccatgatgactggatcggccgccccttcggctgcaaggtccacagcgccgccaccgccggaggcaaggggaagggcgggttcatccacctccttgcgcccacctctgagctgtggacgctcatgctcagccaccggacgcagatcctctacctcgccgacatcagcctcgtcgtctcctacctcgagctcgtccccgggtgccacgtgctcgagtccggctccgggtgcggctccctcaccatgtcgctctttgaccaagaaaatagaggagaggctgacatccgtggcccacatagggtaatctggtcttttttgattgtttctctctccgttttcaccggaaataataaaataatgtatccggtgtccagtagctaattaccactcttttacgatgtcctatagccaattcatgtttttacggtgtctcacggctaattacacgttttttgagtgtcctgtagcaaattttgcattttggaatccttaatcacacaccttgtacatgcgactgttcatccctgcaagtaggcatttttataagaaaaggtattactattacttcacctgagaattgagacggatagatcgatcgattcgatcctgaaaccctggcgaatatgattgtgtcgtcgaaattacgcggtgaatccactcgatgcgttcactgaaaactaacgaccttctgccggggccgggaataaaagaactcatcattggaaagcgacgacagcaacactagcttaggtcgatcgctagctatagctacagctgctgcggcgaccggtgacgaagacgacgacgtacggacgtactccggtcgtacggttgagcgcatttgcgatttgtaatgaatgatgaatcaatcaaccagcaagctagagtactggtagattttatgagtagtagtacatgtatgcatgttcgcagtgagatttgccaactagtgtccgcagtgatctctcttagtgttcaacatgtattgataactgataagtaaattaaatgcaccgacagaaaaacatttcaacacgatagttggccataaggcccgaggccggatggtccggcctaaggcacgggattttagcctggctcaggcacgccacggcctgatcgctgtcgggcccgtgccggtacggcccgatcgctgtcaggcatgtgctagcacggccctgctgttgggccgtgcctgggcctatgcctcagcacggtgggccggcctggcacggcacgaacttcagggaggtgaaatagacttatttcaaccatatgtaagacaggacacaaagaatagggaggacaaatagacgtattatatggaacggcccaaggagtagagatgtaaaatagacttattttaactatatatatgtcacaacccaaagagtagggaggggaaatagacttatttcaaagaaaccacgatgggctacccgtgccttcgggtcagcccggcatggcccgacccttattgggtcatgcctaggccgcaggtggagcacgtgggccggcacagcatggcacggtccggcatgtaggtcgggctgtgtcggcctgacaaatcttggcccgagcacaaccgggcctgagctgtgccgggcggcccatatggccaactataaacacgccccgcctgtgtcgtctcattggtgacccgaacggactcccgggacaacgcaaccgcctccctccttcccctctcccctcgccgtcgttgaagaagcctgctggtaagctgagcaactgcaagaatagttttggcagggctcttttctccttggaggcgctatatatgtcaatggaggcgactagggagacaatggttctactttggatccaccccttccatagatctaacatgttatggccagcagctagtgggaggagggacaatagagcgcagcggggtagagagtgtggtagcaacgacgaggactatcggatccaggtctagtgtgtcatgtggttgcggccgtggacgcgatgggtaactatcgcggggggattgcggagcggccagtggcgacagggagtgatgcttactaaagaagatggtcggcacgccgtcctaaggcaacgattatgtggcgacctgcgtagacggatctggcaacgatagtcatggtggtggaggtagtggttgaccgtggcagcgacggatcgatctggcgcctctaagagcaaatctaccgtaccgtgggtgacatctacgttggaagcacatggtggtggcgaaggagatggctcgagcttgtgctggggcggctcggtggtggccaaaggcacggcatgctgccagcagagatgatcgtgagtagctagtcaggctgacaccttttgcatgagggcgtgtcgacagcggtaggcatgcagctgtgacgtgaggctgtgggtggccgtgagggagccaactggtggtggtgatggccgcgtggtatatcaatggttagttagaggtggttgaggatggtggggttgtggcaagaaggggaaggtaggttccacacgaaagtctagaccgacgttaagcctgggcaggcaacagtgtagagatcgggcgccatggccccctttgggagcattgtcgaggcatcttccacctccctgatggaactttccaggtgaaaatcatgtccatgaataggcgacagcatcacgacctttttaaggacgtcatctcttgaaagtcatgtggctacctatgctatctttagacaatttggactgcgatgacgcttaggatgttattatggcggtggccggtgggtctatacaaggcacgagtggatctttcttctctgttgccctctccctctacaacccttcactgtggtgttatccgggcgtgcattgtgatcagttatttggaagtgttggcgataggtggtgtgttcgtggctctattgtaaacctggcggcaacatccagtcacacatagccgcatccgacatagtgttaagtttcttcctcagcggggtgtgtgcacaagtgttgttggcacgtagtgtgttgttgttttttttttccttttttttctgattgtagtattttaggttgtagtttttttttcaaatgtatattaatagtaatgatgtgtcacctagtgttattcgtcaaagaaaatacaccgacgttaccatgtgacatgtatttaataacattcatactcttaaaacaagataaatgatttgttggtgcaaattttaaatatgtcagactaaattatatctgcttcttaataagttgtgatattgtcggtgcatttcaatgaccgagtgttgaaggtcgcacactgggatgttctctcgtacactttttaaaattaaatttaatgtaaatggttgtgaaaattttaaaataaaatgagtatattgatattcatcactctaccaaaaattaagtttaaacttatttgagaagggaaaaagatagtgaatagcactcgcgttgtttatacgttgtattttttttatttcttgatatgtgagttaagtttatatttaagattttatagagggatatgtatttgctatatgaatgtcgttgaattcttttcagaaatttttgtagctatttgaatatttaaatatttttaacccgaattgaaagagttccccgcttacagggtgttaataagttaattgataagggtgctgatggcaaattacgtacacacaccgtaaaaggaaaaagaaaaagaaaatccaatcctaacttacgtatctaaacaaatacatgtataaattaataattagtattgaatgttttttttattttacggatggagtatactccccccgtctcataatataagggattttgagtttttgcttgcaacgtttgaccactcgtcttattcaaaaaaatttgaaattattatttattttatttgtgacttactttattatctacagcactttaagcacaacttttcgttttttatatttgcaaaaaaaaaatttgaataagataagtggtcaaacgttgcaaacaaacaaaattcaaaatcccttatattatgagacggagagagtaacccacgtgaaccaactcgccgtcatatgaagacgatcaatggagagatcgagcgtatatatacaggagtagtagtgcacatcgcagcatctgcatgtcagcatgagtagtggccgatgtgatgacctggcattctggcggcggcagcatctggtcggggacggatttcaggtggacgaggcggcagcagcatgcaccggccacgatcgatggcaaccaagacttgcatcgcagctgctgccctggccctccctgccatttggattttggagatgaattctgatatggattgatggacctgcgtgtaaatgtaggattacgcattacatggttgtaagaaaggtactcccatataataaatggcctcatcttttcgtttatatttatacttatcagccaaaatttgaattttcaattttgaatttagagttgattttgagtttttttttatcgtggtttatttttccacctttgtttttagatcattaagaacacatgtataaaagttttaattcacaaattattttttatttgtaaatataccgtttcgcttatgcttataattagtgaaccgatgggaccaaaaatatcaataaaaaagtaaatcatgcatgatactattgtagaaatgtctataacaaacgtgcggggcatctctaacaggtcaacatgtgatccatttaagacaacctcatctacgagagggattgagaactagtggcaacatatcatacgtacataagctctcgcgtgtacacacgtgcacaccaactaaaaaatatcaccaaaaaatatagaaaaaatcatacacgtactttcaatagtattacacctagggttaaaatcttaacttcaaattcattacattttagccgtaaaaaaaaaacaaaaaatctgacagttttaaggttgcaattttgtcagaattttatcttttttgttattctctatgtagaatgaatttgaagatgcgactttgcacgtagatgtaatactattgaaagtgcatgtatgatttttttagattttttttttgataatttttagttagtgtcactgtctgtacacgtaagagcctgtcaccccacgaaggagaaaaaaaaggcagtgcaagcccgaccatctaatggtgagaagacagtagcaatgacagtaatagaggatagatctggtcgcctcaatcttgggagcaatggataaggtgactcctctttgggctccatctaatgtctccccttgctctccgaattagcatcaccgccatctcctcctcttctctagcaccacagcctcgcccctgccccccgttagatccggtctccacacatctttagagtcaggctagcgagtgtggactggaaaatcttcaagactaggactgaacttgcttatacaaattgtatctcgaaattttcaaaaaaatttaatagtatctaaataatgtgaatcctatatacttatatagttcatccccaccaagtgtagttaatgatatctctctcttctctcattaagccacatcaccccaattatttctagcctttggatgaaagatctatggtctaaattgtgtcttctttcttctctcataaaacataccatctcaattatttttaggttcaaaattgtatcatattgttttagtttcgataatcaaattacattttatttgtacatattatgcaatttaatttttcgcagcaacacagcggggtattcatctagttaagaagacaaacctagttctcaagccctagatgcactatgtatgtcttcgccccttggatcgaagtatcatgcatatacctgaaaaggttgatattgtgagttttatcggctggatttgtatttagaagtgttaattaacaaataaatcaattatcaaagtttgatattttatattttaaactggaaaaaaaaatacttctcttacactaagtcttgtgagttaatttgtacctctcattgtctcatcataattggtctatacccaattcaatgtttagtgaataatatttttaataagtggctctatcttcttttatcgcaaagagccaatgtaatttccgttatgtaaaaaaaaagagttaatttgtgcattttggaagatttgtttactgggccgaccctaaggcgaacacgttgggctgctaaacttagacccaaaataccaatgggccatcatcatggatcgtcatggaacagagcaaaccaaaccatcagacaaaaccaaagctgttcttcccggctaattttgcttcgctgatcaacaacacatgacaataacaaaggcaaggtaaagaaacaacaattaacaggaagaagatgagcttgaggcgatccatggtgggtcgtcgtcgtgttcagcacttgctcgccggcttcaccgcgccggcgccgccaccggccgcctccgccggcttcccgtgcagcacgctggtcgtctccgacgacgccgagctgtacttctcttcggcggcggacgacgccaccgacaccgacccgaccttccagtacttgccgtcgccggcgcaccacttgccgtgcgccgccgccaccgaggacgccgtctcctcgccgtcggagctcgacacggaggcgacggccctccagttgctccacatcctgagcattatgtacagcagcgcgacgcacaccgcggccgacacgacggcgatggccgccacgatggccgacacctccgcccccggcagccgccgcggcgccccgcacgacggcagcggcgcgccgcagagctcgccgttgcccgcgaaggacgcggccgggaacgcggagagcgcgcccgggatgccgccggagaggaggttgtcggacaggttgagaaggtggaggctcgtgagctgcagcagcgagggaggtatctggccatggagctggttggaggagaggttgagcctctccagcttgacgaggtctccgagcgacgccgggatctcgccggagagcttgttccggctcaggtccagtatcacctgcagctccggcagctgcccgagctccgccgggatcggcccctccagcgagttctccgacagccgcagctcgtacagcttgttgcatcgccggagctccggcggaatgacgccggtgaagccgttcttctgcaggttcagaacgttgagtgatgtcagcttcccgatctccggcggaatgctcccggagagacggttgccgctcagggacagcttgagcaggccggagcagccgccgagctccaccggaatgccgccggtgagcgcgttcgacgagaggtccagctcgccgagcgaccggaggcctccgagccatggcggtacggcgccggtgaggctgttcccgtcaaggttcagatgggtgagccgcgagcagttggagagctccggcgggatgtcgccggagaagttgttgttcgagaggtcaagtatcttgagctcggtcaggtcacccagctcggccgggatcgcgccggcgaggcggttgccggcgagctgtagccggaccatgcccgtcgaccgcgcgaccgccgccgggatgacgccggagaagctgttgttggtgagggccagcacggtgagggagctggagccgaggagcggcacgacggcgccggtgaaccggttgtgggagaagttgatgaccgtcaggttcttgagctcgaacatcgactccggcaaggcgccctccagcgagttgttgtacagggtgacgacgctgagctcggcgaggcggccgaacgactccggcagctcgccggagagccggttgtccgccagcgccagcgcctgcagactcctgcattcgccgaggctcgccggaatcgggccagtcagatcattctgccggagctggagcacggcgaggttcttgaggttgccgatgctcgccgggatcgggccatggaagtggttgccgaagaagtcgacctcctccaagctcgagcagttggtcatctcatccgggatggctccggtcatctcgttctcgtagaggaacagcagcttcagcctctgcagccggccgatctccggcgggatgccgccggtgaggccattgtggtacagagacagcacctccaggttactcaagttcccaatctgcggcggcaggacgccggcaaagctgttgttgtgcagcgcaaggttgacgaggcccggcagccggtcgatcgccggcggtatctcgccggtgaggctgttgttcgacacgtcgatggacttcagcgaggtgcagctcagcagggcatcaatgctgcctccgaggtcgttgccggcgaggaacaggttctccaagctcgagttgccattgccattgccatcgccattgcagaggccttcagggatggttccctccaggagattttcagacagcacaaggtacttcagattcttcagctgtgatgcagagatggcactgatctctccggacagattgttcttggacaaatccacaacctgcagctggctcagccggttcagttcttccgggatgccgccggtgaggcggttgccgagtaagttcaggtatgtcaagccggagaggttaccgatctccggcggaatcacgccggagaactggttgtttgcaaggttcagagactggagagagctcaggccgccaatggaggaaggtatgacgccatccagcttgttgtcagccaccgagaggacacgcaggtttgcacagccggcgagctgctccgggaggccgccggtgagggtgttgttgtccagggccagctgctgaagctgcttcaggttgccaatctggtgggggatggcgccgatcagctggcagtaggccatgccgatcgtctccagctccgagcagtcgccgagctccggtggtatctcgccgcgcagcgggttgttgccgatcctcagtaacttcaggttcttgaggccgccgagctccggtgggatggcgccggtgaggaggttggagtgaagcagcagcgtcttcaggctcttcatcgtcccgagctccggcgggattgcgccggtgagggaatttgacgacagatcaatggactcgacggatacaaggccggctatcgccggcgatatcgtgccggacaggccgtaccccgacaggttgaggccggtgacaatgccctcccctgtcaggcacgtcacgccgtgccatgagcacacgtcggcctccggcgaccagccggagaggacgccattagggtcagtgaaacctgacttcacttgcaggagagtggcagatgttgtgtctactgtggctgcttcacatgatggtgcaagcaggatgccacagaacagaggtagaagagcaagaacaatggaggagctgatcagcttgccagccattgctaagaccaatgataccatcaactgagcaactgaagcagtgttctaagatgcatatgaattggaacttacaggatgctggaactctggagatgacaaggtgagcatgaaactatgaactccatagctgaggtttggaggctcatcatgtgcacaaagtaggagcctaagctgcaaaaagcagaaacaaagttgtcaaacactacctgctctgtgcatatcactcagggtaatgtgatggattcttggtactgaaaatgcaacacaaagccaaaggagaaggtatagcactgtacactatctcttgcagacatggagtttacaataatcagcctagacttgtataatgcagggctaagtatgaggtattttaaaggctaatcttgttgctttgacttgttagctcagcttcttctgcatggcaactggtgacaaggatgaaaaaagggcaccgggaatcagtaagatacactgccactttacagagtgtacgtgcgtaaacagttcaaccactccccatgatttggtggcatgaggacaatagcatgacgcttccatccttattccttggcttaatagttttctaactcaggtttagtgacagaaaactaataagattcgtgcttaccctgttcatcgattccgaagtcgatatttttgctgaccctgcaaacaagtacacggcatgaaattttctccttgtcagcctaatttggcaccgatccaccatgggaagtactggcagtggcagacagtctcactacaagaaaattcagaaaattgaatgtgcaatcaaccaagagagcatacagtaatacgattatgatcacataacagaaggtaaattcgtatatagatatatggtatttgtatctgaatagaccacattagcagaactacagaaaaggactaactaatcaccaagccagcgagacacacatagtggcattgttttcaattatcaggtagagggaaagtgacttttgcaggggagtgacaatgacaggaacagaattgcatcaataaaccacacgaaacaaaggcgaagggggcggagaaaaaaaaaagaacagaactcacagtaactaccacgatagttgcatatccaggcccccatcacaggcagaactgcagcagcagcatgcatgggacgcaccagctcgcacttttctttgtttccttcagttgaactgcacatagcagagattcccacgtttaggaaacatccaaccagatagagacatcaatatggctatccggttatctactattgcctactggcttctaaatcctcatgatgcacaacgacacactactttctggttcagattttcagagttcagaccacattgtggtacccagaatttgtaactaaagaactccttttccaactagattatctactcatttagctgtaaaaccacactagttagcaacgcatgattgaaatttgagtaaatattagtcgaaaggccagcagatgattggttgtgactcaaagcctacacaactacccgtcgtttcggtaacatgaggacagtgatgtgctgttggtgcaatggttgcatcattggtctacgattgactttctttgacattcaaacaattttagtactgggtcctgattgatctgggtttgacttaagcctgcctaatactgtgctacttgcttgtacgcttctaacctgcctaaccacaggatttgagatccggatgggacatgagtcaaaggacaaatgtgggtgtagaataaagcgcccctttccttcttgctcatctcaaatgaactggttaatttatttagtattagaaagagtatcacttcaatataagatgttgaaaaacgagatggtatatttaagcgaaaatcacggacgccaggacaaacattcttggacaaatggacatgtccatcatgctaatacatcactgactacttggacgtgcatgaaccttaccctcgtaaactcagctaaagaaatactaatatgactacattcactagagtgtggacatgcgtagcattgttagtatatttggatcatgagaaagaaaaggttagtgttcatgatctttatcaagatgtaaactgatgttcctatgttcctttttacttgttgtttcggatattgatacgttctccaatacgcatactccgtatttgattattacttttttattatatgttcatacttcataataactatcagaaacataatggtgtgtgtttttcatattggaactacatgttattttcatctgacaaatccaaaaactatttgcatacatttgcatctaaactatttaagggttgactatacgcattttaaactggcacctattaagaacaggagtataaccgattttaattaatagaaacaaggcagggagtttggagacttaagagactatctttttaattaaaaaaagcaatctaaaaggcacgataaaataagacacttaaaattatgaaacccccagaagcacgacattcctctgaatcttgctctaatttctccaattattcgactttcagtcattaaattaaacttcgccggggttcttccggacagctagctaggccccagcataaccattttgtcttccctttatttattcataactttgttttcaatatggaatgattaataatttgagtaaagatcggctaacctctgcaatggcgagcagggatgcagtgcagtagggtagtttgcacgacaaatccgtggacgctaaccttaaccatgtgcataggatatagctcatcagtctcactttttcccatgcaaccaatcagatgcgtgtggacaccctttcctgtaaaaagtccgtctcctttcaggaatctgccggtaaagctatgcttcccgggatgccgatgattaaccaattgacttgagaacattcatagcagaagatgaggcaggctcctgcatgacgatcaatcgcttgcaatgcaatgcatggagagttgacagtgtgcagtgcaggaagggaaaaaaatgaaaagctcaagcatttaccaacctgtggtgcgtgcctgctcctatgacggctcaatcagcggcatgtaaggagacaatcgagttcggcagagctgcgtaggcatctgacatttcgtcgaaaaccatgttgagtttcacacagaggcagctcccatccatcagcccggtttcattgtgaattccgcaaccctcatcatgcttgcgtggccaaatgccatctgaacatgcgccaatcttcatctcactcactcactcactgcctagcaagcagtgtggaatagcagcagatcagttgcctaatctgtggaacactggaactcgctgtgaacccatggccaaaagtgagcttgaggttgagcttggggtcaatggattggcgagttgtcaagtgacagacttattccggttgcacttaaattggtgaattggtgcttggtctctgcagtgagcactcagctgccaaaaaaaaaaactccgacatgcatccccggccatgagctgaaggattccatcgacggacaacggcacagacgccacgctcgagcagcgcgaccacccccacgggaggagaaagggaagtgctttcgcggtgctcgaagcctccgccacacacgccggcgcctccaagttctggacgctagttggatgggcgcgcgcccgcttcgcttcggcgccataaggtcgaacacctggcaggcgtcaggggcaggaggcttcgggtagtccaccagtggaagaagaagaagaagagccccctctcctcagacaacaccggctcaaaacaagcggaacccgtcgcgagacgacctccgtgctgccgccgccggacgccgagctgaagccgggaaccatctgccgtcgccgccgccgcggcgccgcgtcgagcagaagaacggggaggagacgacgccgcggttacaggcttgcagtgttgggccgggccgagacatggtgtacctggtcattagattacggaataagttcatctgtggtccctaacatgtcaactaatccgattttcatccttcaaccgaaaaatcaggtacaacgggtctctcaactgtcaaaacaagtgcaaaataagttccaaggtggtttggacagtggtttaagctgatgtggtgcctgcatcgctaatttgactcggactttatctgacgtggcattgacgtggcgcttacgtgacaatttgatttgaaaactttaaaaaaatgtgtccctacatgtcacttacaccaaaaatttaattaaaaatggtgtggcccacatcggccccacatgtcactcacatccctcctattcttcctcatctctccgcatctcccctctcttcttctctctccctgtccacgattcatagactacccagatccatcgtcgccatcaccatcggcgttgaaccta

SEQ ID NO: 64195 - DNA, 1008 bp, Oryza sativa
gcaattttgaaaatttcagcccgaaattatatgaatttttaaataaaatttgatacaaatttaaacaaaatgttactaaattcatgaaaagatgaaataaataaaaaatttcagccaaaataatatcatactgggagatccaatagaactgaaatttcgatccgaaattttgaaccgtggcagtacaatggctaaagtggtttctccgcagcggcgttgtacgagctctgcaagctagcggagaacatgcatcgcatcgtgtgtgcaagcggggcggcgcccgcgctcaccgactctgcccgcgtcgcggatgtgctcatcttcttcgccaagtccagtgagagccgccacgagctgtccactgtccggtatccctagcatcgtagtcctgctcgccgcagccaacattgtcagcagtggcaacacccgtgcaatcgagcgtgcgctcgccgtcttcgattggatttgtgccaagatcaacgaattggcattggcatgggaggcaataaatcttggtctaagagaaattcttttgaatcccaaatcatccaatctgaaatgctctatgatatttttctctgaaatggctcctgttaaattccaatgttctcaatgctgtcctgtttcgttcttgatgcttattcagatgcttgttcagagtgacaaggagcagcggtcttgatggatccaaaataaaggaggacatgtcattcccagaaacatttcatcatcttacagctcatgtataaactgaagtagaattcagaaatgaactgaacaccaaaaagctgaatcttaatcaaggaaatcgaggaaaattttgtatcttaatcaagttagtacggggccaaattcagctacaggatcacatgtcactatcagctgtgaaggaagaatatttttgttctgctttaattcaaaaaaacctgaaatggaagtaaagaaaacaccaattacaactgatgcaatatatattatgtacaaataaccagaaagaaataagattaa

SEQ ID NO: 64196 - DNA, 1220 bp, Oryza sativa
agtcaaatttaagacggtagatgaagttgaacatggtcttcggagagtctatgatgtgacagctaggaagaattcaattcacttggcaagatgactgtggtgatatgagagaaggtggagcaatgttgcaggtggagtcaggaggaagaaattacaaggatagcgggagtctcttgtttacggtgagcctgatggaggcttgtcggggcagctcggcgtgagcggcgaaaaaggatcaactcaagtcttggtacacgaaggttcgagcaagtaacagattcggattggcgtgacatattcgccaaggtggagtttgttagagtttgtgtcgaatatgtgtacgtagtcggttacagtttaggacttggagttgtactaggtgtaggactagagtataagtcgactctatcctagattctctcataaatagaggggcgtgcctgttgtaaccgtatggcgacttagcatagcgagagggagcggctgccggcatcgaccggccgtgagtcgttgtaactctgatacgttgtatatgctggatcagggaggagcgcccgtaatcagtgccccggagatgtaggccttggctgaactccgttatcaaatatcgtgcctcggtgtcgtcatcgtgtttggatcttctatgacgtttcttccgcgtttggtttccgatgtgatttcgggccggttttataacagaaacatccaaatatattggctggaacatcaaaaaaaatcatgaaaatgtattggtccaactctggtttcttcctcctctttggtgatcgttggctcctttggtctctgttgcaaatccacaccaagatgtcatagtgcccttctactccaccgaggcgggtagctgctgctgcccaagccctcgtcaccccatcgtcgccgacaaacaggaggcacgctacttccagattcttgtagggaccattgtgttcttgctgcttctgcccatgccaatgtccgtaggatcttgccgggagctgcacgggaagctaggacgccccctcccccaccccccaatccaacaggggcgttgctcgacgacacaaaggagatgagtagtgtctctcagtccgccgttgaggacttgcgtgggagagagacgagagagagggggtcacgggatatgtggaacaaatgctcaatattttcttatccatcaggcgctcaataggtagcgttttggacgaaatatacagggtagg

SEQ ID NO: 64197 - DNA, 1176 bp, Oryza sativa
cagacagtccattcttatactacaaaaaaaacattagcaagtgctctaaagagaagtaaggacccaaaaactacagaactgagcttgcaggatgagattaccatcaattacatgaagcaatgtgatgatgatgaaaaattgctatcaagtattgatggcatacaacttacatatgaatttcttaggccacttgtcaatcccaaagactcacaaatcataagcaagtggttgaaaggcagtgtaagaaatacttaacttcttccatacaacgtaatattatcagtatctaaattttgttctttattctttcacaggtcatagatgcatacattatgttgattaaagacatgcaagtgaaagtccaagagagcatggtactgcatttctagaaagtacagcacattgccaggcctggaaaacaaatggtgaacaaattggaacccgcaacaagcaatatcgagacaagagagcaaaagttacagcaaaatatttgcaacatgatatggtatatcaatgtcctcaaatatccttcataataataactgcatgacttacatttcatttcctatgtagattttcctaccactcaatagaaactcaactcattggtacgtggctgttctcaatggtgctaaagaaaaaattcaaatactagactcgatgcgcatggaaaagagctactacgacaaagataaagacctcaataatacagtatgctacattgtgcctttagattcatcactattccttactaactttttacattagatatgtaatactctatttgataactcagataaaaggaattgaaaagtttatccagtatgcaaggctagaagatggcgttgaaaacaaatggaagaacaccaggattaccaattggccattctgcccaatgaaagtccctcagcaaagtgacaagtcaaacaaacagttaatttttgtcgcaaattatctataacgaattaccacttacaaagaacatgcttgcaacagctggtcatgtggcttgcacacattgaaattcatacagcattggaatggaaaagaactctcccctgagttcaatgaaatggtaattttaaattgcattcagtactctttgtaaataaaatgacattaattgatattttttcataacttgcttttcaggatccaaccaccactttcaaacat

SEQ ID NO: 64198 - DNA, 671 bp, Oryza sativa
agagatgtgtaccgtctggggcagctgtttgacttctttaggatgcttactttctttttcaccacagttggttattatgtctgcacaatggtaacccctcgccccaatcgcacatgattacgcttgaagcaacttacatggtctatgtgatgaaccagctcggcttgaacacttgagtacatgtgtgcactgcatccagacaattatttgattgatataattgctgttagatgggatgagagcgacaaattgcagttagctaatcatatatcatggtttggtttaattgcattgcactatcctaaactatcacctgtttgcttgagatcaaacacagggatcaagatacgagaactaggtctaaatcatataccatgaatgggtttacaccaagttaggccctttccagggatgggccgggaatttatttcaaatttctggccaactaaattcctggaccatccagggaggagccaggatttggtagtttggcctttgccaaacaaggtcttaaggtttgaggatgcaacatctagttgaaggcttaatacacctgtttgctgcttctcttttttaatcaatgggggtggagctttctacttttccaaactctcatcgagtgatacgcctcatattttaggataaaccctcatcatattttagtataaacc

SEQ ID NO: 64199 - DNA, 1074 bp, Oryza sativa
gctctgaacaatgcttatcaagaacacactgcggaaaggctgattcacagccaacctggtaaaaagggcagttaataagcttcatagggcaaactgatgcacaatgcctgtccatctcacaccgcataacatgctgctcgcacaactgctcacatggtaggactttgaatgggcagacagagtcatgcttctcaatgtgattagcagaaaaggaagctaaacatccatcatttttgcagtttactatcctaaatctacacagattcctgtgttcagccagcttatcttgtgtgtcaaatctctcagggcaatggataatgcatttcatgtctatactcttaagaatagtccctgcagtagcctctctaacatctggtgcccagaagttctccatctccagcttctgtatgaagtctttaattttgttcaagcgggtttcgctagacaaaaacccagacacatggctcaacaagttccgttttgatgctacaaaaccatcgatcaagtctgagaggaactccgtcggcatggtggatgcttttattaattgttctgagtgatcctcgcctccgtcgacagcctcacgaacaagcgtcatggacccctgaatcaaatattctgctagctcgctcttcattccaacagctacagaagatgggctcttgaagatatcaccagtagtgctgtcaactgaggcagttgccaatccacgaagcaggatttctgccatggaatgcactacatctgaatcacacaggttgcactgaaaatttaagccatctttcccaactgtgcattcaaggttctccattgtaataccaagcagtagttcaaatcatcataacagtcttctgaaaaggtccaatgaagcaaaccatttatgtacttagtctagtatatgctcatgcattcttataaagaacatacataaaattttcaaagcaatgaagcctaaaacttatgcaggtaaggttctccaaagatgcgtcactgttcaaacaacacctaaatggcttctagacgtggctcacaattgggctgcacatcgcctagtcagaagcgtttcatatgaat

SEQ ID NO: 64200 - DNA, 1049 bp, Oryza sativa
gtcaaactcttataaatcacaaaagtatttacgaagtgatttgatagttttaattctttatgcaaactgcattcactagtgcggtgtaacatgcattagacccggactatcatatttcctgacatttcctatctaggggttcattctctccccctaaatgactggaaataattcttatttgtcaaggaattcaggcttcataactatctctgtaaaaggtttccgactttcggagagagccttttgcaatgcattatgatagtggaaaatgcacataaaccaaacaaatgcaatagcactagttgcaggatggatgttcatgccgatggtctaaatttgctttcagagtccgctacttttaggactacatgtccttttctactgcgggtaatacaacaaggatatagcaaatattgcaattcatatcttatagttagtccgcttatgcggatatttggtacttcgtgctaccaattcaccaatcatcaaatgcaatgctagcattgtcctcgtggacttctaaggatgatttagtgagttctattggggttcacgtgatctttctggatcagtcttggcaaatacacggtgtctatgagacactagatgtttgctacttcggaagcgcatatgtccatacagtaccaaatgggagccgcagatattcctcgcaatccagttcagggatgctagaactatatgtggtttatgcactaatctcctgtcgctgcatactggcacacaaatattcatgatttgggaaaatcatgcatacatgtgctatgaccatacgagttgtaatatttattcttataattctaagactgaaaatggctaaaaatccattgctaaaatggtgtagcccaaatcatcacacttttagaaagttcaacgaggttgacggacaatagatgcttctataaagtgcatcatttgttccataggtaatatgaccgtggcactttctcggctgacaaattcagtttgttgctgctagcaacggtcatactgtttcctgtactatggctctggaaatatctctttctctt

SEQ ID NO: 64201 - DNA, 26020 bp, Oryza sativa
tgtatgcacatatcaattatctatcagcactcatgccaccatatgaaatatcacaatctctagtaagtaaggctgtccttacatatcacagagcaatcttggaaagtaataagcaaactacagtacattactaaaatatcaattcagttttctggtcgaatctcagaacgtttctgcttagaaaatctaatctctcccctaatacattggaggggaaatctgttctgtgctgcctactgaaaggcagaattattttaagccaatctcattgtcatccaaagtactacatctaatgaagtgacaatataattgaagaaccaaagcaggggacatacttgtagacgaacaacttgggtgaaatgagagagcttccatgcttataggcaacatatggaaactgatctgtaatctcctacaataaagaaaatgatttactctgtaccgatcgaccgtggatgagatcggcgaggcgggcgcttcggtggcacaggtcggtggcatgcgtcgctggaatggcgaggaggatgaggagttgtacgagtcgctggatcgtcgtgctcgttcacgtccgcctccgatgacgacgtgaccactgaccagcagcaccggcggcggcggccgcagcagctgtgtcgtcgtacgtccgcgacgttctccgcctacgaggtctggatctctgagccgacctccgtcgaggagcgccaccgcgtgctgctgcgtcggctcggcctcatctccgactccgatccccgtccgtctccacgcctatcctcccctcgtttggtggcgttgattcaatggaatgaggatgtaagggcttgtttggcctggagctggagctcagccaaacagtttcagctccactaaaactgggagtgaagttgggtgaagctctctcacaaaatgtactagagttgtggagctgcgtcactttagactcaactcctggagttatatttaggagttggagctgtaccaaacaggccttaaagatcagttagttggtgaattattatagggtacgtccacctattaggcagccactcagtgaaatcatttggctttttcgtacagctatttttggctatggctgcagatgtaagaaccgaacaggcccattttctgtcctcaccagttgccaacgaaatggctgactcagggcagtggtcggcctcccagccgaaaagccctccagacctcctgtgtggcatgccggccttcaccgccgccgtcggcctccacccccgacggccaagacacaagtgctgccaatgcctgaatccgattatattcgtcattggtttcgtgagtttgtgtacgatttgatctttctgactcgatttaccatcgattttctttctggattcctcaagattgaagattcgtatcggattttgtcttgagcaatagttgttgccgttcttatttgagcaataaattgttgcgcatcttattagagcaataaagttgttgcagatttttttaaaacatatggacggtgtctttcctttatcttcctttttaacctaacttcatctcaaacacttcttctattcctccctatcgatcttctcacacatgcgcggctgatcggcagccctagcacacaaggaggcacctgttccattccagtggtctcctcccggccctcttctggctctgacgcctgccctgcaggaattccccccacactgttgttctctctagcatcgcttacggagagacttaaggaaacttattcatatttccagaattccaggtatgtatgtatgtatgtagtgtctaacttctatgttattactggaattagagcataaaccttgccgttaatgacacagagccgattagattaaattagatagaatttggtaatctacgtgatccttatgtcaatcatactgtcattggaagtttagtgccggcaatactgttagattaagcttaattactgtgcttagccaccagaccaacgcatgcaacagtactatataagtatttaattaccatgtttgatgcaagctaaatcaaatgcttacaaccattgtgattataacctgaaccattatattttccttttaggataattcaggattcatagtctaaactgttaagaatacaggaccatctatgtaatcttgggagattgttttcctctcctaaatcaaaacttgacctaaattttagtctccatggtaaatgttatacggagtttgcatgtatctgtgcacacttattatacattgttatacctaaacaagaacaataaaacttataaatctgccactgtttgaactgttcaacaatttctgtatgttcatagacgtacatttagcctttgttttactaaaaatacattcacacttaaatattgctcgacaccaaaactatcacggcaccaaaattgaaataatgtttatagatacagcttgtgaaacatcgctagcatcctgaaactgaaatcaaatagagtaccactgaatgtttggttttaaattgagcatgttacttactatttaacaacttaatgataataagtgattagaaaataatattttctttgtaggataatgtcagactctacggccatggacaaaagctggatggacttatctaataggagtcttcctgaatatcagcaaggagttgaccaatttattcagtttgctttcaaagattacaatgcagacaaattcctccgatgcccatacagaaagtgcaaaaacaatcacttctttgatcagaataatataaaggaacatctctttatccatggagtgcagaaagactacaaattatgggtctatcatggataaaacgtcccagattcagaagacagtggcaatattgatatggatgaaaattatgataactatggtatggatcagatgatgaatgattttggagaacctatggttgtgaatatgggatcactgggtggctcaacacctggtttgaatgatgacatggataactctacagtaactaacgaagaaactaacaaattctacagacttctagaagatgcagagcaagagttatatccagggtgtggtaccttttcgacactagcatttattgtacaaatgttaaatatcaaatacctctatgatctagtgcaaatgcaatggaggctctattttccatgttatgcaaggcatttcctagtagcagtaatgtgcctaagtcatatagtgatgcaaagaagactatgacagatcttggattggattacacaaagatcgatgcttgtttgaatgattgcatcctatatagaggggcttatgataaggctgattcttgtcctgtttgtggcatttcaagatggaaaaatgaagggcataataatgtctctaaatcaaggaggagaagagtgaagaaagtcccatagaaggtattgcgatacttcccattggtaccgaggttaaaacggatgtacttgtctacaaaacttgcaacacatatgcgatggcacaaggagaagttagtagatgatggatataagagacatcctgctaattcaaaagaatggaaggacttcgatgggaaattttcttcatttgcattggacgcacggaacatccgacttggtcttgctagtgatggatttaacccatttggaaatatgagttcttcatatagcatctggactgtagttcttgttatatataacttgccaccttggatgtgcatgaaagatccatatatggtgatgtctatgataattcttggcccaaaagcacctggtaatgacattgatgtatacttgtagccatatgcttccacaaagcagacttttaatttacgtgctgctttgctttggacaattaatgattttccagcatttgaaaacttgtcaggcattagcacaaaaggtaaatatgcatgtccttcatgccacactgaaacctgctaccacagacttgttaatgggcacaaatattgttatatgggacatcgccgcttcttgccgaggcgacatgtctggaggaacaatgatgcttcttttgatggccaaaaggaaaagcgaagtgctccaaaaccattgtcagaagatgatattatttctcagtatgagaaattcgaacaggttattgcttccatcttattattgaatctttttgtgtgatgcttctaaattaaaaaaaatcaaactatgcatgtgacatgataatactataaggcataacctttttttagaactatgactaaccatatgaatttggatttaccaccttactattgctgccacatgtttatttcaggtgaagtttgggaaatcagggaagaaaaggaaacactctagtacattgtatggtacttgaaggaaaaagagtactttttttttccaactcccatattggagcaagctgactataaggctgtaacggactcaaaatttcaggaaaatattttgcgaaatattttaagttatgctcttctcgattcttgcattagagtgatcttacttttaatcttttcttttattttggacttaaactttatttgcaaagttaatcgctatcttttaaattttacaaaagctctctatttattttatttaatctctaactttgactctaaatacatttcctttgaacccattcccgaacatctccaacacccacaaatatcctttcgattcccgctcagctatctccagaacacatgaaatgccattttctaacctccctagagtacatgaaatgttgatacctttcctttgaatctccacctaaatatctctagagtcacaaaaatatccttttcaatccccctttgagtcaatatacctatcctctagagtttatcaagctaccaccaattccgttcccgtagaaattcccatccacatatacttccgaatccagttctatactccaataaatatttcctctttgaaatctcattcatctaaattatccactcaagatttcaaagtctactatttagcttgggccaatatttccctgattgacccaactctctgttatatcccattaaccatttttatttttggggctaaaccagtataacttcctttttattggaatttattttggatcaaactcctatctagacctatcattagaaatccccattttatccttcatacaatacctaccacaaactcctctagaagatcaactattcaaattcttctatttaattatgaatcaagccgccaatttgattcctatggcttgatcacacccttagcacaagaacgatattatcacgaatatttgaatgattgctcttgtgctaagaacactatttccaattttttccttagaaagtctaacttcccttagccacaaatactaaaccaagaatccataccccatatcttggaggtcaaaatcctagttatttgcctccatctatttttgctaccatttcaaatttatccaaagttagaaattaaattattgcctttccttccctttttgattattctaatttttaatttttaaatattaaagaaaaacttccgtgccaagtcttatgtttgattcttattgaattctataaaattggagcacttttacccatttcaaatttttccaccaaattttatctcaaaataaatatccttgattttatttaaaatattttcaaactccttttgttttaaaaacctttcatttaatttttttataaaaaaaccctccatacaaaattttcttaggttccatttcccttgatttctatttgatttctttgtccaaagtccaaaaaggtccacatccatccatccatcctttgattttcatctcctttaaattttattcaaattccatgttcaagttcaaaaatcccaaaactttcattctttcatctcctttgaattccgttcaaaactctccacacaaaaatattaaaccttcctaatcaattcgggccgaaattcccttcttttcggcccattccttttcctcctctctcccttccactcactccttcttgggctgccggcccaactgagccgaagcccagccgagccggcccaaccagccgcctctctcttcctcccctgtgggcgccgccactggcgccatgggcacgccgccgcccacggcatcgcgccgtcgccacggtcctgccgccgctgcagctgttttgcctagctggagcgtcgtgccgtactcctccacctccaccgcccaacgctgccacggccgccgcgtgtgcgcgccgcccttttcggccaatggaagaacgaagccggcgccgtcgtccacttccccacgctgccgccaccataaccaagtatcccttctcctctccgaaccgacctccgcggtcgccctttccccctccacagccgagctctctaaactctctttctctctttcctgccatgccggccaccacctcgccaccggccgatctccctcaccggagctccgctggccaaatccttgcgccatccgggcttgcctcgccgaggtgaaccaatttttcctatttcccctttccttccaccctaaatcgagccaccaccggagctttctctctcctggccggaccaatctttatcctcgccattccggcctcctccctcgcttccctcgctggccgacctcctcttcgggtgagcaacaagcgggaacaccacccgccgctggcgtcgccacctctcggccaccggagcgccgtcaccttgctcgcgcttctctctctcttctctcggcttcctgtgagacagaggaaaagaagacgaggaggagaaaaggaggaagaaggaaggctatgacaagtgggccccactgcatactaatccctttcctttttgtttcaatttcaatctctatagacacccatatttctcaaatcatagatccaattctagtaaattctttatctaaattcatctaatttcaaactctttattttgataccaaattttctatttttaaattttatttaaattttctcatttaaatccctttttattcatttatttatttacatttcgaatttaaaatttattttaattaaccttttttaattattctattttattcaaatacctttaaatttaaatttctgtgttatttaaaaacccttttttaaaaaactaaatttttcctttaatttatttaaacaccttttatttattcatttcaaataccattttaaattttatttctttaaaaacccattttgaattcaatttcctttgatctatttatttccttttatttctaaaaccttcaattatttcttttgctaatccaatagccactaaacagttgtcgtgcaaactttacgcttccatgagacattcgtgtagtctacaaaccccgacgtcgaatcgttgatcgtaaaacacggcataacctagttccaaggtcaaagtgttgcccttcacaccgcatgcctcgacgcgtacagtgattgaagcctcactactctcccgacctccacagcacactagtccttggactatgtgcaatcctagccgctttgctgtcactcacagctttagagtagcactttccatcttgcaaacccacacgaatttttcccaactctctagtcattgcgctgtatcatcgactaaataagccaaatatttagccgtaatgttgcttatccttagcatcggctaaccaactccaaatatctagccattgtgctactctattctagcatcgactataaaccaaaaccaccaaataaaccctacctacccaatctctctttttcctcaactttatttgaaacccaacctttagaaaccaaaacccctctcttttgttttccaaactaaaatttcttttgacccaactcctttttccttcgccttgctccaattttctttatttcttggtttatcgtttctttgtagcaatttgcttataggctctatttgctatctttttcgtattcgtacgttagaccgtacagcaaattctatcgacatccaaggagctgacgtggactcagatgattacgctaaagccgcgggaaatcttaaggcgcaaggcaagacataactaaaattttgatcatatagaaaacttaatataactgtcattttatgcatgaaatattactctttagatattaaatactttcaagcatttttgcatgagattatagaatgatgctttagtcatcattttatgtggttcactattccaaatatctttacaaacttaggaatccggttaaaatgggctttttgaagtgtgatttatgaagttggtatggaagttttgggatgttgagatattttggtggtttaaccggattataattatccccttataccatagaaatgacatagttacgcccatccacacgaccaagtaattggacttagcctagtacattgtcctactatatgaaagattgttgggtggcttattaggagcaggttttgtggtgaatcatgcgtaaggtgtttgggtggcatgaatcacaacagtgggcttcatgaaagtgtgacgatatagataccttgcctaggcctggcaagagtttgaccactatgatgaaccaagaccccactgtgcagtaactagtggtaaatgggactctcgaacggctatggtgtttacaacctcgcgaattgttctcatcgtgtgggtaaagctgggcagacattgcagacgtattcgaatacaccatgctcccggtcaaggagatatgtcataagggttattcctactccaaaagtataagtagttttgaaaatctaaaatgttgagacttctccagaattggcctagatttaggagagggtttttaattacttttccatttaaattaatcattgcatatgatcttttccattaaaacgcttcaaatgctccaataattccaataaaaatcctcataatacttgatcactcaaagtatttaaaacaaattataaccagatcatttaatgattaatttgtatttaaataattactcgtatgttcttttgtatcttacaaattaacaattgagctctgaaaaatccgagaattttcagagtataattaatcatggagaatgtaataataaataaatcaagccattttttatttaggaagttttatttcccacatttaatatcacttgtaaatgtgggaatatttaatataaattctaggaataatttattaaataattttattaatccctggaactaaaatcagggtgtgacatctactgaaagagggcgcatgctaaatctaacaacccctatgataaacaatggattaaaaatatggcatgcaagtacctaacatatgacatgagaacgtttatttagctattctatgcaatggttattgcaagctattacccaatcttcctatcgcacatctacagatttatctcccaattaatataaaagaaacacactggtaccttgccgttcttaacgccaagcaacgtgaagtgcaaatactcgattcgctagccatatatcccaatcagtgaagatcgacccgatctaaggcgtgtggtgagcgatacacttcgatccacttgtacaattcaaatcgagttcgtcgtgttttaacaaacctgacattacaatcacttcccagctggtagctatccagagaggattacaggggacaaaaaaatcagcacccataattacaacatgactggcctaatttcaatattacctcatgggaatacagcgaagtccagcaattgccaaagcaaggagactacgtgggttactcctaaactcttccacatgctattcatattatttaattattgtaatgtgttaacctaacgcctcaatttttctaacgcctcatgtggcctatatatccttgagttcatggagcattggagcggatcttatctcccaccaattcaaattcatgcaactaaaaccaactctattcatattttgcaccaatgcttcccattatgaaaatcatttaaaatgttctccctttacattatgcagcaagatattaaaacatttcaacaagacttagcaggaattttgatcaagttcaaactgaacaatattaaagactgtccactgctacaaaccacaatataaatggaatattgtccaacatttaccatactatgccctcttttgttcaccaactgaggcccttattaacaaatttagttacttcttgagtatttgactgttcccaaacattgttgccttttgagttaatttttatagttgagatttttatttcctctagttactgcacaaaacacttctttaaggaattgtatttttaaaaacaaaaattcagttggtttaacaatttttactaatatctgtacccattttctcctgattaagctgtgttggggtaacacacacatgtaaacacacaaagaaagccgatggaatagaaagccacaacaatccgataaccaaataacaatgtgtacacaaaaaattgtaacgaccattattcagtggcatcattacagggcatagctaaataacccgattttatgaaaaaaaaattgtgcaggacatattgagaccttagtttgacaagctgtgtattctacaatattctacaattgcaaatcaaacaccaatgcaaactaaatgatctagtttgtggcaaaccataatatcgttcacgccgcccacgctgaaactaccgaaaaacacttgcatgtgtctatgtgtccaaatttatagtattaggatatatcatatcatgtattaagtgtatttacttggacaaagggaatgaaatgtattagtgcctgaatccaagctatctaacataaatagcaagtgcagtaaactaaaacggattagtgatttgcattcgtagaactatgtggcttggcaagcatttcaccgattaggtatgtatgtaagataagtaaaaggcagtgtatttttagaaactataaatctattaaggttttgcgttcataaaaaataattagattggtgggtaactaataattccatataaacagtactatagatgcatcaacaatgggttgcttatacattgggtgataagtgataacacaccaatctatccacagacaaggtcaacaatgtgttgtttatacagtttggcatgaaactacatcgtggggaaaaaatgggtccaatagcaactaagtgaattagatcaacgcgaaggaaaagtataattgacaaaataaaaaaatagtaatcttacataaattagttgagcaaactaaagaaatgcatttataaacaccgcaacattagttaaatgaacatattgtgagtttgtaaccagtgctacagcagtacatatctctactctaaggctgtaaaattcaatgcacaaatgtttttactctgctcaatataacaccaactcttgctggctcagttttttttaaaaaaaatatatagctagattacatttaccaaaccattggtttgaattacttgctgctaacgacatagattacgtactctcagcttctacatagcatctatcatctcaaatccaacctagtgtaaatacagtaattacaagtttgcagcagtgaaatttcgcaatatactactagtactatctacacaaataaaactggacccacattgaaatctccaattgaattaagaagccattttttttcttgagggaaggaagcccctacagtttaatatattgaaaaaataaaaggtagaaaattacaacagattaatccaatgatcaaacaaattaagcctatggagtaaaagggagataccattcttaaagagaactctccaagagaaaagagaaggagcgatattataaaaaattaaaccatttcttttctcccagatattccaagtaacataaagcaccttctcaacaaagtgtaaagacctataggtatttttggccgtaatcaacatttctccaaatttaaggacaaatcccaaaccacaccaaattgcgcctatcattcaaagctgaaaggacataaatagtatattaaaacaaacaatacacacccacattcaaatccagttgcacaacttacaaataaaagagagaaataatatatcgcgaactatctcaaacactcacagacttatagagacgagactccaagacagagactctagatgaacctaatgtaacaaccacgtaggcacgcatggttgcatcttgaaaagtctaaattaacaaccgaaaaaattaataactaacgcatcctcaactggtcacgtcttgtgattagcccaggaacaagttggttgcatagctcttcgtaggtggagaagagcaccctatccttggcaccggtgcgatgccggttggtgtgcgcgcagaaatacttgagctgatcaagtgtgcacaaacccagtgtctccccaagcagtaggaacaaccagttgatgcgctccttctcggcagcgatcaccggacgcaagcatttctcatggccgcagtcgtcacagttcggcacgacagggttcatccaccgcgcctgcgcacggtcatgcatatgttggtggttttggcgtaagtagtcggacacctcttgaaacttagtggcaatgttgtagacgatcaccttgcgtgcatcacagcgcctgcaccgagcgtcgccttggatggtggtgatgtcgcggcgagcgagctcggcgagggagtggtgtttggccggttcattggtagcccaaggatacggtggatcaggaagagcattaccgtcgttgttgttgttgccgccaccgtttgtgacgttcggcgcagcgatgttgctaagtgccatgtcgtcgtccccgccacaggtgcggctagatcttgccatggacgcgttgctttgacgtcgagtcgaggagaattgttgatggaggtgcgataggattgatgatgacattgaaggtccaagaaaattaaagcatggaaataccgagactgcaccattggggatcaaaccactcgcgcagccggtgaacagcacaccggctgccgaggccacaaaagacggcgtgaccaccgcatcatcggcaggaacatgttcaatcgatggttgggccgccgatccggagaccacaccagtggccaccggcggccgcacctcgatcgacgtcgtcactgccggagcgcaagaagaggagtcgtcgtcgacgacgcccgtggcgaccccgtaggccaccggaccgagagacagtttcagccatggtggcacgttgtcgtcctcgccgctgccatcgtccatggcggccttcctcttctgtccggacaacgacgagccggctccatgcaccaccgccggcggcggcggcgggggcggtggcgaggacgcctccctccccatgacgagggaagagagagcgccggccggggcgatcactcgtagggctttacacgcacggccatctcgatcgatcggtggttaatttcaacgcgtttggacgacaaccgcgagagagcgcgatgcgatcgacgaccacgcgcgacgacgcggcttgactactctccgctcatccgctgtttgtttgtttgttggtcggggccgaggaaatagcaaaggctcctgtttcttttgagatggaaatcgatcaatctgaacgatgctgctgctatactcaatgcgattttcgggcaccgcgcgttcgtacacgtacgcgcgcgtgctgcatgcacagaaaattttgcgcgtctcgatcgccctagcgcgttaaacaggacgttcgagctgccggtctgccccttccaagatgcatggataaagaccaataaatagataccgtgcctatccacgttccaacaattgcatgcacgcccttcccggtctgatcgttgtttttcttttcgtccaggggcggagaaaccatctttcgtcagtcggccgaatttcacaatagtcctggttgcaataaaaaccggggctaaagatgatctttagtcccaatcatctttagtcttggttcaaatgctgtcagggtctgtcaggccctcccgggatctttagtcccgattggtatcggttccgtcatttggtccacggcaaatgacgagaaagacttaggcggaagttcaattttcttgtgagtacacatgctctatatttatattcaatctccaattcaaatacatacaagtgtatattaattagatctctcgcagtttatcatttatttatagtgcgcaaagcaaaagcagggaactaacttgtgcggctactacgtgtgcgagtattgccattgccttgcagaccaaatcatcaccacaagagagctcgatgtacgtacaaataaattcaaaatttcattgcgtacgtatcgatttgttgtttaattactaattaatttcatacattcatatagtttattcgcatgagggataacctgatcacacacaaggaatttatcgcggcggttcaagaacaactaatgggattcatcaacgaataaatccttgatcccaagggtgaattctactacgacggaaatacaattcaaaggtccttagcttctgagataacgactactactacgtcgaaatcgtagctagctaagacatcataatagattgtaattaatacatgtctatttttctatatgcatgtacacattttctttaatgtaaatatatattttggtcatatatatatatatatatgtatatatgtatatatgtatatatgtatatatatatgtatatatatatatatatgtatatatatatatatatgtatatatatatatatatgtgtatttatacatatatatgcatggtttatatatatatatatatatatatatatatataaaccatgcagcaacagggccatgaaaaaaaaaaggtcagctcgatctttagtcccggttatttcacccgggacaaaagatagcgatctatctttagtcccggattggtagtcccggttttcaaaccgggactaaagggggttatgaaccgggactacaaacgctttctccaccagtggtcttattattgtttgatttttttttcaaaatgttgcgagtatttctatatagcgtagtccctctgtccctaaatagtaaatatgggacgtcgtggactttttttaagcatgtttgaccattcgacttatttaaattttttttgaaatatataaaactatatatatacataaaagtatcactggtagagaaatgctttttactcccgattggtaactcattgtagtcccggtttttcaatcggagtttttcttttttttttctattttgtatatctcacgcccattatctcaaatcattcacagttatatagttcatcccaaatcattcacagtaatagttaatccccaatcattcacaacattcacaacacagatcattctcaaaatcattcacaacaacaacacagatcgaatcacacattcatcacagatcgattcaacacagatcgaatcattcaacacagatcgaatcacacattaaggaaaaaagaaaaaaaaaatcacgcagcagccccggcctccactgcctaccgccgcaccaacctccgcgccggcttccaccgggcgcggccctccgcgctaggccgccgcccggccggccgcgctagatcccggatccgcgcacgaggctgcctccgccgctgcccggccgcctaagaatggggaggagaggggaggagaagatgaggaagaggaagagaatgaggagaggaggaagaggaagagataggggtgaagaggagaaagagataaattaaggtgagggaggaggagatagaacttattaactgatattgcctctgggtctcgcgcacgcctcgtcatctctgccgcatatgccgatcttatttcccggttggtaacaccaatcgagactcgaaataaccgggactaaaaataataaaaataatagaggggtttgacaccgcctgctattttttttcgaaccggaactcatttttagtcctggttggtgttcccaaccgaaactaaagatcaaaaagtagctctaatcttttgaaccgggactaaagattaataatctttgatcccggtatctgttgtagatggtgtgaactggaatgttgcatgcatgcaggtacgtatatacgtaattcgagttcacatccggacacggttgtcgtcaatgggaattcctatatggcaaaggcaggagcccatgcaaattaaagggttgggatttggtctggcggtcgttggaattttgatcgattagtttagttgcgcagcacaacttggaattttgaattatctgcgtctatcttttgtatatggcaaacatacaattaatccgttgttcataccaaatccgacttttcatattttttattagtgtaaaaactatacaaaattattggatatgtgagaatcgaacataagggcaagtttaataagagagtaagcagccatctattagatgagcttacatgtcatttctatatcattaaagataatataatatttaaccgagtcattaatttttctctcaatgtgggccaaaccttggttctctctcctaggctatcaaccagtcacagatgctctttccatgtgggccaaccttaattatctctcacctattcttttcaccaatcacagcatccatcgtatgcatgccgtgtctaggcgcctgtgcacaggcgttgtcaatttagtcgacggctgctctctctctccactccctctttcttccagcaatgaaaaagagctgatgccagcggctaatagtaggtacattttccctattgcacctgccctaagcctcccattgacatgtaggcccaaattacacatagtcattgcgccttgttttggcaaattgtgggcctcttcagtttgttgcctaaatcataaattcttcattagtaaataattaatttaggaaagatacttatgatactttgcatttttaaccatcatgtatttggtgaagggagatcatatgtttttttattagaaatgaagcacacataatcaactgttatgatttgccgtggctctatgctacaccctaaaatggttcttctatgttttaaggatcagtcattatttttttagataatggatttgagaaaaaaaaaaggcctctacatcccgcaggatatatgcaaccacaaggttacatagtatgagcatttaagctcgtaatacatgttccaaacaataaaacaacccgtgctcatgttcttcactggttgaatcagtttgactcatcagtaaaaaaaagatatcaagctccaactcattacatgtagggatgaaaacggtacaaaaacggcggaaactatattttttgttttcgttttcatattttttcggaatcagaatcggaaacccagatacgaaaacggaattaaatattgtcaaaaccgaaaacggagcgaaaactgaccggtgctgatacggtaacgaaaatatatcggaataaaaaacccctcaaactaagctttaaaatatgtcaaatccaattctcaagtctcaaatttcaacattacatcacaaaacacaatcatgtcaagttcaattctcaagtttgaattgggtgtattgggttgggctgaattgagtgacataggaattaggatgctaaattgggttgggctagggaggaattatagactatgttatgggcctttgtaattccggaaattccgagaaatttcccgaaaagtctccgaccgattccgagttccgacggaaactgcccctatcatattcgattccgtttccaagaaaatatttccgaattcgttttcgttttcgaaaaaattctgaccgacagattctgttttcgaaaatagatccggaatccagaaaattttcgtaccgttttcatccctaattacatcagcatccggaccgaccaaacacttcgatattccatcattcgaaatatggcctcttctcaacaatactctccggctatttgactttttttttgttcagtgatagtgtgactttacagtttgcatgaacagccattacatgcatgtgctaccaatacttaacaactgatctttcatcgtggtatcaaaaatcacaaatatctcagctagatttagaaccggtactaaaaatgttttagtactggttctaaaagtccaagtccctgaaaacattttgtctcggttggtattaccaaccggtactaaaagtgcatctttagtaccgattggaaacacaaaccgagactaatgccggaggatctttactttcagttggtaacatcaacccagattaaaagacttgactatttgtgagctccttaacagagattagaatcccctcaagaatttgaactccgaaaaatatactgttacataaaccttggtgatatcctctttccctttacctttcttgttgaattgctttctaccacactaatgtagtgatgtttgacctcgcctccttacttgtggattggatcaactttaatgttgttgcctgtttgtattgctgctctacaggtcagatggtccgttcttacttccgacaatctgacctagtatcataatccaaccatgtttcgctttagctttcgtatttcattttaaatcatctattcacctcctctctaagcgatatcgaggtcattttacttttctataaaacaaatggttcaacctgtatcaatacgtaaatggtgccatctgttaaaaccattaatatacgaatggatgaaaatggttcagatagttataatactgggatgctttttcggaaataaataatgtcggccggatattattttttgatagttttgacaatagaaacgaatttagattttttttttcagaaaaagatacagtaaggttggtatatggcgaaaacgaaaaatggttagaaaatatatggataatttttaaatagttattcggatagctttataaaaccatttatctccatctttaggttcacatctctatcccaacatatttgttaaataattttattttagaaacaaggtatgcagctatccagtatgtcatatttgctagttacaaatcatacactatattcggtactattatctataataaaaacattatttattatagtaatatatcaaataatttgtttttaatggaataccttattattttaaaaagagtaagaagtgtccatgtcaattacatttgttcattactaataactttgaaatgaaacaaattacatttaaaattgagattctaatatgaatattgaatacaacttcatatttacaattatattttttattaaaatctagaaaaccaaagagcctaatttagaataacatattatatataccacgaatttattttcttttggataaaactgcctatatttctttgttgactttgtaagaatggtaaaaaggtctttctttatgttccgataaatattcgtgcccgtattctaactcatattcattatgtatcagtattcgataatattcgactccatttgattttcttttctgattccaaaaattataggaacattatccccgtataaacaagttaggctatgttcgggaggtaaggttgggcacctctcgacacggaaaacaaagcacgcgattatagtgaaattaattaagtattagcctaataaaaaactttaaaaatagattaatatgattttataaagtaactttcatatagaatttttttttaaaaaatatattgtttagtagttttaaaagtgtgcgcgtgaaaaatgaggcaagtgagttgggaaagaggggaaaagaacgctatcttcacgggaggcagttcccaacacaaacacgaaaacggattggtccattagcacgtgattaattaagtatttgctattttttttgaaatggactaattttatttttttaagcaattttcgtatagaaacttttttttaaaaaaaagacatagggagagatgatgggaaaaggggcatccggacacaacatagtatatacgggtacaatacatagacacaactattcaccgatctagggctgtcaatgagccgagctcgagcaagctcgtctgcccaagctcgagctcgacacaggctcgagccgagctcgagccgagcctactgcactttcgagcttttaggcaagctcggttcaagctcgagctcggctaccgagctcggccataagtagtataatatatattttaataataatctcttgataagtataattattttttagttaatcacactaataaaagagtagaaaataattaaaataaatatattgtactaacatatgctaatttattgtgtaaatagatactaatatatatatttatctattagtttattatattaataaggtaaacatgcaatataaactatgcacggtcaagctcggccaggcttgataaagctcgagctcggctcggtaaagctcgcgagcttttgctcaggctcgggttcggctctcgaaacctcgagctgctcgctgagcctcgacctttttttttgacagccctacaccgatccctgcataccaaagtcggcggctacacctgactcatcgatccactactgccgccgccgcccatggcctccgccgccgtcgccgtcgcccccgtcgtctccgacctcgtcgacttcctcaacgcctcccccaccgccttccacgccgtcggtacgccccccttcccccccgattcctatttcccttccttcttcctcctttggtgtcgatcgacgcaaactggactgtgaatgtgttgtctcagatgaggcgaagcggcggctgaaggcggcggggttctcgcagctgtcggagcgggaggagtgggcggggctccagcccggccgcaagtacttcttcacgcgcaaccactccaccatcgtcgccttcgccatcggcgccaagtgagcctctgctagatccacttttaccttgtcctcacactccttggattgctcgaggctataggattatttaatttgtcatactttttctattttttttttgtgaagaaacttatctgtagtaattctatacggttttgtggatcatgaatgtcctgattagtgcattatttattattggattatgttgatgtgttgtaggtatgctgccggcaatgggtttcacataatcggtgcgcatactgacagtccatccctgaagctcaagcctgtctccaaggtttagagtttgaactcttcgtagttgatttctgtttatgttaattggcgtggtacaattcgatgaattggcgattaaatcctgcttcttgccacgcaggtaacaaagggaggttatcttgaggttggggtccaaacttatggaggtggcttgtggtacacatggttcgaccgtgatcttactgttgctggtagggtgattgtaagggagaagaaggatggtgcagtgtcgtatgcgcataagcttgtaagagtgcaagagccagtcatgagaatccccactttggctattcaccttgacaggttggtgttagcaacttatccatttttgtgttttattcctgtgattaagtccatgaaaattggacctacattaaattttaggtcgtaattttgttagtcctatattgctagatcggaacagttaatcaacctaaactaaagtaaactataggtcacatgtgtgtccaattgcctatttggtttcttgtggcaacttatttattctacctactatcctgtagtaattaatgtttgtcaaagaaaaaaaatctggactaaaccaaagataacagtaggtcccaaatacagaaaatcgacgacatgcttcaggtatcagtttcagcttgaccctgtcagcatgcacttgaaccttttaccattagaaacttagagtagaaatccacacttcagctaactgagccagatgcctaactgaaaacatgcatcaccaatttaaaggaaactcaaagtaatacttgtacactctgacatatctagtttggatgtgttcgcttaaactgaataagagaaggaattgccatatttgatcagtagtaagatagctcgtatacagatcgtgatgtccaacattatttcacaacatcctggtccatttgttcatcttgtattgaaacattttctacagaaatgccattatgttcttttgtttcaaaatttagttaatataaattttctcatggcaacgaaaactgaaaatttgacatatcatattgattagttatgtgaactttaggtcttcgctaatgtaatgtacctagctgtttacatgtaataacaacgatacatgtggataaaaccttagcttttagcaccttacacaattgctcttaacacgtctaaactaatttaccgttcacagattaactttgaagaaatgttttgagaataaatcactatatttaattagtccaatactttggtttgtcatgcccacttgccagtactttgaaatgtcattctcaccatgcatttactttcaatagtgcaacctatgctggacataaatcctgttatgtttcgatgcttttattgtttataatagtaaagagtaatttcatttgtcttgcttaaattatgtacaggaatatctcctcagaaggtctcaagattaacaaccagaatcatcttgtccctgtgctggccacatctgttaaggtgatttgaatacattggccagtgtctgagtttccttttttttatggaaactagaaatgtatcccattaatatgacatgttaggaaatccactaacaagcgttctagatacaaactctggtaaatcttcatgcctcttcatgccaaataaacaggctcaaagaagaatctaaagccatgctgaacttggctagttcatgcacaaaattgcattacaatcactaggaccaaacatgagattaataacatccaaaccaagcaaataagtttttttggcttctataacaattactgtgccattgaagcaattagtccttgaaagtaactattgagtaaatatggcaatctggagcaatacaatattttgttcgataacaattactgtgccattggagcaattagtccttgaaagcaaatattgtattttgttcgttgaaggtttgtctatgctgttttcagttcacctatagttcctacatttatgaatttacttatttgaaatactattgcttgattttgtgtaaaatctagctccttaattacgccactttgtaaattttctatgttgttgtgtttgcaaatcgtattttctgctgagggaggaaattactttcatgcaagcgttttgctaaagaacgtttaaatatttctttcacttcaacgaacaaaatacaatatggcaatctggagcaatacaagactgaaggcaatacaatattttgcagaatgaaatgcagaaattagtggcagaaaatggttcagagtcatctgagagtaagaacaccaagcatcatccactattattgcaggtacttattttgtgtagtatactaattccattggacaaataggttcacaaataatacaaaactcctgatatatctttcttttaaatttgttgcagttgattgctaaagaagcgaactgcaagcctgatgagatatgtgactttgagctgcagttgtgcgatacccagccaagtactgtagcaggtgccatgaaagaattcatcttttcaggaaggcttgacaatctttgcatgtcattttgttcgttgaaggtttgtctatgctgttttcagttcacctatagttcctacatttatgaatttacttatttgaaatactattggttgattttgtgtaaaatctagctccttaattacgtcactttggaaattttctatgttgttgtgcttgcaaatcgtattttctgctgagggaggaaattactttcatgcaagcgttttgctaaagaacgtttaaatatttctttcacatgtttctaagtgtattattacatttacttaatttgaactagtacggggattttttataagaaaaagaagatagagaaacaacaaacaatgacatcaaaattaagttgtaaaatttgctggaagtaatagctcatcttctcaccttctattcattccaaatttgtataatggagcccctcttgtatcatgaatcgcaatcgtgattgctattgaatgggttagcgacctagcatcctttataactctagttaagtgctacaccgtgtcgtcattttgtatatgtgctgctctagaacagaaagatacctttccgttgtgtactttaaggcaataaagttagtcaactgcatccctttctaaagaactaattatttctttcttcttgcgagcaaataatatgcaattacttaacccctatactgtttcaggccctaatagaatcgacttcttctgaagaatctcttgcgcatgaatctggtgtgagaatggtggctctatttgaccatgaggaggttggatctgattcggctcagggagctggttctcctgccatgttagatgctttgtcaagaatcacagggtcttttaactcttcaaattcgagggtactaactgattttcattacgcaagaataaagcatatatttctgtttcagttggtaaccagatctgttactttcattaaacaattttgtttttgttgaccatgtaatgtggcatggcttaaaggatactttaaataaactgtttgcacatattgaaatagttctccccagctccattatgcacattacaaacaactagactgtttgcagtctgtgtacctatttaggtttacattgtgacaatctgcttttaattttcagttgctagaaaaggctattcaaagaagctttctagtatctgcagatatggcacatgccttacaccccaattatatggtaagattttctttgcatcagtatctgagatttgcagttatacagcaacaattaaattaaaccttttgaacctatttctatttatctttgcaggacaagcatgaggagaaccaccagcctaaattgcatggaggactcgtgattaaacacaatgctaaccaacgatatgctacaaatgctgtgacagcatttatttttcgggaaattgctgagaggcaccatctacctatacaggttagttcatgtatgaaggatccttctataacaactgtgaaatagtgctttgttctgaactaatcaagttgtcatagtctctaagttcaaaaatatgtctggctaatctattgaccttgactcctgctctatcaatatataaggcaaatttcttgccttccttttcggaaaaaagaatctattgaccttgagatgaataaacaaattagataagctcttgaacagtttgtgcttatccagtttaagaacaaggggctattacttgtttaaacaaattggaaatcaataaaatctaatttctgcattcatttttgcaggattttgttgttcggaacgacatgggttgtggttcaaccatcggcccaatactagctagtggtgttggtattcgtactgtggatattggagcaccacaattgtcgatgcacagcatcagggaaatgtgtgctgtcgatgacatcaagcactcgtacgaacacttcaaggcatatttcgaagagttcactgaattggacagcaaagttaaagtagattgctaagatgaagtagtgaccatactggatcagccgactggtggtgttgctttgacatatcctgtactgttgcaaaataaatgaacaataaattgggttacattatctcgtcacaggaatctcatggagaatatattttctggctgtgatttttatctcctcgttcctggtcagttgccgggatctgtgctggccacatcatcttttatggtctagtacaggtcgaaatgtgcttcttagaagtataataagttttcacctcaagtataggagaaaatcagaaagcctcctccctccgtttataactgttttgactttttcgtagttcaacttttgatcaagtttatagaaaaatttaccaatgttgataacaccaaataagtaacacaaaattgagtatactttggtagtatgtttattttgtgttgaaaatgttgttatgtttttatataaattgggccaaacataaaaaaattaatttgtctaaaaaaatgtcaaaccatttattaatttgatgaaacg

SEQ ID NO: 64202 - DNA, 3957 bp, Oryza sativa
  unsure (1)..(3957): unsure at all n locations
ccatggctcttttatgtgataatatgattttcggtgatatttgcaaatttcaaatgactttcaaacaaatatcccaaataccgagggttatttgtgtattttctgaaaaattcagggtttacagtacaaagatttcaatgcaaaggaacaggcacttaatttccaaaaacagcaaaaatcacaggatagatactttcctttttctattttctttccatttttttctttccttgtcttctccttaacttcttttctccactcccgttgactccgcacctgccatgtgcggtggccgggatgccgaggtggcgcggcggcggggtggtcaggtggcgctggcggccaagcggcgcggcgcagcgcacggcggcctggcgcaacgcgcggcaggcggtgtggcgcgcggcgaggcagggcggtgcgcggcttcggcagcggcgcggccgtgcagggcgcggctgtgcggcgagggcgctggccggtggggacggccgtccggcggcccggggcggccggagcagcgaggcggcgaagcggccggaggcgaggtgctgcggccaagaggggcggcacgaccgcacgagacgcggcttggtgtggccggcgaccggcgctgcgcggcagccgggcagctaggcagtgctgctcggtgcggcggcgtacgacggtcaggatgcatggcgcgcgtgcggcagtccactccggtgcggatgcggctcgccgctcgcggcaggcgcgggggcttggtgtgagcatggcccgtggcgtccgcgttgccgtgcggcggtagcgcgggtcgcggtagtctcggcgtggccagcgtcgccttctctcctttccgtttttttaatttttttttcgatttcttctttctcttcttcttcctaatggcgcatgcgtcgtggatgcggccgatgtagacggcgcggcctagcgctgtgcgtgtgctttggcgcgacctggtgcggatgcggctcgatggcgcggccgttggcacagtcaggctgcggggtgctcgctggtgtggccgacggcgtgacgcgccattttcccctttcttgcacttttcttgtttcatttcttctctctctccttccttggtggtgctgccatggcggccaaacagtgtcgcacacgcatccagcatgggcttgctgcgtgctctcgttgcagtggcacggcggccagtgacggcgcgggtgcagccatggaggcggggtggccggcgtgcgttcaggagggcgcggttctcgtcggggtatccgtgtgcggcatgacgtggagggacgcgctcagccagctagtgtttttggggaaatccctaatcggctttcgccggcgactccaagtcggcgttagcagatntctccagagaaaagcaaaaacggaacgagaacgaggagagtaattcgttttcgcgattagacggcgagatgcaaaacggatctacgtgttattacccttcttcttcttggtatcgtgctgataacgtattatgcaacccagtgctacatccgtagttcaaaggggttacataatgtttataaaagtggagacacaagatatgagggtgtggcatcatttctcattcacccattgcattctcaagtgtacaaaacctctcctccaaccctctatttatagggcaatgccttgccactttacatattagtgatgggcccaattagggggtaaccgggccgggccttcatgggccggcggtttcctaacaattatatcgatgtgatggaggtgatcactcgatgtgagtgtatgtcggaagacgggtggagacatgagcgccacccgtaacacaaaacctttgcgaaaaccaaaaacttaataaaacaaaatgatttcgactgggcagcatgaatagaatatgggtggttctgtaaacggcaagtcgccaaccctggtcaattaaggactgagtcaagaagctatacaggaaacgaaacgagtacaaccgcatttcttcaatgggtatagacccagcgaactaagaaatagttgtggggtggcaccccagtcgtggtggttctgcagtggtgacgattgtgatggaagtgtggatcgattggatcgatcgtttgaatgccgaggcaaaaacctaaaatgcacctaagtatatattgttatatatattgtatacccccttttattatctcgggagcgccaggactcccttcactgctagctcgaggtgttgtgttgtgacgggagtgcaatggggatctatagtcgttggagcgggtgctgcaatgcgaggatgactgaaaaaacgggacgtgataagtctcatgtgttgggactaggcttatgtgttgggcaagtcgtggagtgcaggattaaaagcatacattaactgcagtgtgagtaaaacaaatctattcaaatagccgtgcttgcggttaatgagcgtcgggacttttactactcttgactaggctcatagattttaatcttgcttagattaggaaaagaggtgtgaccttgtccaatgagtgagaaggtcgtagtgatggaaaatgtgggaaaactagttgtgagggtaaaccggaccaagcgaggcttggggaaggtggatgaaccctcgcagattaacgaaccaagccatccttgaatccctgtgagcactatatacattctgtagtggtggctagctgagaacggttggtactcacccttgcttaattaaatattttagaaggagaagtcggagccgacttatacgtgtgccatgctgatgaagaggtgttgaagacggtggagtagggacctaggttcaccagtcgctgcctgtggaataagatggaccgtcgttgcttcgcttccgctaccgtatctacttctttggatatttggccttgtagatgaccatacttggtctatttggatgccactcgggcaaccattgtattattaatgtattgtaaagcctgtataacgatgtcagctttgtgatatacaacattgccatgtgtataccatctactgattcagagaatggtattgtaatcacatgaagttttcggtgtacaaaaccgggaggccgacacattaacattgctttgccctcgcaactaacaccggcccaccacccgctgctgaccctgggctccagctgctgcggtatcgcctacaccacccatcgctgatcagtcacctactaggccgtctaagcccgatcctccgctccaaagctctatccctatctttaacactaaacctacccctaaaccaaacccgatttacgttcacgagatgaaaatcttgggcacggtcgcggactagccttcccctttgcttttgccctacacgtctccgaccaaaaaatccattctgaatttcagacccgtccccgtcgcctacgtcattgtcggtaactcccggcagccggcacccagtcgccgggcaccgccacacatcggctccgtattctctacgaccagacacaagcccgcgctcgcactcactcggtatgttcaaaactagtactactactagtaactgcaggcatcagccgcagaagatctgcaatgggggccatagccacaagactacgtttccggacccaccggttcgcgtaagcaacaggccccacatgtcagttgcactgcgggctctttggacaatatccactcgctgaaaaaattaaggtgcggacagggtgatgcgagcaccaagagaaaatgtttcagtcactgacaggcggggcagaaatagctgttgcggtgtgggggcccgcatggcagcgagcgtggtggaaattagcggagacggcttcgtcgacgagcgcgatctcctcgcgcgataaggacacgcatagcggcacggcacacgcaggcagagaggcgagagcatcgcgactcgaggccaatttcttccttcccctttccttttcgctcgcggcgcgaggcgatcggatggcggcgtcgtcgtcgtcgtcgtcgt

SEQ ID NO: 64203 - DNA, 845 bp, Oryza sativa
gtcttcacaattcacaagaaaagaaaccttcccgcttcaacagtattccgccactgcatggtttatgaatgtctgctttctaagaaaatttcacctctatttgtgtggcttttcataggatggtcatttttgttacaaatttaaaattcaaagataattatttgtgcatgacagatcccatatgcttatgccctgctgtcacttgcctagtgcctacaattgcctatcattggttaatctaaatcattttagtattgcagaaatttattgcaaacagatgaaggatctgtggttaagttttggacttcattgagcaatcaaaatgtatctgtgaagaagattcagttctagtgtttttagcaaaagaacaaaaaggacaacactgctgtcttgagtatagaaatgttatcaatggtctactactaacatggcttgtgagcatgtcatgtaacccaacaaattgcccagcacataatgtgatcattagaatgtaacagaaaagcttgatggagaggataaaagtacaaaaacattaccaagaaactgcagagcagaagcaggtaattcattacgacatggtcaaagtgttcccatggcttgacaggtggtggtcctgagccttttactcttttgttgttcctcttctttgtatgactagcatcttcttggcagtacccatcacctataggagaggtaaaagtgtaactctactacaagtaacataataggtaaaatcttcatgcttatcacagttgttattaacttagtagattgacagacataggagttgcaagattcctaaagacataataaatgacgtaattacctccatttgagctttcttg

SEQ ID NO: 64204 - DNA, 1370 bp, Oryza sativa
tttgaaagcacgaatcacagaagcgtcggtgatatcggggatggtatttctgcactcactaaagcgccaacatagtcccttaaagattcacccgaattctgtgttaatgtgtgtaaatcgtcttcgatctcgtggcgcttgtaagtccttggaagttagcgacgaattgctgccacaaatctgcccatcaagagatcgagtagggtgggaggtgcatcagccacgaacgcgcagaacctttcaacgccgttggcaaatagtttgctaacgcgttgtcgtctgccccggcagcgtatagtaccatggagtagacctggaagaattcttcagggtcagtactcccatcgtacttctctattgctccgggtcggaatctcttgggccatcggacatcacgtagagaacggttgaaagctctacacccggcgctaggggcggtgggttgtcggcgattgtgtgtcctccgtggatgtctatcggataacgaagatgaagatgatgacgatgatgacgatggttcactcggctccggtgtgcgattccgagggcgacgtacaggttctcgagaattctgtcgtcgtccaccattgttgtcatggcgccgatccccattatcaccaccgtcatgttgacgccctcgaccagcatcgtctggtgtccgctgttcgtgattgtcgcggtcgcggtggctgtgacgattatggtggtgttggtcttcgttcgagcggcctcctcgctcttcgttctcgcgacgtcgtaaagaaacacgatgtcgggaacgattcttgttgtcttgcgcgtgtcgtgcttcttggcggccattcagatagtcgcggagatcgccggtcccgcgaggtggaggggtagctcgtctaggcgacgtccgctgctccggtggttcgctgtcggcactgccagctgtcggtcgttctggttctgctctggtagcggcctcttcgaatgcgttactgagattggctaccgattcccgtagtcgttctgtccatcgtgcgagatcatcgttaagcacggagtcatagggagcttctatcagtattgcgttgacggtgccgagatgttgggccggcgtgaccgtctggttctccgcctctgcgttagcatgtgtagacgtgctagtcccaccaatggcaaatacgtcacgtgttgtactggaagatgacgagccatagtcttcgagcaagtgtaggactgatggctcgtggggatcaatgtcgattactccaacgaatcgatccgaggtcaacgtcgcttcttgttccttgtctgtctccttaagagagattcctgactgctggaccttaggaagcgtcgttctcatggcgcggagaaagacctagcagcttgagaag

SEQ ID NO: 64205 - DNA, 1086 bp, Oryza sativa
ccgttgcctcccaggctctgcgcggtgaggacgagctgacgtttgctgagcgcggcggcaacggagtggttggggcgaaacgggcagagggcgagtccgtttcgggcactacggcgtgcgtggcagcggcttatttggggttgaaggtggaggctggtggcatgaggcggtgtggaaattatgggtaccccatacgcacacggcatggttatccgactagttatagaggataacttgtatctatggaatatgtaatagatcattacttgggtattacgtttccttgtatattatggaacggcctagagtcctggtttggtaatattgtaaaatagatttaggaaaccgataccgtgttgcttaaggtttttatcttgtaatcatgcccccatcttatataaggtgggcaggaggctttctagggggcatgaacacataagatcgtcagatctatactacacccggcggattcaaatccccaaacaggagtagggtattacctctcattgagagggcctgaacctatctaaattcttgtctccgcttccatccacttttaggtctcgtgtgctattccattttattattgccgaattcatgttttgacagttggcgcgtcaggtagaggtgcgtcgagtttctattgacaagtgcgatggaataaattctcaggagtcgtcggcatcgtcttcgcttttatagcgtgagatccactgccgacgacaccaccttcatcttcggactagttcttctcttctggagtctgcctttcattgccatcgccgaaaattccgatgtgatcaacataaatagccaagcgactaatcaccgatccaatctaccaccggatgtcagtggccaaattatttccctgatgatcaagatttgaagctatcaactatcatgagtatccacagcccgccacgcaagtgcatatttccatctgacgcatgcgcatgtgtccaccgcatgacaattggctgaccaatcaggaagctgctagcaatggcaagcaatcaaattccaatcgccaatgttttttctcgtcgatatcaaattttctagcgagattcaattactacatgg

SEQ ID NO: 64206 - DNA, 1343 bp, Oryza sativa
atcgtcttcttgctctgcggctgcaggtggtgatgataaggcgagaggaggaggcttgcgcgccgccgccggcaggggagagacgccgccgcagatgtccatgtactcatcggcgacctcgccgtcctcgagtccgcggggcgacgtgcggcgaacggcggcctcgtcgtcgagcatcttcctcagctcgaacagcgcggcgtcttccgtggagccgagatcgatctccagctcgtcgtcgtcgccgtcaacgccgggaaccgcgcgccagctgcaccggcgccgcatgaagtcggcgacgtgcgacgggaggatccccgccggcagcgacgacaggaggccgaccagctgctccttctgggccatggtcatggcctccttgtccttgacgcggcgagggagcgggcggcgcgccgccgcccccgccgccgccttgcgcaccagcgcctccccttcttgaggaggcctcgcaccgcctccatctccgaccggcaccgcttcctgaggagggaaccggagccgccgtggccgcgcggggaggagcggccgatgatctcctccatcgccggggacggtggtggtgacgaagatctcgagagttctcgctcgctctcgcctggtggtggctgagcaagatgcccaagaacgtgtggccggaatgcaggatcgagacaggacaaaagggcgcgcgcgccgatcgttcccgcctttttatggccgatgggctgataccgtctcggagtaagattcgaatcggactctcccaaaaatccgagtaggattggttcggattcggactggacaccaagcctcgcgcgcttgcgtaggatcacaagctagatggcaatgcgagttggcgagttgaagcaaatggatagagtacaaaatgcagaggttgcgttaggagaaatatgcaccatcgctcacaatcttaggcctatgaacaatatccacagtattgagtgtgatcagcgccatgtgcccgggggaatggtccgggcaaccaaggacgagaaaatttcagatgtgacaactgatgaatagcaagcaccacagataagtttattgagcataaattagacggagaagtcctcgcttctatgcaaatgcttgttggatctccattatatgcaatctttatccagctctccaggcagaacaggcacaaaagacagaccatgcaatggtgaagagatggctcaaggccattcatagctaccatggtaagtctagaaccgactagtttcaatatgtaacaccagtgtgatagtacaaaagttccatataacaacagtaactcattgatacatttgcagtatacatatccagggaaaaaattgctt

SEQ ID NO: 64207 - DNA, 742 bp, Oryza sativa
  unsure (1)..(742): unsure at all n locations
ttaaaaaaaatcttttgccactttgcctacgtgagttgctatatgaggtagccagtgtggaccagtgatatgcaatgtctgttttgcccctcgccttcgtttctctccttggagatgaaactcccaatttaaccagccgtctctcctctccgaatccgttcgcttggcggatcaactcgttggatgcaaatccaattccgatcaggagtaggcattcactctcgtttcctgccgatataactgagcgctagattggccatcgaccacatcaccaacaactctcgccgcctcacactcgcagatctgacagttgatttggggaaaaaaaattcaaaaaataaggagaaaatcttttcgccgccgacgaggaggagagggatgtcgcggccgaggacgacgagatgcccaaagcggcctgcgccccagctggccgtggctccgtgcgccgccaccggcaagcgccgccgcctcgcgccccccgagtcgccgtgggcgtcgttgaaccccgacctcctgcggctggtcgcggagcgggcgctcgccagcgacctcctcgactacgtccgcctccgcgccgtctgcgccgcctggcgctccgncacccgctgcccgcgcgggcgcgggatcaccgacccgcgcttccacccgcgccgctggatgatgttccccgagggccacggcctccaccccggccacgccaagctccgcgggttcgtccgcttcttcaacctctccaccggcg

SEQ ID NO: 64208 - DNA, 1372 bp, Oryza sativa
tacacagatgtgcaattctcacaaaatagttgggtcacagctcaccaaattcggtaattgtatggaaccacaagctgagagtgacggagttgccacttttagcattaaattctaacttactcattgtgcaaaacaagcaccgacacatggctaacgcaatacagatcaaataccgacatcaaatctagcagaaaacagctatacgcgaggaaatttgcatggtatcctctgatagaatggctacgctaaggctaaattaatccgtctcgcatccaaatcgaacgaaacataaatcgcattgaccagggtcgccacagtcagttcaaatttccgtacatccagatccaaacctcagaaacactgcctactcatgaatccgccacgagctaatcagaaatcgaaccgcagattccgctcgtcgggggggcattgcaaccagacgcaacggaaacgaaacggaatcaaaagcgagcaaggcgagagatctcggcaatgcggggctctcaccatcgaagccggcgcccggatccgggccctccgatcccctcccgcgccgcgcgaacggcgggagccagaacaccgccgacagcagcacggcgacgccgagcacgagcgccgccacgcatttcagccgcaccaccccaccgacaccgcagcagcagcaccaccaccaccccagtcgcccgctacctccccttcctcctcctcctccttttcctcctcttccgcctcctccgccccctgccccatccggcgggcgttgctgctggtgctgcccctcgccgacggcctccttccccatgcggcgcgatctcaccacgacgcatcccggcgccaggcagccgccgcctccgcctccttggacgccattgctggggggggggggggcgatccggttggtggagctagggctgggtggtggtggtggtggtcctccgctgctgcggcgtcgttgcttaaggaggaggagattgaggtgggcgagggaaggtgagagaaagtgagaggtaaaccgcaccgcaccgagccgaaggtgaaacgtgaaatgaattggagtggaattttggaagggaagggaggaagacgacgagcagcgctgcggttggagtgacctgacctgacctgaccacgccgagtagtagtagtagtagtggactagactagagttaagtgggtaaagctcacttattgttggctcggtttattaaattaaggtcgttaatttctttctggttgtgttggtgtggaataaatttgtaggtttagctttttctttctctttttcctttttcatggtgttgtgattggtttgttttatctgggtttttggtgaggattggtttgaagattttgaatttggaagggggcaaag

SEQ ID NO: 64209 - DNA, 72682 bp, Oryza sativa
atatatatatatatatatatatatatatatatatatatatatatatatatatatatatatatatatatgattgtatgatctttatgagatggatatttgaattgaaataactactacttcctccgtcccctaatataagagattttgacattttacttgtactgtttgatcattcgtcttattcaaaaaaattttagaattattttttatttttttaacttactttattatccaaagtactttaagcacaacttttcgttttttatatttgcacaaattttttgaataagacgagtgatcaaacaacacaagcaaatgtcaaaatcccttatattagggagtactactacatcacatacagttgcctcgatcattttaagtttgaatgcttgaggtagccatcatatgagacaggtagtacaagtcaatgtgttcaatttgttgttcacaagttaaaataattgggtagaaaatatgaacgcaatctttcagcacaaacatgcatagctactttggctgtgtttagatccaaacttctaactttttccattacatcaacctgtcatacacacacaacttttcagtcacatcgtaccaatttcaacccaaactttcaactttggaaggaacaacatagcctttaagtattgacaatgttgaaaaatgaggggcatgttgaaatggaaaatgtatacctcttccactctttgtcaatgtgcttaccattgtgctctgcgatcgtgtgaatgtatgggtcgagtcatcagcgaggatgttctataatcaaaactattaatgcgaactactctacattattgagaggtgactagagatcgggcggcttcttctttgtttgtaagccgtcggtttggttcggtgccaccaaactacaccttttatcattttttttacaggttctctattttctacgagatatattcaatttcttatgtataaataaatttgataaaactacaaccatttgtcataactaccagcttgttgcaactttagttgattgcatgataatcactgattttaacagaaatatacaactctgtatgttaggttgctcactgtcagttcatccatgcaatatccgcacattcatgcaaattaggcccacatatcagaaactgtataggataaagtcaaaattttgcaataaaactgtatgttttcttgtagttttgtgaaatgtcgttgtaccaaccgattcagttttataaaatttactctttatattttttctaaattgatatttgattttagaatttccactttgctacctgattttttgtttgatttttcctctgactattcatttatttagtatattcaaatataatgcttatgaagttcagttattgtataaaggattttaaacacatactttatcctgtagtacatttttagatacgttatttgcatctaaaagtgtcggattgataagctccgtagatgtaggaaactacaggtttaaaaaaataggaccaatctaggaaggactagattgatattgaaataaggaggagggtgaggctcgaacccggaccggctagctcgcagcttgcgttgctagccgggaagaccccgggcctttctcgaaactacaggtttgggatcaaccaagggttttgggtgagcttgttgtgcccatgagtgtttgggagtaacacaagtcatgtatacaagttcgagtttcccgaaagataacaattatacactcctgttttgttcactatcggctaagtccatataaacctggaaactctcaagctagctagcatagttcttgccaatttctagaaccaacccttttatgtaaaatcaaagtgttttgattattattttgtgatgaacaattggcatatgtgattattggttttgatatttggagattattggcgaagtggttttggagatgattggattttacagatgttaaacaggagctgctgagttttgggtccggttagaccgggcatgggttgccagtcaaaccgacggttatcgagcggtcagaccgggcgactctgtgttgatttcagtttcgggttgtttgtttggatatccgtgattattttatgtttatggcttctagatggatactacgtatgtaatactgttatttgctaacaatgagtcaagttggagatagcttggtctcgaaatatggtttctttgtttgattcatgtgtaggtgacttgatgcctcgagagagtattgccggtgatggatcgggagtcgacttggggataaagcgatgtccgtgacggtcagatatcatgcaggatacttaggctagagttcaatgcacgtggttggtgaagattccatatggcatacgatggaggcattgtgtgcgtatgggatacggagtcgaatttggaaggagtctaaatttggtatgattggagtttgtaaagtttgtttcttgtacaggaaggtttcctaagtggattaggacttctagtatgagtttggttcatggctttaggctgcctacctcatgtataaatagagagggagcgtgaggcttcccggtatcgcttttgagagtattgagttgatagtttagttagggtttcgagtttagttgagatttttgtgaggagtgctgttgtcgcactttgtaaacacatagagaaataataaaattgtcatctacttcgagagttcttcgatttgtgttttctcgggtttggtggtctaaccggcgaaacaccggcagtcagaccagtgacattgcggcggtcagaccggcgggtacactacggtcagactggcgacggcaacaggaggcagaggcgattttcaggcggtaggaccgggctttcaacgccggtcaaaccgacggcttccaggcggttaggccggcgcatcacctacggtcagatcacgatccatcgaatttaagggtaacttttaattccgcaaaaagtttaggtttttgggtataccaaccattcaccccctccccctctggttggcttagttcttgtatttcgatcctacattttatatgctttgatggtttgacacctctctctctctggggagacaacaaacattcgctcataagcttaaccaagctctatgccggtacagacatcccgtgggatgtaacgccaggcccatttgaagcctcccagttttttccctgagcttcccaacctcctcttttggtttatttttatttgctaaaaattgaatttttaacttttcaccgtagattatttttcagtttttacttttagatcgctaagaatacgcatataaaagttttatttacagattatttttcatttataaatataccgtttctcaataagcgaataagcgaaacgatgtagtcctccatatccatgcccgtgtgaacacaacgaattgttaatacacatatcaaaagtcgaagacaccgtatattgaaaaacaaagagatatatgcattgttacagtagtcatctacatatttatcaagcattagtccattatttatatgacctgtaaattcaaattcttcgggcaaacaactgccattttcacttgcaaatggaattgttcaccttacttctatatatattgcaaatcggctgtacgactgtagccgattcaaactgaccctacaaatatattgctacacaaacacagaggatctgtgtagtcaaagacagggaatcaccacaaaggcatcaattccaaaattaagatgaacagaaggaataccctgtcaagattgacttgatgtaattatatcggtgttggtatacaaaacttctttcctcattccaacaaattattttgacaaatttcagactgtgaagcgaaaactgtgataaaatggagcaattgcgccatacagcaaatcaaaatgaaaaccacatggtgttggcagcagtttaaacatctagaaaacccagtgtaaggggttttcggcacatgtcatgtttataggctgaagaactggcagtttatgatagggctttctggacctcaacagtcacttcctttggtggtttttcggcatgcagatttgcgactatgcccttcttggtgtagtagtcaatcacctagaggaaggaaaccattccacgaattaaattgagtgaacaggcagcaactgctttgcattatggcagataataaacaatatttcacaataaaactaaggattacaaaagaaatgaggaaattgaagccaggagatggaaatatcaggcaacaaagatacataaacgtataccgcaatggaagtgtacttcaccatgttgtcaaaaatcttatgcaatacattatacagtcatatgaaatatataagaactccatctcatgaattctcaaatgatgtcgaatttgtaggagaaaatgaacaagatggttcactgaaaaactcccaatctactcccagttcatactcaaaaagaatttttggatctagagatacccagcaccaagaattattggagctctactaagcagacccacaaatgaagaaaaggtacaaatctagaaatgaagggttggcaaaatgtaatcagaacttaaaaacaatgaaagatatacaggaaacactgtaatgcaactgaaggaatccgccttaactgaagtacgactacatcctaaaagaatatctgaatatttaaaaacgtagttgctaaaggaaacatacaggcttagtttgtacgtggaaggcttcaagccttgacttcaatactgcagctgtgtcatctttcctttgaattaagggttctccagtaacctttgtgaaaagacaaagcaatcagggagcagaagtgcacataatattaccaattaaaagatatatatgatatcaaacaaatttacttaatagcagcacaaatatgtcccacatgaaatcattgctaaagaagaatatgcttttaatggaagcaatagaaacaatatacaatctcctgctacaaaaacatgtcgatgtatctatttatggacacttaaacaggcataattgtcagaaaaggaagcaaaagtgtgtcatgcaaacactgcctatcatttcttgtcaacaaaaggtgcattttactcttcgtacgagaaacaaccaaaacaagaaaaatatatccataatcacactacctatttaactatttgggaagcaaactaaataaacagtggcaagaagaaggtactcaatgaaccttttttattttgaaagaatgatggctcatgttttgttcttaaaaaacaagtaagcagagtactacgatgatcgatgatgagacagggaaattatggtaaaggcgcatatgctgcaagcatcaaacaatatatgtaccaaatctaatagaaataatgaaaatggtaaaaatctgagtatctgacaaatgcaagcgagagcaagtaatctggtatgacttacatcatcaagtccaggagtcttaggaggagcaaattttgtatgataagatctaccacttgatgggtggatccaacgaccggtaattcgttcttccagtattgcatcatcaattgcaaaatttagaaccttgtcaatcttagtaccttgtttggccaacatttcatcaagctgcaccattttttagtaagaaaagtgatacaatgatagaaactgtccatttatatagacagctctaataacaaaaaggagctcttttatatagcggtgcatattgaccaaggacctcaccttctgtgcttgaacaacagttctagggaaaccatcaaggataaaacctttctggcatgaagttttcttcatggcttcatcaataatcccaacaaccaagtcatcagaaacaagctctccctagaagataaggaaagaaacaaaagaatcaagaaacccattcctgctggttataatttctgttgctatatgtttcttaaaaactaccttgtccatagcttctttagccttaatcccaagtggagttttagcagccactgcagccctcaacatatcaccagtggctaaatggcacaagcaaaattcatccttaatcagcggtgactgtgttccctttccgcagccaggtggacctaaaatttagtaaaataaagggatgtcaaaattgtatgtcttaccttttttttttttagaacacgcagagattgtcttaccattctagaacatcaatattcaagctttctgcccagatgcctattaaactatccataaaagcatcaaaatttgacatcactttgcctctatggatatcaagttgtcaacactatcctatcctcaataacatattagggtgtaactggcattcttacaatgctgttaacaacaccagtgtctcagtgacacatgcatgaattagaacaagccatcaatttggagatagctaagagcagacgatgactagattcggtccacttaaattaggtagtgcagagtgtttgtaaattagctatacttcatgaagtaaaagaacaatagaataaaccttccataatgatttgtttgatgaccagtaaattagagtagtgcattgctgaagcagagcattgcgcaacagaacaagtttatttgaaatttgttgtgtcacacagtttacataaccatacagatcgatttggtttactagtgaatattgaaacaaaggagtaatacgtctatctctttgtttttattccgagtgacatttccaaacctttatcgatacatataaagttgcacctttctgttttggttattttaaaaagtttccacatcagacaaaaaaccacgaaccgccctgttgttttctgctcatcctcaacacatgccacatgacaaatttaaaataacatgtgtgagaacaaaaaatgcaacctccaatttcaacacatactactgaatacgaataaattctataccttaaacgcctgaaattcctattatgcgtcgaacaccgatcatataaatatttcttttcgcttgatttctgtcactaatatccttccgtcaaatggaaaaaccccaatcgactcaatcgcaagttgcaagaacaaacgcaatttgaccatcaaaaattgccgcagtttccaaaggtggaaacaacaagtaaattttacaagatttccctcgaagccaaacatttttgtttgcaaaaaaccacgaggagagcggaagaagaaacccagatttgacccaaaaaaagaaagggagacagctttgcacggatctaacgcaacatccccagcaagccacagcaatctttccccatctcccgaccagggcagcacgcgccgccgaaccggatccaccaaccaacgaaccaaaccaccgagagagagagagagagagaggaagaagaaagaggcgggcgttaccgacgaggatgacgcgcttgtcgggcttggagctgcacttcatgcggcggagcagctccgtcatcagctccatcgacggcacgtcctccaggttcgccgccatctccgcagcaacaactactgcactagccttgttcgtcgacgaactcgcgtcgcgtgctctccgcgtgcgccgctgaaatggaggagtctcggtcggatcgaggaggtttaggtggtggggctttttgtttcgtttctggtgagacggtgacaaccaaagctgggctctttctgtttcctttttaagcagtttttttttccaacgaaaaagacgcttctgcccacgcaagcacgcaccgctctcggggagtgtatggcaaataattttctacccaccaaaaagacacatttaaactctaaccattcattctccctctttcattttaatatttaatcctaaccctgattcatttaccaattctaatcccaccccatttttccattatccaaacacaccttcggtgaatctttaacttcctcgtttcctattaggatgctttttaaagggttaaattggtgtgtttttaaaaaataatttatgcatacattgtttaaaaaattcaaataaatatttttttcaagtttataattataaatatctaagtaataatgtgctaatgagctttctcgtttatcatgcgtttgaaaatcaacctccaactagaggatcaagaagccttaaggctgtgtttttctcttgtttcccaactcatcgttctagttttctatgtgcacgtttttcaaaccattaaatgatatgtttcctaaagaaatttatgtgaaagttatttaaaaaaaatcatattaataaaccatcatatttttcgtgcgtacttcacctctcgaacttagccttagatgggtgggcttagccgtctacgtttatttttcttaattggaaattggaattttgtgactgaaataagaatttacaaattagagttgtagtacgaaacatggtttgtaattaacaaccttcttttttatgtgatattaattttgtttctgcactagactacttatttatgacagcatatttctcgaacggttgaattgcgtttcatgaaaaaaaaattaataatttctttttgaaaagaaaaatcgtattgcagtctcagttggactcaaatttcaatttgagcaagatagataaccatgatattttgcgaatttgtattcattgcatagttcagcacaattaccctgaggtggaatagaataatctttggggttttcggtaataaagatactccaagaagcaatttgatgctttgtgacacaagtcagtatcacacgagccaataggagccatcaaaccgttggcactgtcttatgtattctaaacatggtagtacaagagaacgacttgaaattcgcttccattggattacgttttctcatgtcagcttgagcattcttcttaattttcttgcttaattttcctgcaaaaaccatgtccaacgaacaccccagttgattaacaacagggcgtcaccaaccacagggtttggtgtgtccacctaattaatcttcctgcagcattgatttccacgtgccggctaaataatccagcttttggttgtttcaactccaagcgatgtatatagaatagtcgccaggggcccttcttcagtctccacgagtatttttttaagtaaattacaaaccagttttggagattttttttttcactttaggctaggcattgttggcaaatattgtattttgggccaggtggcctatctgtaagtgagacacaaggacgggtgactatgtctcattaatatatggttcacccgatctaaagtgtaattgtaaaaatagcaaatccaaaataaaaagatgtttagtttaaggtggtcaaagtaaattttggtataaatgtgtgccataaactacaatttttttttgcgttgggctgctttctaattaagttcaaaaagttatgatcatatttccttcccaaaactgatttcgagggttattagtgaaagaattggatccaataaatcccaaaagccctgcgttagttttggagttctcatcccgtatatttcgctatgtggatttgagagctagagagtgatccccaccgactcccagtctcccatttgcgtgcttctcctctccttccccgcgtctcttccctccttcccgtgcaagccgtgaaaacgcaccgagaggatcgacggatccttttccgtgcggtcacagagagaaaaaaaagagatttttgttgttagtttaataaaaagggctcacttttagttttgggattatatttaagctttttcttagtttttttacttactattttcagtttaggaaacaaaaacaaaatttttgggtgaattatacatattcttttggtgatgctcttaataagttgaagatccgtattttttattttgtataatcattatttgtgttctttgagttaaaagattaggcgtcgttgcatcgagagaattttaagcatttcaatcactgagattttaaataacggaataaaatttctaaaatccatttcttatgcccttattcaataggaaagcaaacgtgagcttctagcttacgttttcatttaaagtaaattacgttcacggtatatgaacttgtgctgtgaataaaaatatgtatatataataccttgtaaattgaccatttcggtatagtaacttggctagttcataatatcatgatagcttaacgcatgaccggcctggctaaagagacccacgcaaagcaaacttgatgtaatatggtacacattaatatcatgatagcttaacgtatgaccatgttttaaagatcccaagaaaaagatcaattagttgtcctacagaactatattttcatgttcagaacagagacaatttatttcatgtcttggaaaattttgaacctctatatagctcgttcaatgttgttcaatgtaatataccaggatggtttatgtcatgcgttaagttaggacaagtaactttgggaaaaaaatattttaattttcatgatcaatcactccattttcattgaaaatttatttttgaaagtttatttattttcatggtcaggtatttttaatcgttttgtttcagagtcggtttaaattttataaatttcgtgcgaatcataactaaacattttgtcggtctaaaatttgacgtgtaatcaggggcgttcctacatgtatctacccggtgcttatctatttctaggtgttttaggtcatattaagcattatattactaaaaaattagcctataagcatatcaaggacccctggtaatttttttctgggttcgccactgcgtgtaataatagttacactgcaacgtgtgccatgttatatcacttttgcttgcatgaatcgttttggtccagattcgcatggattagccaagttattgtatcggaattagcaattttcaagctattatacccattcatgcagccaccacgcaagttcatgtagcgtgaagataatttattctttcatttgctttgagaagtccaaagcactatttcctttttttttactacaatttcctaagtcccttcaaaatccctggacaatggagataacttgaaactacaacattgcattccaagttagggttcaatacctcatggtacatgactaacatctggttacatagagagaggggaaaacaaactctatttttttttctcaaccacatttacataacagaacttgtgtacaaattaatcaaactattaatgcaggacaattttgaagtgtagttatgaacacataatatatgttcatttaccaggcaacttttctaaactggcaaaggatatctaaagctatactgctaaatcattctaaggttttggctaacaaaatcactacttttatacttaaaggcaaagacgtacagagatctatcactccagtgtaaccaaagataatagaataagtacatgatatgggggcaaattcgtaccagacccaaactactttctccacacgcgaagatcacatcttacacttggacaacctcaattagcattgtggaagatgttttatgggcgatattcccctccaccaatcaatttatagtgccacaacacaagctatatatattatctgttttcaaaagatcatacatgactacatgttagaatcatgaaaatactataggttaattgagctaaggccatgggcggacacaccatgggacataggggtacgcttatacccccaaaaattttttagaaagaacccatcgtatagcatgcatattatggatacatatacttgaaccaaaagagcactttggcataaaagcaagaaattaatcttgccttgaattattaagtatacattacttttgtgaaatctactatctatatactactactgaatatatatgctaatagttgtatcatatttagttatgtctcggtatatttttaaactttgtacccccatcggaaaatttctgcgtctgccattgactaaggccagtgacgaacaaaagcttcgtcttgtagtcacttaagatcaagctcactattacgaaatatggttattcacaaccactagtctcaaagcttcacttaatacaataagatcttattcaccccgagacaagtaaaccctcctcaattgcttccttcaatacttcttctctgagtttcttaatctcatccaatgtggcaactactgaagtagattggttggctggagtagattgcttttccttggcagcacttcgtttatgtcttttaaccactttcttcaccccctaatgaaatttgaaattaaggtagaattaaaaactactatatatatactttaggaatgttattcctccatacattatataatatgaatgcttagcatggttcctgtcctggtttggaatagactggagcttttttcatagaatatgttaacgaaattatttgtctaaattcaaacttaaatttgtaatcagaatcagtgcaataacgttttgaccaaccttgtttgtgttttatgcttatgcagggcagtcttcaaatcatttacagtcacatcaggtggtccatacttcacaagattttctgctataatatcaacaagcctgcaccacacgtacatatttcatactcttttggattacaaaataaatagatctttgagataagaaagaataacagttagttaatcttacatttcttcacttagattagcagttttgtttatcctcataacattcaatcaaggccagctgaaaaaaaatacgagttattacatgtatatatattgcaaaatataacatcagctataccatagaaaaacttttactaagttctgaccttaacattcaattagaactgacaaaattagccccaaactacaatgttgatttctatattatcaatttgggcacatgtttggtcttatattgcatttggtaacgtgtgaatagcgtaaggagagagacacaaacccactaaaactactaacaaattgaggatatgcgtgcaataatagagaaacaaaaggcaacaaatgcagtcacaagcgaagatcatgacaagttaaataagcacacacgcataaagttttgtggtagcattaaatttacatcactttgccatacgaaacaaaagggtacagttcaccgtgcagtttgagtgttctagttgcatcacttgcaataaaaattaattgatgttgctgggatgcaaacgcactaggtatccaaatacccacagtctacacaacacacacgagaaacgtacatccaatatttacaataatcataagattgcctactttctattttagtacaaccatggcatgcatatagtttataggcataactgatcacacataacccatgaagtagggctgtcaacgagccgagttcgagcaagatcacctgcctaggctcgagctcgatacaagctcgagccgagcctataaaatgcttgagctttcaaacagactcagtttgagctcgatcaagtttgagcttgactactaagcttgatttgtaagtacaacaatgtatatttcaaggataatctttaaaaaaacaataatttctaactcatcatattaatagaagaagaaaaagaataaaataaatatataacaccaatataagacatacaagttacatatttaatatcctaatttattaaataacaataaaaaacatatattattggaatagttagaagctcgagctcggttcgacaaagctcgcgagctttgggagaggctcaggctcggttcgtttgaagctcgagctgaacgagtgattattgaacctaggacctaggacgagtcgagctcgagcagcttacgagcctcgagctttttttgatagcctatcatgaagaaagctaccatgaaccacttaatgcatgaatagcaagaaccataatctgaacatactcaatcacatagatatgtaatgaaaacaaataaacaaagcgaacaatccattcatctcacacaatttaattagtttgttatgcacttgcattaacattatcagtaactcacgggtggcataaaaaatcctcaactcctaaaataacaaaattacactcaaattctcaataacgaaagactttgagtgttaaattttatccaccaatttaccgattaaggtctaagcctgaaatcaggaatttataataacccgtcaaaaacatgtcctcgctgttttattcataacacttgaactgctaaaccaaatttagcaaaaaaaaatacatatagaacatctacagaaaattatctacaactttcctatccatcaaaagttataatttagcctctatcactaacagatttgtgccatgtagggccagtttttgttgtatcattattgacagattttgtttaacatctacagaaaagtatcactgctttttttttctcctaaaccgcttatctgaatcgagtgaaacaagtgcctatagaaagatattaacatgacctacaagtgttgtttggaccacatgacctgattcccttactctttaattaatccaagaaatcaaaagaatatttcggactacaatcgaagaaatcaaaagaatatttcagcctacagtcaaaagattaaatttgatataccggcaactaaaactgtatttctacagagactaggatatatgtaactggggactatttgaggatacccttgtagtgaagaaccttaatttggaccactccaatgaactacactgtggaatccctaatttcctcttcgtcttccttttcttcgatctgtcctcttctactggtgagatcagaacagcagcagcaacgaacaggagtagattagcaggcagaacaacagattggtaggggaggatgcagatggcaatagcaaagaagaaactgacaacgcgcgatggtagtggcggcgccgcgcggcagtgggatctcaaggttttttttttctttttatagaaaattcgatccatagcataggaaaaaaagcggtaccaaaaaatagtataaaaatttttcgctttcgattagaagcacaggccacctgtttttcttagctccatagtaattctgtcaggtttagagttaacagcattagattgaagtatagaaaaattttgttggacccatttgcccttcgtcttcctgtgtcatctcgtcctctcggaccggtgcccacgacgacggcgccgtcgccaaattgcgacgcggcgatgatccccgtccccatccccgccgccgccatccccgtccccagccgcgcgccattccatgtccctgtcggctcccgtcccgacgacaacagcagttgtaggaagctgtacgagccccggctggtggccatcaggccctaccaccacggtcgggacgagctccatgccatggagcagcacaagtggcgcttcctccagcgagcacccaccgtcccgctctccgacttcgtggacgcggttcgggccgtcgagcagcgtgctcgctgctgctacagcgagagcacggccatcttggacgacgacggcgacggcttcgcggagatgctgctcctcgacggctgcttcattctcgagttctcggcgaagctgagccgcgcgaattagtgcacttgcaaaaagctaattaggatttaattaattagttgattaatttgttggcgctggcgccgccgtggttgcagatgctcccgatggccgccatctcatcaccgctgccctgcggagacgacacgagcgagctgagcgcggagtcgaagtgcgccatgcactccgccgccgccggcaccatcatcaccatctgttcagccgccaccgcccacggcggcatcatcatcatcgtcccgtacgccgccacggctggcagcaatgcgcccgcacccgtgccggcgccggacgaggaggtgaaggaggagaagtagtagcgcagcggggaagaagtgctcgtcggccatcatcgttgtcgtcgacggcgtacagcggcccacatccatccacgctcgggcagtggcggggagacgaggcggtcgcccggcacgccgatggttgccgcgccgccgtccacgagggagtggaagaggagacctggtggggaatgtggggagcgaagggcaaatgagtccgacaaaaattttctctactccgatctaacgccgttacatcaaaatgcgacggaagtgctacgtggcgaagaaaaatcggtggcttatgctatggatcgaaagtggaaactttttgtgctattttttggtaccactttgtttcctgtgctatggatcgaattttctctttttttttcccaccgtgatgagcagctatttataaagtggataaagaaaaatccgatggcctacatcgatccaacatccactattacatgcaaacacttggtaatagcaaaattgtagcgaaattgccaaactttagttattctgttaggttttgttgcttctggcccatatcgattggttgggctttttttaacttcgaaatcaaatctgctgcttggatggttaagcctgtttaggacatgggcctcatagagtataaaatttttgtgtataaaggttttggggacttagctatacatttgtcatcaaattttaatcaaaaaaatttgatagatatgaatcaatcaaaatgtaattagattgttacttgcgatcccgactcccttggcccaacagcgatggacgagggagagatgaggatggccgagcgacaccgatgacgatgaggccccgcggtggcggtttcgcggtccttcggcccggccatcttcctctctccctcatccactgttgccgggccaagggagaccggttccaccaccgccgggccacctcgtcgtcaacgtcgcccagccatcttcctctctccctcgtgcaacagcggcaggagcggtggctggccctagggctatctcgttgcgaccggtttccaccctccgttgccgatgccgatcgacgctgacaactttttatgaattttgtgatgtgtgggatccttttttttttaattttgggatggtggtgcattgtgaattctgatatttggtatatgcaatgtgaatgtgactcatgaattcattgtgggtatgatttgtgagtttgggatttgttattgtcatagttgaattcattgcgattaatttgaggatttttgcaaatgtactttttgtattttatttttttcaccaaaaatccttatcactggcggctgcattaatggtgtcgcatgtgaaaatctttttggcatgcggctgatcatccgccagggaaaaggtccgcaccgcttgtgaaatcttttttcgcacgcggttggctatccaccaatgaaaattctctattttcattggccattactcgcagctgccagcgaaattctcttttgaccgctagcgaaaatctttttcgtagcagtaggcccttctaattttatttgtagcttaggagttctagagatggatttgttggttatatcaattcagattttgttgaagatttgaacagaacaatatcacccacatgttatgttttaactattggaagttgtatggttagtgggtagattagtttgcaagcaactgctatgttatcttatctactatgagtgtggttatttctgaagcttataaagaactattttgcttagaggtttgtacattgtgttttatggagataagtcttaaattaatatattttgtaatagtcaaagtgcaacatgtcttatgttttacgagataacaaagcgtatagatattactttattcgagatgtcattattgatgatgatatcaagatatttaggaagtattcactaagtttatgcttttctcaaacttggttagtgctatagttcagtcctaatgaatatttactgtgcaatgattttacctacctgagacactttcggtgattgatgagttttacactacaagagtaaattcatcttaaagtggaaattgttaaatatgataaccaaattttaactagcaatatattccgattagttttcgggtagaattttatttagttacgagaatacatcaatgccggtttcaaaaccagcactattgatcccctcatcagtgtgcactgtagtgacagttgaggaacggacactataaggcttcccaactaacactaaaagcattttctgtagcagtagtgaaatcttccttatatgattgaactactggcctcatcttttcacttatacttatgcttatcaggcaaaatttgaatttttaactttaaatttagagctgatttggaggggttttttttcatcgaagttaatttatttttcagcctttgcttttagattgctaagaccacatatataaaagttttattcacaaactactattcatttgcaaatattccgtttcgcttgtatatgctgtagtacaagtgttaacgtagaaataaatttgattttgaatgtagactgctattcatccatatctaacattggaacaacactagctgtagctctggctctgactgcttccgatggtcgatcaatatgctactgatatgaataagaaaatggacatttggccacattcaaaacacggtttcgctagaatgctattccgaaaacgtgtttcattaaaatgccaatatagagcgggcgctcactgccactttaccattttagtcgttttgtgcatttttgaaattattttcgctccttcactaggtaatgagacgaaattgcccttccaccctttcgcgcgcggcaaccctggtgacggcgggtcggagctcgaggaaggcggggaggaccggatggccgacagcgcgaccagatcggcatacggtggcggcgaagcgagtccatagcggcggaggcccgcgctctagctcgccatcagctattgttgcctctccagctccgcgaacccgatgctcaccgcgtctccctccgcctccgccgtaggcatggggcccacctcaaaaccctagctagcgccgccgctgccactcgaccccacgggcctccgagataactccggcggcggggttgtgtccctgctcaccgcactcaagacacaccggatggttaattttgtctcaccacccgacggatgagcgaacatgatttcgaaaatgcacaaaacggtcaaaatggcaaagtaacggtgagcgcgcgtttcatattagcattttaacgaaacgcgttttcaggataccattctagcgaaaccgtgtttcgtacgtggccaaatgtccattttcttgatgtgaaccagtgcatgaacctgcatcgataactttttcaagtacatatgtacatgattgaataggttgggtacaataagaacataaaattgagtagttaatttatattcacgacaaatttgcttgacttgactccataatcaagcattgatatgtatctgatgctgacacacatgatacctggtttcgttgaagaaaaccattagcaagctaggttgtttcttggtcgtggcattacttagatgtcctatgtcctttgagaaaactagcttcctagcttggatctattcataagtagtcatatgagtaacatcattggcccttttgttttagaaaaatcataatgcaattggtaagatctgagacgtactgctccctcctgatcaatcctgctactactatatatgaaaacatgtttaatcatgtgacgttcactctctccgctcggtttcatctaggtttcagatttgattcctttttttaatagtaaacttggactcccttgtccaacttgatgaagaaaaatataaatttgtcagacaacttgtaatgtacggaccgcatgcatgcgatgtcgtaattaaaatgggcctgcatatatatatatatatatatatatatatatatatatatatatatatatatatatatatatatatatatatatatatatatatatatatatatatatatatatatatacatataccaccatgcatcaatgtgtgagttaattaattatctcccatgacataacacagatcatgattatggagcgagagcgacaatggccaaaatcggcagggacagagtcactcctgttctctcttctccactccagccttccagctcagttcaagaccggggatggagtaagcaaaactccatcctattcagtccaatgtattatatcctttttacaatgataaaagtgtatataaacccccagcctctacatatatattgtaatagtggtaatgccaactgccggctaagttatatccatgctatccaaatataacgctcattatcgatagattacctacttaaaaaactaatttaatattttgccttttgtctcacatctgaattaattctatatctttctagaagtacatataaaactggccctttaataagagccaacactcattttccttgcgccgtgtttagattcaaaattttttcttcaaactttcaacgtttccgtcacatcaaatgtttgtacacatgcatggagcattaaatatgaacgaaaaaaccaattgcacaatttgcatgtaaatcgcgagacgaatcttttgagcctaattacgccataatttgacaatatgatgctacagtaaacatttcctaatgacgaattaattaggcttaataaatttgtctcgcagtttacaggcggaatctgtaatttgttttgttattagtctacgtttaatatttcaaatgtgtgtcagtatacttaaaaaaatttttggcacacgaactaaacacagccttggtctctatcctcaacatgtgaaagaagtgatgttgttaggaaacgataggcgaacaaacgataaaaaacaatagatcaatcacagaagacacgagatttaacgtggaaaaccctcccaaaacaggagagaaaaaaccacgggcgccagccagcaaaatatcttcactatatctgatgtgaggttacatcgccgcacggcggcttacaagaggtatatatatggtggaaccctaaaagggatgatgattcgtaccgtgggggctccgcccccgcacccccgggcgtccccaggtgcacagcccaatgggccaacttttgccttcactccgctacggcagaagctagcctttattaagtgcaaatgaatttggatcacaactcaacagatgtaagcatattttattagtaaaatgacaaatagccatttgtcattttctcccagcaaccaacattgtctcctccctatgctcaatccaaaggtctttatcacaaagggaagctggcctttgggctgcagaggctgtcatggcgggcatagtggatttcgaagagggatggcgcctcctggcaaccagcctcgccaagcaaaggagcatcatcgatggtagcatgagcaagagctcttcagaggatgacaacatgcagctctacatgtatgtacaccatgcctacctcatatagtcttatcatattttcttggctttaatttgatctgatctagctagtttaatctatctaagtacattctttgctttgtgacaggatggtgtacaacatgtgcacgcagaagccacctcataactaagcacaacagctctatgaacgctacaagacggatattgatggctacaacagctctatggtatgaacttgtgtttgtgctaggtgatggcggagtactcatagtgtctttccacatggttgtgtgagatgatcgttgtcgatgggtaattaatggtgcaggtgttgccgtcaatgagacagataaatggcgagactctattgaaagggttggttgacaggtggcggaaccacaagaaaattgtcataagtgagacgaggttcttcttctacctcgaccgttactacatcttacggaagtcacttgtcccacttgaacaactgaacttatgttcttttcgtgatcaggtacgtcaacctctattgtttctcccgtcatgtgattattttacatgagtgtatgttattagtgcacatttgctgtgcttgatttggacatgccattgttgtgttcctttttatttgtgatatataggtatacagtgagctcaaagataaaataacaaggactgtggttgacatggtgaggctcttgttctgttctacgatttcttctaacacttctgcacttttgcagaggtgaagcgatgatcattaattttcttttttctgctattaatttccttgatttgtcagattaatgatgagagggatggcaaggttatagaccgtgatcttttgaaggatgtccttgatgtgtatgtccagattgggcttggcatggagtgttacgaagttgattttgaaaatgcgtttcgcgagagcacaagaaattactactcaaacaaagcccaaacttcgattttggagtgcaatggcgctgattctcctgaatacatgcttaaggtatccattcagagttcatagaaatcatgcatagatatagtctgatcttcttgatgaagtctgaaggatattatttaattagttgtgttgtttccacaggctgtggaatgcttgcaagccgagctggaacgagtgtcacattacttgcattcttcaactgaaccaaagttgatgcaggtaagtgttgagtagtggtttgtgcaatgactttctgttctaccatcttttttaatattatactgagtttcacataaacgcatgcaggatttgcaatcagagttgatgattacgcccgtggagacgcacactgaagaagctgattaagttattttcttgcttcaaaggaattgtactgttgcttttccaatttggttcatcgtagtaaactctgatgcaagtccgtttaactaatttggattttattatgggagttgcagattcccactaagtatggatgctttgtgtaattgttagacttctacagtaattgttatgatgacggccgagaagaactgaggagaaaattaaataggggaatcggggagaagcaaaagcatttcagtattttctccaccgttaacgatgtgtttggctatgtttgttttttatgacggagtgcaaagactctagtcgttgaaacaggaaaaaacatggagcatacttgttaggagctacgacttgcagatcacgatcacgcagagcgtaggaatgctcgacgggaggacgaggtctgtaacctcgccgccccggagccgtgttgagaagacgaacagaagaaggtagaaacagagactcggtagatgaatataatttcttgcttgccttcatcctgaattcctggctctaaatagccttttacacttgaactaacatttgctaaaattaagggataacaaactacttaacaacttaatctcaacagaataatctaatcgccattttcttgcgggactgttgctcgtccggcacgatgttcgctcctgtcccggcgtctgcggaaggaaatgttggaacattcatatttcgttgcttacataagagagaacaaaaaaatgcatgcattttcgaggtttgtttacagcatagtatataataactctaaacatatgtaactgtcccaaatacacttcatctgttcattcaaatttgttttttttttacttttctcaaaaaaaagtttataactcatacagcgtgcacttgggcacttctctaaaagtttaaaatcaggaaatctaaactacaccaaaacaagattttctttccttctcttattcatatattactatatttcaatgcacatgcatccctttttaaatcctaagagaatttcataattaatgggctaacaccctttggggaaaaaaaaaggcttccgctgttcggtccggtctcttgctgcttgtagcatccatcctctcttggctggctgtctgtggaccatgcctttcaggctttcactgcattgagaacccatttagtacaactcctactctaaccaccctatcctaatctatactttctttaaagttataacccactaactctaaaacttaacatgtaaccatgccacatcatcacccactaataataattacatattcaacctcatgcaagcatgcaagagcatctacaatctatttaattctacaaattaacatgcaaacatattcaatcaccatctctcacatcattttcacaatagttttacaaatctctctatcatttttataatatttaatatatacttatcaaaatgttctacattaaattgtgaattttatttgtttcatgataaatattgataagccctgagatttgattatttttttctttttactcctagctgaattgtaataaaaaaataatattaaaaattacttagtaatttctatagcaaagtgcggggaatcccctagtagtagtaatttttaagaacggagtgacagctctactctatatttaggatcttgaaaagtatttggtacaactcaaatttcacaggacaaaaaatctggagtccaagctataccaaacgagccctcagttccatagaaattgaaagtttggccttatgatgatggaaagctgcaagttcatagagtttttttctaagccagctcctttcaaagcctagcacttttagcgtggataatgatataacttataagagcaggtacaatagcaactattagccagctataaatatattttaatgagatagaagataagagagaagagcagtgggctacagatctgtagccagctgcagcacggactccatgacacagtatgtgtatgacaagtgggaccatatattaatagtatcttaaacaactattgtatgaattggctattagattggctatagatgaattggtgtcaacccccgattttggaaatcgaaaatcttctgtgtttattagtaccagtctctggatcagtagttggtacacacatacatagccgaatcacaacatatcacgaatgaatttaggctaagagagttaaatgcttacattaaggccaggtaggccaacaactatcagagaaacaacaacggaagacaaaataatataagggcccggttgacatgccacaagcagtcgactggggaacgagacctagaatggaaccgcactccggtcatcttgttaggtacgcaagcgtactaacaagggcttctcttcaacactctgctaaaagatatatagagagcaacaatgagtacaaaagtactcagcaagccaccatacaaaatgcagtaatgtacaggataatacaaggagtggctatggttactttgcataaagctgagtttccaaatatcatttcacaaacctaagacctagcataaactgatcaagttttaattccattgttcattaaacagcgacggttctatccaccatctattgtgttcctaaggatagcttcccgccactggtcgtcatggttttctggggtctaccccttctcgcctctcgagaagttgatccaccggtacaaaatcatcatgcatatcccatcccattcagattaagaaattagagtctagccaagtgtaatacgcgtctcggtgctcaataaccgcgagcacggctattagaatagattgatttactcacactgcagtggatgtacactttacccgtactccgcgacttgcccaacacatgagcctacgtgtaacatactagatttttcagggtacaatttttgcgaaaatatttaaagttgttgttcttcgttctttcgaattggagcctcccaatccttatatttctttagttccctataagtttccgactcccacataattttgtttagtttctctctccaaaccaaatctgagatatccagagaaaattctcaaaatcatcagaagagcttgtgttttttttaagttaaaccggagtcatcatgcaaatgttctaagatcccaaatcctatcaattcctattcaaaaatatcctaccaaaattccatacaaaaatctctccaaaaattcaaatagatcactgtgttacttctcaggcagagttccttgcaatccagtccatattccaaatttcctttcccttgtctctttctctctgttgggccattctagctcatctcctggcccagccgaggcagccgccccaaccaagccgctgctcgcttcactcggtccagccaccgctcgcgctacgcgcgcgtcgcctcgcaccaccctgcgccttgcttgcgcccgcacgcgcttggcccgcactagccgcgtgccgccttgcacctgcctgctctgcgccgcatgccgccacgcgcgcgacacacgctcgcttgaagccgcacggaggaactcgatcagatggtgtagacgttgtcgcacaaatcttaaaaaccgagcaagcaccactgctaccgtcaatctcaatctcccactgcccaactatttaagcaggcaaggtagccatgctcatccttttacccctctctttctcctttactcagaaaggaatcgagttcccaaaatttcttcaaactgccgtggtcgtcggcctatctgtcgccgcaggccaccggtcgtcgtatcctcgcgccaccagactcttccagagccggtgaggccatctccttttttttcccctcctctccatgcttgtactgaggtcctcgcatgctcctgtctgccaccatggctgccaccgtggtcggcatggccgacgcttcatctctatcaactaaccaaaaaaatggaaccttctcgtccgggaacacgttttgacgcgctcacccagccacgttcgccaccggagctcgccgctcaatcttctctctccttcggggcctaaatcctatcattcgcgttccggccggcatgaacatcctctctgagaaccagcaacagcttcgagttcgcagtacctgggaacgaaattacctcaagacgttcttgctgttccgccacaataaccatcatccaggttttccctttttacctctcattctgtctgtgttcgtggttgacagaggaagaagaacagtactagattcaatactgttccaccatggtccaacctgaccacaccacctgagccagcccagtagttgtcaaccaaaagaaaactgattcatatcaattcttccatcagtgatcacttccagattcaaacccaatcaattctagtctttatctctagtatctatagcattaatcccaaagtgcaaccatactacacataccatcaatcataactctaggataaatcgtttgccatccaaatcaagtcaactctggattattattttcttttgttcgggctatgattcacaatatttattttatcgtttatttgtagtatttttattataggcttatttggtcgtttcttcgtgtgcgtacgttagatcgtattgaaaatcccaccgggcacacaggaactgaagtggacctagaaggctacgctgaagcttcagaaggccacgttccacaaggcaagccacagttccaatctttgatcatattgatacctagtagagaaccacttagttattttctgcattgagtatttataaaattattttgcgtatgaattatttttgaataaacttgttagtttagttattacccattattacattgttattattggccaaatccatggattgctatatcacgtcctttgataacctaggtgtagatttatatacttcacaataatattctagtggataagaccaccaaatatctatactcatatacatggtttacccgtcatcacgtggtggcgtgtcgggtgatataaaatgtgttatttgatatgagtcactcgcctggagtgatatggaagattaattccgggtgaagatggatgttgtggtgtctgaggccgtgcatattgttatattttttttgtggaaagtgtatatttacacttgaagtatgcacgggcctatgctagttttggtggctttccccggatataaggactacccccttatgccatgaaaaatgatgtaatttgcgcccatatacatgactgagtaatcagacttagcctagtacatttgtcccactatatgaaatactgtagggtggctctatgagcaggtttggggtggacatgtggaaggggcttcggccaggttgacatgatccgcaatggtggaacccgtgaaagcagcgaccgtctagccttgcttaggcccagcaagtgcccgactactaggacggatcaatattccactgggcagtaaccagtagtaagtgggactctcgaacggctatgttgccctcagcctagctagctgttgacatcaggtgggtaaagctgggcagtctctgcagagatgagtcttaaatcattcgaatgtgccgtgcttccggttaagaagctatgtcattgggtgattcctatttatcatggtatgagtagattttaaattaaaatatggaatatgataaagatgaggatgaatggtgattaatattgctattattttaaaatgatgatttacaattgtttgcaaatgaaatattttacaaagtagggaaaaactatttataataggcttgttatgaaacctccttgatgactatattctttgtacgccttgcatatattctatttgtattattatgggtgtggcttgctgggtacctcggtactcacctcttgcataaaatgtggttcagacgatcagttcttccctgaggaggcgcaggaaggggaagaattctatggtgctgacgagttcttgttctaggtcgatttgctctcaggcattgcctgtggtgtttttatcctattttgtgtttgggtcttttgtttgtagggagtgtgtttggcttgtcggcccctaaaacctgtcttagttatcttttatgtaataatttctgtaaaaacttgggtatatgtatcgaaagctgttctgtatatcaatctgtgcgcgatcgaaatcttggacggtcgcgggtggtttcgggataccatactcaaaccgggtatccccacactacgtcccaatgaatgagacttgccacgacaaagcctttcaataacctcactttggcagtactcgctccatgaactttagtcctcatgcactctaggcgtccaaggtttctagcactgagaggagttctggcgctccccagggggaaagattcacacattcattaagttatagttaagtttaggtttgcacatggcagtcctaccgatggtgacaccactgtaggcacccgcccctcgcggtcctaccaatggttgccccaccgtaggccctgcctcacacacaacaagaaaaccactacggcttgggtaccgcctccgctcggctctttactccgctaggtctatacccacacgagaagtacggttgtacgggggtcgtttcatgcttaacttcatggctcggtccttaattgaccagggacggcactagcctttaccggacaccacccaagtcctccagccgccccagtcgaaaacagttgtttagtttaatttttcctttcacaaatcatgtggcgctcatgtctccacatgtcgtatctcaactaccttccctagggtagttgcccaagcatatagcatttgataaatatgagaatgcatgattctaaagtagcactactaagcttttgtcataattgactaaggactcatatgtaatcatgggtacaagaaaataatgagataagcaataatcaaaggcaaggcataataacaagtaggatattcatcattgcatgcaattttatttgtaaacaaagcaatttcgcaattaggatcaacatgctcaagggatggggtgatgacttgcctgctcaggacaatccttattcttgatataatcttgatcaaccttcacctcctggaagctgcatacgctgcctcacgactaaccgatatacagattctataatacgcgtgaagaaccaatattcaaacaacaatcaaatatgcacaaacaaaatataattgtcggggtcgaacctagggctgttcatactactcgtgtttgcaaacggataatctcataatcattcttattgtcatggcggcttatttaggagctaattatcataatataaatgggatacacatttcgttaattcggagttgatctatctattgagttatagaagggatatgaccacatatatatgcttctaattagtttacatgggttttacagtgataaagcatgttaaagagaattattcttctacctagtttactgtacagtaccaattttatttattagtacatttttaggtcaaccataatctaatcatttgatattaattatgtaacaattataaatatattttattaaacagttaattatataccattggaaagcttatgaatttagatgaattttaggttcaagtttcattcaaattggagttaaaatgagtaagttatgctagtttaaatatccaaatttgaataatagcaaaacaatactgttcattaccgatttatttttattccgaaatccatctcattcctaatagcggctgacaggtggggctccagggttctatttgcttttcaccgtattatttttcttagggaaaaacaggaggtgggcccatcctgtcatcggctcggctgagggaggtcgtcttcaacctccagccgggcagaggcagcgcgcatggcgcggctgggcgcagccgggatggtgcgaggccggcacggaagcggccggaaagatgtggcgaggctccggcgacctcccgccggtggcgacggctcgccttcctcaccgctcgcgtgctgcgcgccttcgtcgacgcccgcaaccgcgagtagttcctgccgagcaaccggtctttccgccacctcggtacgtgttcgacatgttgcgcatatttgatctgttcatgttttactgcttagtttacatgtgtagatctaatgatgcgttcaatctagtttacatctgcaatgtcatgatttatttatggaataaattaaatcattatgtgcttataatttcaacagaagtgaccttgagccccccgactggtttgaatcccagtcagagagagagtttgttggagtattcggtgacgaggaggcaaaaaatctcccaaagcgaagatgaagcgagtgactcacgaagttgattccatcgcacttttcgacaggaaactcgacgtcacccctacctggcgtgccaactgtcaaaacatgaattcggcaataataaaagggggtagcgcacgagacctaagagtggatggatgcggagacaaaggatttagacaggttcaggccctctcaataagaggtaataccctactcctgtttggggatttgaatccgccgggtgtagtatagatctgacgatcatatgtgctcatgccccctagagagcctcctgcccaccttatataggatgggggcaggattacaagatagaaaccttaaccaatatggtatcggtttcctaaatctaatttacaatcttatcaaactaggactttaggccgttccataatatacagggaaacgtagtacccaagtcatgatccgttacatattccatagatataagttatcccctataactagtcggataaccgtgccgtgtgggtatggggtacccataatctcaacaaatggctaggaggagctccgggatagcatgtccaacgggagcttgtcggcggcacaatggtggccaggtcagcacggctatagacactaattgcacaaactggagctggcgctagttattagaggtacaaaggatgctacgggcgtgagagtgtaccatgagaacgcgagacggcgaaaagcggcggagtagggctcgatgtgtcgcagaacataggcagacagcattgacggtgcccgaaagtgctcgtcgacgttccttgcattaacgtccaacctccccaatggcgacgacggcagcgcggctccgcctccacttcctccaacctccaactccggccggggagaccccgcaatggtggtttctagtagcggtgagatcatgcatggaaggtgcttgatgaaatgtattcgggacgaaagctgagaggaatggggattttactgggggcttagcttagggtgtaaggaaaccatggggataagatcgccagcacatggcctggatgagctagagctctaatggcgatcggataagagcaatgaggtggatgacgcgactaaggttcatctccttctccattaaggttctatggctccatcattgtgcctatagcctatagtctgcgagttttagtcctagctggggaaggggactctgttttatccactagacataaagaggggcgccgagacatcattggctgtggataaggtggcggacgtggccatggcgacgcgcgcacatggaagctgtggcggaacggcggcttggttgggcggcgggcccacgcgggcgctgtgcgccgtggtgcggtgcacgggaggcaggtgtgaggcggcatgggcgttgctggcgcggccgggagcgatgtggtgcacgcgatacataggatcgaacggttggcagacaatgtacagtagcgcctagaaaggagagaaaaggaagaaaaaggaaaaagaggtagagtggaggggctaaaatgcaaaacagttagaattggattttgaattgagatgtagctctacacattttggatttgagaattcaaatatttatttgaatatttatttatttattcatatctctaccaaatgattttacttcccattagatcatcagaaattatccaatatacttggaggctttgatagttcaaaaattaattaaaatattcaatgtgacaatttatggtttggcaagcaagaacaaccataacatctagcatgatgcaaaagttttaaaaagtttgaaattttagtgatttttattatcagggattttcaggatgttacaattggagcgggccaataggttaaggcccacttaatcaagactagttatatttatgtcttaatgtttagttttcaacacatgaacaatagggtaatcttggtgtctagaaaaagctgccacataagatttttgtaacgtggaggcaacagagagcagggagaagaaagttatctaatgattatcagtctaatagacagtgcagaaatttcttggccaataacttgaataggcaacctatcaaaattgtattagttgttagtgatcatttaaaccattgtttgtaccaattagatggggaaaaataatacaatggttaaaaggcaaatgttattggcacatccgttcttcgttgggtttgatggcttacaaagatgatactccctctacttttagaatgtttgacatcatttacttttgaccatatatttaactatttgttttattaaaaattatataattattatttagttcattgcggtttctttatacttttttatgtttacatataatttttaataaaacaaatggcccaaaattcaacaatgtcaaacattaaaaacaggagggaatattgttttctataagtcaaaatttcatacagattctaagggaatatattcgctaggcttctgagcatagctgcaaaagtatgatgtatacaaataagtaatgtgtaaggaatgctgttctcttgagattatagtcctacaaatttttatcaattatggatggaaatttaataataaagttcgctttgatgtttggttcatctatgttttctatgtcggtcttctcatcatgacgatgtgtgatgtcttagcttgataataactggattagtataacgaattttggacagaaactcttgagctaaagactgacatttatttccattatctaaaaatattggtaaaaactagttatgagggggcaccccaattagcatctcaccggctcaccgcttgctacaaatgtgcaagtagatgtggattgccggatttcttttttcataattttgtaggatttacatgcagatcagttcaattcacgcaaatgttggagaaaaaaaatatatcccccgtgttaaaacatgacttctgtcgatgtgcatgtggtgccattcctgaatacaaaatagaactttatggcacaatgcagcaactggttaatatcttgtcctgtaaaactagataaaaagggttgttgcttgagcctggaagtagaatctgatgctcgtacttgatggagaccaacctagcttacatgcgactgcgtttgagattcctccctctaaacagaagttcattttctttcataatcaaagtttagttagtatggccatgtttgggaagctacaaatactaaaaaagtagtaagttctagtacaatctagagaaaaagtctgcagtttggagagttttcttctttttttttttactttggaagtttttcatagttctgtattttccctagctttattgccaattttattcagaattttatttttattccttcgggttttcatttttgtttcacgtgtttttgtttttatttagattcgtgttttcccatcctattgtacctatattagttctcaagttatgcatcatccagacctaccattttttattttaaatatttgtattcgtcataaaactgtgacagccacacacccacaccactcgaggtggcataggaaattacagctgtgacttttgacaatgtcgtcattttggtttgcttgcttagaagttttgttttaaaaaagtatgttttaaaatttagattaacaaaggttcaaagaatataaaagcaaatgtcagaaaaccacatttatacttagcatatgacctacatattatggttcagggttttataaaactccatgttaaacatatggagcatatattttcttaaagtattcgtcttataaagtgtctataaaatttttagttactcatttcttaatgcatgtggttagggtaatttattcctattttgaataatattttttacatatgctaaagagttaggattctaataacttcttagtggttatgtgtcacaagtcataatccatgttgttctttttaactttgcttgtgagaatgctatgtaacaaattgccatcctgttcatgacggacgagataggccatcaggcaaccaacattgaatcacctattttctctccttctacttatctattatattgctcttcctctctcttatccacaagagcacacgtaatgccattgctcagctagttgagaggagccttcgtcacctcggatcaacgcggtttgggagaggggggctcccaaagagagagcacacgtaggcaagggattctctcttctctcacccttctattataatgagagggtggagacggcggaggccactgagtggcgccccaatgatggtgacaagcagagggtgcaggccatcgggtttggcgcgctcattgtggtagagaccatccggattttggtattgtttatccacgttgggtgagatctagtggcctccattttggctggaagtacacatttcactctccccttctcactcttcgtccttgccgcctatgacaggatgaacaaactttgtttacctttcttctcactagcaaagggattcatatccatctggctttcttcctcaccgttgatacctcgcaaatatctcatgataccttgcaagtattacctgatacctatcagtatactcacagatataatcccgttcaaggtatgtgatatagcagttccctaactttgaggttttcgaaaaactaattacaagaaaaaagaaaacttcttacaagtccctgtaaaatacacacaacctcttcttatttatccataatgagtcactaacaagtaagccaaatacctacccattatattatgagtaaattttacattgtgccacatattttgaccaagatttcataatggactagggttacattaatgttttcacctagcaccatatatctttacataagtttttagtttggactaggggtgagcgaagcaaggaatgtgagaaaatttacacagggatagttataaaaagcaaaacattttatgttttcttccttcttttcagtgtaagtggtaattaactattttctattttatttttcttcatttgtccctatgtatagatcattttgtatcacttttaaacatatttgcatcattattttagtgtgatttgctgaaaaaagttgttttgtgatttgctatttctttctaaagatatttatcttaatactatagaactaaaaatgattgatttgaactagcttttctctaataacttccattgatgtactcgtgcaaagatatgtggtgctaagtgagaaggttggtttggcttttgcccattgtgaaactttggtcaaaatatatggtgaaatgtgaaattaactcttatattatctttttttttgtttgaaactttggttaacttcatattaaactaactgatgtcaaaaaaaaaattgggaaggaggtagtaggttatcgagagaatggaagctggagtatcaggcaattttcagggtaaaatatgaattttacccttaaaaattttaacctggcggtcatcgtccagattcgttccttgagaatagttttactccactttgcttccatctgacctctttctctgctcatcctcccctgcctgtcacctcgagaacgccgggccgtccgtccgtcctcttctccctcttcttctcgcatcccgtgtcgtcttctcacttcttcccccacaacccacaccgacaaccaccaccactactgcgtgcccacgaactcctcctccctcctcatcccagtcgcccaatcattccacgcgacgtgaccaaacccccctctactctatccctccatctcttcctctcaattctcaatcttgcatcgcgttctcgattcaggccaggtagctcatgttgcacaggcctcttcttcctgcttgctgtttctttcagggaattctctttcggttgggttggttggttggttggaagtcgctgttcttgacgcgtttacttgggttttagcgaaagctgctactatctttttttttcttggtttctgacatcccttctctgcatttgggttcttgatctgattttatgcctggctgctttgcatttggaatgctttgattgttctttttttttgtactgaatttggttgcattaaaatctgtttatatgtgtactgaattcatcctctcagcttcccctttctttagggctttctggtactggatttgggtgtcgtaaatggctagcttaatattaccttagcatttagaccacattcaatgcacccgtactgagccatcttgcaatgctgcctgctaattttcgtagcatttccttctctctagtactgtatttgggtgttattgtggataaagttcctgagctttattccccaaaacccctctttttttttctctcctaatgtatggtttctcaatgcatttcatttgggggcagttcttgcagaccaggtgaacttgttttttttaatctccctccttttctctgatgaaattggttttcagggatgctgcattgaccgtgccgtttgctcagatctctatgcacctctggcatttcccctctcttttgtttattcgatttgagggggtgcttctccatacattctttgttgctttttcatggccatgttgtgatttatctatgatatacagtaagttattatgtaacatagattcacaaaaaaaaataaatagtatctcttcttgtcagttctagctgcatcttgtttatgccacccatgtgatgccttgagttgtatttatgtgagtggttgacttagttctcacctcctcaaatcattgtaataaattttcctatgattttgatgtggacagatgcttctcatttcagttggatttctaccccatttgcagcttttttgcaattagattggttgtaggacttggtgttttggtgtgctttatccttaatttttcatgtacagtagctgccttttctccctttgttagttagtactaacttactaaccgcttttactaattgcaggagcttttctttgtcaatgaacttaatggcagtcgacttttcgttggataattgagagaggactaccagattgtgcaaattgtcaactaggattactatatttaagctcagagtgtatcaactgttgaagcaatggtgctaggcctccgaaccaagacgaggaaggatgcatccttccatgtagacttcaatatcttcattcaagaaatcagcccatggcccccttctgagtccctcaagtctttgaaatctgtggtcctcttttgggaaaatggcgagcgcaattcggggaagaccaatgctgttgcgccttcaattggatcaggtaccacagtagggaaggttgaatttaatgagttcatcaacctacaggctgtttttcagaaggaggggtcatccaagagtgggaaatggcagaagaacctgcttgagctgaatctgtatgaaccaaggagggataagctgaaagggcagcatttagggactgcgacactggacttggcggagcatgcgatgtttcacgaggacacgagtgttcccgtgccgctcaactccaagaggagcttgagaaacaatgtgcagccgatggtttatcttcgaattcagcctttggatggtgataactcgagcgtttcctctagagatgcattgtcaaaggaggcatcagtggacagggattcaaaagaattgatgtcggagtacactgaggatactgagtttgcttcatttactgatgatgaggaggaggaagctccatacccttaccgctcagatgggaacttgcgtgcaggtagtaatagatctcaggagtctctcaaggtaaaaaactgaactctattcctacatgtgtactaggacctatgttgtgtctgatcatcttcccaaaagatgttttttaagacagtaaatgaagattttttttccaaaaaaaaacagtaatttgggcaggccattggggactatctctagccacatttactaaaaatgtgtctgaattagaaaacaagttttcaatttaataaagttttacatacttttgctctcaatacaattcattgctgttggaatttctgaatgggcattggtggttattttcctttacttaattatgtcatgtaaaaacttaaaaaaaaatgctatctgtaaacaggattttcacatgtatgattagtactttcagtaagaatagtattgtcgaaattgtgtagttcagttcagtttttttttccttccactgcatgttttggcgtctagttgaactaaatagtcttcttttatcttttatgcatgattctgaaaccaatttgaaattctctaggggaaggatgtaagaacagttggtaatgaaggctctagatcaccatttgattcccagcgtgaaatgccatcttccagtacaaaagtgaggagcgaagaagttgaaaagtatccaattcaagtccaaaaggcaaatggccatccagggaatctgtctcttttatcagatttgcctggtgaacaaactccatcttttccagcacaaaatgctctcagagctggtcgtaaaatgtcatttgcttatggtatgagtgattccaaccaaagaaactttggggagagaacatatagcactttaactagtgatagagcaaagaatatgaggtacagtatgagagttccggattttagtggtagtgtcattaataagaaagttgattcccagaaggaagaagtgaaagaagttgactcccaagatattgcggtctctaatgatactaggactgatacctatgatggagcacaagctcaggtgccaatacgcatatcaaataatcgtaacgacaccaaagttcgagaactagaacttagggttgagttgcttgaagcagagttgcgagaaactgctgctgccgagataggcctttattcggtgatcgctgaacatggtagctcatcaaacaaggtacacacaccagcacgaagactctctaggcatttcattcatgcgcttaaaaactggtctagagacaagatggggagtgcagcaagaagtgcttcctctggtttggttctggttgcaaaagcttgtggatatgatgttgcaaggtactacatgagacttcctctcatgctcaacattcgcattttctttagataaatgaagcttttattaatctcagacgattacatcaagtgtgatagaaccatactaagaatgctcaaacattcgcattttaatagtgttttcttttcaatggaataatttgcaatgaattgacaattgcttaacttctatatgtcatcattatatagattgcagtaccctgtaaaagtagtttatgtaacttcggaattcctgttgtgttattttatttattgcctaatataacttctccaaccaggttgagtttctggctatcaaactgtgtggtgttgcgagcaattgtttctgaaacttctaaacaatcgaacagcaatgctatcaataatggttccaaaacaggaccaaggaggaattctgcgtcaatgtgggaatcgcttaaccggaagaaaggaaaattgctttcccctgagtttgataactgggaagatgttgacacatttatagccgcacttaagaagattgaatcatggatattctcaagaattgtcgaatccatttggtggcaggtctgcctcgttattagttcaatttatttgctgtttgtgcccttgtctgtaagatttgttaaatacattgcataacaaatcttactttgcaggcattcacaccacatatgcaatctgctaatataagcagtgaaccgatgcctagttcaaatgcaaagaaatgttatggaaggattactgttgtgggcaatcagcaacaagcaaccttatcaattgacatatggaagaaggctttcaaggaagcatctgaaaagctttgcccagtaagagcagctggacatgagtgtggatgtctccctttgttggccaaattggtgagctacatatgattaatcaatagtttgaatttcctccttgaaaattgtaccataacttgtcaccttgaaatattctattcctcaaaatgtgttttccctaaaactattcaaattgtattgttcccattgttttttttttgtccatctcaccttaatttcttttatttaagaatgttttatatgatcagccatatcttgatttaacactcaaacaatgagaatgagaaaatatagacttcatataaatattcaagatctgtactaattcctaacatcatttctctttgataggtgatggagcaatgcatagctagattggatgtagcaatgttcaatgctattttgagggaatcagatgatgagattccaaccgatcccatgtctgacccaataactgatcctaaggtccttcctgtaccatctgggaaatttagttttggtgctggggtccaactgaaaaatgctgtaagtgaaattaaaagcatgctcattacgaggtcatgttactcgtccaatggagcctatttattttatctggctttcgatcaaaagctctgaccatttgtctttcctgctggttatagattggcagctggtccagatgtcttagtgactcgtttggtatggatatggatgactatccagaagttgagagtggggatggtgacaatggtgctgccgaactccgcaaaccattttatctcctaaatgcattgagtgatctcctaatgatccctaaggatgtgctcatggaaaccagtactaggaaagaggcatgcactctcatcttgttcaacaaatgcacattatttccatctgaacttgtgaagttttcttttctggtcataatattgttttctaattctaatacgatcatcctgcttttcacagctttgtcctaccttcagctcatcaatcatcaagagaatccttgatggctttgtgccagatgatttttgcccagatccagttcaacattccttgcttgaagcactggagtcagaggttagtttatttagcattgggctgcattgaaattgtatgttggtttatgttgcaaacaaaagtagatgattgcctgattacctagtctcgtaagtatcagatatcaagtcatgacagtgtgattgaatcttacgtttcatggtggaatggggaaaaaaaaggcacttatgtgattgcatcttatgtttcattgcacatggttatactttaggactgcaaaataccttttactagttatattgggcatacgcacatcgctttttttattacgaactacgggtaacaaaaaaaggagaattgatgatttatgccacttctttgtgaaactaaatatggaacttggttgctatttctgacaatattagcttgcgataaacttactctatttgtacaaccgagttgttttcctggcataaagttgtagtttgctagtttcatgagaagtaaacctaagcattaccttcattgaatgtaccatcatgcatcaaaccacaatttgaggaaaatgaggaattttcagttcaaccacaaacagtactggactattactcatcaaacattcatgctgttaggatcatttggagggtaacaccaagggcatccgagcggtcccgtgcagcgcgtcacccatcctatacccatacccggcatccggagcaatcctaagcatgatcggcgaccccaggaagagcgggtcggccatcctccgcaagtccaacacgagcgacgacgagctggatgagctgagctcgccattgaccttcatctccaaggcttcgtcgaacccgctcgcgaagctgaagcagattgggaacccaaacagtgccaggtacaggctcctccatgaggtttggaagctggatgaccagtagtgaccagtgagggtgtgtcctaagcatcagtgatgctttgcttctctactgtacatacacaagcaatctctttctgatagtctccaggtaatttccagctctcttcggaagcaagaacagaagaagaaatttcaagggttgggttaaaagtaatatttttggtgcttccatgtatgtaagaatgctgtataacttgcatcttgctccaatgtgttaccagctccctagatttcccatgaatttcagtcacactattaccaggcagaagtgtaaattcagcaaaatctcagccgttcatcttgtaatccattggtcgaaatgatgtagtcagctacttagtccaatcatcctccaaggctccaaccaaaagaattgaccgagttcttgaaatggggtgggtcgaatccaacggtccacaagagtcggcccatcaccagtgactccgtgcactgcattgcacaggggcagtgaaaactcttttagtaccacaccgctttcctacctcggacgcatctggtttataagctggagcgaggcgtaggcccgcgacgccagagggtgaagtgtggccctgtgggaggggcacccacgtaacaagcgcacttcacgtgcggctgtaaccctaaaccatactgcctctccctcctccgtggggtttgagtcgcaggggcgatccgcactttgctgcttgatcgatttctaaaggcgtgttctgccggtgctttggccttcataatataagcaccgatgctttgcgtgggtgcccctcccaggagaatagggttggtggcgtcctgagtagtcagggccctatatatccccctatttagtagccctccttttttttatttttgttccttttttttttgccattcattgattgaactaccaatgcttaatcccaataagatggtctttttttttgtcgttcattgattgaactacaaatgaataatcccaataagtagggatataagtgggtaaacccactatccacatttatttttccgttcattgattgaactacaaatgcttaattacccacttgctatttcattcatcacataatagtacaaattttagaagaaaaaaagactagaagttcttttttttttcttttatagttcattgattgaaatgcaaatgcttaattccaataagaagtgggaatataagtgggttagcccactaggccactatccacgtttatttttccgttcattgattgaactacaaatgcttaattacccacttgctatttcattcatcacataatagtacaaattttagaagaaaaaaaagactagaagttctttttttttcttttatagttcattgattgaaatgcaaatgcttaattccaataagaagtgggaatataagtgggttagcccactaggccactatccacgtttatttttccgttcattgattgaactataaatgcttaattacccacttgctatttcattcatcacataatagtacaaattttagaagaaaaaaaagactagaagttcttttcttttcttttatagttcattgattgaaatgcaaatgcttaattccaataagaagtgggaatataagtgggttagcccactaggccactacccacatttctcacatgattaaaataagcgggcaaaaagaataccgcttagcagctccgcttgcatccttaaggttgtatttagatccacgggtataaagttttggcgtatcacatcggatatacggacacacatttgaagtattaaaacatagactaataacaaaacaaaatacagaatctgtctgtaaactgtgagacgaatttattaagcctaattaatccatcattagcaaatgtttactgtagcactgaacgcgctgatgaagcctagagggggggtgaataggctatccctgaaaacttaaaaacaaatcgcagcggtaaaattcaaacagacccagaacatactcctccctcatcaagacttgtaaacatactcctctctcccgtcatatgattggtgcagccactgtccacaacccaacttgagccatcggaggagtatgcctataaaagaaatcaagcttgggatttaggaacccaaacttgtctaagtttgggtcccttgatgttagtcaccaaaccctttggcacccacacacaagtgcggtactcatcattgtaattcccattaaaataagcaaccactttgccctctgaatttttggaaattacatataaatcatagtaaagaccctctggccggaacttcctggcattatacccggaacttccagtcagccccttcggcctatcagaagcccggaacttcctggaacttcctgtcttacagggcaggaacttccggtcattttgcccggaacttccaggtgtctgaccagtgaggggacaagtcacctcacttgcttgtggagcttttccttctctcacaaacattaagcattctttcacatttaccatcacatgcttagacacaggacttccaccagaaaacccgagcccgtgtccatccttgttaggatgagcggtgatggtcttgtaaagggcatcttttgaatggtatgtcttcatgcatccatatttcaccaatgtgcccaaccttttattctctttcttaagagcttgcatagcatcaacattagtagcatgagagttcaaatcaatattgtaacacctagcacaaccattgctagtagatggattggaagaattagaaaccacatttggttgagaagtgttattccaaagagtgtcaaattgaacttcaagatctttatgacttttgtctaaactagcaaatttctcttgaagagtttcattggcatccctaaggctagctagagaaccattagccaaattaagctcattagctagttgttcatttttagcacattctttagctaggctctcctctaaggcaaggtttcttttcttctcaagaataagtaattcttcttgcctttcgagagattgttctttactatccaaagctctcattaacttagccaaatgttgcatagcgggtttgctaaagctcttaagcacatcatctaattcattatcactttcctcatcattagaatcaacatcaagagaggtgtgagagggcttttgagtcatcaccttacggccttgagccatgaaacaagagtagtggtaggagtcgtcgtcgtcatcactcaagttgttgaagagacactccttacttgaagaggatgacttgaaggcgacggtagcaacaccacattctccttcaaccttgtcttttggcttgggcttgggcttgacctcgagatcttcttcatctccggagtaccacacctccgccatgtgtgcctccgccacatgagcacgctccggcttcttcttgcctcccttagccttagctttatttgacttgggacaatcggcaatgaagtggccatattcgccacaattaaaccaagctctctttgattgcctctttcccttgtcatcatcatttctccctttgccatagccactcttgcgaataaagtgcttgaatctcttgacaataaaagccatctcttcatcttcactttcttcacaacttgactcttcttcttgttttgccttcaaagcaacttcttgatttttgatcatggcggcattcttcaccatttgcctcacttcatgagcttcctcttcttacatctcatgagacacaattcttccaagaatgtcacttggggtgagtctcttgaagtctttcctttctcgtatcattgatacaagagtgggttttcttggaccaaatgcacggagaagtctcttgaccacaaagtgatttgtcatgtcctcactcacaagtcatttaatcttgttgacaaggatcatcatcctatcatacatctcttgtggtgtctctttgtcatccatcacaaatcttccaagccttccttccaataattcaatcttggcctcacgaacggcgggtgatccctcatgaaccaattgcaaagtatcccatatctccttggcctcctcaagcccatcaaccttgttgaactcctccggactcaaggcggagagaatttgcattggaagcttgagcattgcggtggatgagttgctcttgctccaaagtgagcttcatgtcatcatggggtacatcaacacctgtacaaacaactttccaaatacttggatgcaaagagattagatgcaacttcatcttgtgcttccaagcggcgtaatgtgtcccatcaaattgaggagcacgcccggaaggcacggagacaaagttgtgagggggaatggtaagtttgctgtaatcaaaaggtatagtagctcccttgggtgatggagttcccttgctgcttgctccatcttcatttccattttccccgttctttccccctaagtccgacatcgtggatcactcaaagcggtgaagcttgaatcaaaagcaccttgctctgataccaattgaacgcgctgatgaagcctagagggggggtgaataggctgtccctaaaaacttaaaaacaaatcgcagcggtaaaattcaaatagacccggaacttcctggtaaggaactccggaacttccggtctcccaggcccagaacttccggtgttctaagacaggaacttccgggtaacagaacagagatgaaattcaaatttggaaacaggagactaagccaatcttcacaagatggtgcacaggtattctaagcagaggatatatcacagaatcatccacagaaacatcatagaaagagacgagagcgattttttcccgaagttcggatcttgcaatcctactctctgttgaggggctccaaagagctgggtttcgattaaccccttgcctcacttgtgcaaaaaccctagaagaaatccacagccttcaaccccaaacacctctacgcaaatttctagaattgagtgaccaccaagatccaactcaacctacttctagaaatccaccacaagtgtgggttgctctacttggaaagcctctagaatctcaacacaagaacttcactaacttacctcgttccctttcggaggagagaaaatccttcaaacttacccgggacatccacaatatgcaacggattctcgcaggcgacacctaaccgtcttggagatcatctccaagagtaataagcaccgagatgacagcccacaagatattccaagtgctcacccaagatcctagtcttcacacctctccaaatcttcttctctccctctcaatctctctatctcataagaattaggctctagattgagtgaagaaggtaagaaacacttgggagaggctagcaacagctctaggtttgaaaagtgaaagtggaatagctaaggaacgagctagaaacgagctgtatatatataactgctaggtgacgtcatctagccgttactcacaattttgaactggaaactagacaggaagttccggacctggaagacaggaacttctggactacacttaggaaaaactttttcacaagaccggaacttccggacctggaagacaggaagttccggacttgcacttttggacagatggagtatttgcaaaaatgactcctagggaaacttgacacttggttcacactaagagcacttgatatatctcagagcatcacctggaacccctcttaatagtacggtttttcctaaaaactcgatttcaaaagataaactatcctatgcacttctcgagttccggtccgctttgaatttgtactttttgggggtctccaagcatccatcttccacaccttagactaatgcacctgaaagttactcaatgaactcattagtcccttaaccacatttgtcattaatcaccaaaacccactagggggttaatgcactttcaagcaccacattatcagatcatggagtaattaggcttaaaagattcgtctcgcaatttatacgtaatctgtgtaattggttactttttttatttatatttaatactctatgtatgtgttcaaacattcgatgtgacagggtaaaaatttttgacatggatctgtttgcctaactcacactgaggcgcggcccaacaaaagaaaatagtagcccactaaccatttccaacaaaataataatgaaataatacggctcctgtctacgtctaatatctttagctaagatgatactctactacgtatcagagaaacaaaacaaaacttaattaattattaattaactgcagcacgtagcttcctgaacttacctaaattaatgttaacttctaatgccctaccctgaaaacatatttattccctgtatcccattatataagccaaagcccacgggtaagcctaacacggtctctaaaactaattttttttcttacaatttcttgtatatgaacaaaattataatcatataaaaataaattcaaatgtcagtttaatgatattattttcagcaaatataattcaatctattttgaatcaaatgttttaaagttaaatgcatgcgcactttatattatgggatgaaaataatattgtatttacataaatcactttccaattgatttgattgtataaatagaatacagagggacggcatcaggccgttgggaggtgacatggttcaccttaatgcaggaaattactattacctacacttacgaacataatacggtaggttatatacgataggatgcccgcatgcatttcctgagcttataataacacaacgacggcaccacatgagacaatcttattgcaatttagacaaccaagtcaaaatcaggtacaaccccattattcattacatgatcatgcaacacttcacgaaagttgtaatcgaattgagatggcagttaagctttcgaacgctaatacaactcggaaagtattcagtgcctacctgcaggcaacactgcatgaggtggtgctacattttctccaaagcacagaagtacattttaagcagaaaacaggggcttagatgcccttctccagcattgcccggactctggtagggagaccatatagcctgatgaacccttcagcatcagcctggttgtagatctccccattctcaaatgaggagatgtcttccctgtacaggctgtatgggctcttccgggacgcgacgtttacggagcccttgtacagcttgagagtcacggagccggttgttgtcgcggtaatgttctccatgaacgcatcaatggattgtcggagcgggtcgaaccaacggccagcgtagaccagctcggcgtacttgagggcaagcatgtccttccactgcattgtctccctgtccaaagtcaaggactcgagctcacggacagcagctgccatgatggtgccaccgggggtctcgtatacaccacgggacttcatgcctacgaggcggttttccaccatatcaatgcgcccaataccatgctttccaccgatttcattgagcttggcaaggagagatgctggtgagagatcttttccattgatggaaacaggaacacctgcaataataccaatctccaaatacctggatgtatgaagcttaggttagatactacagatgtgggccaagtaaaaaaaagtgtactagtgtgggcgaatgaaaaatatatcttagcaagcaagaagatgaaaaacagcacacgcaaaattgtagcagctaacaagaatttgcaaaacaaaatgactatggtatctgagcaagaatttgtgattctcttcagatagtccttgaaaattagctagtcagtactctacagtctcacacagaagttcaatcaatgcccacctaacttaactacgaacttcaagactgtatggcccttgagaattgagatagcccgtaccatgtaccattaagcgtgaaagcatactatattgaatcatgacagcaatttaagaacttcgcataaagagcatagagaatacttgtaaagtaccaaacatataagacatgattatcgcttactcaggttttgaaggtgcattttctggtgcaactgacatcatatacatatcttcctttggctcatttgctggatcttccaaaatgtcaccctgaaatgtttacataatgtaagtacttaactacaaaaagatgcagaagattgatcatgatatcaatacgatggtgtaattcattgatttgaaggtttggagcataagcaaaacataaacaattgtaagaaacgggtagaagaaaatatcaaatagaaaagatcttcagaaagactaggaaggaatgaagagtcaaaaagacagcagaaatacctcatggctaaggtgccacaaatttcgatcacggctgtatattgatttctttgtaacaggaattggcacattgtgtttctttgcatactcaatagcatcttcacgtcctgtgatatcccactccctccaaggtgccaccactttaagctcagggtttaaagcatagaatgtaagctcaaaacgaacctacagaaaaaggttagcatcagatgactgccatattaatattctaattaacatcagtatttacctgatcattgccttttccagtgcatccatgagcaactgcatctgcaccaacttcctttgcaacatcaaccattgcctgcaatggaggtatatggtgttttcaaacagaataaacaaatataaatgatttgcaatatttctgatgttacttcaagcacatcatttccatgtttttattattaaccatttgtgataattactcaattgtatattaaaggtagggtcctacaatccttatagatcctatctcacatataacaaagaaatttgacaggagaccattcaattcccatagaagcccaggaaaagttatcagcatagtgttatttattaacgctattactaaagttatcaggaaatttatcttttgccatagatttatcccactgtttctcatgttacttatgagcatgctcctgataaagctgggcaaaagatgtatttaaaatattacctttaaggaaaatatatattactaaagttctaggggattacagatagagcaactattcaccttggcaataacaggcctagccattgaagtccccagcagatactttctttcataaactgcaccagcacgcaagcaggggtaaatgtattcactaacgaactcttctttcaagtccttcacaacaagctggcttgcaccactagcttttgccttcttctctagcccttccaattcaatgtcaccctgcaaaggtatatgaatcgaagttatggttaactgaaaagaagtaagaaagtttcaaactataatgcaactttgtttgattattgtcaacaaaagaaatataccagtagaagacctaggaaccccccaaatcatgaaatttataaagcaaaaggtcatatggtaaaaaataatgtaacagccaaaagaataactaaagtactactctactaggtaacagagatactggtgagagcaagcagagaaaaacattatgaacgtcttcggtaatgcagcaggaagttgtggttcacatgacattacaaactaaaagaaaataatgcaggcttgataattacacgagtaatgaacaacatacctggccaacatcagcagtgaaacagacaacttcacaaccatagttctcccttcaatcaaacaagcaaatggcatagtttgcatgagtcaaattaatatagaacataggattgtacaaattggtattaaaacaagaagaatatatataccggagccatggaacaataactgatgtatccaaaccaccactgtaagctagaacaactttattcagtttgccacgcagtccacctttcttttgatcactactactagctgttgcggttgaaattccaccatgctcacttgcacttggcattgcacatcttatagctgcacattttgacaaaggattatcattcattgaacgcaacatgctaacaactatagacaaagatgaacagaattaacataggcataagccataaaattccctattgcaagcagtatgctatcataaaagttcatgtacaatcctgaaactagattaaaccaaacaagatgaaccaatctctttttaactgctcacagaaagatgtgtaaaactagattaagccaaacaagaggacatcaaattggctgtataagtgatttcatagtcatgtcctaacagctttttgtgtgtgtgcaattaagagcgtttgaaccaatgtggttaagtccaaggaagaaagaggaggttctctaaatcaattgattttctcattagcacatcacaagaactgatcgaaccagaaagcatagcttcacagatcacatgcttgtactaaacaggtccacattagtaacacaagtaattaatctagcgcgaacagatgtaaccaataacatgtcctacattgcacatacaggtacataacaagagacgatacatcatcatccacaagggcatgaacagtcatataccttggcttttgctccccttcccgctgagctgctgaacccgaacgatggagcctgcggcactgaacaacgccccagccttctcgtggtggtggaggagacccacccctgcacagccaaagccatccatcgatccaccgccgcaaaaaccaatcagaacgagtaaaaacaaaaaacccaacacatcgttccagtaaaagaagaagaagaagaagaagatctagctcaccggcgggggcggtggcggcgcccccaccgagggcgtgcgccatggtcgggggcggcggcgaagggaggggcgttcggagcgggaaggcggcgagggtttaagcgcggcgaggcgagaggggaggcggcggcggcggcggcggaggaggaggttggtgggggagtatttgtgtgtgggcgattgtggcttggtgatctgtgggtgggccgttgaaaaggtggtgggctacgactacgagtcggacttcttttttcttttcttttctttttcgaagtagaactaggatctactatcaggtttaccttttcattttcggtttatcaaaaaccagcaaaagaatagataaaaattggtgactttcgattaagacgatataaaaaccgagtaataccagtcagttttcccaaattgataagagcagctccagtgtgcacctaaaatcgattttaacatgaaaaaaccgaactatgcacactgtgggaagcgaaccgtatgtgtcagatgaaaaagcgacttcaaaacagaagtcgacattgatgataaaaaattacttgttgctacaggttgtgagggggaagggaaaggtgggattatttttttttttcatgggtcccacccaaaatcgattttaacgctgtaggggtcgaatcaaatgtttattcgacttctgtgaaccggacttaccgaaccaacactacaaatgccctaaccagcggtttcatgaaaaccgatcaatttttggattttgtgaaccctgactgactatgactactgcactagctagtagcctagtactgtattcggtttttttatactggcatgagaatttcggttttgcaagtgtattcggcgtggtattactattacatcacggtgcccgtggtttaaaccatgtcgattgattgaaattagttgtatacaaaatagagtttatgtctgtggtggaaatagaagacaaaaatatatactcctatatcgaatctaattctacaaggtaaaagtttttgtatactggcatcagaatttctgttttgcaagtgtattcggcatggtatttgatcatggtgtttacgtattatgatcggcgtagatttattaagattagttatatacaaaatacagtttgtgtctgtgatggaaatagaagtgaaaaaaatgtatataacgaatcaaatttcacctttacaatttattgacaaaacgtaagattacacctacctatctctatttctactattataaaaattgaaaaaaaaaattgtcggtattttggtacgtcatccgtgtatgagtcggttttttttatgttcgttcacttttgaaaatacagatctttatttgagtcgggttttaaatctgagtcatataagaaatctctttaaaaaaaacttgcatgctatcttgagatgatcagacttctaattgtagctcatagttttctagaaaaaaaatatatatccaagcgaattctcacagtgaaactattataaagattgaagatgtttttgctagtactttggtacatcattcgtgtatgagtcggtttttaagttcgttcgcttttagaaataaaaatatgtatttgagtcgggatttaagtccgttcgcttttggaaatataggagcagccgtataagaaatatctttaaaaaattaacttacatgctaacttgaaatgatcagactcctaaccgcagctcatgattttctagaaaaaaatatatatccaagcgaattctcatagtgaatttcaccttaactaaaccgtataataataaaattaaaatagcgttgctacacacgggtattttttctagtatgaagataaaaaccaagagttgtatatgaaatatgattatatgaaaatagaaaccatgagttatatacaaaatgcaattgtatccataaaaacataaactatcaggatgtgttcttcccccacctttcccaactcagctctctcgttttccacgctcacatttctcaaactgcaaaacgacatgtttttttgcaaaaatttcctatgtgaaagtcgtttttaaaatactattaatcttttttctttaaaaatgattaatacttaattaatcatgcgctaacgagtcgctccgttttaggtgccaaagggattagttcccatcccccactaacgaactcagcctaagagggtacatagctaccaggagacaggagttgtgaatcgcaagcgcaatctatggacatgcgatcgcgatctcggtcgaatctccaagggagggtacccaaccttggccgaatcgcaatccacagattgtgcccgtaccttggccgaatctccaagggagggtacctaaccttcccactagaggagctcgtgctccgacataggtcaatgggtgattagatggatcggaaagtgatgctaggttaggctgtgttcggtttcagggaatgggaactaatccctcccgcacggaaaatagagcgatctattagcgcgtgattaattaagtattagcttttttaaaaaaaatagattaatttgatttttttaagcaactttcgtatagaaacttttttgcaaaaaaacgcaccgttaagcagtttgaaaagcgtgcgtgcggaaaacgaggagaggggttgggaaaatgggtgccgaacacacccttagttaacttaaatgcgcttattcttcaccgaattatttggtacacgcttcgaaaaaatatattttctttaaaaaaatattttattatgatgtattgcttagaacacttatcttaaaatgttagttaagtttagttttttaaacaattaatttatttctataatccatggtgataatccatcaaataatctaaatcaaaatgtgtcttaaagcatgtttttttaacaaattgtgatggttattaaaagggtattaggagcttgttcctcgcaaacccggactccaaattaaaccggcgtatatattccccctcgatatttcacatgtaacttttcaatgaacaaacagcacaacagtatagaacttacaacaaacaacttgattatctacttccctcctatataccctatatatatatatcatctcaaaatgatttgatcaattccatccaaaagaatagcagccacccaaaaaaaccaccacttacaagtttcaagaaaaaaaaagctcggaaaaatatttccaagaacccaaaaaaaggagaaagaaaatgatttctcggacaagcatgatcttgtgatgatcaattcacattttgcgcaagaaagaagaagaagaagaagaagaagaagaagaagaagaagaagaagaagaagaagaagaagaagaagaagaagaagatttcgcaatggagctctgatctgcatcggttggtagctcgctcgatcgatcgatcatgaggaggcgatcttgtcgagggtgtcggcgacggccttcatcctggggcggaggtcggcgtcgagctcggtgcaggcaaccgcgagggggaacgccgtcaccacctccttcttcggcagcggcggcgcgtcccggaccatcgccgggtccacaatatccaacaccggccgcgcctcctactggaacccgcaccgcacccaccggaccacctgcggcaccactggagccaccgacgctggcgctgtgcccgtgctcgccgctccctgaccggtccgtcgtcgccgccgacgacgacaacggcgccgagaacgacgccgatgtcgacggcgacgcgtggtcgccggggccgcgccccgtcaggagctccatcagcaccacgccgaacgagacacgtcccacttctgcgccgggcgcgcccccgccgtccgcgcctcgggcgcgcggtacccgccgccgcggtgatccgccgccacggacgacgccggcttcgccgcgtacggtatggcgccgccgagcaggccgcccgacgacggcgccgccgggggcgcgtcgacgacgtcgtcggcgcatccggcgacggcgaggaggcgggcgaggccgaagtcggcgacgcgcggggtgaagtcggcgtcgaggaggatgttggacggcttgacctcgccgtggacgaaccgccgcgggctgcactcgtggaggtacgcgaggccgcgcgccgcgcccctcgcgatcttcagccgcgttgaccacgacaggggtgtttgacccggacgacctggggaaaagtcaacgagtacatgagtcaacgatcaatttgcatatggggatttttttatactggtttttacactttttttttactactgtgttagaagattaaagtggcatacaacatactccatctgttttatattataagtcgtattagtcttttttctaatcaattttttttaaatttgatattgaaaaaatatagtagaattttaacataaaacaaacacattattataatatatccaatacagatataatgaaactaattttgtattttttgcgttcacaaaagaaactaattttgtattatagatgtttaatttttctataaatttaattaaacataaaaatatttgactagaaataagttgcatgaaacggaaggagttccatagaaatttcactcgattttaagccgacaaaactgcacatggcctctcaggtcagcaaatttgttacttatgtccccataaaaaaaatactactacctccatctaatatatatatatatatatatatatatatatatatatatatatatatatatatatatatatatatatatatatatatataagtaactaaccaacgttataaaaaaacatagcaagtacaaaatactatgaacagctaagagtaatataacatgcaccaaattttaactaggacaataaacaggataacaatctaaacaagaatcatcattattttctaccagccacatgattacccaaatacaatttgcaacgacgcatgtgcaaagccggacggcagcttagccttagctcacaataagatcccaatactcacgtgcactcaaatcctcaagcagcatatggaaatggaattatggatcgcccccacgtttattagctctccagctaagtgcccagaattttaatgaccgattaactagcagagcaatgtgtctgcaggaccagatcaagaaatgccttgaagtttcaggctttcagcagacacatgatggagtggcaagtgcaatggcagggcagcactgcactcctgcctggtgactgttcttgttccccccagacagaagcaacccattgtcactgtgtttgattggattcaacatgtcccaggccccagacagaggagacataagagtactaaccattaaccgtaggaggtggatcctctgcagttgtgcgactctacaagagtattaaaagtctctggtgtatgaatctggaggaaaatgaggcccacatataagtggttctcacggttcagataatattatagaggaactggtcgctaactgtaaaaaatatgactacaaccgtgatccctcccattcaggtttttttttttttaaggaaaggcaagaggttttgccttatatatttatagagcagaaatcctcctgccaattaggttgaaccagataaaactagatagcaactcacttagatcaatgcatttgtttctatgttactcctacatagataaatagaatgaagtgacatgtatacacacatagtgataaaaatatttttttatggtgatacttgtgtaatatactgaaaattttctggctttctatgctaactaaattagtagacaccaaacagtttgttgttagcagctcctagagaatttcttaattttctcttccatcattaaaggctgtcaacctttgtcctttcaagcctaaaaccacaacacctgccaaaacaccagcctcaccagccagttctacattgtcattgagcacaacagaaaaggcactctgattatgcaattatcacctcatttttcactttttagtctttttgcctttggctcccagggacagctttaatggtagtctctaatgatagattagtgaccaggagatgcatgctgttagggcatgacagtgacaaaggtttcaggcctgaaaaggtctttctgtctgtcttcccctgtttattctggaggggctggaaaggctccttctatttctcagccttttaattcactttggtttgtcagcattgtgcttatgtaaagacagtaagacagacaactttggagcttgatatgatttgatgtaaagattcttctaaacattaaactttcacaaagaagggtactctttcaccctctttttcccctctcatgctatgaaacagtactacagagcataaatgtgtgacttggttccatatattttaatgcacctagcttgtcgaatgatgcttagtgataattattttttattcaaagagaagaagtaaagtatattcctggtctatgcgcaccaactttatgcaggttacagctgctcctcatgctacttccatcacattggattttttggagttaaaatcaattcattgttctaactgtctaatctctaattgttttatctatggttgacaagccggggaaaaatgaactaagcagtaaaaatagtttatgataaaaacgtttatgttagtgtttttagctgtttaaaaatcaatgccagaaaataaaatacaaagaaaacacctcaaaaccaactcaaaattttaagttctaaaattcaaaataaattttggttgaaaaatgataaggcaataggtagacgacgagatgctatcgtacacattaaagcatatcacattctcaagcttaataaggaggatggattcattcctccaaaataattggaccacgccgtccagtctacaatggatagcagcaatcctccaaccaaacaacccggtaaataaactgcccgtccttctctatcaatttactctttcagttttaaactgaacggggtgtgcaagtgcaacgtacctagaagatgagaagaggttggtacttcatatttatctaaggtgttaacttacttcattggtcaaactgtttgactcagtgaatctccaactaacttgacaaaataattttgccattaattttcttgagaatatggtaagcttataagtaaattgtacatccttctctatcgtattaatcttttagctttaaactagacggtgtatgcaattcaaaaggtcagaagagatcgatactttggctgtctaaggtgttaacttactttcactaatcaaactgtttgactcaatgaatctccacttaactcaacgaaaaaaaagccattaattttcccaagaacatagcaagaatagtaggaaggccaaaaatgagaaggtcgaaaaaccgtccgctgatcgaaaatagctgtttacgcaaaaccattaattgaaccaataaaatccaggcgaatttcattgaaaatttgaaattcagtttgattatttgaatttgactggtttacctagccgagaggctgacatcggttttacgaaccctcggttttgcgaagcctggataggactaaggacaattcttccgagtgatatgcccatggacgcagggtgtggtccagccagggagacaagccggtgtgcctttcttctgccattgtttggaaccttgtaggaggaccaaggaccagtctcgctccagattttgtctgaaagcatttgccttttggtaattcctccccatgattggagatgagatcgatccatccatttcatttcatgtatgtaagactaaattattctgtgctggagttgtactccttgacacgcttccgttgcacggactcctttctgacttacaagttgcttgctgtctgttattgtacagcacacttagccctacttggattggggaattttttatccaattttacttctaggattttagcaagtcttaatggatttaccaagttaggactcattcgactttgatgattttcaatgcattattgtaagaattgaatccttaggattttttttctatattcatcgttcgttttacaggaatatatcataccaaattcctaaggattatagtcttgcaagctaatttcataggattcttagtataaggtgagacctcttgaagaaatttctaagaaatagagtgcataagacatcctaatcttttacttttcctattactttgatttgaaaatactactaaccaaataagcccttagttctcctagttttcgcagaatttacaaatcaaactgtgcctgcggacgtgctgccaaacagaacgcattaagtacatgtggctacatacgagtatacgacatctcaattaaagaactccaaaacaaaacaaaaataaagcacgcagtagacaaccagaacgctacataaaacaaaaccgactattgatagttactaatgtacttctactatacacgtagtagtattatcaagaactgtgaggtgtgtaatcgacaaaagaaaaaaaaataaaaagggtatgtgatggcgacattttcctaagccaatgttcctagattttattgatagtgtcacaaactatttgactgtctaatcaggcagataaacccacattttcctaatcaaaatgttttggctctcgggtgatctcgtcgaatgcaaatcaatcatggtactgcaactaccatgccactccgatagcaacgttccaaaataagtacactgtatgcaacaactaacgcaagacaatgttccatccaatctaataaaaccaacgtcaaaatctcgacaaaattttgtcaaaaaagagaaaaaccaacaattctcgattcttactaaaattaaagacgcccccagtttcgcttaccactatataaacaacttaaaaaataatatataaataaaatctttacatatttttttattatcggcgtaaaaacaaatactcaaaaataaactacataaaaattttaaaatttaagttttcggagtggcttatgaatatccaagagtgttagccatcaagagtgttagccatcgatatgctctgtttaatactctatccgttttatattataagttgttttgacttttttttaagtttaatcaaacttatagaaaaaaaatacaataatatttccatacaaaacatatattaaaaatatattcaaaattgtatttaatgaaaccaattttgtgttttagatgtttttaagtttttttttcaaactttcaaaattaaaggactttgaaaaaaaaaagaaaaacaaaggaggggtagtagtacggagtaaattagtttagcagtaagtgtcatcagagagagtgtttaccacgcatcgcggcggcgaggttgccgttgccgacgaagtcggtgacgacgagcttctcgtcggcggaccagtagtacgcgcgcagccgcaccacgttggggtggcgcgcccgccccacagcccgcgcctccgccgcgaactccttgcaccgctccccgcctccaccgccgccgcccagccgccgcaccgccaccggcgtcgcgccgttgccgaccaccaccttgtacacgatccccttccctcccttccccagcacgtacgccgacgaccggagcagctcgtccagctccaccctgaaccccctgtcgatcgccaccagctccccctcgccgtacttccctccgccgccgccgttctccgacgccgacgagtcgtcggtgtcggtgtcggagtcgacgccccggtgaccccatatgcagcggcagagcccgtggcggctttcgttctcgtcaccggcggcgacggtggaggagcggccttgtttcttgcgatccttgaccttccagtagacgtagactaggatgacgccgacgagggcgacgccggcggcgtcggcgatggagatgagggcgatcaggctggtcctgatcggttggtggtgttccgatgccgccgcggcggcggcggaagccgacgatggggtggtcgtggtcgtcgtggtcgtcggtgccggtggcgactgcgtcggcggcgggacggcgcggcaggggacctggagagggaagccgcagaggccggggttgttgaggaaggaggttgggccctggctggcgagcgagcccgtctgcgggatggcgccggagaggttgttgaagcggaggtcgagcgtgacggtcgccggcagccgccccagctccggcgggcgacgccggagaaccggttgtgcgacaggttgagcgtgccggcgagcctcgggagctcgccgaggtcggccgggatggagccattgaacccgttcgacgaaatgtccagctgctggaggctggccatctcggcccagatccccgccggcacctcgccggagaacgagttcccggcgaggatgagccgctgcaggctccggcagttccggaggtcgccggggagccccccggacagcgcgttcctcgacacgtcgaggttctgcagccgcgggatgtcgcagagcgcggcggggagggcgccggtgagccggttcccgtagaggaacagcgagtgcagcgacgacgcgttcgacagcgccgccgggacgccgccggcgagccggttgtcgtgcaggttcagccgccggaggaacagcagcgagccgagctccgacgggatgtacccggacaggttcttcccggcgagcgccaccccgaccacccgccgccgcggctcgccgcccgccgccgtcacgttggagcacgtcaccccgggccaccggcaggggtcggggtcggactccgaccacgacgacagcaccgacagcgggtcgtcggtgaccgccgccttgagcgccagcagcgcgaggccgtcggcggtgagcgcgacgacggcggacggcggcggcagcgcgaggaggaggaggaggagtagaatcgcggtgggtagcgtcgtcatcaaactcaccccaattaatttttcctcctcttcttctaatcttcttgcttactttgcttgagctgagctgagactcagaatgaaatgagctgagctgagctgcctagtgattgggttagtgaacagtgtgtgagagggagggagagaggctaacactaacactagtaacagactagcactaactgaaacatggagtacttaaatggaagagtagaggaaggggaggagaggttggggaaggttataagaagcagatctgctgatgttggcagctagcttaggttgccatgtgaggcatctgatggttttatggaattcagggtggactctagatcaatgacaatatatttgtcaacaatttttaagtgttttatctggcttagggaaattgtcaaaacattaggtgagaaatacaattacttattctatgtgttatcagggccgtctgtttttcatcggacgactagtcatatgtatcctttttttactcatggtttactattttgatttcgggagattaattataattgttgttcagtcctctcaaatggggaatatcagaggaaatcttcatttttttcctttacttttttttcaaacctttatcatcaattcttttggtcagggtgagcaatttaaatgagaaaaaaagataactaagaaaattcttccttaaatttggatgtcccctaattttttcccttcgattctaaagattttttcttttaaattcaagattgtttttgggaaacattcgccacccataaaaaaaatattcctcgaacaaaaatccacctttactttatttttaacactgatggcgcgcgagtgacaaacatcaccttgaaagcgagtttgagcccttgaaagtggccaccttggatattgaaaatgtagtgaggcgtgcgtgcatgctagtatagtagtgatggatgatgatcctctcccctttgccatgctagtgaggaagtggttatgtgtggagttgcataatagtgggggtcttcattaaataggggccccccaattgtgtcaatgcaactcaattgttagtagagggagaggctacctagagagagaaaaccaaagatattgtgtgtgcctatgaggggagtagaagggaagcaaaggaatgtgttgagttcaagtgttgtgcattgcatacaagtaccactactgcattgaatagtagaggatatgttgacagatagattggggggaatgatggaaggacgttgcggagttccaaaggctggatggatagatggccgttttctcatcatcatggctttggttggtgaagcatgcgtttgctagcttcactttggccgtgcactttgccggcgcctgagtaaacacgcacattgatcagagattcagagctaagctgtgccactgatcatttcagagcacaaggaaaagattagtgtgcatggatgcaggtagtgattgtggttgggtgttaattatgctgtcaatggcatgcttgggttgggttgggttagcaacaggcattgttgctagatcatgtctgtgcctggacttggggtgtgatttgatcgatcttagtgatgcagattatgtctttacagtacatggggcatgattggtgtacatgtggagtctttgcttactttctggtcttttgattaacctgtgtctcaatttgtttggtaaacttggctgctagttgcattgctatttggcagggttgtcctaagtgaaagttgagtgattgattaattgcaattggtaagtagctaagctaggtgtgcagtgagatatcacaggtcagtttattttcatcatgtgctagtttcatgggagatggtaattggtaagtgcaggctgttattcagatgatcctatggacttttaatactgttgtttagctgcctacactatagttataatgtgctaccaacaagcaacaactcttgtcccttgtccatcaaatggaaatatgtaatagtagacaattgtgctttctacagtttgcagtgacaggcttgacataggctgtgtttagttcagcgcaaagtttagattttggttgaaatttgagatgatgtgactgaaaagttgtgtgtatgacaggttgatgtgatgaaaaaggactgaagtttggatccaaactttggatctaaacatagccatagtgattacaaaataagtagctaagactgtgtttagttcagtgcaaagttttgattttggttgaaattgaaaatgatgtgactgaaaagttgtgtgtgtatgacaggttgatgtgatggaaaaggactgaagtttggatccaaactttggatctaaacacagcctaagtcatgcatactgaatttttcgcatctttggtcctcatgcgttcagaactgcaactctggtagaatctgcagagtttttctgctgttttcttgcagtatttgggtgagaaaaaatccagaatattttattttgtcgtatagaatggcagcaatgtacaaagtgtttccactttttaagggaatagttccatcgcctgctgcagactggtcattgtcgttcttgacttcttgatgcttattattacttctttgtccatagtttctggtttctgaacaatccaccagtggagatggagtgcacagccatgacaaagacaatcttcagatatcatcagtaactgaaagattaatgcaggtatagctgctacagacaagtagtttcactttcaggaagtcactataaaaatgattattgttcaatacagaagattcttggaaggttacaaatgcttccgtgattatcagtaaacatacattgtatgtacatagcgagttaatgtggtttatttctgtccattacagtccagtagcggtactcacttgcatgtatctctatccctagtgccctgattactgatagattccatttctctttactatgtctagttcacaagtgatagtgtgcatccaaaatttattccctgcaatgttaaagttaaggatgtgtttggttgagtggatcagggttgatgaaatatggccgtcaagtattttatgctgtttggttcacgggtgagatggatggagcagccacccgaagaataatcctctaagatattggatgggtgtatccagccaatttggccggatgagaccatccatctgtgctagcagagatcattagcaactactaattagtgattatcattttaagattaggattgattaggaataattagtatattttgttgcgtttgattagtaataagcaagcataaccttatgaactagtgtaagaaaaaaactcagtttgggatcgagaatttaagatgaatatacactcccactttgtgattgagaagttatgtgggcttatactacaaagagccagggccgtcgatgaggacgtgccaaatgagcgaccgaacaggatcccaaaaattagggggcctaaattttttatattttaatctatgccaatgtatttcattttttacaaagtctcactcttactcatttgttgatttggctagaacgggtttgtttattctttagctccgataagtattcgatggcaatcaaaaccaaatcaaagtgctatagctcatgacgatgatataaacgtgcattctaggtattaaatattccatttttctatttaataaaattaaatcactacatcatgacataatatttttgtaacattcattttaaaaatcttctttcgacttaaatagagctccactactaatttatttttgtctctttatttttgtggggctcaaaattgtgttttgtaccggagcctgaaattcccatatacggcccagtaaagagtccagagaaagcttatctgggccttcacgttgcttaggccagggaaggatctgcgctccgtccccacaaatttaggaataagtgcactttcgctcccttaactagtgactgaatataattcgtatcattcaaccgcaataccagatatctcgatcccctaactattaaaaccagtgcagtttgactcccttgatggttttggatgatggtttctctacgtggcatcttcgtgatacccctgacatcttttaaggcggtagttaggatatttatggcgtatcttactgaggaaggtacaaccagatgaatatctctgtgttacttccctggtaagcttccatgctcttccttcgaggataaggaggggcgatttctaccgggggcgaaggcagcccgggccctggccatgccgaggccgtggttgtcttcaccacgtaacttgagaagacgtccttgttaaggggtagtagaggtaaaccgagagagagagagagaaccgctaacttgcctggacagattcagctcgtgcccgggctcccggggtgcccgggcccaagttagtccgggacccagagtttgtggctatctcagagctattcccccaactccccaggatgcaaacttgggggcctaggcagcccccgagcaacggtagacggtcccaggctcccaagaccagggcctatgatcgcgtccttttggtttagctccctcttcagaaatgctttggtgtttggttaattattttgacggggaaatggggaccccattcccatttcatcgacagctatatttttggattaaaatataccgagttatgactaatttccaactaattgaaatttcggaaatatccgatacagtaccgaaaatgataaattgaaccctgcttcttcatcgaagaagctccatctatacaacgaaccctactcatttgtgcattgaagacgcaacactctagatagaaaagatgagaccgcgagaacgtccggtggtcttccgctggaaaagttgtttttccaaccctctttcatatatgtaatactccctccgtttcgaaatgtttaacgccgttgattttttaaatacatgtttgaccgttcgtcttattcaaaaattttttaagtaattattaattcttttcctatcatttgattcattgttaaatatatttttatgtaggcatataattttacatatttcacaaaagtttttgaataagacgaacggccaaacatatgctaaaaagtcaacggtatcaaacatttcgaaatggtgggagtactaattaagctcagtgctatgtaacctaaacgcttcacatcaatggaagtattccggtgggaagcttcgcattcacccttttagaaaaaaaaactagacagcatgtacgtggaatccacattagcaaacaaatttgtgaaaatgttgaatatcccatttgaatctcgacaagcttgaaagcagtgcaccataaccatctacaaccacccacttctttacatcaatatgtgatatgtaaaattgatgataaaatgctaaagtttgataaacatattaatgcaaagattaatgctaaattttaataaagattttactgcaatatttgggctacagttggatatagataacaaataggtgcacattgcaaatgatgtcgtatttattagatttagatgttaattgcatatattcgatcttacatagaggttggaatgttgaaaaatacattccatcttgtcacatatatgccgccaaatgcaattcctcttatactatcattcactatgtcgtcgtgagtgtgtttggcaagccttctgcacaaacatggtagcatctgatgctgatagcctgataccatctctcgagcccttctgaacaaatcaaaccaactgaaaagaaaaggcaaccaaacgctttgcaggaacaacattgataaccaaagatgctacataataattctcataggattaaaaagaaaagtagaagttatgtccatttaagcactaccggatagaaacaagaaccttacccctaaaaaaaagtcaaatggagggattgaccagctaagttctctttctgtctacaaatagatatatattataatgattgcaatcaattcacgaaatcttaaaccactaacatatgcaaaaatactgacattgatatattttcataactaaaggcaatgagaaattgagagatcatgtaatcaaatgtttccaagttcccacaaagaaatattttgtttagatccctgaccaatttccatcaatatggatgtgttgtatcttggagttcattaaggctatgcgcatgagaaagggatggcaaggctcatctctgtgtggcttcatcaatgatggaaagaattgtacatgttaaattgatttgcagtgttgtagcaaaagattgttagcatgcttatgcaaagaaaaaaaaggaatccacatcagatgtaccaaagcaagaagttaattttactgggaaactaccatctgcagtttacatggactccaatatcatcctcaaatccctaccggacatatgcatttaacataactcaaaaaacaagataattgcagaagtccacaaccaacaatagggacgcagactaaacattcctcttagtatcgttgcaagtatacttgtcaaatatcaaaagcgagaaacaaacccgagtagaaatcaaccagttacaaataaatttgtgcctctacagacctgacaatctggaccaccgatccaccgaaggctacaacatgggatgctgacttcatgaagttcatagaagagtgtccacgtcaagtttattggcattggtcacacaacaacataacaaaacactgtacgccaatctaatagctcaggttcagactttagacgaaaagttaatttgctatatcatggtaactttgacgtaggttttgattttgagtagagcaagtacagataagccataagtctcccaaacattaaatgaaatcataagtaacgaaatatagcattaagggtgatatgcaatcaggaaaaatcaattatatgaattaggaaagatctgcacaagtctacaaagctaatcagatttactgtatatcatacataactgatcatgttggcagaaaaatgatggtcagagcaacaatacataaagaagctttacctggtagcaattttgcctagacaccattgaacatcattaaaacaagtttgaggtcctctgcaactgtatatttaagaagaattttcatctgcactgcaaaaagccacaaacccatatatgagtatcacaatcttttttaaaacaaatattgacctaagaaggactaaacttcactgcacaattttttaaacaataggcctcagatatctgttatatatgggttgctttgaccaaatttgaaagcgatatttatatatgggaaacaaaacattaggatcacactctatttttatgtagaacaaattgcatgacttgaaaaatttaggaggacatttaccgagtaataaaaggctagtacctatgctgtcgggtattgactgagctgcaaccatcacctacgactccacatggttgtgcacaatccaggaggtactctaaaagaaccattttactccattcgtcccataatataagggattttgagtttttgcttgcactgtttgaccactcatcttattcaaaaaattttggaattattatttatttttttgtgatttactttattattcaaagtactttaagcacaacttttcattttttatatttacacaaattttttgaataagacgagtggtcaaacaattcaaacaaaaactcaaaatcccttatactagtagggtgcccatgcgttgcaacggagaaaaatcacaccaagtgaaattatgttaaataatcattgagtgtaaatcggatgtaacaaaaacattaatatagaactaataataagtatgtcacatatttataattttcacatctttatagtgttcacatgcttaggtttccagcctcgttatcaaatgagcaatattaagaaatgtattttgttcgcagagagcctgttttaatctattttcatgcaagcattactgggagtttttgtccttcgacatttgcaatgcttttggattggcttcgaatattattcttcgtccttagtattttcagtatttccagtttgcacaaattactgaacaagtgcaaaatattttttcatatcattcacacaaggaaaacagggaaaatagtttgtttaccttcgattatgttgagaaggatctgaagacgtcaactggaaacaacaggatatgggcaccgaatttctgctacttaccttcatgaaagtacctacgtagtgaaaaatcgcaaatcaggcttacatcataaagattccattttttcgctagtcgattccagataataacacataagctataacatgagtgagtttcacactattcatcatattgcagtatatttattaagatttcttgttgatccttttaatatagcttaattcatcaatcattcatagtcaaatagtgtcttatcacacaatcttgacattatttgcttcttttgaaaagaaattttggtttgacaaacttaaatactgtcatgtcaaattcccacaaccttaattggatgctctcgtcaatgaccttgacctcaagaccctggatttccataggacagatcaatatgaacccttactattgagaaac

SEQ ID NO: 64210 - DNA, 68547 bp, Oryza sativa
cccccgcggcaaccgtgagaaggttggtgcttcggtgggcgctggcgcggcgggaggagttggagatgagcggggagtagggggcgaagccgaaggagggcggccgcccacacccactagtcgtcgcacacccggtgatgcggcgcgcacggagcgaacccccgccgcacgccctgtcccccattgcctcgccgtccccgtcgccgcaccgtccttgtcgtcgcgcctctcccctcccctatttcctgccgactgcctcccctttacctcctcctgtcacggtgctcgaggcgacgccgcattccggccgccattcctccatccatagctctgcccgccaccggcctccctcactgaagaagagaagagagaagagagaaaagagaagagaagagaaggagaagaaaaaaaaagtgcagctgatatatgggccctatgtactttttttaattttttctgactaggatgccacgtcagcgaaaccaccaatatatactgccatagaactttgagtgcacggtttatgtgagtttaggggtatacagaaatttctagttttatggttaagggatcttaaaacaatatcgctgttctgaggttgaagtagaagagaggatagagttgcaggaactgctacaggaaattcaattgaaggaggggagagataaactgagatggatcatctgttttttaagtgcgcttcggctagatttctttggtgctgcttgagagacatttttgggatggagcaatgttcccaggacaagagctgagatgattgagaaattgaaagaccctggcacaaagaacaatttgccttacatttgttttttttctgctgtttgctgggccatctggcttggaatgatttcgtctttaatgataaatgtctttcgggcattactatgattgctcataaggtggtgatgttattgtaacagtggagtcctttggtggcgcagaagtctactggagaggtggagcacttcaaggacttgctgcgtgccagaatcaaggagttggacgagaaaggaacaagctgatgctcgggacctgttcaaggaagaagatgcattaggagtacagagtagacagcagtttcgtttggatccaggcgatgcgttgttgttttctaaagtttctttttcctggaaggtgttagggtgatcttttgtcagttatatgttgatctcatcttcagttggaaaccccaactctactacctcccctttttcttttgagatcttttaaggtgcttgggaggtactcagcgtacctttcaaactattgaatatcaaccgttgattgctaaagatgaatttagaaatagaaaaaacacgacgatgggtaatttagtaattgtttccagttctaacaacttctaacttcttcctgattgtttgccgctagcccctactctattaactgttgctcttgtattactttcgctcactaattctcatctctcgctgttgttgcttacattattacttttttttcagggacattataatagttacttattaggagataggaatattacataaatctatggtcattcacagtatcacatctgctagtcttttgaaggcatttttcttctctatcttttagataacctgagcatgccggtgtcgaccacgtcttaattaatccatgaatgagctaccaaaacttcaaataatatgacattccccgttctgtgtagatcaattttcataacaaaataaatccgtaattgttcacaatttcatgtaatccatattaaaaacttcgtaacgaaacaaattcgagaagaatcgaagaacttatatatgttacggtcatttccttttcatatctgatagattgatataataccaggggacaaaattacctatataccctcccacttaatctctatttttatacctgcccacctttttttaagtaactttctatgggtaccttgtatcgtaaaccattggattgtacctaatcaatggttaacgtgattttcaagtaccggagaaagtctcttttcttttttctttttcggttccagtctgtaatgaactctgttatgctttgttagtaaagctgggcggaaaccctttgatctaaaaaaaatatcgctgttaaattgaggaacctccggtgaacttattccttttcacgtgaatggaccgggtttcgtgggctttcaaatcgaggcctagacgtgaagagagtgtgggcctaattgagtaaatatcgtattgggccagtgggagaaatgggctggtcaagttaggtcaattggagacgggcgctttgggagtcgggacatgtgtgtgctagaatagtcggtgcaaatcatggaaacttcacgtgccactgtcagctcacaacgtggtcaccctccccggcctcttgctccctgctcatcttggatctttgattttaaccttggtttatcgaatggtttgttaatcacttttgctaaatcgtgtggtattattttacatcatcgtattaatctatttttcaacttttttatgttgatatttagggcatgtttgattggtaactaaatttatcacataaaatcttaggtaagtcataattttaggaaatgtttgtttttttcctgccacaactcgatccacatgttatagagtggactatatttttatctaactttatataagtttagtttgttactccctccgtttcaaaatgattaacaccgttgacttttttaaacatgtttaaccgttcatcttattaaaaaaattaagtaattattaattcttttcctatcatttgattcattgttaaatatatttttatgtaggtatataattttacatatttcacaaaagtttttgaataagacgaacgatcaaacatgtgctaaaaagtcaacggtgtcaaacatttcaaaacggagggagtattttgtttatcgtaaaagtacagtaagactaaggttgaatatgtgttaaattaattacgcggtaaagggaagttattgaaacgatttgatgaaaaagttggaagtttgtgtgtgtagaaaagaccatgtttagattttaacttttttttcttcaaactttcaacttttccgttacattgtttcaatctcttcaaacttacaattttaacgtgaaactaaacacatctaaagtttgatgtgacagaaaagttaaaagtttaaagaaaaaaagttggaatctagacaggctaaagagtcggttctgttttccctgtcccagctttgaagctcctcgccgaagtggccaaccttctcgcacggtacaccgtacacatcgccaccgtccatcttccgatccgacggcccagacaccacctgtgatctcccccgaccccgagccgttgccgcgcggcggatgcggcggctgcgtcgcccctcccgtgccggtagctggcgcgtccacacttcagacactccaagtccaacaacttaactttcacttcacttgccttgcctctgccgcgcttgctcggcacggcaacccacgcgaaatcggagattccttcgattcacgagatcaccacgagtccaccaccctcctcctctcgctggattcgatgggcgctcggtgagatccgaatcccccacggtggtcgccggagatgaagccgccgcggaggtggatgtacgggcggggcggcgggaaggggaagccggcggggctgctgctgctgggggtgttcctctgcttgtcggtggtgctgctgctgctgctgcacggctcgtccccgtcgctggagggcgaggggaggaagcctgaggcggtggaggcggcggggggagggggagaggaggaggaggtggcggtggcgcgggcggaggtggaggaggcgccgctgccgccggggaacgcgcggctcgccttcctcttcatcgcccgcaaccgcctcccgctcgacctcgtctgggacgccttcttccgcgtaagcgcgcgcctcgcccggatctcccccttcctctcgctcttgctcggatggctcccaatttcagcgaatgctggtttaatttgaatcctgattgcattgcgttttttgggggtgagtagggtgacaaggaagggagattctccatcttcgtgcactcgcggccggggttcgtgctcacccgcgccaccacccgatccggcttcttctacaatcggcaggtcaacaacagcgtccaggttcgcgacctcgtccccacttccgttggcaatgtgatgtgatccgtcggtagcagcatccgttgcagtccacactgggttcctgatgagttgggcatgtgtgatttgtccttcaggtggattggggggaggcgagcatgatcgaggctgagcgtgttctactcgcccacgcgctcaaggaccccttaaacgagcgcttcgtgttcgtctccgacaggtatggattatggaattatgatgtgtgctagtgtgtatgcttggataaagtattactgactttagatactaagttgattggcacaaaattttggcaatgcccaaaaaatttagtcatgtgttctgtttatagccaaaaattaagcactactaaattatttgtcttggttgaatagcaaatgcaagtttagtagaagcaaatgaatgcctagccagtttttgccagaaaatttggcaatggccagttcttgccattgccaaaaaaattggtaaggctatgaaccaaaacaagccctaactgcaatctgtgttggcttaatctcttgttcagcacaatgtgttgtttctaggttctgatcataatgaattaagggaatgttcctgaacataatgatatgtccttacatttttataaatgtggactgttatctagtaaagattgtttgttttttttaatcatcgtttggctaactaatttttttttccaatatgcaatgctcagatgataagtagtttctgtccgcgattttaagctcatgctaaaaatgtggtgcgatagcagtcctcaatcttaaattccatggaaatgaatcttgtgttatactgttagtctgtttctattaagtttaacgggactccacatgaagctgtactgaatttaccagatgccttggtgcaattttaggtatcgtttacacggttgtttttctgacagctccaaatttgaacttagtactacacatctttttttataatcttacaaagctcgttgttgcaccattttggatcttaattggattcatgcttactaggatcttctctctctgccagctgtgtgccattgtacaacttcaactacacttacgactacataatgtcttcgtcaaccagttttgttgacaggtataggcatcacaatttcgtgttgtgtttcctgatgatggttaagacttaagaatgaattctgagttcatgacaagtatcagctagtaactatgaatgttaaagaaaagaaagaaaaaaaatcatgttagcctttctcattttccattatctaagtatttccatgtaccttgagcttcaaaatggttcctgtagcaaactgcagatttgcagcttaaagcacctttcatttagcttgtataatatcctgggtattaacagcatccaattgcatatgctggggacagttttgctgatacaaaagcgggtcggtataatcccagaatggacccaattatcccagtggaaaattggagaaaaggctcgcaggtacctttctgtttctattgatgaaagataggagaattttgcttgaactgtgtaacagttagttttgataccttatcaccattcatttgtgccatacagtgggctgtgttaacaagaaaacatgctgaagttgtggttgaagatgaagaggttttgccagaattccagaagcattgcagggtatgtgactcaatatttatgcactctatgcagataaatttcagtattgtataacatagtttactcatgatcataactgaccagtgaactttttcaccttgtacctttcatcaaattaaaatcaggataacagaagttgaaaatttgaatattatcaatatttacttttttatgacagttttttgcattcgcaagtgaatgtgctctcaagataatcaacataggacacaaagaaacttgtagatttatgtaaactgccacgtatggtactgacattctgacaatgtttacgacaatgcatgatatcagtgatttattttattttattttttaaacctttttaatttttatttttaaaaataaatcattcgaaaacttatttccaagatctaaaccttttggccgtagttggttggcaaaacaacattgccacaccggtctggctggcatggcagcgttgtcttgccacaccaccgtggctggcaggacaaaactgtcacgcccgttgcgggtgacgtgtcagtgttgttttgtcacaccaggcaggctagcttggctaaaaggttcagattttggaaatattgtaaaattgtcatgcccattgcgggtgacgtgtcagtgttgttttgtcacgccaggtgggctagcttggccaaaaggttcagattttaaaattaaaaaggttaaaaaaataaaataattcgatactagtacctttgccaaatgaatagaagatccaccggatttttctatatcatcaacccaagttacttaactcatgtctctttcctatcaattagcttagagttgtctattcttgttcctattaaatgtacctttttatttattgcagagaaggcccttaccagagttctggcgggactgggatcgtcctattgtaagtgaaagtctccaataaaatactgaactgtcacttagcttgttgaacttgcttttatgtgtttatttttgaactgcagctggcacattgagtataataatcacaactcttgtgctatttcttgtactccataaaaagcttaattaacagaattattatctatggcttcaaaatttaccactgaactctatatctctatctaattgctctactgttccagaacaaagtttaattagtaattctgtgagactaaatgctgctcattttatccagcctgcggaggcatggaaggcacataactgcataccagatgagcactatgttcaaacattgcttgcagtaagtcaacaatcatttacagtatcccttgcagctgttcctcctcacaaagacatctgaccgttcaattatttttatcgaatgcagcaacatggtcttgaagaagagcttacacggaggtcagttacacacagtgcgtgggatctatcatcttctaaagatcgtgaaaggcgtggatggcatcctgtaacatacaaaatctcagatgctactcctgcacttgtaaaatccataaaggtatatgtttctttgcaatggcacattttttgttacctgaaagtggtgattatatagtatgtacatttaaaaaggaaattaagagaggctttacttttttttcttttatttgaaaattctgtcattattaaaatatttaagtacaaagcaacaaccaaggtgaatgttggaacctctgttgggtaatggcagacgctatcaattcatctgtttcaaagctttaacaaatgtcagtttggaaatgtgttgcgtctgataaggaatgtcagcttttgtttgtcatgtatacagttctgccaaaacaagctgcccgtacgaaatgcacatgacattttctaactattcactgagtacctatttgttgaatttttaggatattgataatatatattatgagactgaaaatagaaaggagtggtgtacaagtaatggaaaaccagcaccttgcttcctttttgcaaggaagtttacacgagcagctggtctgaagcttcttgatttagtaagttcaggacctttagcttttcatttcatatcgtgatgcaaacacaggcattcctaaacctaatgtattgtctaacgaaatcacattgtgatttgcttatagtttttgctctctccaaatttcccttttgcagtctttgatagcagcaaatggcgcatctaccatgtaaagtttctccgtcaaaagcagaatactgccagcttgcacatacgtaaaggaaagtggtggaggggacagaagataacagcgaattttttttgggcatcttcattacaatttgttgcactctgaaaagggacataggtgttctaaagcaataaagtttgtttcttttagcacctaggttagtacatatgttaacccactacttagcattataactgtaactgtaagcaaccacctgcagttggattggcaagaatcacctcagttcttttcacgacaaattcctttttcaaatttatagagaattggcatgtcttatacttgcatgcatactgtagtcattccatcgaaggcaatgcgtgatctggttacccaaacattaatcaagcatgttgaactcaggaactgcgtatttcacatggatttatactctcatagcagatctgccgatcaacatgcatgtttggcattctgttccatcagaaacatgggaccctagtgccgtggcaatggttatcccctacccttaggacctttggacttttgatggcctcaatttaaaactgtgctggctggagatgcagcgatggtgtagccaattcaatgattctcatcattgttgttcctccaattgatgtgttacttcttgtactcacaagctctggggcaattgtgactgtactggtatagacttaaaacagtattcagatactgtactctctactgcatactggcagtatcaatgtggggccatccatgcagtgcaacgtcatcaggagggttgctggcatggcacctgaggtggtctcatctgcacacaaacactgctatgaactctagattcaactctagattcatcagactactagctttggatccaaagagactatcaaatccttccatgtccagtcacatttgtccgtgcacttctgcatgcatcagttccatctgcttggtgttttgcttctcatgtcagattcccccaagtcgcacattatatcatgaagcattttattttttttcagctctcccttttctgcatagatctagtgcaatgtatagtatttatgttataatgttgtggtgccaaatgacaagaaaaggaggagaaaaaggtagaatgcgagcatatgcatgttagttgcttgagggtaagcctggtgtccctttcaggcattgcattgtcactgtcaatgtgctgcattgtccatgctgtctgcaagtgcagttctattgcaaagatgtaggagtactcgcattgtgttcacaggatttttgaggaataatgtgcatagaaattcttttttcctatcattcggattatggaaactggtcgtaggaaatccaaagaaaagtttcctttgatgctgattttacaggaaagtacaggaaaagtccatccaccttagaggtgtccaaacgggcggcacggcccggcccggcacgggcacgggtccggcacggcccggcacgggcacgggtccggcacggcccgtttcggcacggcccgttaggcacggctgatgaaacgggccgtgccgtgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgttttttttaaaaaaaaaaagcaaaggaaatgtataaggaaaaaaaattaaaaatggaaataaaatgtttaaaaaaaagtaatgatttactaatgttaaaaaatgaaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatataatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgtagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaatgttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttaagaacaaatagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttaatgccacgtggcgccttcccattcgaccgccgccagccctgtccgcgcctgacgggccgccggcgtgccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctaatccacctcaagctctttctttgcttcctgcgtgcaaatcctaggcaattgacttcctatgatccgaatgctctcaacttttgtattcctttgtttttcatttcattcctctttttcacgctttgattcttttcctattcctatacttttcctatcctatattttctttccctatcctatgatccgaacgagcccttaggcgttaaaggaggaaagggtttaacatttgagagtaacaagggatggcgtgagtgtggtttcatggtttgtggctgcccatgttcttttgttctgaactttggaagcaggtttcagaattagtctgatgatgagattttaaccagcacttattgcagtgcctcttttttctggggatggcacaaaaaagggagtagagcctcttttttttcttcgtctttttaccggtagtatttttctgacagaagtgaaataacctggagtttctgccccagttttttacagcaagaatacaggcatcaactcaagttttattgtctccaagtcttcaacatctgtgctaggtaagtgacagcgaagtttatgcagtaccttgacacctgagaagttgatagcaccattggttttacctggacttttgctcattacagttaattaaaaaaaccattgggttttgcaagtttatatggacaggataacgcaaaaaccagaaaaggaataaaccttgaatcaactgaaatacatctaagatggaactgaacttcagtttcattagttacaagaattagtttgcatatttgaccttccaatagtaccttcactgcaccagagaccagactccagagtgatcccctagtttgcagaatttccttttgcatactccaacaattttacacagctctgcaccgacataacaccagagacccagagtgacagcctgacactcatggacttaggagactaaacccaagcaactaagctagtgttccatttttttattaagaacaagaagaatattaagttaagctagtacttctactggttttcaaatgtatatgctgttagggataaggtacagcatgccatgaagttaacaccagacagccgttttagccatgaaaagaagttaagaagcatacaaccattttcaagacaaaaaaaaaaaaggagggatgaaatggtccgatggatataagtatgcatagcgaacatcactgcattctaaatccattcttttgatctgtacagaatcttgttggtagaaatagaatggagtactgctactaatcttgcaccccccacattggcatcaacaattggtatcaactgaaatacatctaagatggaactgaacttcagtttcattagtacaagaattagtttgcatatttgaccttccaatagtaccttcactgcaccagagaccagactccagagtgatcccctagtttgcagaatttccttttgcatactccaacaattttacacagctctgcaccgacataacaccagagacccagagtggcagcctgacactcatggacttaggagacttaacccaagcaactaagctagtgttccattttttattaagaacaagaagaacattaagctaagctagtacttctagttttcaaatgtatatagtccacctataaactgctagggacaaggtataacgtgccatgaagttaacaccagacagccgttttagccatgaaaagaagcatcgagccattttccagagataaaaaatggagggatgaaatggatgtgttatgcatagcaaacatcaatgcattctaaatccattcttttgatcttgtacagaatcttgttggtagaaatagaatggagtactgctactaaacttgcatcccccacattgacatcaacaattgctcccactgataagtgagatagtatcataatatttcctccacaccagtctgtccaaaaggcagcacagcactgcatctgcatgtgcagtttctgtatgcctacatgcattgcctctagccatgggccatgggcctctccctccactaaggctccgtttagctccccaaaaacttttctcaaaaacatcacatcgaatatttggatacatatatgaagcattaaatatagataagaagaaaaactaattgcacagtttgcatgtaaatcgcgagacgaatattttgagtctaattaggccatgattagccataagtgctacagtaattcacatgtgtcaatgacggattaattaggctcaaaagattcgtctcgcggtttccaggtgagttatgaaattagttttttcatttgtgtccgaaaacccctcccgacatccgttcaaacgtccgatgtgacacctaaaaattttcgtttcaccaactaaacatgccctaatagtgtgtgtcagagtgtgtgtaggcaggttagcaggtaggtgtaggagagcagccaaaagagcaagatgaactgtagcaaaatgagcaatagcaagatcaagtggtgcatcagactgatgataatggagtgcaggaatggtcctacctcagttacctgtcttttcctttgaagttgaaccatggtcaatttcatggatgatgaaaatgtgtgttgttagtagtagtagcaacagtagtagtactcagctatgatcaaggttactaatgattgctgttgttacaacagtgttgtagatactactcctaattaggagtactagagggtttttcattgagtcaactagcaacagagattttgtgaaatttctttttcctggttggcaggttcttagctaatgaaagtcttacttctgatgaagagaaggtagtaaaagggagaaatcatataaggcatatatggccagcatgtccagattggattctatttgtgcctattgtttctggagtgatagtaccggtcaatttttccaactaaccttcttttctgtcggaagataaatgattcaacattcttttcgattgtaggtgttaaaatatgctcgatcttctgggactttttttacccactttgaatggcggttactattaggcttcatgtttaatgtgtttttcacctagtgcatcatgcttcatatgttcctacgcagggcatgttttgcttatttcataccataaggattcttgtctcttattgagctttgcttatttcatctcataggggtttttgtctcttattgaggctttctttaacaataattatgcctatgttcatcctagatatagaggcctaggatgtaatcatcttccttatctaaaaagttgttaaactaagcagtcaagcctgttggaatacaagaattccaccacatgctctgtagatgaacccattttatttaatatactgtaattttccaacgaggtaagttttgccaatggcctttttttaagagaaattttacgattcttaagaattaacaataagcagagcttgctcctgttatatcaatttcagttttttcttaggacagaagtaacattgtactattctgactaactaattttccatgcattgtcacagtaaaaagaaaaaggcatactacattaatatcagaatctcatgacaatccactgacgttataaattgttgcagggaatgatcatatgcatccatatgatccacaaagcatagctgaacagttatcacatttactcctactccaataatcagagggggcaaaacctaccatcctcatcatgaactacagctttattacatagtaaccgtaaaattcagatcaattacacatttgtaccatcatgtatagctgccatgccgtaccacttacctgaagtcagtaaaagatttcagtaacttagtaaaaaaaaaggagtcactgttcactgttggctagcaaagcaacaaacatggccacagatgaatgcagctgcactcatcagtgaccagtgacctcactatctagtcacatacaccaacccccaccatgactgactctaaactttcacaaggaaaaagcaatgagcatcatgaagactgaagaacccagcaaacctggaaatgcaactgttgcatatcaatcatcaagaatctcttcagaaagaggagatgatacttcagagttcgaagactactcctttaagataactgaagctttttatcccactcagtcaatttcatcaagatgatacaatttaccttaattacactcccgacctctgcataactaggatgaacgcatggagaaaattatactgaagcttcaagtgctgaacatttggtccaaaatttaggaatgccttgcaccttggccacatggagagcacacttggaaagcttcactttagcatcttacgctggacagcatccaccaacatctctctctctttctctctagaaagttactgggtgacaccacacagaaccccactgagagaggccagccaaaggtcaccaatggattctggagagagagaaggagagagaggggacatgaaaaacatatggctagtaaaatgatgtaagcatggagatgtggggtgctcattttgagacaattatgctggtccttgaaacctaaaagctgtgctggttggtgaagatcactgcaattcgcagccatttcccattgctaattgctaccactccaacatcacaacaactttgcattgttagttgttaacttcacctcctactctcctagtttatttttagcctcattttcacctgatacatggactatctttctactactatgtggtaacaatatccatgtatttatagggaggagaagaagaagacaagagcaccaatgtgtggcagatacagacagttttcaggagagagcacaagaagaggcagcagcagaagttgcagcagctagcttgtcattgatcggaaatcggatcccactacaaaattcaggcggctccaaaaacccagatcgatgagctccactctgatggcttcttgctgcttcatcatctcttacaagaggcctcgcccaatcattgccacctttgtccccttcctcctcctcctcttcttcttcgccgtcgtcgtcgccgcctcgtcgtccagcaatggcacggcggcggcgctccaccccggcgaggagctgctccggcttgagagagtcagggcacagctcgccagggtcaggagagcttccgtcaagacgatccaggcatgagcatgattactcaatcttgattagctaatcttgtttgatgttcttggagttcttggttgatcggcatatttgcggatgattgtgcagagtcccgacggcgacgtgatcgactgcgtgccgtctcacctgcagccggcgttcgagcacccgaggctgagaggccaaaagccagaggtgagcagcggcggcggcggcggccatggctgccgctgcagaagcagtggagcagtgacctgacctgacctgaccattgcgtcgctgtactcaacgtacggtggcgcgtgtgctgtcgcgtcgagctgatcaatgattgattggtgtacggctctgcgctgcaggagccgccctcggcgaggccgacggagacgacgaggaggaggaggaggaggaggaggagtcacgcccacggcggcggcggcggcgagcaccgggaggaggaggacgacggcgagcacgggttgcggcaggcgtggtgggccgccggcgaggcgtgcccggaggggacgataccggtgaggcggacgacggaggccgacctgctgcgagccagctccgccgccgccgccggcggccggttcgggatgaagcctcgcggcgtcggcgtcgtcggcggcgcggcgcggcgcgactccaccagcagcggccacgaggtgagtgccacgtcacctcagcttcagcttccgctgccgacggattcagacaagccgtactgccgtgctggagtgcaccggcgctatagatggccatgtgggccgcccggcacggcacggcccaggcccggccgtgcctgggccgaggcttgtcgggccggcacggcccgaccgacgcaccgggccgtgccgtgccagcccacgtgccgcactcacagcccaggcacggcccaacacgcctcgggccgtgccgggacggcccgaaggcacgatgggccatcgtgcttttcctcagaataagtctaaattttctccctcctattgggctgtgacattgtatagctaaaaaaaagtctattttacctccctcttctttgtggtgtggtatataaatagctaaaataagtctatttaaggtccctattctttagacattgacatttatatgtctatttttagtccctatactttgtgtaccgggtctggcctgccagcccatcgtgccgggccggcccgaccgtgccgggctagcccagcgtgctggtggggaggcccaggcacggcccgacggtcgggccgggccggcacgggcccgacccaagtcgggcagtgccgtgcttgggccgggccaaaaaggcgtgccgtgggccgggccttcgggcctcgggccttatggccaactataaccggcgcggcaggtggacacgtcagcgtgccacgtgggccccaccacagctgacaagccctgtgcatgctcaaaagtttatctatctttttcaacaaccagggttaaaattctcttttgtgaatcatttgaaaaaactggattctgaaacaaatgagtttcttttactgtcaaagggaaactacaatgatttaaaatcgagaaagtttttttaattcggataataaattaatttctttctttatctatcataggtcatgtcaaatgctactatctccggtaataaatatttaacgtttaagataatggtttggttaaactttaacatcaattttgtgttagaatattttttttagaaaaatgataaatttatgataatatcataatactttttaagaaaaacatatgcatgcaattttttattttttaagactaagtatttaataaattatcgatagtataactataaattttaaaagtttgattgaatcttatcttaagcgtcatactaaactttgagaaacttcaaataaaatagacaaatttgattttctttttctcggacattgttttattattacgtcctttccgagataattttttttattttttatttcattccaaaactctaaatcatatgagaaggaaaaatctaaataaataatacttcagtagtaagaagtctaaagaagtacttttgtcggtaagaaaatgttactgagtacaactttactgaattgagctaaaataacccccatatatacttgtatatggtagtgatgcgaagtttgttaactcgtgtgtactacctccgtgccaactcccaaaataagtttattttaatatattaatttagacataacttatatcaagattaatgtccaaaacaaaactgaacttgatttgagatggagggagtgcttacttgttactaccgtcattgtttggatgttgtcttctcaggcacagtcaaaatttgaattataatatttaattttaaagttaatcttaaggtttttccttcattgtttatttatcagtattagcttttaaatcgctaagaatacaaatataattgtttttacctgtattttttttcctgtaataaccaacaaggttttgtttgccaaataaactggcgtgtgtcggtcagatgccgatggttaatttacacgcacacacgccttacggcctcattgtttcacttatttgtggaataagccaataggtatatttgcaaacgaaaaataatttacatataaaacttttatataaatgttagtgatctaaaagtaaatgctgaaaaataaacttcgacaataaaaccctaaaatcagctctaaatttaaggttgaaattcaaattttggttgataagcatagggataagcgaaaagatgagggctttaatttggttgcgttgatactgacattggtgagcaaaacaaatttatgcatatgcagcatgcggtggggtacatgagcggggggcaattctacggggcgaaggcgagcctgaacgtgtggccggcgaaggtggcgtcgccggcggagttcagcctctcccagatctggctcatctccggctccttcggcaatgacctcaacaccatcgaggccggatggcaggtgctacattttcttttctttctctcctccttttctgaaacttgttcagtcaatcaggcctagctagctagtagccagtttcagagattacattttactctcagctctgcatactgatcattcggattttatcggtttatcgacggattccgtggataccgctcgtgagcggattttgatccggtatcgggatcgttaaccctgaaaccaacgctacattttcttaaacttattcaggcgtagccaatttcagagattgccattgctctcaactctcaactctgaatactgatcgtatctagctacctgtatctttctgatgaattttcaggtgagccctcagctgtacggtgacaacaacccaaggttcttcacgtattggacagtaagttctttgctagtaaagtagtaatctgttcctagtgtttcagtattagaagagagatagatcagtcagttcaaagaacaagttactgaagaatgatgcattgtgcagaatgatgcgtaccaggagacgggttgctacaacctgcactgctcagggttcgtccagaccaacagccggatcgccatgggcgccgccatctcccccatctcctccttcgccggccgccagttcgacatcaccctcctcatttggaaggtatgttgtgcgcacttttctgtgaatttcgaatgaaatttgacgaatttcaaacaaagcttgaaagccaagatttgaatataaactctcccgatgatttgcgatcttgaacgaaattcgaatatattgactggaaactgagattgtaaacatataggtgtataagaagttagttctctcaaataggctcaataggccaaaagtgatgggcttatatagtccatgaagtcttttcctttctaaaaggcaaaattttcatagatggagatctcaaactacatataataagttaaacttttttttttgaaaatttactatactacttagtactacaaatgccatggtatttataggaatttaattcaattcttattttctattcaaatttgaattttcatgaaaccattctattcccatcttgagctgtctcgaaacaccaaactttgcggaattcactcgatcgatttttattgggaatgtgaacttagctttgtcagcatatactctaacaacattatcttttcgcttatacttatacttatcagctaaaatttaaattttcaatcttaaatttagatttaattttagggtttatttatcgtagtgtatttttcaccctttgcttgtagatcgttaaaaacacgtatataaacgttttattcacaaattatttttcacctgtaaatatgccgttttgttttttcctccaaacaaccaaacaatggggttgtaagaatctccaccttctcaaagcagttcgaatccttcctccgaattcaaactatgaaaatacatatagaatctaagaatgaacaggtagccaaaagttgccaccgtagcttttccatattctcaccagctagttacatatcaattgttttcttcaaacagagcctcagtttaagcactgcgagatttgaacagtttttttttgtgtgtgtgcttaattctctcacaatctgaacatatttgaacagctaaactccaagatgatatttgaaactgcacgaaacgcaccgtttagtagcttgaaaccgagataaaaagtctgaataagcgcacgaatctcaacgcaggacccgaagcagggtcactggtggctgcagctggggtcgggtgcgctggtgggctactggccgtcgttcctcttcagccacctgggcgcgcgcgccgacatggcgcagttcggcggcgaggtggtgaacacgcggccgtcggggtcgcacacgccgacgcagatgggcagcggccgcttccccggcgaagggtacggccgcgccgcctacttccgcaacgtccaggtcgtcgactgggacaacaacctcatccccgccgccgccctccgcctcctcgccgaccaccccgcctgctacgacatcgccggcggccagggcgccgcctggggcaggtacttctactacggcggccctggccggaacgcccgctgcccatgagatgatgatgctagctaattcaaggaaaatatacgatagagtaaatcttctctttgttttttttgctttttctttccctctcaatcttcttcaggttcttgtgtgactgagcatatgttcatcgagttttagcttagtttgattatttatgtatatttttgcattcaaatttacagtcttacatcttctctttgttgcatgtgtaatgcattcgtcttgagattgcatggattaatcggagagaagaattgcaaattttgggggaaaaagtacgccggaggtccctcaacttgtcatcgagttacaaaatcatcccccaatcgtaaaaccggatacaacgcatccttcaactaacaaaaccagtataaactaggttcctcagcagtttgaccctgattttatccgacgtgatggctaaatcaacgtaggacccgtgttggccccatatgtcaggtgccacgtcaacagggtctctcttccccccctcctctcccttcctcctcctctctctcactttcttctctccgggcaggccggccggcggtgggaaggaggtcgccgcgccgtcgcgggaggaacctggcatctgatgaggcgcgctgccgtagtaggagccgggaagcggtggcggcgtgcggcgtcggagccgcggcggggcgtcggggaggcggctcggcgtcgtcgtcggacgggaaacagatgtatgtatgagcaagtaaatcggcaatggtgattagtgatgcaatgtcacatcgagctttcacgccatagccgccagaatctttggaacgatatataagagcagagcaagtcaagcagtcaaatcaatagctcaagcaaacaagcttgctcggttcagttccgacacaatgcttgccttgagctgccagccattatggccgccggattcgtggacgacgaggggcggcgccgggagggtcatggcgttcgtggcactgtcctgcgccacggtggtgatgggcggcgccatctacggctacgacatcagcaccgcgggcggcgtgtcgtccatggagtcgttcctaagggacttattaccggaagtgctccggcggatggcgggcgccggcgctggcgcgcgccgcgtcagcaactactgcaagttcgacagctagctgctgacgctcttcacctcgtcgctctacatctccggcctgctcacctccgcgctcctccgtcgtgggtcacggctagccgcggccgccgcgcgtccatgatcctcggcggcttcgcctacatcgccggcgtggcggccagcggcaccgctgtcaacgtgtccattgccatccttggtagggctttcctcggcgttggcctcggcttcaccaccgaggtcacaacactgaaaaaatcaaattattctcaaattcttgatgtgccatttggacaaatcttctgcaaagttttttgaattttgcaagttcttgaaacattttgctgtctatgccactctgcatggctgaaatggcaccggcgcgatactggggagcattcagcaacggcatccagttcagcctttgtttcggagctctcgccgccacgaccgtgaactttgccgtggagaagattaggggaggttggggatggagggctctcgctggcgctggccggcgtccccgtcgacgacgagctggacgagatcatcgccgcgaacgccaccgcggcgcagggagagaacgccctgtggctgttctatcgacgaggagccatggcggcgggatctggcgcccgcgccgccggcgacagtggcggcggcggcgttgggaggccctcctgctcccacgtcgtcgcctcgttgccgccgccgcctcgccgccggactcccgcctccccactggcctcctcctcaccggccgccggctacgctgctagtgagagaatagaaagaggaggaagagatgtggagagggtaggggaagaagaggttgacacgtgggacccacatgggtctcacgctgagtcagctgccacgtcggaaaaaaccggagttaaaaccgctgagggagctaaaaccgctgagggagctagtttgtactgtttttgtaaattgaaggatacgttgtatccggttttacagttcgaggacgattttgtaactcgatgacaagttgagggaccttcggtgtactttttccaattttgggatatggtgatgtgggctgaaatttgattttgattttagagaggtaaatgggccttgggaagttgggatgtgcacactctagcccaagcccaaatttgaaacgatatgaagcccacaatgtcttctttcctgagatgaggcccattggcctttttagcctttgcacaaaacaaacttgttcttttttttttcttcggggacacgcaacacaaaacaaacttgttgcactgaaaaagaagaaaaaaaataacttggtcaaatttagaaatgctagggagctagtttgtgaccaaatgcatagtggtgtgcttgtgtgtgtgtgtatctactctacactctcttatcttaattctgatgatagtgccccttttctaggagacttttatgccaacatttttcaaggatgtgtgaatgtatggttttgagtgtgtcaagtggaacattgcgtccaaaaattgataacgataatactcatacagaaaaaaaaaaggggggaaagaaacactaggcaaacatgatccatgcatgactagggtttaatgtttcggtttgctgatttctattgggggtggccgaaattctgaaatttcggtccgaaaatttatgaattcttgaataaaatttgatcaaatttgaacaaaatattaccaaattcatgaaaaaaatgaaaaaaaatttaaaaattttgatcgtattgggggggggggtctccgatagaaccgaaatttcgatccgaaattttgaaccctgtgcctgactgctggagcaattttagtattgtcgccagtagtttctaacaggcccccttttagaattttttttttgtatataatatcactgaagtttgggacatgcaagtcctaagtgaatgcaatggcatattggcatcggaaaataggactattgttgatgagttggctgtcatcgtccttattaaatgatttaatcattggtggcacgcttccattaattctgattaatgacccatgttgctctacaaagggccctaaactattagctggttcaaaaatgtagaccccatgtacagactaatccacatctaaaagagcatcttgctagcttacatatgcagttgatagcacaaatcaagattggaccactcaagaaagaaacaaaagaaatgggacaatatgaacaacaagaggaacatgtgctctctttgacaaacatcttcacccataatatggctagcaattattactttagtgggataatttacactaataatccattgggcgcattatgccccaatttatggtacaaaagattattgaccgtcatatctcctatgatcactaaataataaaaccctaagcacaaagataacatattcccaatctgtacccacaagggtgcacctagcaaaacgacacaccccctacagtctatggcaagctgggcccaccagcaaacagtaaaccatccttttcttacaggtccccgtgagtgcctacacccatggttgcatggtcaacatcaacaatcatcaccctcacatcacactgctagtgggcccccttcagtttgaactatctatattactgtattactcactcctgatcgttgagcaggcccaaggaaccggaattagcacgggcttggagttgggcttgggcctgggccggtctagcaagggccatgagtttggtcggtgaaatgggctgtctcgggtcagcccgcttccttgtctctgcatcagtaccaactccattgccggcttttcttgcctcgacgccatcatcgtgtcgaatgccacgtagcaacgccgccacatccttcatggtcggtcgatcctcaggtcgtgggcttgcgcatagcaatgccatgccgagagcttgcagcatctcttggacctgggtatcgggccggccctgcaacctcacatcgatgatctccgccgggtctcgcttccggcaaaggtggtcgcgcacccattgcaccacgctttgtccctccccgaatgccgggtccagtgggcggcgcccggtgatcatctcgagtagcaccacaccgaagctgtacacgtcactcttggttgtgatcttggtcatgcatccatactctgcgttgatcaagatcaaatatcagccattgattaatcttgtgcttttctttttaaaacaaattcaattaaactgctgaaattttgtttgaactggtgaatgtgtgtgagtgtgagaaaaggctcttaccgggagcgatgtagccgtaggatccggcgaacggcggaggcgatgagctggcaccgtcgtcggcgacacgggcgaggccgaagtcggcgaggcacgcctcgtagcggtcggcgaggaggatgttgtcggccttgacgtcgcggtggatgatccctggaacgcagtcatggtggaggtaggtgaggccctcggccacgccgacggcgatggcgaggcgaacctcccactccaccacggcggcggtggtggtggcgccgccgcccatcgcgccgccgtggagcaggccgccgagggtgccgttcgggaggtagtcgtagaagaggaggcgcgtccggcggttcgccgcccagcccagcagccggacgatgttgcggtggcggacgcgcgggagcacgctgacctcgccggcgaacgcctcgatggacgcctcgtcgcacgacctgaacttcttgacggcgatggtgacgcccgacgacggcatgctcgcgcggtacacctcgccggaccacccgtggccgatcacgttcgccggcgtgaggctgcgtgccacgtcggacacgccgatctccagcttctggtacagcgtcacgtcccacggcggcgacatctcgccgtccttgtcctcgccgccgcgggcgccgccgccgcggcggtgccacccgaagaggacgagcgccgcggccgcgaggaggacgacgagggccgagagcagcaccgccatcgcgacgcgggcggcgcggcgcgcctccacctcgcgctcgctggcgtcgccggagcaccgcgagaggcacagcgccgggttgccctcgacgtcgctcgtcggcagtctcgcgaagaacgccgtctccggcagccggccggtgaagccgttgaacgagacgttgagcgccacgaggttctggagcgcggacagcggctggaggtcgccggatagctggttccgcgacacgtcgagcaccccgagcctcacgagcccggcgaactccgccggaatcgcgccggagaagccgttgcagctgaggttaagcgcaatctccagccccggaatcttgccgatgctccccggcacatggccggagagcgagttgccgccgacgtcgaggagctggaggcgcgtgcacgagccaatctccggcggcatcggcccggacagccggttgccgccgagaaccagcttagtcagagacgtcagcatgccaatctccggcgggattccgccggcgatgacgttgtcggagaggtcgaggtactggagcgagagccagtcccggaacagcctcggcggcagctcgccggagatggcgttgtcgtggaggtcgacgaacgtgaggttccggcaccccgacatctccggcgggagcgcgccggcgagccggtttgacgcgaggtcaaggaagctgaggttcccgagcatgccgatctccggcggtatcgcgccggcgatgtggttgccgctcgcccggaaccttacgagcgccgcgcagctgccgatctccggcgggagctcgccggagaggttgttgttgatgagcagcagcttggacagccgcggcagccggaagagggagcgcgggatggcgccggtgagcgcgttgctggagaggtcgagcgcctcgaggctcccgcaccggccgagctccggtgggatgctgccggtgagctggttggcccagaggtagagcatgcgcagcgccgggaggcggccgagctccgccgggatgccgccggtgagctggttgttgtcgagctcgaggtcggtgaggttgctgcaccgggcgagctccggcgggacggcgccggagagcttgttgacgctgagctggagctcctgcagcgacgagaggttgccgaacgacggcgggatgtggccggtgaggccgttgagcgacaggtcgacgacggcgagcgcggcgcacgagccgagctccggcgggatgacgccgaccagctggttctgccatagcagcaggttcctgagcttcccgagcccgccgagctgcgccgggatggagccggacagcgcgttctcgtagaggtagatgttctcgaggcacccgcaccggccgagctccggcgggatcgggccggagaggagcgccgtgtagatggccagcgtggtgaggttcttgagccggccgaggctcgccgggagcgggccggtgatgctggtctcggcgaggccgatcatggtgaggctggagcaatcgccgatctccgccgggagcgcgccttggaggttcttgttgccgccgccgcggagcacctcgaggctggacatcttgccgatggacgccgggatcttgccggcgagctggttgtcgtagacgatgagctcccggagcgaggtgaggttgccgatggtgtcagggatggcgccctcgaggcggttggagttgaggtagagggtctccagcttgctccccggccggcagagcgccgccggtatcgtccccgtgagggcattgttgctgaggtcgaggtgcgccagcgccggcagctcgccgagctccggcgggatcgggcccgtcaggttcgcgccggtgagcaccagccgtgtcagcgtgcgccccacggcggcggcgaggttgcccggcacgccgccgaacaggtcgacgaactccaggctcagctccgtcacgccgccgtcggcattgcacgtcacgccggtccaccggcacggcgacgcgtccccggccttccagtccgccagcgcgccgccgtcgccgcgcagcgtcgccttccacgcgagcagcgcggcgccctgctcgtccacggcgagcacgcagctcacgcgcagcaccacgaccacacacgccatgaccatcgccgccgccgccgccgccggcgacctcgacgccattggcgccgccctccatctgcttctgctactcatcacgcatatacactaataaccacactctttgtacctctacttgtatgcaagtatatccaagaacacacactactatgcaaagtgtagtagctaatcctatagggattctagtgtacttgtgttaattgctcccaaatcttggtcttgcttatgtcgcaagactagtactaagtactactaacctctaactaatcaatgaagtcctaataaagttttagtatgaaggagagagagagagagagagagagagagagagagagaagagagaccatctcaaatggtacagtttttatatgcttgtagggaagaggtgagatcaagaaacaagaatgaggtgtctaaataggtaggagaggttgaagagtttttgagtctgatgagatcatgaaggtgaatgaagcaatggagacttgtccctgtccctgcagaatctctggatccaaggccacagagcacagtactaacactgcactctgtcccttctatgactactttagtagcaatctcttatggcctctagtagcaatgcacataatcaccatggttaatgctgctgttaggattggtgattgggtgtataaatttttgacagccatcaccaacgactaattgctttgcaatgcagtgcaatgccccaattggagcttaaagaggggagtgagagaggatgcagaaattttttaactgaagcaacagctttgctggcttgagagtaaaagatggtgcccccagagacatggcaatggcatcaggttaagcaacttcatggaaaggctgtgtgtgtcaagggggatatgattaaataagatgcagttagagcaacagctttaacagactgtgggtaaggacttggctgtagattttcacatctcagggtggtaattgaacttactagtatgaattaagaacatcaagagttgacaacttggaaatgggaattagtaaattcttacttgagaaaaatgggtcatcggtacttcagaaatgcagaaaaaaactctgaatatatgggcagcaaagtctcaagtcagtaactcaaaaacatagatgttagaaagaatagagtcatgttgattggaatataagacaacaattaactgacctttttgccttgtttgattacatattaacagccatttctgaatgtgatcgtgtaagtagacagtaaagccctgcactgtaattatgatcattgcagggtgagaattgaactaactgcgctggtaagaatctccagagttgaaagttgaaaaataagaataaaaagggacatcacagctgggtgcttagtggtaacacatgacacacagagagaagaacacagttcattccatgcagtaacaattatataaaccgcatggcagaggctgtttcttgtcaggataaacagaaaggattggatcttaaaaaccccagcagaggctgtcacatgcccctggttagatctaatctcacctttccactgtcaagttcatagttaattactactgcctcttgtactttgtgttaatggtgaggaagccgccatctagctagcagctggattatactagtaaaagtacaggaaattttgcaggctcgcagatctagatctaccttcttctccaaattcccatcggtaaatgggcagttcggattgaccaatgctgaactactaatcccgtagaagataatggaaacttgcagagtatttacattggggttagaacttccatttgcagtgttggtcgttttacccgaaaagatagggtacatgcttctgcctttgcagtaaaaagatatgtttatgatgtgtatttaactagcatgtagaagtagaatgcttacatgagtgaacattctagcatgttcaaatacagtgattgacaagtgtacatgaacaaaatgaggagtaaagtctaatgataatttggttaccggttattaccaccagtaaaaattcacggatgattcttgttcataccttacagttctcatgaatcatcctgagattagtgttcattaacttgtaacaattcatcagcagcgaagctgcataactgcaaaagctaaccaagttatacatgaatggaagggaatggagggagagagagtcgtacttgcttaattactgataaaacaacaagtaaacaaataccaaagagtacaatcatttgtagggtgcacagtttccaaggttttcaccacatcatcacctagatctaccagcctaaacatgtttacccaattcatttattgtgtccttagcatatggcactgtcagtcttgttgacaaattcctgatcagttcatctattctcgtgatgcttgtgcatgcaattcatgacagtattttaaccagcgtttagttgaaaggcatctcaaagagccagcagtacatatcatttttttgacactagcagtatatatctttgatttcactaagcaaaagtgattaacctgtcacgtgaggcagtggactcttgagatacttgccgcgtgactgtatccaaccatcaataatattccaattcgtctgtagctcctcctagacatggtgtgctattgctactcatgtggctcatcttttgttagtgtggtgcaattacatgtaaataattcaaactgaaatgaaagggaagttttaagaacaaaagcaaagatcacacttataacagaaaggggggaaagaaaaggaagaaaggcaatcaaaatcagaaatattttaaagctaaactgcaacttgctagtaacaataataggcacaaagattgcattgtttaaaagaactgaaatggtgttagtgaggggaattgaggaggagggaatctaggcatgagatgtggggaggtggtagggcacatgcaggagtagaagacatgaagaatacaatagcacagggcctgcctaggataggcatcatgtgagaaggagatggtggaacaagtatacatagatgacagatatcatggggggaggtggccatctgtttaactccagtgctccaggaaactaagggcatgaatcatgatagacaagtttttttttttggatgaaaaatgatttttctttttgttgaaaacgcaggaggaccacacttcatttcattaagaagaagaaaaaacacacttacacaggagagaccaatttgatgaaaaatgataaggaagctattagcaataaacaagtggaattagtgccttaagtggtgcttcgtactctcgtgatgagcaatgcacaaaaaagaacagccatggaggtacagggtggggcggctaacaatatgcaatttcttgtctttacaaaaaagaaatgtgtttttttgtcgcttggtgaggcaaagacttaagcagacaaacagactcacctagtccattgtacaactccacattccaaagaggatatgaagataagaacagagaaaacacaattggttgctatgtgtgattgtgtgatgatctggatttttcatagaagtgttgaagtgcagttttgctacataggttaattttcacttcatctccaaatggttacctgatgaaatatttctcaacacaaatgcatctgccactggaagctaaaatcgtaaacctctcccaagaatatggtttcctactgaaatcatgaatgactcaatgaacgaaacagtttacctgccaacagagaaacttagaaggtttagtattagtttaaacatatactccctccattctcttttctttattttataaattttctaagtcctgtcatgtttgaggataatgccattaccagttaaatcgaagttgcagaaatgaaagaaccttcaggtatgaagcagagatttttcttttggatatctcattaacaaatgcgtgatacaaattttgtttatgtgtaccaaaatttcacataaatacatagcatgtgcttcatcaagactattacatatgaaacttggtcaacactaacatcatgaggtaggtattttttaaatcacagtttcatgtattagcatcacagtgtttccatcaacaagttggcaaataaggagctttactacttttgcagttatcaattactccaataaaactttcaattagtaacatggtgaatcaatcaatacaaagctctcagggggtggacttgtagaccacacaaaaatcaatcagttctttagtgcatactgtgaaatgattagattcaaatatagaactggtagggggtcaattaacacacccaaactataatctttagctattatttaattgacaaagataatatagttctttagagaaccatcttgggggcagtgcccgggttttgagggtagtggaattaagtcctttgatctctttcggctctaagcagcaattaaaccaaaagtactcatataagcacaccatagctgttaccatctacctctactttctgacctcatcaccttttatcatgtgcacctaattatacagtatattcgtttcttgttcatcatcagcttaaaccttctcctgaaattttcaaattattaatggttcccaagaaagattagctttgcttttcactgcactcctgttccattgtaaagaggttacttgtggaatttgctaactacatatgaagttaaatgttcctgaatgatcatatgaatttatatcgaaactgtgtggtgacaaaagtcttttgcactcaaccagtgtcaaataaaacgcatcacacttttctttgatatactactttcattaaatcctaagtttgtacttactacattcatttccaatatcaccttatgttactttcaggagtgaggttccatggtcaaatcaaatgacatcaagacatagaacaatgaagcaaaaatccaaggtgcaatgcttccaaaacagatgctatagcatctttgcattgaaattacaaattgaaagggaatgcaactacagtaaaattgacctaagaactcatgatcaagaaccaataggtaggagagaatccacgtgcattacaggaacacataaatacaaataagtggattcccatttttccatcgcttgaattggatagataaatcacccaggacaactaatcaaataccgcaccagctaatccaaaatagaaaattgaaataattcagtttacgggaagcattacaatcaccaaatgtgacttcttattattatacaaattgtaaaactgtgtgggaaggattgcatcatctcatagtgatcccttcctcaatttaagggaactgctacattgcattaattgtatagcaacaaaaaagaagcaaaaaaggctcaaaagctcaagggcacttacatttggacggtgtaaaaagacagagaactatggcagtaagctatgatccaaaaatacagacaaaaatgaagtcaagttagctttttgcaagtccaaggaaaaactgtgtagtatgtcatggcacaaaaagacataccaaaatgatgtcaccattttgtttctctaaacactaattcataaggaagttgttttctgtagctcaatgtatggacctttttacacggatagttcaccaactttatgccatgaatcttagccaagattatttcaacaaaagtagagtctggtgagaatacagtataccacagtccacatataaaattagttttggtaaaaactattgttctcttcagcacggccactaattgcacagcaattgcagagcaacaaggaccagaaactttcacatcgatcttccatcagtttgtttcacaggcataactcttcagcacttatattatgtgatgtcaccatcattctcatatttatagggaaaacgttcagcaaaggtaaatttccaaatacttaagtgctaagacaaaagaatggtctcactgcaaaaagaagaaaagacaaaagcatggtttcaaacggtacattctaatttatttccggaaggaggccccgaatgttaaaaccaaaaaattgtacatttggcactaaatggtgagcccattaacaacggaacaagggccactttcatcttctcacatgggcaaacagcacattgactgaaagtgatagcacgaagtagaactataattgaggaacttactgatacagaaggaattgaggcaaatttcataacaatttgtagaaacaaaaacttcttgaaaaaaatgaagggatcttcatgattctcaaatagatatactgcgattaccattttccctatcaaatcaaatacttttacattattacaataaacacttcaactaagaataaccaaaatcttcttcattagaaaaaggagaacatcaccacacgtaccatttcataacaaaataccacttacaacaatagaagaagatttcagaatggtataacaaataacatgttatggccatataaattttgttcctgttttatatagaaataattgtgccaaaatcaaaccacctagaaaacttctttacttaggtttaagcacatagctgaatagttttgcttttaatgtccgaatcataaatattttggggtttcaaaaaaaaaaagaatcataaacatttcatgaagatttccttttttcctgaacacatttttctccaacatggttttcaatcaaattggattcatcacgaaatttcctcttccttcatgctgcactcttgaaaaatgcacagcaagtagcagtttcaaaaatagcatcagcgtgatacaatatccagaagaaacacaaaggccatcacagggaataagaaagcgagtgcattgcatatgcttcctgctttatccatataataggaactccttttttcagcagcctattagacaatgtttttgcctatcatacggatacaaaacaaaagatatgaaataaagttgaatggaacaggatgtgcagaggatacaacacaaaagacatgaaacaaagttgaataaacaggatgtgcagcaaagcggagatgcacaacaagtgaatcagacagaaaatgcagatgcacaagtgtatcagacagaaaatacagatgcatacatgctaaccaaaaccaaattgagaactaagatgaacatttttggctaatgctgtattttgccaattacagtacaagttcataacccctgagaccattcaggcaagacagaatggaaaagacgacacatcacctcttttgcaggaacagtgttcatgatgaaaaattgaaaaccactagttaattagactaagctactacctgtgatctgtgtaatggaacagcaagcaagcaagcacctccagttcatcagaactccaattcccaggcagctctctatatatatatcactatatcagaatctggtgaagcctctgaatcatgctgtaattgcacagtcaaaaagatcatacaagctatgatgatcgaagaattgactgaacgaatgatggtaccttaatcttaaagcacactccaaatgacacacaactaatgaacaaaaccagcgtgaaaaaaaaaataatcagaaaccccttctcgttttctctgcataaccagtagcgggaggacgagatcccgcgctcgcgctcgcgcgatgaaccattcccctttcgctaactcatgcagtgctacgactacgagtgatttcccccatcccgcgacgcgcaaagcggagtgatggtcggagtcggagaagacgagcacaaagagagggaggagcgtgttgggatccgaacctcgcggcgacgacgacggagcggcgatcggcggcgctcccgccggcgtcgaaccggcggcggcccgcgccacccaccctacccgcggtcgccgccgccgcgccggcgagcctcgcctccctgctgggccggatcgggccgatgctatgctggtctactcataatgggccgaaacaggtgggacccactcttaaatgggccgaatcttctccggcccaacgaactcccaagcggaggactagtcgtgtactccaagtcgtaagtcgtctcctccagtgaagaaaaataaaattaaataaaattaaaaaatattttattttattttatttttaatttgaagcccaactttaatttccttcctaaccaagcagtcaagcacttcattcaccttgctcccctccgcaagccgccgccgcagcaactccggcgaaatccccggccgccgccgccgccgcccgccgccgcgatgaacgcgtcgcagttcatggacaaacagatcctcggcctcgcggcctcgggcgccggtgcggccgccgccgccgccgccgcgtcgtcgtcccctcccgcggcgggaggaggtgggggcggcgggctgttcgatctgatgagccccgacccgcaggaggacggcggcggccacgcgcgccgcgggcagcagcaacacggcggcgccgacgaggtggtgcccagctacgacttccagcccatccgcgccgctcccgccgccgcggcgccggcctccgcggcgagcccttgggggtcgctcgactccaaggcggcgtcctccaacctcaaggtatcatctcccagccgagggcgcctccgatagatctgctcagctcgcctcgcctcgcctgcttcacacacgaattgaacaagcgaaatttccaaacattcgtaagcttgtgtgcttttcttagccataggaatgtccagttctaggtgattggtaatactttgtgactctgcgctgtagtgatgtcgaattgattgtgtgaagttgtgattgctcgtttgctattacatgattcagatatagaaaggaaagtgacattttagtattcgatgttggtgaagattgatgccttatctgctcataaaggggagaccacagtgctagttaggatactactagttagcttgatttctacatttagcagttcaatgctatttctgtggaaataaccctgagcccctgactgtaatcaccactgtattacgatactgagcagttcaatcagtttgttttcctaaaaccatttgaggatattttcagatgctactctgttatgggtaaatcatgctcttatcccaagaggcaaagacccgaatatgtcaagtgttcactttgctaggcttatacccttgtcagggaacgatggatatttgccagcattgttttaattttgtgattctaatactttatcaatggccctgatttgttttgattcctttatttagttggttctgattgttcaagcctttaaggtctaggttagatagtttggcactttgcccaaataagaaaaaagaactatcgtgaaaaatatgtaggttttatatgatattttttatttggcaattttgtgaatttctgatttaggtaatatagcaatacaatttgttgccaactcatcaatcattaacatggacaataattacatgtatcttttcatcccaagtccagcaaattacctaattttttgatactttgattcatggtcatttatcaattcatacaagtgatctgcctctcttcccttgtgatatattgcttaacatgtttatcctctctcattgtgcaaagagtgctggcatgttggagtctcatgtgctcaagaaggtcagtcacgaagaagaaaggggcaacttcagtgcagtctccatagcagatattgatcgcacaatgaagaaatatgctgataacctgctacatgcactggaaagtgtaagctcaaggctatcacagctagagggcagaacacaccatcttgagaactctgttggtgagttgaagctaataattggtaactacaatggcagcactgatggaaaactgagacaatttgagaacacactgcgtgaggtaagcttccctctcttttactgttagacaatatgctgtaatatctgaattggtaaccaatttatggatttgattatcaagaggtaaagtaagtaaccaatttatggatttgattatcaagaggtaaagtaatttagttttctattgagtaacagtagtcttttctttaccttcccatgtgaaatgctgctatttttatttttatccttttgagagaaaaaagctgaagccagtattctaagtttttgtcttcttttttgtgtatttatatgaatagtaaaatgtacagcttctactttaccctgtcttggcttatttgattattaatggtccatagcttcacatgccctagctgggttgcgacattggttatagttactatttgtgatttaaaggacaataacatgagcagggagctaatatgtaccttaactgagtttattctttaactataagtatatgcagtttgcctggtgttgtagtctttaagttgtgatataattgtcttgaacattactaaaaactgcttatttggttctaatttgtattaatttgttttataccattgtgagggcatcccgtatcttactatggcatgtgctacgtgtaggttcaagctggtgtgcagattttgcgtgacaagcaagaaattgttgagacacaggtccaactttcaaagctccaattgtcaaaagcagaggatgctcaatcagaaaaggctggtgttggtcaggcagattcaaggcagcagccaactctaccccaacctcagcatcaagcccctccgccttcccatccaccggcattgcctgcccttcctgctccaaatgcaccacctccacctgcaccccaaagccaacctccatcacaattcccaggccatttaccacattcccaggtgcaatcagtcccacctgctccaccgactccattagcaccaaccataccacaggagtcctactatcccccgtcagcagtacagccaactgacaccacacaccagcagtatcaagctccacccgccccacagtcgcaggcacctccagcaccaccacagcattatcaaacaccacctcagtatgctcagtattctcagcctcctcctgcaagtgctaacccctcaactgcagtcccaccgtcagtgcatcagcagcctgaagaagtagcagcgccgtatggccctcctcctcagagctatcccccaaatgtgcgcctgccatctccttatgtgccaccacctagcgggcctgcacctcctttctatggtccaaaccctggcatgtatgagcctccagcagtccggccaaactccgggccacctccatcctacaatactggatacaaaccacagggtggaggcggtttccccgagccatatggttacagtggatctccatctcaccgtggcaatgctggaatgaagtcgccctcgccgtttcatccaacaggctctgcgggaagcggcaactacagcaggctccctacagctcaaatgctgccccaagccgcgtcagcgagctccaccccaagcgcctcctcgggcaacagggtgccgattgatgacgtggtagacaaggttgccacgatggggttctcgagggagcaggtgagagcggccgttcgccagctgaccgagagcggtcagaacgtcgacctgaacatggtgcttgataaggtgatgaacggcgccgacgcccagccccagagaggctggcacgggcgttaaaagctcagctgctatccagggccatgaagcgctctcccatcaacctgtgcatatcactgaacatccaatccacggagtcattttgtgcattcgcgtgaacgtcagattcggaattcatattgtcgatttggtggggaacagaccaggtctgctcgatttgctgttggtgatcttacagcaagtgttctttatctctttgattcgcctggtgttggttggtactagcagtagtactaaaacttggtatctgatctccaaaaacgagtttttctagagatggtgttatggttgttatccactgatgatatgttaatgattcacgggctgcactgttctgtttaactagtcacgctgctaagctgccttccagtttccagaaacacattctgccggactgatgattgattacccgatattgtgttgtgatagcgtacgttgtgatgagtcgctgggagagctgtttgttgtctgcccaagacggacagctcgggacgaaatacactgaagcagaagggaaatttcgataatcgaaatcgtctcgaaactttggaacgacatttcgagaacacaacagaaatttaagaaaatttggctagcatatgcagcatgcttgatgcggatgcatctgatctccatccaagctgtcttccccggccggatcgatctctcaccacgaccttggcttcgaggtggtaaggttgtttcccaccgaaaaatttcggatatttcggaaaccctctcgaattatatcaagacaatcgaaatttcggaaatatagttcccaccgaaatatcggatatttcggaaaccctctcgaaatacaatcgaaatttcggaaatttagcgcctacggtttcccaccgaaaatttcggatatttcggaaaccctctcggaaatatacaaccgaaatttcggaaatttagtgcctagggttgcgttgatccctcactttgccgccccaacctcgccatctatctataagcagcctggccgccgacggcggtggtcgacggcgacgccgtcaccaagcacaagcgctccaacgccggcgccggaccgggcgacgaggatccatggcgccgccgccgccgccagcgaagaggagggatatatatacgttcgtgaatctttgacgaagaggctggaccggcccgatcatcgccgaggtcttggggaaagatccacactcgcccattgcttgacggccagcctattcccaacgaaaggctggaatctctctcgaatgcgacgcttggaatctttggatagataaattatggacttggatatgcgttcttcgacttcgtcgaccagcaccgcgccaatgggatcgacgacgagggggttagcggctcgatcgccgccggcgacgacgaagacgacggcgaagagaggaaaggactatgtgggccggccggtgtggcggtgccagcagtaactgacatcaagcgcgtgtgtagatgaatggagacaaagttatacgcgtattactcaaacaaatccacgagagaaattttgggaattttcgaacaggatttatattcaagcaaattctatataatcaaacatgaaatttagtgcagtgttttcgattcaggcaaagcaaattttgcttgcttgcttgcttttgttctagtacactacaccactctgcaatgcatatatcatgcacgcacggagattttaattaagcttctctaaatttctgagcccaccgaaatttcgggaatttcaagatcctctcggaaatttcgaaagatatttgtcatactttcggaaatttcgggaatatcgcaatcctcgcgaacgaaatatccaacagaaatcgaaatttcagaaattccgcgccgaagaactagcttgcgcgcgcgagtgattctgccgccggccgccgcagacggaactcctcgatgctgctctcgtgtttccaccggcgggccggccggctcggacgccggcggcggcggcggcgagcatcagaacctcaccgtcactataccacgaaacagcccgatgtaccacgaacttgatccacgagcactagcagaatctcaccgtcactataacaagggtgggttctttccctagttttctcggcttctactctctcgtttttcacatgcaatgcttcctaaagtgctaaatgatgtgttttttaaaaaaaattcaatatgaaagttactttataaaattatattaatccagtaattttaagctactacttactacatccgttctaaaatgtgatttgtaccaaaatgaagctattttttcacctgccctcttatctcaaccaatcgcaaccattctcttctccaccaatcataacccttctttaattatctatacctactttcttaatatctgtgcctacctaaaaaatgtttatattatgggatggaggaagtatttgggtgtagctcaattctattttttttttttgagaaaattgtaatccttaatttgtataggcaaattagctcaaaggatacactcactaattactatgaaaaatttaattacaagcttgttacaagcccaaggcgcgaacacagggcgtctctatcctttccattaaattaagtttagaatttaagtgtgtgcttcatatgtatccaaacttatatgaacgttagtgaaactagataatgaatggagataccaaaacgtcttataatatagaacaaaagaataataatatttataaaatatctactattatcgatacctatatgcatgttaaaaaaaatgcttaggataagattttatttaacttttaaaactctaacaaataatgacttctcaaatacttagttttcaaaatataaacaaaaggtatgttcgtggaatagtcttgaaaagtacgataataacagcgtaactttggaatgtttcataaatttctatattctaacataaaaatcgatggtcaaattaaagttttaaaatttcggccagccttatcctaaaggttatttaggagagtggatatacagtgtaagcgccagtattaggtgacatcgaccactttcgataaaatttatggttaaactacttatcaacatattataacattatggtttaagtataattagtacactatgacactgataggcacgttatgacatcaagaatattttttttggcccgccactatatatttatgaaaaaaaaagagtactagtttcctttcctggtttttccaaagagcggtcaggcgcataaaaggaagttctcgtttctcaagagtaggaaaaaagaaaggaggattttgaaactctatggacacatggaaaggctaatgggcgggtgatcgctcccctacccgcccaccctctcccccgtactactagatgtactcctctctcttctcccccttcctcctctccttctcctctttctactgcagtagaccacataaaaatttttgaaaaacaaaagttagaaaaatttatgtataaaaatattatatataaaaatttgaattcaaatttaaatttgaatcgggtatgtaaacttgcgacttataaactttgggtctataaactttaggtgtataaactttagatgtatagaaatactatatatagaaaatatttgaattcaaattcaaatttgaatcagatataattcaaattcaattttgaatcgggtatataaactttaggtctataaactttaggtgtataaactttagatgtatagaaatactatatatgaaaaatatttgaattcaaattcaaatttgaatcagatatttgaattcaaattcaaatttgaaacgggtatataaacttttaacttataaactttaggtctataaactttagatgtacagaaatactatatataaaaaaatatttgaattcaaatttaaatttgaatcggatatataaacttttaacttataaacttttggtctctaaactttagatgtgtaaactttaggtgtataaactttaggtgtataaatttactaaaataggaaagtaatgcggtgccaaaaaaggaaaccaggtgaagggagagaggggggaggtggggagcgaatctgatcgctaccccatccccacggcgatcgatcgcccattagaggtacccatggacacaatgcatgggatatatatatggaaatgaacatgcatgagataatccaagctctttgcggttgctgatgtggatgatgagcctgaatgttgacacaattaatggcactgtcagcgattattccacagctgaaatatctttaaacagttcaaaatatgatcaactaaggccctgtttctttcagcttgggattattataatccaaattattgggagtaagctgaaagaaacagacaacttattgaagtagcttattataatctggagcctagcttattataatctgataaactcatttaggtgagctttttccagattattgggtaaaaaattacccaccatgccaccccactccctctttagacttacaaacccaataatctaggctctaataatttaggaaagaaacaactaaccgcttatgctactacagattataacaatctagtttatagtaatctgactcaataatctagattataataatcccaagctgaaagaaacagggcctgaatacattcaaagtaatcctataaattatttcacgaacgcaaaaaaaaagaaaagaaattacacgtcattctattagaagaagtaaattaaggaaattaagtttttacacgacgcacagccatatcgcccaaccatctactctcccaaatcaagctcctacactacaataaaaatgctttgtagagacatttttctagtactatagaggtacttatcaaatgactttacaacaatgtagaggcattttaaaaaatgtctaataagtgtcttatggtgaattgtctctacaaacgaaaagacattttataaaatgtctataagatggtagaggcattttctagagacattaaattgtaccgcaaacatataaaaccaatccaaaaaagataataaaatagtttccttggttttgacaagtgttgaactcatgatctcttgattcaatcattttaatcttcaatacactaaccaactcaactccatgtcattacttgtatgcttggtcctctagttatttatatttagtcctttagtacatattatcattctaaaaagtgtctctacatagtttaaaatgtctcaacgaaatgcctttatatattagacgcattttatagtgccgaaagaatgcctctacgagataaaatctaacaaactgatctaaaaatgtctctagagtaaaagttttctaggcaatttttaaagtgcctctataaagtgtctctacactataaaacttctgattttagaagcaatttgcaaaacgtctctacaaaagtgcctctatacgaggtttttgttgtagtgagctagaagaactagatgcaattaaaatacaaaaacaaattaaaattaagtagcagattacccagccgcgcgtattttcattcacctaattaattaatcgcaagccagaaaatcacaacacatatatacttaattatgatccatattgatatccaaccagccacaaactcacaaattaaagtctcacaacacaacatcgaaattttaagagtcgatccaaaattatatagagttttggactaatattaaccaaagcacattaccatgcatgcaccccagatcgatatctagaaccgaacttgatgaagcaaccaaagacgacgacgataactaattaagcttgatcttaatcctcgcaacttaactgaccatctcatcgtcgacatcgatcaagattcaagatcaagccctagctggggcgagctcgctcgctcgatcgaccgatcagttcatggcggcgaggcggtcgacgaagatggcgaacgcctcgtcggtgtcgagcatgctgatcctgaccaccctcccgtcggcgccgaacttgccgccgccgcggctgatgatcttgcgctcgcgcaggtacccctccaggtcgtccaccccttccttcccgcagcgcagccacgcgaacgctgcacccaaatcaaatcacatcatcaatggcgatcgatcgaacacaaacatgtcagcaatggcgatgcgatcgagcttcgtgtgtgtgtccgtacgggggtaggcggagacggtctcgttggcgaaggtgcagtggccggggagctcgtcggggagggtgaagatgccggaggcggcgacggcggcgcggagcttggcccagcgagagaccatcttgcggcgggcgaagtggaacagtcggctcgagtcgtcgtcgtcgtcgccggcggcgggcgcgcggtcgtagccgtcggtgatggccttgaggatcttggcggcgcggagctgcgagtccttggagacgccgatggtgttgagctcgatgaacttgctcatcttctgcgccaccgccctgtccttcaccagcgcccacctgtgccaaaaaaagccaatcacattgagccaaaatttgttcgaatttcaaaagtattcgtacgatgaaatttgtgtgtacgtacccgaggcgggtgccggcgtggccggtgcacttggagacggtgaagagcatgatgtcatgggcggcggcgctggtgatgggggtgtactgcggccagtagtaggcgaggtcgtggacggcgacgccgtcgccggacttgagcacggcctcgcggatgccgccgtccgggttgctcggcgagcagacgagctcgacgtaggtgtcgccgtcgaacatcttggcgtcgccggcccacctgtacagccccgacttgaggaaatccgtcaccgccgggtacgactgcgccccgccacgccgcatccacacaacacaaaagatatattgtgtcaaacaaaaataaagattaaatcatgtcaagatcaatcgtacttcctccgttttacaatgtaagtcattctaatatttcccacagttcattaacattcatacttccttctagatagatatatgtctagattcattaacatcaatatgaatgtaggaaatgttagaatgacttacattgtgaaacggagggagtatttaactttaccatttctatcatttcgagttggtaatatcagtctatcttgttgatgtatttcttttaaaaaaaatcgcaacaacttagatgatatgcgaactatgagagaatgtcacctctcgagagtttagaatagtttccctatcaagatcaatcagaaaagagtaattttactatatttgagaatgtagttagaggtatcacatttactagcataaaacttatatttgtacttatcaatttttaatgtgaaatttaattaggtacttctcaaaacttttaatgtgaaatttaggtatctcaagacactttctcgaggaagaaattttacggatactgagaaaatacctcgtagtacctaagttttacactagaaataagaattttggtaccaagttttataaaataaaacttggcacctccatgtactttcttaaagatattaaataaatctacctttctcaaggacactaaaatttctaatgagaaaacgaaaaactacctttttcaaggatgaagataccactagaaaacatggcatctccaagtacttttccaaaaatgataaaactacatttttcaagaactgtaaaatttctcatctggaaaaggaaaaaacaaatttgattgcaagtgatgaaatcggattgataaattacggagtagtatggtgcgggggagacgacgttcatgggggcggaggggcccggcggcgagagggcgtagagcgcggcctggaagagctgggtggatccggtgccgacgagcacgtggtagccgtcggcgacggcgttgccgacgaggcggtggaggcggcgcacctcccgctccaacccgggctccaggaaccagcacaggctgcccacgtcggagaagtagctcatcgtctgccaccccgggatcacgatcgtcgccctctccccggcgccgccgcgccagaacgcctcgtacatcgtcgggtcgccgctgcgccgccatcaccacaaagagatcaagatcggaacaaaactcactcgccacgccacgccgcgccacgccgcgccgcgtcgcgacgcgaggcgtcacgtgtacagtgccatgcatggacgaacaggtggtcgagatcgatcgatcgatccatcgatccaccggcggcggatcagacgagaacacttactggtcgaggttgatgattgagtccttggtcaccggcggcttcccggaggacggcgcgacctccgcctccgccttcttcctcaccgcggcggcgtcgtcaccgccgaagtatctccggcggaggtagaacgcgagcgcggcgaggttgaacgccacggaggcgaccaccccgagcctcccagcctgcgccgccatcccgccaccgccgccgccgccatccttgctgcccatcgccgccatgaccaactcacactcactctcccttctcctctctatttatagataggggaagtggttggagactggagctgagataggggtcccctatttatatctaaatcgcgtacacgtttcttcctatttttagcaagcacggcgtcgccggcgccggaatatttcctccgccggcgccgacaaggctaccggcggcggcggcggcggccggaggagatctcgccggcgagggagcacgtggggggagcgagcggtttcgatcgagatcacgaggagcatggagagtttgttcgatttgtttggttgccccggattaaggaaagaaaagaactccatcgatcgttaaacctcggtgattaaggttaatgacagtgcgcatcatgcaataatgacatgtgtacttgatttatttggaaattttaaaattggaaattagagttggtgtaaaaagtatatatagaaactggttttatttggaaaattggaatgcaggcacagtcatgcaaccggggttaattaattggatcttgttgagtgctaacctgtgttagaggcgatgactgcatgcatgcttttgtttggaacttttctttatttagattagcatatgactcagatctattcgcgtggataagtacaattgccatattttaacttaggcccttattatatatagagtaaatttcacaaaactacatatatattgaccaaattatcacaaaactacatatttaaggagttatatcacaaaactacacatttagcaccaaatttatcacaaaactgcagattttaggttaagtatcacaaaaatgcatatttaatattgaacttatcacaaaactacaacttttggagtttaaatccctagcaccattgttatggtggagctataaacattattactttgtgattaaattggttctaaacctgtagttttatgataatttagttactaaacgtgtagttttgtgacacttcatcttaaatgtggagttttgtgataaatttagtgctaaatatgtagttttgtgatacaactcctcaaatctgtagttttatgatagtttggtcatagtatctgtagttttgtgaaatttactcttatatatatatattggaagaagaaattaaaatagctgcatatgcaagaacaatatacagagaaaactctattaatttgatctccctgaaagattatgcatattattgttatagaaacattagttatttttttcttgatgaaatttatatatcgaatcttagacgtcgattgatcatatcaacaacttacatttgcttgggtcattagttttttttttacgaggagcagaggtagagttgcataatatgttgaaaagaaacacgtgagtatatctataaacggtttatagttaaatagatatagtgaaaaccgacaaacggatgtcgccttgcgcattttccataattggaaagaatgatatgttttggttgggtacgcgtttaacgttttgtatattggaaagtaacctatattataaggtggtgtgtgtgatatccttaaactatactaaaatagattgacaacctccatcgaaagcgacaaaaaaaccgttccacaatttcaaatacaacaaaagcgcgggaaagaatagaaagagtgtgcttactcttacatcctgtaattataagacctctacatgtatggtctcatccctatgcaaataaccttgggtggtttttccatcggttcagtgatgctagcaaccatcaatgaaatatttttattttgacaatgcatttagcaatatatatatatatatagtctggcacccaattatctactaagatatatgggataatggttttgtttgttcaaggaataaatatccaatatggagtgataaagcaggtaaagacattgcacattgcgtgacataatttatacaagcttccaaacaaaacaaagtgtaatcatctttcagcataacaccaccacttaaatatacacgtgttatacaaaacatcaaatgtacccaagaagagtctgaaacgaaacgatataaagtactattgtgggataagtccatttgacaattctaaactcttcactttatctaaaactcacccctaaacatcaaaaacacgtatttgacaacaccctcgccccttgtccaaacaaaaaatggttggttaaatattgctaagtgctaacctgttaggtggaaatgactgcatgttttttttataacttttcctaataagctattcgttagattaattagtatggattggttagactcgatatatttgcatggataagtacacttgcttcttttaacttagcctcattggaagaagaaaatagctgcaagagcaatacttaggaaaactattttgatctctcgagcactagaaatatattgttgttaagaaacatgagttaaatttttcttaatgaaacatctagaatcttagatgtctattgatcagattaaataacataaattggcttgggtcattagttgtttttactttttacaaggaagagcagggttagagttgtaaaatatattttaaaaaaatgagcatgtgcatatatctatgagcgggtcatatagttaaagcagatatggtttggcggttcatatagttaaagcaggtatagcgcaaatcgacaaatggcgggtgttgttcatgcactttccgtaattggaaagaatgatgtccttagttggggagttgcacgttcgttgcattatgcgtttttaacattttgtatattagaaagtaacctaaattatgagattgtgtgcgtttgatatcattatattatactagagtcacttgacaaccccgttgaaagcgacaaaaaaaccgtaccacaatttcaaatagaacaaaatcataggaaaagaaaaaaaagaagagtatgcttactcttgcatcttataattataagatctctgtatatatggtttcatccctatgcaaataccccttaagcacttttaccatcggttttcagtgatgctagcaaccacctatgaaataattttatttttaaaatgcaagtagcaacatatgaactgaaatgtctggcaccagattatccaccaagatgggaatttatggtttaatttgtttattcaacgaaaataaatagtaaattgcacattgcacattgcgtggcataatttacataagttgtaacaaaacaagcgtaaagcatctttgagcataacaccactacctaaatgtacacgtgtcatagaaacatcaatctgtacagcagaagagtgtgaaatgataaagtacgtttgtcacacccacaactgtacatatcacactttccctgatcctcggcctttcttttccatcaaatctagctagctaaattctaagcttataatgatcaaaacatggtgttggtggggaagcaccgatgttatgcacatatgcgtcttccatgtaatcgaaaagatcacggtgtttgcgctcttaaaaaatcaaatgaaaacggatctctggttccagattttcagatgttgtgtgcgtatacgtcttccatgtatcaaaaagattattatgtttgtgcttttaaaaaatcaaatgaaaaagtctctttggttccggattttcagtccaaagttcatgaacattatattacatgttgaatgaagtatttaatttatagaaaaaggtctcaatacaccaaaacttaaagttggtcccgtttgtcgatgcttattaactatgcatacaagttaaaataaaattataagtttcacaaaaacaaactactttttatttggacagttttaaagccaaaagccatatatgagagcagcttttttcgctggcgttattatgcgtaaagattgcttatgcttgcagttttgtacttttgcataactcaaaagtcaaaggcatatacttggtgaggttgcttctcgcgtttcaaatttcttaatttttggcagatagcagctggccagatttttgtgttggtaatccaaaatgatgtaataaataactaataaaacaagatgaaggcagggagaaatccctccactacgaatttaaagttacaactaggtcacatccggtgggaaatgactcattcctaagaaatttatacatttcagttaagcttactgatgtagaaaagccaacaaaaaaaagactaacccctaatatgtgcaaaaattacgcctaattcggaatgaaatagcctatgctgattaaccttgctagtgagaaatgttactagagagaacagtacgcattgaacttagtcagaccatctagatataaactgagatgatggtatgacccaccatgaagctcaggtgtttggagttcttcacaaagatttgctggccttcagaaacaggtgatattccttgagcatcatctccccgccatttacagggtcaaagctgtatctgtagaaactgaatgtgccaaaaaattgttgttgtaattagtcgaaaatatttctcagaagacaaacccatgacaatgcaatattcagcaaataattaatacatcatcaaaatctaaataaggtttatgctagtattgcacggactacttcagtccaacctacttaactgatgctatcccctgtctaactacacaatgctatggcattttaaacaataatcccaataaaatataatccaaaagaagtacatataggaaggcagaagttacagatccagattgacttgaacgagcatgattgctcaataaaaaaacaaagaaagaaacagggaactgcttacattgcatatttcttttgttattttaatttgagtagcaaattgccaaaaataaaaagttatggtgtgcacaatcatcgtttgaagaatctgcagactggatcttttcaatcccttttagcaatatgaattaattcccaacatgcttatcagattttaccaaagaatattgacattattttgcttagacatacatttcttgggggacgtttgaatttagtaagcatgtgagtttcaccgacaagaaggccccacatgtcactgatagaggtggtggccatcaccgctactaccttttaaagtagtatagatagtctttgagatgtgacttttatcattacatttttaactttacatcactggaatttatataggttgcaatatgacaaaagtaattcttcgtgacaaaatctagctttgataaaagttattccgagttttcacatatctagctttggcagttttaaatatttttaaaacttggaatgttagaacaaaagtaaaacaccatgtttgtaaactaaacaaaatgtctaaaacccatttcttaattatcctctgttgtcttttgtaaagaaagagtacctgccatcaagaccgatcatcattacagtgtcttgatctccaaatgccataatataccgcgtgatttctggtaaacggaactgagcaaaagaccattctgaactgaagtatttcggcagaatccctgtaaattttcaatgtatataaggaatttgaacaggaaatacagatggaagagcaaaaaatatgtattgtcaacccccatgcagaagataaaattgagtttcttttctctatcggctcgactttaaactctcaaagcccacatgccaatatagttaacaaagaaatagttttgttctttgtgtagtgtatatgaaacaccccctatagtaatggttggcaaactgtagcaaagtatggctagcaaccaaacaccccctaaagtaaacaaatgaaatgggatcgtaatttgtaaagttgtcgcggccatgttaatggtatcatggtattagcacacaagaaggggactgtaccgcattaccaattagaatcacagtaccgagcataaaagaagctatcaactttgttatgagctataagatgctaaatacatacatgtcccagaactgagacaacacaagttttctatgtaaaatgcttttgcaaggaagtttcaccaaaaaaaaaaaaaactagtgaagacaatatttgaataactgacaatactgtattttaaaattgattgaaatattacaaagagataacttactagcccataagattcaaaccttaatcaactaacctttcatgaaagacagggatgagctcgtattggatccaatctttgtttgtgtaactggaaccgtagaaccatagttgcaattgtcattcacctgtgcacctgcagttgcagactcccccttttttgcatcctcctctgcatctttcaccctcagactgaagacatgcaccgttcctttgtcactggagactgctagccactgcacatttggtgacagtgcaatgctatatatctcagctctgtcaagtcctctccgcacctaaatagcaagacgagtacattactgtttttttttttgaaggtaagtacattactggttactgctgaacatttgtaaattacatagactatagcaaggaaacatttatgatatccaaagacataacaatgatataacaaaagaaacaaaagattattttgcagcgcaaacaaaaaaagaaaaaaaaacagcctcacctcctgcacgcaggtgccgtccctagtgttgaatatcctgatcaaagtacccctgacactggcagtagccaagagtgttccatccaaggccattgtcatgcacgaaaggggcgagtcatgagcagcaatgaacctggtctccttcaacccgaaatgctcaatgagaacctgccccttggacgtcccagggcaggcgaaaacggaggcgtttgcgtgatgagacaggcagcacagcccattcgggttcgacaccgtcctagcctggtagaacagcctcaggtccttgaacctgtaaacattgatggtcttctcaagaacaaccacaaagtagtccttggacagcctgacggctcggatctcgcttgtgaagttgtacttgtggatgcggcgttcgttgtaatcgtcccagagctggagcatggtgggtgggaactcggtgttggactctgcacctgccaatccgaatatgctggtgcggaacagcatctcggcgattccaatccctccattggggccaaacatcctcctcatggtctcgtggaagggcttgcaactgaagaccctgaagccattggtggttgctgcaatgaagcagctgttgtcctggttccaagaaaccgacagcaactccaccccatcgtcatcactgccagatgcttcttcaacatggcccataggtgaaaaagactgaagattatggcacgcaagtgaggttaatcaccaagattctggcagcagaaattgcccccttcttttttcagaattcagagtgaaccaatcgctcctagaacagtagagtagaacggcttgttcagagcacaagaactgagcactgtcgaacaattatgctcctcaagaacctaaatcatatacatacagaaaacatcatcaagatgatagaaagctaaggaaagctatcatgtacatacagaaaacatcatcaagatgatagaaagctaaggaaaacgagcactaaatcaagcagagatggccctgaaatctaagatttgatctctataataaataacatcagttgcctctccaatactccatagtcaatccatacacgctaacaagtaacaagagattagaaccaatggcctcgccgcaagagcgcaaaaggcagggaaaaatcaaacgccgacggccgatcaacaccccgcaaaagaatcagccaaccgccaaacccagaggttaacacgacgggaatcaaacctaaccaagagagagagagagaggaagtaggggcacgtacctacctacctacctacctagctctttcccgcagccgtgggatcgggaatgcgggggcggcggcgcggtcgccggcggagttccggggagctcgagctatcggcggaggcagcgagcgggagtttgggcgggcgcgctcgcggtcgcggccatggtggagcgctagatgacgagcgatgccgttccgcttcggtgttcaactcgggtttgtttggcgtggtttcgtttcgtgttcgggttgtgggagttgtgatgtgatccgggttcacttcacacggctccatggaaatcggttcggatttcgcgaaattcaaaatttccttttatgagatcgaaaacacgaaccactcgatctttctctatccttcgataagtttgacaagaatagactggattttgattttttttttttacaaatttatgcaaatttcatcggtttttattggggttcagatttcgcaaaattcagattgttttcatgagattgaaaacacagaccactcgatttttcgataagttcaacaagattaaaatgaattttaattttttggtaaatttatgcagatttcattgatttttatcagggtttggatttcacgaaattcagttttttttatgagattgaaaacatgaaccactcgatttttcgataaagttcaacaagattaaactagattttaaaagttttgacaaatttatgcagatttcattgaattttatcggttaatcaatggatttcatgattttcatgagtgaattttgatctactatctggattataaaccttggtcgtgaccgtagttctttttttttgcgttgaaaccaagtatgtttacctggttccgtaccacttgttagcagaaacaaacaatttgtagataaatcttttatatacatattcttaataattcaaaactaaatgctgtaaaaattcacaaaatcagatttaaaatttaaattttggtttatacgcgtaaggataggcgaaacaatagcacacaaacaattcggcaggttaattacaggagtacatggcttctgaataagtaagtagaatgaaaaacgggaagatgaacattgctgatcagatatacacgatgcatccgatatttaagagtatgtatgcatagatgaaataagcagcaacggattagcgacacgaaagtcatctgatatatatttcagataaagatgttcaacacaagatagcttcagaccaggcaatatagcaccagacacttggtgattcagggttcaacaaagtgatatatgatcgagtctacaaacaaacaaaaaggtccgatatttcgtttcccacagatgataaggatagatatatctaagcggctgagaggaaggccttcccgggggcacgagcagagaggcgaccatggcaaccaagtagctgcaccatagagacagtattgacaaagattagattatccgcaacgatgcatacgagaacaattacaatagcaattgacaggtcataaaagcaaagcgaaaaaggattttaacaaaataagttactcatcctgataggacccaagataagcattagtttagaaacagcgtgtttaccttagcattgacaccatcaggcatgattctaccctcgctcttaagcctgacgtattcatcgcggctgaacttggtgaaacccctgaacaagaaagtgcaagttaggaacggaacatgagcttatggtactcagagcacatcagaaatttagatgtactcgtatgcatcaccctgtttgatacttaccactttctactctcaatgatcttttggcgaccagggaacttgaacttggcacgacggagggcttcgctggcatggacagcattgttgggcttgcaccgcacagaaaggaggacctggccaatatccaccctagcacaggttccctgtggcttcccaaaagcacccctcattccagtctggagcctatctgccccggcacacgaaagcatcttgttgatacggagcacatggaacgggtgaacccgaaccctgaggtggaaggcatcctttcctgcagacttggtcatgtacttgttgcacgcgatacgcgcagcctcaagagcctcactggtgacattctccttctcccaagagacgagatgcacacagtgggagaactcatccacacccttcttcttcatcccgacatcgtagatcctgatcttggggtcagggacaccacggcagtaccttgacttggggtacggcttgttcttgatctggcgatagcaccttgcaggtcctaaccaaagcaagccacaaagtcaagttagttactcagaaacaccctaaagcacctacagccccatcactgttaatctgaatactattcataactgatcgatgaacacgcaaatagtgaatatacaaagtcatgaaagaaactaaatccattacattaatctaaataatcataattgatcgatgaacaagaaaatagtggatatagaaatagccatgaagtaactaaatccattacagggattcgcttcaaacaacaaaaccaccacaaacaagccatttctagctaggataaatgcatctacatctgctagctacatcagaataaatcatttagattcacagagaaccactaatcatatcatactaccattatctgtgaaaatcaaagatcggtacagttcccccaacaatattcacatcctattaagtccaacatgactccttcaggttgagtaagcaaactaacgagatatgcaacgaaacaactacaaaatctatctacacctaaattcatcaaagcaaaacacagatcaacaccgggaacagcaacaatccagcagcgcccagctactatggatctaaaccaaacgcccaaaacgcgcctgaaatcagggagccgcggcgaccgatccagcgcaaccgtggaacaaacagcaagacaacgagcggtagagcaggaaatggttagacttactcctccccatggcggcggcggcgtgcgcgcggcggacggcggcgggaagaggcggggatgtgcggctagggttcggaggagcgcggcgcagaggcttatatagaggggaggggggctgtggggtttgcgtcacgcgtgaccgatggtggtgattgcgtgttgggcttgaggagcccatggaagcccattgcaattgggccacctcttcctgtcattatttttttttcttttcgttttttatgggagtggatattgctggtcagagtccactcgggtgtgttctcatgtttccaactcatttctgttttttcgtgcctacatttcggtgtgttttaaaatattttatagataaattactttaaaaatctatatgatcatttttagagttttttaatataatatttaattaattatacgctgattcatcctatcattttgaatatcagggtatggttcccaactcataccttctaatacagccaagtcatcagttgacagtaatatgttaattttttaaaaatatatatatgggttattcaagttttatttatttattaatgtgcattatataccttctaatatatgtctgtttagaacatatatatttaattcaaggtttcgatcatcgaagtgttttagttgtcttttaagtcaaagctctctaaggccctgtttgtttcagtttaagattattataatctagattatataactagattactataagctggattataataaaccgacatataataagctactagtttatttctctagattattatctgtttgttagttgttagctacccaataatctaaaaaaagcacctttagaatagcttaccagattatagttatctgacttatagattataataatctatcataataagctatctgtttgtttcagcttactcgtaataatccagattataataatcctaagctgaatcaaacggggcctaaattttgatgaaaaataaactaacacataccacatcaaattagtttctctttttgttagtgtatttatttggtatagtaggtgttaatttatttttataaagttagttaaagttagagagttgtatgcgagtgggccccacctatcaatggcacatgaagtcagaggagctccttctagtagctaggccctgtttagttcccacacagaaattttacaccctgtcacatcgaacgtttgaacacctgcatgaagtattaaatatatctaaaaaactaattgcacagattgcgactaagagtgtgtttagttcacgctaaaattgaaagtttgattgaaattggaacgatgtgacagaaaagttggaagtttatatgtgtatgaaagttttgatgtgatggaaaagttggaagtttgaataaaaagttgggaactaaaccagtcctaatttacaagacgaatattttaagcttaattgctccatgatttgacaatatggtgctatagtaaacatttgctaattatggattaattaggcttaataaatttgtctcgctgtttactgatggattctttaattagttttttattagtgcctgaacaccctatacgacatcctacataatacccgatgtgattaaaaatttacactcctagatctaaacatggccttagaccggaggatgtattggattaagttactcaaaatctcagacgaatccggaacaagttttgaaaaaaataaaaggagagtaatgttaatgaacaaaattaagtgcagcatagcttcggtttgtacacttatttcgtagcaaaaaatgttgacatctcgatgggaatagaaggttctgacttaaagggactctctggttcgggcgttcaatggtaggaggttaaaatcggacgctgatatcagcataacgtcagcgctcgactcacgtgcaaaactattttaaactgttttttctcttaaattacttatccaaatcatgatccgattgcaccattaaattcgttgcaattaaatcttcaaaacaagaccacacatagatatattccgactgaaaaattttagcttatcattgaattatttttaaatgttacatgatgtttcaccaggtatatcggaattgtttcactaagtagattgaaaatgtttcattcgtttaaatcgggtgttgtttcaccttatattaaaacaatgtttcagcaaacagagaaagaatgtttcagttcactgcaacattagatatgtacatagtgaaacattgtgagtacactaggtgaaacattttttgtggaacaaaaaaataaaacgaattcccttaatagagggttttcaaaatatatgggtgatttgttgcaatggaatatttcagttcactgcaacattagatctatacatagtaaaacattgtgagtgcactagatgatatttttttgtggaacaaaaaaaataaaccaaattcctttaatagagggttttcaaaatatgtgggtgatttattgcaatggagtatatggtgcggctacgcgtcagggaggggagcacctgatccgactcgcccgcgccggtcgcccggcgtataaaaacacgaaaagaagaatttttacgcaagaaaactgttacaggtataatcaacggtgtatagtcatcaggtattttggtctcactatattggattggatgtggatgtgtgcgtcactgccctcgtggattcgtggccaatctcgcgaagtcgcgatactttggcgtagaggcgcgcgcactccacaaattccgctgtgcacacgcgccaaaaaagaaaaaaaaaacaatttctggaggcggaggagccggtcgtccaaccgcgagtggtccgctccgaccgaagcggggtcgggtctggtcgagccacacgcggccgcggctgcgtctccgcgtcgccgtcgtcgtctccagaaacgcacgagccgagcggagaattccacgaaccgtctcctcctcctcctcatcctcttctccactgcccccgcacaaatcaactctactttccaaaacgcggcggcggcggcggatcaaaccctcatttggtgggattttttgctgcgtttaatcaaatcctctctctctcttcgaccgcggggagatccggggttcgattgtttcgtctcctcctccccctctcgtgcgggcgtcggaatcgatccacgccccgcccgctcgctcgctcgctcgctctgtgagcccaaggtagattcctcctgatccgtggccttcttctgcttcggctgtcgattcggcgtgctttcttggtttgcgacgttcatgggagggggtgttctactgttcttgggggttgggggaatggggagatatggttcttcatgtgtaccctactttgccttccattccattgggttccatggcgttgggatttcgatccttaaattgtggtagttgggagaagtagtactgtcattatgctttgtcttagtgaattatcgtatcggtgatagtttgtggaacaagaattactagcagagataatagagcagttctgggcattcctcgtgctcttaagagaggcagaattcgttatctgtcctttctttttttcggtgaattatcaatagggatgatttgccttcctagtctttattctgataggatcatcctatgctagaatgtctgcgagtttgttcacttgaatatatgatatcttgtcctatgcatttggtgtccattatcgcttatgatctattgttatgcctaactcagacttcaaccatgccttcctagattttagttttcttgcagtgctttcgtagttttagttgctctttttctgatagaccatgacatgcttttatcattgtttagaggacattttgctcagtgctgtgctagctttgttggctcaagttcacaatgggaggttgtgtgggcaaggtgagtcttccaaaaccataattgatatttagcggttcatcatggctgttcaatttaccacatatattgatttgtgatgtttcttttatttatgttcatttgttcagggacgacgacatattgaggaagacaagcttgatttcaaaggtggaaatgttcatgtcataacaagcaaagaggactgggataggaagattgaagaagcaaacaaggatgggaaaattgtaagcaagctagcaatttgctcaatggattacaaatacatcttttggttcttatgttgtgcattggttggtgatctatcagtttgcttcacactatacaactttacgaagttgatatctatgcactacttatcacatggtcctttcctttcctttctttttttttttaaaaaaaaagaagtgtaattatctaatgggattgagaacagactgaaatctgcatgagagtgaaaaaaaaatcagatattccagttataaagtcagaaataattcatgaaaactgcattcagatattctagctagtaccctgtgcaaaaagttgccatttcttagtattccctgatttatatagctttctgcctttagtcaatgcaagatccttgtgtggaataaatcatttctagttatgctgacgtgtagaactgctttttccattgttctagtttgtttctaaaagattcaaacctcatttgtaaattacttaggtctgttttatgttggttttatttctcatccaaaacaagttaaacaacattatgccatactcccagttattctgaatagcacttgcatgctcatccacttggtatttccttttttttttcctcaggatttgttttgcttatttttaggatgcctgcttgttttttggcaatacacacacaacatttacgactcatccactttagatggccattctgttgttggctgaaatctcgtaacaagataaagttatgaaaattcttgatgcaaactagtacctttgacgtactcactgttttgttttgtaggttgtggcaaatttcagtgcttcctggtgtggaccatgtcgtgttattgcacctatttatgctgagatgtcaaagacttatcctcaactcatgttcttgacaatagatgttgatgacctaatggtaattctaaccgtttgtttggtcaaatttgctattgaaaaatgattaatttcagttttgtatgaaccaagaaaccccttatacatctgatggcggtcattttatcaatagtatcatttatctgtaatcctgtataactgattgtgcatcctcactaaatgccatcgattaaggtttataatcaagaatagattgtgtactgagttccagatgtgttgaattatttgctgagggatatcatacccaaagcatgacctatcatcctacttatggagtaattgctgtcgacataccatgagaactttgaaaaaaaataagtttgtttggtgtctctgtatttttttggtaaagcttcttatatattggaaattatcatataaaggctaaacacatgttgcgcctgcactgttagcattatagcattataaagagcttctcaacacttctagaattaagtaaacagatgtagtgattgcatgcaaattgtcctaaagttaactgaagtcctgacattagagtagcttctcacttagcatatctataggtcagggtgcatgttgtaatgttcttccgatttaacaactctcttgtattctctgcaggatttcagctcatcatgggatatccgcgcaacgccgacctttttcttcataaaaaacgagaagcaggtcgacaagcttgtgggcgccaacaaacctgagctcgaaaagaaggttcaggcacttgctgatggcagctgaaccttattatagcgcaacggctagaactgaaacgaatttggcatgtctgtccggccaagtttgtgtccgtgtgctcccttgcagcttctagtgtatagttttggtgtctctgttcaaaccatgtttctttttctttctgaattttgcccatgtgtctggccacacacatatgcaatctgtgaactaagaagttgtgatgtgttcagagctgtaacataagagtaatgtactagagtagttttaaaagacagtgatatggttgtattttgagctatgaagttgtgccaataaatgagtgggttttgaaagtgactctttaatgattccttctactagaaccgaactatttgtcataaaattcccatgaatttcagttttttcctgacgaacggacctcgacgttcggacctcggagtgaatgggccttagcccactcgaagattaattctttagaaaatcacaaaagcccaccttatggtatggcatgcatgtgtagtttagtaccatcttgcttattctaggagagggagacctccttaaaagggaggatgcccttctagctacttgaagcatgtgtggtggagagaagaaggggaacacgctcgctcgcctcgcagggcagggcaggcggcgcgtgtgcacgacgtacgcgtcgaatggtccaccaaaattggttcctctggcagatgcagcctccttttgcagttttgttttgctgcaaattcggattcgtttttttggaaacgttccgaaaaatgacagaaaatctttctgattttcaaacgtggagctcaaaggttttaatttctggaattcgatatatatatgctatcttataaaaacatacacctgggaacaaaaattgaagttttaaattggaaagcatttggaaccaaagaaaaaaaaatgaagtttcaaatttaaaaccagatgcctctcctagttgtgtgctactacttggatggcattatccaattggagacttcgaaaaatgagggatccaatgaccggctgccggcctacgccgcaacgcacggccgtttcgccccccactccggcctaccggcgccccaggaaacacgccgcacgcgccacggccatccgggccccaccaccagccatcactaaaccctgtgcttaaatcaattaattagaccttaatcacccagcgttaatcccacctggcactcacagtgcgcttaataaacgggcgtgtccagctcagcaccagccgttccaaaaatgtttcgaaatcccaagccgcgagagaattgtcgtctcgaatcccaaccacgactagggggccatctctgtaaataaaaaaaatcaattaacgagacgaccagtgatactccctctatctcattttaaatacagttatagatctctatgtccaacatttaatcgttcgttttacttaaaatccttttatataaaacataaataaaaaaaatgataaaacataaatagtactccctccgtttcaaaatgtttgacaccgttgactttttagtacgtgtttgaccattcgtcttattcaaaaaatttaagtaattatttattcttttcatatcatttgattcattgttaaataaactttcatgtacacatatagttttacatatttcacaaattt

SEQ ID NO: 64211 - DNA, 734 bp, Oryza sativa
gtctatctatccaagtatccaagttggtagtaatagaaaatgtcttatccgattttaagttcttatattttagaacgaaaggactacaaccggttcaacatattgacgttgttaattaaagggataaggagttgtaagggattattattcgatctcgatctctccctccccgaaggaactcgatcatccacagccacaaacgctgaaacttactgaaagcaacttggcggccggcagggttgatgtcttgatgatgtgattagaggggctttttggcaggaaaagagggggcttttttcgtggtcacgagcgtgctttatatcttaacaagttgctgcttagagaacagatgcgtgatagctagccaagcaatggtccactgggaatttgtactagtgtacatgtacagttgcatgcagtaatactacagcgttgagttgcatacagtaatactacagcgttggagattagaaggatcgtgtccacaacctaacaatagcaactgtggtttgaggaacagatcactaacagtatcccatgtcggcaaagaatgcagaatagctgacaaactgatatactatacgcttacacaaaaataacaagacgaaaaagaaacaacctcataattttttcagcggaggcttaaaaaagccagaaacttgatcatttatcacgacagggacaccgccaatctgaccgataatccttgcaataatgacccagcaccaacctaa

SEQ ID NO: 64212 - DNA, 649 bp, Oryza sativa
agcagcaacaacaaaacacacagactcgacttcacatgctcatgctgacatagaagccactccttattgacaacttagaatttaactactaaaatatacgaacacgagtagctgcagcagcagcaatgcatgacagacttagagcacatgtttaggctgacatagaagccactccttattgataacttagaatttaactactaataaatatgatggtcttccgatggaggaaatcataatgcatcatttattctccccatgaaacggacagaacttgacttctgcagtggtatcatgcttcatgacatggcgacaatcactatgtctcaggtcttctcttcacccctataaagacaggaaagatagaagattagatccaacgtcacagggtacatggaaatatatgatgtttacaggttgattgcaatatgtcatggaccttaagtgttccccgatgatcttgtggacgtcttggcctcctcttgtcccgatgcgttcggggccagcacaggctcctcccggaccggaatcactgaagtttcaattgattgctattcgtagtcttcatcgtactcctcatcagacaagtcttcgtaagcattgatctcaacctgatagcggagaatcccccctatcccaccaaagcccc

SEQ ID NO: 64213 - DNA, 726 bp, Oryza sativa
ctagattcattagtatcaatattaatgtgaaaaatactagaatgaattacattgtgaaacggaggaagtacgtatttttttttagaaaaaagaaaaacttattaacacgttttagtagtagtaactttatgctattgctatatagggtcgacctttaaatttggcacctatttcttcttggcaggaattcaccggcaaaagctagccgaagttaacgcgacaaccgacaactagcagataacttggggttgttgtttggttggggccgtatgttgaggagcaggagattcctgctcacgaaatgcttgttgcactttcaaagttgacattagacatgcatgtagataagctgccataatagcacaaattaacagtaggaaagcaaagttaaccggccggtgaacgcaagttcaaataaaatagccttggctcagtgttcatttcgagcgcgaccggcgctctattctgaattcgagttgggccatttcgacattccctcttccatggcccatttgaatgcgctgaattttctgggctcgagttattgggccaattttttttttttttttacaaattctttcctctgataataactctagttctagctcgattgaacatgatagtgaattactccctccgtcccaaaatataagagattttaagtgaatgtgacatatcttaatacaatggtaaggaaacacatcagcttttacaatactacaacat

SEQ ID NO: 64214 - DNA, 656 bp, Oryza sativa
acattgggcatgccctaaattattatagcacttcccacatctatattgatatattcatattaatgttaatgaatctagataatggcttacattgtcggagggagtatgttcatatgcactatagctgtgtataatgttaaatcaaattcagttggacttggatcgtaattttcttattccaaatctctttggattagcgagaatcctgcttcaaaatccctgctctcctcatccgaatggattaggcagatatcaacaagactactccgtacatcagcattcagcactatggtcgtaaaacatcagcaggttgtgacatgcggaattgcagacgaattctcagtccttccgcgtacagagatcgcaatctcgcattcgcattggctgttgtaagttgtaacctgtactaagcctgtaacattggcaacggaaaggagatcaacacggaaacaaatcgctgtcaggggagacccgtgtatcagctcgtctgatcgtgggctcggacgcattcattccaggatttgtcgcgagtgccaaccaccaaactatttcccggacaacttcagagagagagtccaggtgatctgtacgtgcttgtccctgaagggatgaaccgtgaacgaacgagatgttccaaggtatactgatagtctagt

SEQ ID NO: 64215 - DNA, 1424 bp, Oryza sativa
aattaaggacagattagtaggatagagaaatgaccacaataaccttatttattgaacacaatacatgcacacattccatatataaatttaattaaaaggaatgttaagacaacaagttagagatgtgatggaaggaatggagattacaaggaaatgtattttgatgtaatcaatttgctagatcccacattagtagaaatacaatttttatgggacaaaggttcaaaggtagaaattcattttctatgggatggaggtagtacaaagtttagagtttgaattataaaaatcaaacataaaacggtaggttcacaatatcatgtaaaacctgaacaaaaaagttattaccactacaaattcaaaatctcaaccgagtgatctatgaagttgaaattaatcagcatacagtagttcccaaggtacatcatcttgtaggaaattggttttccataatttcggtatcgttcctaaacatatcatccaggcaatcccacgtcattcctataatttataaagttatcacaacttccctatctccaaaaaaaatccaatcgagacaagcagtctaagatacacttagttcccacctcattcctataatttataaagttatacacttagttcccacctcattcctataatttataaagttatcacaacttcccttctccaaaaaatatccaatcgagataagcagtctaagatacagttagttaaaaactcgttgctagacatctagcaattatcccaaactacactgctccaatcaaaagcagaaacagaactagatagagatagcagcatttttatgcagtcacatttccatgtaaggccgtgtttatttctatttcaaaacgataatcttcagataactaatttaaactcaaaatcatccagaattttacaataacatcattaggaagcgcaatagttcctcagcaacagcaaacagatctagaggtagagaatcttgttacagatctgatctaacgatcaaagtaaagaagcttgttcctcaccataggtagcccgggatcttgatgcggaggaagagcatggccatagcgtacgcgatgacgatggcggcgacgccggagccaccgaaggagacgcgaaggctccggggcctgttgcggtcgacggcgaggtcgaggaggatgatcccgatgccgccgatgacgaacatgatgccggaggagagcccctcgatgatgtactggccgttgacgcggccggggaggaagacgacggggcggacggcgccggtggcggggtcctggacgctgccgatgccggggggctcgacgatgacgtcgtagacgaggccggagacgacggcgaagtaggtgaggaggatgagggcgaagacggtcatgggggaggggagcgccaggttggagggcagcctcaggcgggtgcgcggc

SEQ ID NO: 64216 - DNA, 1507 bp, Oryza sativa
gatttcgtctagctcgacatcgagctacacgtggatggagatgtactcgccgatggccatgctgcaggcgtcggtgacgaggccggctagcccggacaggaggacggtgcgcttgtcggcggggcgcgccgcgctgatgccgagcatgagcgatgcggtggagacgaggccgttgctggcacccagcaccacggcacgcagccactaggagtgcacgctgccgccgtcgtgggtggcttcctcttcctccttggcctccgccacgatgagctcggcgtcgccattgatggtagccatgcttgtgcttgttgaggagagagcagagtgagacgcgcgccaagcatactcatcggcgctgcgccgctcctcgctactggccagcgtcaccgccccgctcttatccttcgccgacaccttctcctagtccctcgtcatcgcggcacaccgccgccggcactgccactgcgacgatggcagcccaaggtagcccgggtgagaaattaggtggaaatagagtgaaatggctcaaatggcaaacaaatgtaagccaagtcttggcagtggcattttaacgatgccatttcggggaatggcattgtggcgaaacccactcttacagtggcagaatgtccaatttctctcttccgagcaggcagtgtacgattggcccctggtaggacatccaaaaagacaaaaaaaaaattaaccgaatacaaaggcaaaatttacacaatggtggtgtttgggatagtttaatctctctcacgaaaacataagttcctataataagtttcttccatcccaaacaccacctaactttaaaattttacttatatgacaccgtaaaagtaaatctttagactaacgtactaccgaaaaatgtatatttatcgaaaaacaccgtcatgcactattttcttctttgtgatttgattaggagagataaaatggagcaattgctcgtttgaccctgttttaatgtctaactaccaatatgaccctgtttttaggtttgctcatttgaccctgctttttaaaactaaagatcagagatgacctattttgtgaagatagataacggtgttaactaagagaaaaattgtcctttttacccctgctcaattaaccatgttaaatttggcatagttttaacaaatttgagacagatttgtctatcactcatttgttcattcttatcctctctctctctcacgagaccactgcgaggggcagcaggaggagcgacggctcggcggcggctacagttgcggaggggcaaagggaggagcggtggtggaggggaagcgtcgggccagcgatgaggagggccgtcgctggcggcaaaggagcggcggcggcaacggttgctgagggaggagcggcggttgcggcggaggaactgcggcgaggcaactacggagggctgacagctgcggaggagcgccggtggtggctgcgaaggggcagtggcggcttagcgacaccagcagcggcggtggaggggaag

SEQ ID NO: 64217 - DNA, 794 bp, Oryza sativa
  unsure (1)..(794): unsure at all n locations
cccccgaaagacagaaaactgacatgtatcttgtactacatttggttaacctgaccgatccattacattcgacggataaaacaatttgagtttcctactaaaatgttttggagtgagacttaaagcacatccagttctaatgaacatccaaggagatgcaagcgtcttacagagtaatataagcagtataatgattgatgggctcaacttaagactggatctagatgtgtgtgaaatttcagttaaaggtgtcaaatatgaatccactctatataatgacagtacgacatattaggctatattcatgaagcagaatgtgtgatgtgccaaattgtcaaagtggcaaaagcatgtgccatggtatggagggataacacatgcaacaaagctaagaatgaaataccttctgagcgtgcatttgtcttcagagttttagtaaagacagacttttcaaaggccaactttgacgcattactagaccaatcatccgagaagtatttcacggcaacacgtttcccttcagaatccagaagcaaaatgttcttcacagaagggcaagattcctgtgtaacgaanatggacaatcatgaatcattacatgagcttgtgcaaaggacagaaaaagttacttaatgctgcatttcatgttcatcaacaaaagcatcattgcatggaaaaacaaagttaaacattgatagaatgaatcaaataagaatgctgattcagtaaagagtacaaaaataaaaataaatgatatgtatttttttttaaaaaaaacaataaactggatcgat

SEQ ID NO: 64218 - DNA, 2385 bp, Oryza sativa
caaatgcatggtctgactttgggcgcgagattgttcagaacgaggaccggttcaaatgcgttgacgtccacgtacgtacgccggcatctgcacgttccggttggatggtggccgaaccgaaccgcgtccacttgtgtggactaaattgctcatgtgcgtgccggttggttcacttcctactggatatatttcgtaggcacgacgaactagtggatatgggcatctagaagtagaaacgtcagtcgcaggtgtttgctgcgcgcgacatagccatctacgttgaactttgccgacttcatgtgtgccgtgcgtgcgtacgcgatgcgaggatcggacgcgcacatgaggtgagctccgttgcagcgcgcggcgcggcggaagaaccgcgcgcgcgcgggagagggcaacccgttccgtgcagggcgaaaataggagggggatttttgtacgctcacggcattttttttgtcagcgaaaattcatgcaagttgatcacggcgacgaaattctccccttgtctcgatgagacgagagcaccatgtgcagaggaaaagaaaaattgcaaagccatcgattgctcttgctcttctggtttcatgagacgcgtgttgccattgctatgtccggttccagccctattactgtcagttcgcacagggtctccatcgggtttaaaaatgccatggtaaatccagaaaccaccttgtaaactcacaggtttcgaaagagtttaaactgaaattcaaatttccggcaaagtgcatccaaatcttaccagttttcatcgttaacgaccactcgggcgtggtattcgtttttggaaccctggtacatccatcgctccatctcattttcattgttcatctgtttgcatttaggccatctttggcaattggaataggtggcccataaaagacggcccgttattaaagcccatggtcctttgtcacgttggagaagacgcgccacggcccacgggctgtaaaaagtggggcccaaggtgaaggctcaccggtttcctaacgggtgcgacccatctaaaaatacaatgcatctcgattcttatcccttccgtcctccttcctcctcccccctccccggttcgacgcgcacatcgaaccccgacgaccaccaccgcccggccgtcgccgccgccgacgcggtcgtcctctccggtaatccctgttaccctcctcgtattatcgctccttcctctcctcgccggtcaatctccgcgtcgtgttttttcttcgcgcgccacgatccttgccggccccccaccagctcccgccgccccggcggcggaggcggtccgggcgtgctgctccggaatccctttacataccggaaactcctctcctggcccacccccacactgcccagcccgattcctaactccggacggtggtcgtcgtcgccgccgccgggaaggttcctgggtttgtgcctctttgtgggtaggatgcgttcgctcgttttggaattgtggggatagttttggaattgtggggatagcgagaggaaaagctagtttggtattccgattcgtcttctcctcgtcacccgccttcttggaaaccccgcctcgcccgtccaaccaccaaccccgcacccccgcctcgccgcctgccgtccaccgccatgaaccaccttacggaatacgtatccatcaccgttggtgttcgaggtaacctgcaccaattcaattcgttatttggcggtgctttcttggtggaggtagatgcttgccttgcgctgtggtttaccccctcagcttaagtttggttcttgagttggacttgcttgggaaaaaaaggtgtgattttccgtgtccggtgtccctctgtgtgaaatagcaagaaagacaggtgcattgtgccgtccattccaacatgttgaatgcatgtggtctggcattctgcttgtgatttgtggcatagttttggcaccaatgagttgatgggattatgtgattagtattgtagttttgtgtcctcatgtccagtaaccagagtttttctcatgacaacatttctattgtagagttctatttactcctataacagtcttattttcaataagacgtcacttattttatgtgatttccatattggatggttgggtacacaggttagttagtatttatgacttgcttgcaaatgtcacactggacaatctccttacctcattatatggaaggggatgtgtatgattagacagaagggttcaaattcatctgtttttttagaaagtctacattgcaatatttggtatatataagtagatattcatcgcttaatgctttatagagggagttggggagcccagcattcccttttttctattataaaattcactatgtttccactcgtgatgaactctgta

SEQ ID NO: 64219 - DNA, 1309 bp, Oryza sativa
gtaggacatttttgttctttgtcatttgtccatgatatgtcaggacaacaatgcacagctggtctttctactgatccttgatttggtaccaccagctttgcatagcatagcatatctcatccttatcttcaaacttttctttgattagtttaaccttagctcatgcagttatcttgtaaacttctccgagagagcaaaggaagctagtaattattaagaacaaatactatttgttaaaatactgtaaattgcaaaagaaaaaccatttccttgacaagtatgctggtccaacggcatcctctgatagtctgattaggagcttccaattttttattagacggtttccagaaacaacagtcgatgttctttggtagtagatgcattgttcagagaccacgtgagcttctcttaccatgaattaaactacaagatcacatgcctgcagtttgatcatgtcttaaaaagttactaatttcttggcagagtggcaacgccagaagctttacggtaatcatgaggtgatcatcaacctaaagaaacaggaaagagagaatatagaatttcgatgaatggcgttccagttgcatactgcactttctggtgattattatgttctcttttagatattttttccttgttctttattaattcataaagccacactttttcaggttatgcgcagttctggaaagagaaggaataaataattccctagcctgtacaccgaatggtttaatcagcatcaaatactcctaacatgaacaccaaaacaatcataaataccattattactgcttgaagcagagtcaccgccactgtgactggcttgtgggcccatcaaaccaagaacaatggctcgtgtatcaactatcaactgttgatgcagaattgcagaacatgaacatgaaacaagaacagggaattggaactgaagtttcagtgagtgagaagtgataggaacagactattatcctctctgattttattacagcaatgaaccaagtaatcccctcataacaacaattacaaaacagaaagaaaaaaaaactatagcatgtagccgcccccatccagaaacaattacgtaaacttgacagaaaaatttacaggagatcgaaagctaaaaaaatttagtgaaatgaagcaacaatttcttcacaatttttgctgccaagaatacaaagccaaccgaccaaccaacggccaactttttttcctgcacgactgaacccgaaagctgcaactgcagctgcagctgctgtcgcttgcaccactcgcccactacaccaaccacatggccactagcccc

SEQ ID NO: 64220 - DNA, 23350 bp, Oryza sativa
tcaatgtatgttgccccgagaacgtgaacgagaacgagaacgatcgaacgaacgagagcgataacgagaacgatcgaacgaagacaagtgagaacgagggaacgaacgtgaacgagctagggaacgtgaacgagcgaacgaacgaggacgaacgttaacgtgaaatgcaatatatatatatatatatgtatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgtgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttaaaatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaagtttgtgtagggttctaatgtatgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaacaagcttgagggtcggcacatcataacggaagtggaagaagatggacgtcctagtgccccagccgaagccgccaagaactatgtacgtcacagcggttgggttgtgcgggataacgtgcctgtcagtagggtgtactggcgaagaacaagggcacgcggagatcatgagagctttgtcccagattcggagaaagagatgctgtggaccacaatgctcgagacattcacccttcctacgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtataggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgtctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtatcatgaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaactttctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatatctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcaacgagtactactacgtcgaaatgatagctagctagctaggacatataatggattgtaattaatacatgactacatatgtttctatatgcatgtgtacatattttctataatgtaaatatattttggtcatatatatatatctatatacatatgcattaatttgcataacatatatatgtgtataaatacatatatattatgcatgtatatacatataatataatataatatatatatatatatatacatatatatatatgtatgcatatatatgtattgaaacatatatatgcatggtttatatatatatatatatataaactatatatatatataaaccatgcagcaacagggccatgcaaaaaaaaaaatggtcagctcgatctttagtcccggattggtactcccggtttggaaaccgggactaaaggggggttacgaaccgggactacaaagggtttctccaccagtgtaactccaattcatctgtagccaatctaataggtcattcatacaataattgcatactacactattaatgcctggtcccacctgtcatagacacactgcgtcttagaatctgtgctacagctggctataaatctatagctcgctgctcttctctctcctcatttatctttttaaaatatgtttgcagctagcttatagcctgctattgtacctactcttataggtgactattatatgaatcggctattttaaattaactatagatgatttggagccggtagttagctatactattaaacttgctctcaatagaacttacctcgatctcactaatgctctcaaattatgcccggacaactttaaatataaacaatcatattatgtttcaacaatcatgatttgagactacacttataaagtttatatgggatgaaacaaggggtaataaaagtgtagcctgggagcaagagccattgaggtggatttgtgctcaaattgttgaattattgaagtgaaatgggagtagtaggtatctagtgagtgattatttgatggtttatttcagcattaagtcagtatcaatacttagttagtatgtagtaataagcaatcaatatcaggaataaagcagattaatttcagttttttatgagacaacagttaatgagaggaatggaccatgcattaatagcttttttgttgtatccatggctgatatataagagcaagttcaatagtatagccacctactagctccaattcatatatagccaatctaatagctcattcatacaatagttacatactacactattaatacatggtcccacctgtcatacacacactgtgtcttgtagtctgtgctacagctggctacaaatctgtagcccgctgcccctcctctcttctcatttatcttcttaaaatatatttgtagctggtttatagcctgctattgtacctgctctaagaagctcaatgatataaaggttgacattctcgacgatgtggccacatataatcacagctaatgaggatatttatgtaggaagagtatattagctcagttgggttttttttaatcacgtacccgcccgacttttagtctccaacttaataagggtgctcttattaatttttattctgatttaatataggtgttcgtatatatggttaatattttagtggtatttaatttaattttttaaaggtgttcataagtaagagcgtgtatgtatgtgtttgttctctgtgtttcgaaaaaaatttcaggtgatctgcccaagatttcaacgatgcctaaaccgtatggatacattgacaagacaagtgtgcgctcaagaggactaatacttgaccaccttttgctatattaataattaattaacaaacgtgattaagccacatttcgatcaatagcctagggtgttcttgaagtgcgcaatgaccaggatgaggagagcaatccttaactgattccttctagaaaagactccccatagtttcgatcaaacgacacgaggtgtggtccgggaagtttcttctgtgcctttcttttcatttatatttttctaactcaattgcaaaaggcaaccatttgaccatttagctccagccacggcgtcctgaagatcagaccgctttggtacgtacaacatcttttttccctattttgtgcatgaaaattatcgggtaaaaactaataataataattcagtacgtgtcatgaaagactctgaaatcatagtattttgagaagatattgaaaaggttactgtaagtagaggaggcgctgttatacaactgtctgaaaactcaatttagccttgtttttctctttttttttctttttctgaggaggcttcaatttagtttttcagatacgaaatttgcaaacagttgaaagaataggagtataacagtactcaaacttcaacctagagttgtttagcgttgtacattacacttgttgtaaattacatttatttcaaatgatatcaaactagatactgaaaatctatatatttgtatgcaaacatcttccctacattggtaattttggaactgtttataacttctaattaaacaataattgtgaaggtagcgaagacaccaacagtttggatatatggataataccgtcaaatggcctttcacttagaggacttttacggtacattctacttaaagtatatacttacagtatatgaaagggtagatttggtatttgttaaaaatctaaaaaggattgtttagccatttttaattgagatcatttttttccatcggtggtattttttcggatgtcgtcgtccgtacgtgataccaatccagtctacctcgtacgtggtacgtcgggtcgccggcagccgtacgttgtctcgcgtgtggctcccacagtcccacaagcgccgcccagcagctgtcgtacgcaatgatgccgtcgccgccgccgccgatcgccggaagcgatacagcctccgccgggagcaaagccaacatattgccattctcgtgcgcagcactattgccgccgtcgggcccagcagcagccgtccgcttccagaaacttgcttccgtcagtctctctagcgatataagttcttgagtgttaaaagcctgagcctgtgataatatataactactgcatatttgcatcagacttgtttatgattcaggcttcatccgcttcaataacaatggatacaagcaataattaagttaattaacaagtctaattctctacaaacacttgtgaatcggtacatatgtttttttataaaattcttcttcacttttttaaaattgctgttgtcgcatgccgccgcggggcttccctgccctgctgctgctgcatgccgcactgctgcttcggccacctgccggctgccgctgcccggctgcctttgccgatgcgagctgccgcagctgcccgccagcagcggctgctttgactggacgcctatcgaccggatctaactgagcaaatgcgaatttataaaattaccccctacgcaaatagataaaaagacaaatataccctattcaattttatactgcaggataattaagaagaagatcagattaatttacaccgttagatcaaatataatggcagtatatacttgcagtacaatgtacgtaaaaatcctcttcacttatacctgcacaagaattcaacgatcaaacaatcggttcatgatctgcaatatttggacaagaataaatgatctctatcaacaatgttcgtgcatcctttctttcttggaagaaaggcttaagggggattttactctacatatgcacagggtaaaggtgtcaaaaaaactactttggcaatcatggattgattctcttatgtaacctcttgttttttcttttctttctgttgtacgtatcgttctgtaatctgtaaattgttaatagtagtatactagtatagtgcagtagaaatcaaaaaaaaaaatcggtgtgttttttgtttaaaaaaaaatcggttcatgctgtggtaacggtatcaaatcacataaatagttatgcttagcaatttcggttttgatcgattgattgttgaaatggtactgcttatttgtatatcagaactaattcactctgatatcacatctctgttatatatacatatggagaagtatagtaattttgaggagatattgatgcttcatttgaggctgttttacccacagaaaggtattcctgagtttatctgttcttttgtacaaaatgaatttccaagttattgtgtcaacacatatataattgaagtgtcaacacatatataaacgtatatgcgtgcaatcatgcatagggctggtggcaagttattataattgaagtgcaaacaaaaattgagaattcaggagtacttctacaagtcaattgtgcaaaaacctgatgtgaacgtaggagttgtctgaaactctgaatgaatattgccctttctgctcagcagaggccaaaggcaagtgaccgagacactgaagcaagaatgatactacgcacttgtgtaatacataaaaaaaattatacaaatacttagaaaatattcactcaatttttactcaaaaggacttctgtaaggacttctaatcagcaaagttctactctgaacatttctttagtcaaactatgctttatattttgattgaaggagcagtagccacataggagttcctgaaacgcacgctacttgggatatatcatcatcctatataaaaaattgaagagatttattattcacaattgatgatgccatcttcagatagaaacaagagtacccgcacgggataacttgtaccaatattatctatccatttttctactcacaaattaaaagcactgtgttcagaaaccacaggtgtcacaggcaatcaaaccaagaacatagaaaatcaggcgcccacatgattcccccaattgccagcagatgctgcagaagattccaaacacatctgtctctacttttatctccttttcctctccactagtattttatttttttgcaatatttttcacactccaaaaccccatcatttttcagctataaatggccccctcctccaagcttcaattcccttttcccctcttccccagctcctttgttaggttttcttccagtgagctctttttgctcatattcagatcttcacttatttcctagttgttactactgcctttgagtattgacagcttcatcctgccaactcagctcaatcttcctctgaagtttcagtctttgtttctgaatctcttcagtgttcagaggggaagttctgccaaaaaatttctctggccatccattttccaaggggagattctgccaaaattttcatctctgtccatcaatattcctggggaggttctgccaaaattttctctgaaatcggttaatttataaggggaggttctgccgaaattttcgctggtcatcaatcttccctttgttgacataccctgcataagtatatacaacaaacatataactttttgcaaggtaagaaggagtttttatctgttcttgatgatagactcctagagaagttgtcctagttgtgtagatgttgttgctcatcatccctgagcacctcctctctagatttatgactggcccagccataacccagcttgttcagtccttctctgttgtcttcctctactggttctatgtcttctcagtaagctccctgtagttgtagccttttgaaattacaagacttatttatacaacataattatcaaggcatccacatataaactacaaggtatatatatatatatatatatatatttacaaaaagaaaaggaataagagggagtaaaattgttgccggtgcgaaaaaaaaaattgttgagaggtgaccatgtcgagtgggacctcgtccgggtcgagccagggaacccggagctccaggtcggaagatgacctgaacctccaggcccagatggagaagaagaggaagaggaggaaggagtcgaaccgagagtcggctcggaggtctaggatgaggaagcaacagcacctcgacgaactcacctcgcaggtttatatatatgctctgcttataatatatatatatatgtgcacaaaagtctaaagtttgtgatgcatacatagatctagtttattgtttttgctgtcataattgttttactttattttatctttatatgatagcttgcactcatgtgcaggtagaaagcaaaaaacagatgaaaacagaagtgccacttgaaatatctgccaaaaccaactcaataattgtgctgcctttttcaaaaggccccatcatctgtttcctacctaattcgttcaataacactagaaaacaattcatcatcatgatcttccttgtcataaattgagcactcaccaaactagcatcacaaccctgcatcaaaaatcaggaacagaagtctaaacacatatcactaagaaaatattatgtgtcactgaacaggtgaaccagctgaagaatcagaaccagcagctgagcatggcactgagcctgaccacacagaaccttgtggcagtgcaggcacagaactcagtgctgcaaacccaggagttggagctgcagagcaggctgtgtgccctaactgacatcctgatgtgcatgaacaacaccagtgctactcctactcctacaattccagccaccactacaagtgcttgtgatatttttggtgccagctcatggaaccagccacccatagacttgtaccagtaccagtgcttctgatctaggaataagaagagggttgttgtggtagtgtgggtaggaccagaagccatcaagtaatgtttcaatcatgtagggccattgttgtcactgttaatgtatgcaattcaatcttaattgcctgctgtaggggacagggatatttgctctttcttgtagctgttggtggtagagggattaccagatggcaaaatggtgctttggcaatgtgttaggtggggctggttttggttgttaagggtagggaggagaaaattggtaggtttttcttgagcatgcaagaggggaggcaaaggattttgtgtaatgatgctcttcaaggaaagtattcataattatgattataatgtaatatgtggatttggtggatcttcataggccaagtgcttctttgtgctccatatgtgtgtgtggttatctgaaaatagattatatgattaacatctctatttattttgagtattggttcaaaaagggtagaatgccattttgacatagtttttcttttacctattatttgcttcttactcactccagtgtcaaaattattgacgttttagctaccgaagcaaagtatgctaattcttgacattttggttttgcttgtgcatcttgaatctgcttgccactgcatgcatgtacgcagaccatgtccaaaacatcaaaaatttcgaaactggagggggtatttcttttacacaagtgtcaacatacatgacgaaagctgcagtcgtgacatatgtaaaaccacctttttgttttttcatgtgacctagatatttcgtcaacttttcttcacttatttctcaaggccctctatattgaaagcttgagttttacccttaattgtggacttcatctagcacttcagatttagcagagccatggaagcatttatcaccttttgaaggtgttatgtccaagtctgaacatttagatacagctcaaagggcattttaatttgtatagcatcaatatgtctggaggacatgtgaaatattttctccttactgatttgtctaatgaaaaatctagtatttcagacaaaccttgcttactgaagaaccaaaatgaaaatccaacacagcaccaaccttgggaagaaaagatctagaagatgcgtaagaggtgaagaaaagaaggttgatagctatatgtcttggtacgtactgtagaacagtgggagcacttatcaactttttccaaagtgcgatttcacaatgaaccaatcatcctttatttcgaaaacgaggaagacactgttgtgctttgccaaaagctatgtgctcccacatgctccaattccatataacaacttttgcaattctctggcttcagcaggaaaaaaaattcatttctctgcataaacacctcttggatgcatcctttctttcagaattttgagctagacaaggagagaaacacaagatctctaccaaaatccatagagcctaatcctgaagtgcacctaattggatgacagatatcctctacagtaaagctgatttaattgaatcgagctctcatatatacagagctgagctatcctgctgaaaggatggtgagggtgaattttcagagaaattggtacaagaatagataaaggcataactgcccaattgtcgctgttggaatatgttggcatgtgacttcacgaaatggagacatcagcatcagacatggaaatagtaaccaacaggtcatggcaaattccatggtgccattgagtctgaacttacttctgcactaagtaaaatttggtagggaaatccaaatttgagaaattctgatcaagaaagaatggacaaagaagcagtactccaaaattcaatagaagctgcaatttgtgtctaattctgactatttctcatatttacactagatgtatcacaggtacaagctgaaattgcagctggtagtggccaatcaaagaacaaactaatagagaagtaaccaaaattgctgagaagtttcatcccaatcgtttgatcgatcgatcgatcgatcaatcatgccatcttatgagcatcgcaacgcatcggcggatgatgtagagccttgccttctgctccttgagagccctcttgaggcccttgagcttcatgtcttgagcacccatcctcatcttcatgatctggagagatgtgattcactgaaagagatgagacaggctttgcttgttggatttggaagtacaaacttttgtttgagtttggagatagcaatggtacatggtttatataggccgtttgtcatgtgggctgtgtcagcagctgaagtgttttttactctgcttatgcatatctgagtaattaacttgtaactggtttcatgctttgaataaacaaaagatagtttatgtgatcttgaatcaacttacttaaatttcctgaggcttggttgacttgataataaaaaaaattcattgatcacgtaatggcatcatttgctctgcacgatggattaacataaataaatacacaatatgtatggttgagctatgaaaaggttatcctactggtactggacggtgatgccacattgtgagtcactctaggagttcgtgtgttgtgtcttgtaattcaatagttattgcggaatttcttgaagatgacagcgcaagatggtttttagtcaacttttaggtttgacaaaaaaatattttcccagtgaaatgccaagtattctctctttatcattcagtatttcctttttcagatgaaggaagctttattaaaatcaagataattacatcaaggagctacttccggcttctgtataatattattcttttgcagacttttgttagtaagtctactcatttttttgaccactactcgtaatcgaaacaatcaaatttcacccaatagaaccgttataaccttcaaggcagaggtggaataaactcgcccttgctcgctctacctcggtttaaaattcctccaagtctacacatctatctattatatactaaaagtccattaatcttcctacaagcgctctcaagccgtcacgtgacacttctacaaacgcttctagaccgccatgtggcaatgcctaatctcatcgtcgattttcacttaaatcggtggacccgataatttagacgattagattagattagatgtattttatttaaatagaaactactatgttaatgttggccgaaaaaaaacataagaattccaaagtatacgtacgactaaaaatcaataaaactctaatattgttcatcggttcgctggcaaaataaatataagtacctaagaatgggaaaagagcagtaaagcttatgctgctcacctacgattcgttaggaaggaaaaaatatgccagcgtatttagaaaaaaaaattaaagccacgagtaaaataaagccaaaaaatatacgtatgtagtaccatccaaacaaatcgaaaatataattttctacataaaagataaaataaaaatatgttattccacaaatatacatcaactagacatcataaaaaatataaagtatcaaattaacgttatgtaaaaagtcacattttatttttctttaaattatattcctttaaaaaacatacgtctgtagtactattgaaaacaatcgatggtatttaaagatatatttttctattatttaaagataaaatatattattctataatttaagcaaatatcatcataatttttatttaaattgatgaatccaatattttagaccattaaattaggtatattttatttaagaaactaatatcatactctgtctatatagacgggagtaaatgttggcaaaaaaaagaaaaaaaaactgtccattggaagaaagagaaaaaaaatctacatacggacttactataaaaaaatagaaccaaaaaaaatatgtagcgatgaccttttgaaatagtgctttctcttattatttaaagataaatatattactctataaattttgtaaatatatataagtagttaaactagatttatattataaatatgaaatatccaatcaatgatctttaaaagttttatctgaacatacgaggctgatgtatatagtaattaatgctatgataatttttttatttcatatcatattttagggtgtcaagtatcatttaacgatatacaacgctaatttaaaactacatacgtaaaaattaaacaacacaatttagttgttttattttacatcattggattagatttattatttaaaaataatatatttctcctatacatgaatacatgagaaatatagaactgttagaccggaaaccgtacgtacatatgattggaaaaaaacaataatggtcatgtatcgtttcccggaagaacagtaaaccatatgcgcgtacttatgataaagccaaaaaatcgacagtcagaaaataaaattttatacaatttaaagataaaatataataatattaaaatttacacaaatataaatataaaatatccaatcaatgctttttaagttttttatcttttatgttattttaaaattatatatccaatttgtgatcatgttgtattactttaaataaaaaacaattaatgtctataaccctaaatacatcacaacatatggagccgatatgcaataattattgttatgataataatttcacattatattttaggtgtaaaaaacactttttgaatatgcaacactaggtgttgaaaacagatactgaactaacatgcacttcactatagatatttatcaaaatatagtatggtactttggagattatcgtggtagtatttaaaaaaatcactttgtcccggttacatgtaaattcttctattgttttgggataaaatttaattccttctatttatgtgatggagggagtataagtaatataagtttatctttgattagatgaaggagtaccattagctatatttttaatagaaaatatctttcattaatatataataaaaactaaaatgttacttaaagtcatctatagcttacaaaatagaaaatattatatacataatacaaatagatatgaaccaactccattattatgacagactttttgtttgaagtaaatatgcccaaaccagttattaacgaacacatatttaaaatagtgtaagaaatattttaaaaaatatcatccatatttattcgtaacaaaaattcaaacaacattaaacaacatgcccgcgcatacgcgcgggctatctttctagttcttctttaatatttaaaagtagtcagttttgaacaaaagttgatttcacactggtagagaaaccatctttggtcggtcgactcaaatccacaatagtcccggttccattaaaaaccgggatttttagtcccggtttataagagaaagatctttagtaccggttgttgttaccaaccgggactaaaaatcatctttagtcccggttggtaactccaaccgggactaaagttcatctttagtcccggttgattccatgtcagaccgtatcagggtactaagatctttagtcccggtttgtaacaccaaccgggactaaaaacctatttttagttccggttgatgttactaaccgggaataaaaataaaaaacacactatataatccctattaccgatcctcttttcccatccacacaacaaactcctccctctctctttctccctctccaacttctttatctcttccttatctctaactcctaccttctctttcttttttttccttccattagtcacagcaaagcagacggcggccggcgagggggcgcggggggccggtgcggcggcggccggcgcggaggcgcggggagcctcgcggcagcggcggcacggggggccgcgcggaggcggcctgcgcggcggcacgggggaccgcgcggcggcgggcgaggggccgctcggcggcggcgcgggggaccgcgcggcggcgggcgaggggccgctcggcggcggctggggcggcggcgcgtggggccgctcggcggcggccgtcgcggaggggaggaggggaggcggcagtggccggccggccggcttttcttttttttctttttttcttttttacgatttatcctgtgatgtatttgatttgtgtgtgatgcggatctgtgatgtattttttagaacttgtgatgtaattttttaaaagtttgtgatgtatttggagatgatctatttgagaatttagagatgttctgtgatatgtgagaatttggatttgggatttcttggcatgattaggggatggtgtgaaatcagtattcaatactaaaacaatgaaaaagagaaaaaaaaagaaaaaatatctttagtcccggttgttgttactaaccggaactaaaaatcgatttttagtcccagcgggactaaagatagcgatctttagtcccggattcgtagtcccggttggaaaaccgagactacagggaggttacgaaccgggactaaaaagcatttctccaccagtgtcactctatctcagagatggctctttcgccctttaaagttgttcctagctgcaaaggatatggtaataaatatttttccaacaaaagttcaaaaaagtgaggaaccatctcatattctacccatgaaaaaataagcaaatactgagccttacaaacaaccagggaccattgtcacacaaaactactgaatttcatggaaaaatcactagttaaattttgaagatgtcacatgatgccaaattttaatatttcttaccttttgtgttacaaactcaaattttttaaaacttttcattggaagcaaactccaagtccctaacggttgatggtcttttccaggtgaatatgaatgttgaccagacatcagtagtagagagagagaaatgtgactaagggatagtgagaaaagatctaagaaatccacgtttttagacaagaagaagaaatatcagaatttcaatgtctgctggaaaaagaaatttaattatttgccttttcattattccagggttatatgcatattgttttcctttttccgcaccaacggacctgcatcgcgaataaatagctcacgtatgcagccaatattaagattaattttttatattatatgaaaggtgtacacacgcacataccactatgcatgcacacccccacacacaccctcacgggagacgcacaccacgtcaccacccattggtgaatgcatcccctaacactctcaaagagacggagattaacaacaaatctctagcctcattaaattcctatcgaaaacgcatcattgtgtgtataatattttggtaataagatttacctaataagtagagtcatgcatcaatgactccatcataaactactggtgtttccctaatatcaagagtttttggttaattgatccccaaagagtgaaaataaataagttttcttcaagtattttgctgcagcctaccatcgagatttttctttgttggcacaacattggctgtctggtctagggattacttaagcatacacccttcaagataactagcaccatgtcaactacagaaaagtcaatgtttttaaacaaaatggcaagcagaaatgtcagcgattataaactattgctgataacattgttaagcattgtcaacacgatggtttaaccaatagttccaaagtattaggtttgaccatgcacacatacacaaattcttcgatgatctaagaaaagaaaagataagagattttttttttcattatctctacgctggcagatgctatcctgagtttgcctccattcatgatgctcacatggcaagacctttagagaaggatacttcgctacgataaaacaataataggatcatatcgtggagttactgccctaataggatggtaaaattttgttttataaaatttgttcataattttctgccatcccatacatttgttcactacccaaaagtatactttttctcaaaggaagaggcagactgaccaatcttttctcagactatttgggtatcactttaacttccaaagtcaatgcttcaggataaagatatatatcatgtcaacatggaggtaagaagtgaaactgaagtgttccacattcaactaactgtgcaaataaattgtcagctatctattcctggtgcatgatgccaactaaaaccttgccccaaaaggctggctcagcagacaaacagaggtaagaaagcactaaacaaggcattgggaaataagctaattaacctcagccaatcagcttatgtacaatgtacctgccagtcagacctattttcctttttcatgattggatggttgtttctatgttaattaccattatagttttttttatcaagcaatcttaatcaaacacaatctaggagccacaaagcatcgcagaataacatgtggtgcacgaaattcagtgcatacataggaaatcataatgcttagcctcttgagtatacttgtcatatttgaccactttatttgttcaaatattttgacagaagtggaaagtccaccattataaatccctactgaaaagtccggcattatatcattactgccgctagagtcccttatgatttttttgtaacagaaaggaacataactattttatgttaaattattttttttcagctcttgcagttaacagacaaaacatgatgtgtgccttctgttactgccctacatagggcctgataatatataggctggtaaacttttggtttctaaaatttgttcatatttttttctctttgccattccacacattctgtcactaccaaaggaagaggcagagtgaccaaatttttggtttattaatttacaagaacacctgagttttggtcagactattggatacacttaacttctcccaaaatcaatacttcaggataaaaatatatcatgtcaacgaggaggtaagatgtgaaactaaagtgttctatattcaattagttttgcaaagtaaacacaatttatcagttattcctggcgcatcatgcaaactaaaactctgctcccaaaaggcaggctcagcagacaaacggagacaagaaggcactaaattaacaaagcatttaacaatgggctaaacctcaggttatgtacaatgtacctgccagtcagagctcattttaccttaataatttttggatcaagcaatcttaaacacaatctaggagagcattgcttcgcagaataacatgcagtgcacgaaattagatggcgcaagacacagacgtacagagggtatcataattcttaacttcatgagtatacttttcataatttgaccactttatttgctcataaattttgagaggagtagagaagtccaccattataaatcactacggaaaagtccaccattataaataattactgataaatgccagcattgtcaactaaatgatttagtttggagttccaaattaacatctggtaggcgcagcacatgtacatacaaagattgatctattccctcttgcataaatatataatgttgcagccacaattaacaatactctatttgcttttctcaaaaaaaaaacaatactgcttcatgactatagtactccgaatctctgtcacttctggtagcctgagagtaggatagtaattttttttatggatcaaaactttgatcaccatatttgccaatccataacacatcttgttactttcatgggtaccattatattcttcctaaaggaagagacagagcaaccaagcttctgctttgcttcacagagagagaactgaattttggtagtactattggtgtacggcaatagcatccaaagttttttttaatgaaattagcatgaaaagtcaatcccttcaggagaaaacaaaataatatgtcaacaaggagggtatgtatgaagtgaagctaagttgtcccattgtcaactacttgtgcaaagtcagaacaatatgttaacatttcaagttgatgtcaactgaacttttgctcccaaaagggaggctggcagacaaacaaagacaagaaagcactaaacatagcatttgacctcatgatctaattaatgttcagctatgtacaatgtatatatcagtcagtgttcagtgtttcaagttgaaaggaacagcgttttggatggttgctgctaagtaaccgtcctagttttggatcaagaagaatctaaaacgaaatccaggacgagaacaatggcgacgtgttgctttgcacaaacacatgggttgtacaaattttgagtagaaagtcaaatagtataacacagaaacttccttttcatgaaaaagtactcaacgtgtgacaatgtgagctcatagagctcattttttcacaaatacaagtcaggtttggcaactttatttattcaaaaaggatttatcactgtaatagattggtccattatttcggtggcagagcggaaaattttagtaagatagggagttaaaataggttatagccaacatataattaacatgaccatttcaaaaataagtcatctcttgtttaatcctttcgcaaagcaaggataaaagcacgggtgcgatgttgggcccccctcgtatagaggtgggcttggtccacaacaaatttaagaagcttgtcaaaaccagcattccacaatacatgagttccttttttaccttctttttatttgctctctaattctttgattccatcaaattcattggtgatagctaaaccggaaaggttattaaagcttttagcccacattagataaaatatggtttctatcttttttctaactttgccttagttagaagtgacaagtgttcacaaacaaaatgattaataagttaaacaagtatggatggattcacccaaaagaaaatgatccttgcattaggtggaatccaagattgcgtggagacgtggtaaacttatcctttgctaatcttcctaaaagaatcctcttccggtcgtcacctttcactagaaatcaaagaagaaagaacagtacacaaaagaaaaacgctcaagcaacagtgcgatttccggtcaccggtatatgaccaatgacatgcagtaaaagtgcatgatgaatgcacttctttattagtcaatcaccacaaatgacactgtcctttaaatattattaattgtttctacaattactatctacatatttaaatatatggcatcgttgactttggtcaatctatgccagtttaacaaccatttttctattagaatataatgataatattttcttaaaaagtgtaatattataaaataaagaaaaacatataagcatgatttttatgtttccaaaccaaatatatggagagctattgatgatcaaagctttgaaagttttgaccgaataaagtcaacagtgatatatatttaaatactaagggagagtgttcttatgaaatgacaatcccctagtggagtatgagcaaaaggacacaacatcataagttcataactatccaatggattatgagctaatcccatcaacacccaaaaacatttaatcgaaacaaaacaaaaaagattaagtgaagcaattgggaattgcatcactatccacttgcaaaatggtcaaacatttggcacccaacaagggaatagaatcacacaacactaatctgctgttgtgccaaaacagtaagcatagtgggcttcatactttagagagcccacttgcatttctctgtgcattaggttctttgatgaacctaaccatgttctgcagagatgctcaacttttcagtcctggttttagccatccaataaagcatgtttaccgttccctaaaccgtttgctt

SEQ ID NO: 64221 - DNA, 33896 bp, Oryza sativa
  unsure (1)..(33896): unsure at all n locations
taaacttgctctaaacgcatactacacaattcatagttggttccaccagtcatacgcacatgcatcttggagtctgtgttataactggctataaatctgtacccgctgtccttctctctcctatgttatcttctccaaatgtgtttatagctggcttatagtctgctattgtatctgctcttgtatctgctctgatgccattttagtctctcaatgttctcactaattatgtctcaacaacttttctcacagtatatcacgattaaagcaaacatttttttttcaattcgcatacatgttttattaatgtattataccactctactacgtacctccgtcccataatagatgtcgctttgattttttcttgcaacgcttgaccattcgttttatttaaaaaattagtgcaaatataaaaaatgataagtcgtacttaaagtacttttgataataaaactagtcacaaccaaaataaataataattctaatttttttaaataagacaaatgatcaaatattaaaaaaaaactcaaagcgaccagtaatgtgggaaatgtgggacggaggtagtatcattttttttatcaccacacatttcattgaagtgtcgcttctatatcctgcaacaattcgctgcatatcatttagtttgatctatcgtcaattccagatcacgttaatttaacctctagttttaaatttaagagtgtcaaactttagtatgcatgacatactcccgaatttacactgacactgacactgacatagtctcttcaatgcctatgttcgatttttgtttttgtaatgatatattcataaatatgttaaaaatataattaactaaacgaagacagttttaatcaaatttcacatataaaattttagtgttttcatatatacaagattttgagacttgatgcgtatcctaaccgacatccattcgagatgtaaagcatatcattattttgtcgacacatgtcgctagtacttgcgatgtaaatattagttaaggtcttatttggaacacagaaatcttgtagcaaaaacatgaacagaaggaaagttagagatttctactgcctgacgggaagtgtaattaaccaattaagaggcatcgaagataatatagtgttacaccaaaattgacattaaaatgtgtgatatatataataatttactctatatagactaattaggaattgtaaataaataggtggtacatacaatatgcaatacattaaaaaatgaaaaagatgacataacctaagaagtacataaacccatcttttaatttgggcctggctctctcctccctccgctgaacgctgatgacctactctggtaatctcgtacgacacaccatacaactgtcaaaacaattttttatgctttacatcttgaatatgtaataagtgactgtagcttcaattaaagcaaatgccgaatttaatatccattatataaaaaaacatcttgaatatgtaaacccaaaagcctaggcccatcctaccaatgtatacgtacctagatgaagttgagaagaggtctgtagactctgctgattccagagatcactttggatggcttacagtccacgcgtacatgttacgacggttcttgcatgcttttgtgctatgcatctcggaccattgctttcctgtttatcaattcgatcacagcatctatatatatgctttagcatatgctttgcttttccaagtgtcactaaactgtttgtacgtatggaattaatggaggcgtttgccgtaaagattatggtcgaaagccaaagcgatcacttctccctttgctcgagcttgcgttgcgttggcaattaatcgatctgtttggaaattaaagcaacacgtatgctgatcgatcttgatacgatcatctccagaacaaattaattaatttagtttgatggtgcttgttgtcttatgagctttgatcgtatttgcttctacatatgtttcttaaagacaacataataggaagttaatttgcaacttctatatgacttgtgtcacgaactcggatttgagtcgcaacgaactctcatgtgattcgaaacggaagggaaaggaagctgacttgaggaagaagaagaacagagacaacgagaagcagaggagcaggagggagattggaattgagtttgaggtttcagtttgaatataatatttcgcatcccgctctctcgcacctgccgactatatagcaatgcgccatctagtctctctcactgacagtggcccagcctttcgctactgggtccactcactcaacggaaagcgtgcgttgggccgctacatccttttgggtcgatcttgctgttgggccgctgttgacgtctcagtttgaatgccctgctcagatgccgccgtgacatcccctcccccttgagtggcaacttgtccccaagttgttgtagttggaaagcgacgacgtagctcctgctcattctcccaggtgacggtggcaggttcaccgccagaccacttgatcaacacttgttccaccatcttggatcctttgcgtacaaatcgacgatccataacttgaagtggtaccggagatgcctctggtttcggacgaagaacaggaagcctgggcgacgctgtttcacttggtgccaaagcttgcttcaattgtgatacgtgcaccactggatgaataaggctggaggagggtaacgccaagcgataggccacttcccccacccgctccaaaacctgaaagggaccataaaaacggaaatagagtttgcgatttactcgagttaccactgactgttgttcgaagggctgcagcttcatatacacccaatcgcccacaacaaaaactcgttcggaacgacgattgtcagcctgaaatttcatccgagtctgtgcacgcaggagatgatcccgaatcagagtttgcattttctcccgctcatgaagccaatcagcaagctcagtagactgacaagctgcagtaactgtcaacccaaaatatcaaggtttgtggccatagagaacctcaaaaggagtagtgcccaaagcagagtgaaaggatgtattgtaccagtattctgccaaagcgagccatttactccaatgagaaggacatgtgtgcacaaaacaacgaagaaaagtttccaagcactagttcacacgttcagtttgcccgtcagtttgcggatgataagaggaactcatccttaattgggtgccagccaatttaaagagggaagtccataatgtgctagtaaaaatccgatccctgtctgaaatgagagactgaggaagaccatgtaacttatgaatgtactgcatataagcctctgcaacatcaagggcagtaaaggggtgagccaacggtacaaaatgactatatttggagaatttgtccaccaccactaatatgcagttgaaagaatctgagcgaggtaacccttcaatgaagtcaagagataccatttgccaagcatgttcgggaactggaagtggctgtaacatgccgggatatctgacatgttcagacttagcatgctgacaaatatcacacgagttgacaaattgagttactgtggagcgaagtcgaggccaagcaaacaattgtttaactctttgataagtaacatgaatgcctgaatgcccacccactgcagcagtatgaaggtttgctaaaattttctgttgcacagctgtattggtaccaatccacatacaatccttgaaatataacacaccatttttcagagaaaaattgggtacagcaccaacactgatgcatagggtctgaaccttgctacaagcatcaggatcaagcgagtaaccagacaccacctcctgaatccaatcaggcaaagcaacagacaaggcagacaattctaaagtggcagaagaaggatacctagacagagcatctgctgcaccattatcagtgcccttcttataaatgattttgtactgcaatcccagtagtttagtgagagccttgtgttgccagggagtggtcagacgctgatcatccagaaaagatagacttcgatggttagtccgaatgaaaaattcagcatgttggagataagggcgccaatgttcaacagccagcataatggccaagctctccttttcatatgttgacaagccctgatggcgaggcccaagagacttactgagaaaagcaactggatgcttttgttgcataagaacagcaccaatgcctttatcggaagcatccgtctcgacaataaatggttcagaaaaatttggcatggccaagacgggagcagtaatcaaagcttgttttaatgcttgaaaggctgcctctgtttcagatgtccaaatgcacaactgacccttttgcagcagattagtaagtggtttacttaagatgccatagtgacgaacaaatgtgcaataataccctgttaattccaagaaaagcaacaaatttgccaattctggaccactcaaatcttgtcgtcatcagtcgacacaccattgggagtgatgatatgccccaagtaggaaagccgttgttcagcaaaagaacacttactctgttttaccttgagctgatgcttgaccagaatttggagcacttgtcgcaggtggttcacatgatcttccaaagttgcactgtaaatgagtatgtcatcgacaagtaccagcacacatctgcgaagtaaaggagataagatgctgttcatcacaccctgaaaggtggcaggtgcattggtcaagccgaaaggtatcacacgaaactcatagtggctactatgtgttttgaaggctgttttatgctcatccgacatcttcatacgaatctgatggtagcccgccctgagatcaagtttagtgaaccactgtgcccccgacaactcatccaacagctcatctataattggcaatgggtgcttattcttcgcagtgatatcatttagatggcggtagtccacacaaaaccgccatgtcccatattttttcttaaccaatagcacaggagaagaaaatgggctggaactaggttgaattatacccttgtccaacatttcctgaacttgctgttcaatctcgttcttttgagccggtgtataccgataagggcgcacattaacaggcactgcaccagggacaagagggattgtatgatcaaaagatcgagctggaggtaaacccattggttcatcaaagacagaaacaaattcttgaagaacgtgttgaatcttgacaggaatttgttctgaagatcctctgtcctccaaagaacataactgaacaaaatgagcaactgctctcttgtcactgaactcttttagttgttgagtggatatcatttgacactgttgcaattctggcacaattccttgaagagtgacagattttccctgccagcagataaccaaggacttttgtacccaatccactgacattgggctgcactgcattaaccaatccattccaagaattgcatcataattagttaaggccataatcttaaaggtggtgtaaaacacatgcccttgagtcgtccaaacacaatcaggtaactcagctgtacaagacaaaacagctccattggccacctttacctgtgctatagtaggaattaactgcactcctgacagctgatctgctaccttggaactgagaaaactagctgtgctgcctaaatccaccagtatcagcacctccttaccttggatataacccaaaatcctcattgaacccacatgttctgccccttgtattgcgtgaactggtacaaccattactacttgttcttcagacgtaatcaattcagcagattcagaaaaagaactctctccaattgcatccaaaacagagaataattcctgaactgcgtgtaactggacagagttagcacatctatgagttgtagaccatttttcagcacaaatgtaacataacccctgagctcgcctttgtgcctttagagcaatcatcttgtcagaaccccaaattggttgaccaccatcaattccctttttttgtcatcaacctttccaactgcagatagaactcctttgcctggtggtagaggtagtggcaaagccccttttaatgctgaattagagcgaatgtgcattcctcctttagagtccttcactccagactccggtggagcttccagcacttcctcttgcaaagacgcaatagccagagtagattccaaatcgcggggatgttgtaacaatactgcatttctaatctctcggcgcaatccttcagtaaagcgatgcaccagatactttttgctaatgacaggatcataggccagcaattggttcatcaactcgtcaaatttctcatagtattcccaaactgttcccgactgtcgaattgtatccatttgtataattaacatgtcatgctgatccctatcaaacttagtggaaactgctatgcaaaaatcatcccaaacaggaaaccgcacatgagccctagacgaacgcaaccaggatgctgctctaccatagaaatagatggtggctacatgaacccacaaccctggaaaagtattgttcacatcaaaatagtgctcacacctcatcctccaatcctgggggtccgtgccatagaatttagggaaatctagtttaggaactctatgattatactgtctaccgccttgttcaaaaccaaactccccaacctccgaatcagatttgaaattctccaacgagtgcaaaggaactgaatgagattcaaacgtagccttgtctagagttgggatcagagtggtcaccactccagatgccctcctccggaaattctgttgagcgccgtggccatgggcccaattgcttccgccttccgccgcgacttgatgcgaagatgtcggcggcgtaggcagcaacggcgccttcctttcctcatccgtcaacggaacccgaggggaaagcgtcgtcggcgaagcttgcatcgatttgccaaggaaatccagttgctgacgaagttcgccaacctcgtcgcacaaatcctgaatcgctgactccacttgaggctgccacccaccgactcctgcatccagcttcgcgacgactgcctgagtctccgcttgcttgttgttcaacgacatcagcgaatcctagatgtcgccgagaattttgctgaagtcgaggttctgtttctccatggcctcaacctgcaattgcaaacgagacgtgtaccttggcttctccaggatcgctgctatgataccaaatgtcacgaactcggatttgagtcgcaacgaactctcctatgattcgaaacagaagggaaaagaagctgacttgaggaagaagaagaacagagacaacgagaaccagaggagaaggagggagattggaattgagtttgaggtttcagtttgaatacaatatttcgtatcccgctctttcgcacctgccgactatatagcaatgcgccatctagtctctctcactgacagtggcctagcctttcgctactgggtccactcactcaacggaaagcgtgcgttgggccgcttcatccttttgggtcgatcttgctgctgggccgctgttgacgtcttagtttgaacgccctgctcagatgccgtcgtgacaacttgatgcacgtagccaaatccaaggcacatgataatcaaacacaataatctattcttattatttcttggtttgtgtcaaaaatagtgtttgcccttttcaatgactacaatcaaacaactagaagtattcgatgtcgtgttgagtttagtttccataccaaatattaatgacgataaaaatcacatcatcatccactagcaattattatttagagtagtttacatcacatgcaagtatgtcatgttgggtttagtctcacatcgataattgatgatgagggagcacaacttaaaaggtaggggacggtcctcacctatcagactagtcttttgggttgtgtagacccatgacctaaagttgtggctccgattgggcctgtggtggagcaggcccaatgtgacctgggtggcccacaattggggggccaggctacgcactctaataagtggtatcagagcccaacgtttgaaacccagaacaatttttatgggacacttggtgaggaggccggtaacaagtcttcggggtccacatgtcacatggtggggtcacatgggttgatggggagattgttgggtttagtcccacatcggtaattgatgatgggggagcacgacttaaaagttggtgggcggggctgcgcactctaacatgtcacatcatcacacacaagcaattattgtctaaagtattttaaatatcatgtaaatatgacatatcatttacaattttgttgtatttttagaactcattatgcaagcaatgtttaatcattatctcgacaccattttcacattattcaaacatatacatctatcatttatataataacatttatttaaccacgtatcccgcggtaaagtgcgggtatcaactagttaattataagcaacatgtatgtcttccaataacgaaataatatccggaaataaaagacaaacgaagcataaatttaaaaactatgctctaaaactaaaattataaaatttctctgtatccaaatccaaaatatatatttatacttgcagcctatgtttattgcacggattgatgggatgatgactagtgatatgaaatcaggggcgaagccaggatagatggtcaccgaggtcactattaattaacgatcctaacaattggctatagcttctaataattttaagtctattgttgtagtagtggttaccttttacatatcagagggtgtttagatccagaggtgtaaagttttggcgtgtcacatcggatattatataagatgtcacatggggtgatcaggctctaataaaaaaaactaattacataatctatcagtaaacagcgagatggatttattaagcctaattaatccgtcattagaaaaagtttactgcagcacagcattatcaaatcatggagcaattaggcttaaaagattcgtcttgcaaattagtcgcaatatgtgcaattagttatttttagcctatatttaatacttcatgcatgtgttaaacgtgcgatgtgacatggtgtaaaaattttacgtggaaactaaacaaggcctcaattacaaccatatcattattgtactaggttactatatttgggaaaagaatataacaacctcttatatggtgaaaattacctttgttatatttccccaggctcatgcttcatgatcatgtaattgaacttgaaaaatcaaacgttcatatttcagaactctaatttcgtcaaattcaaacttgagagaccaggttcaaccaaattgtgatgataattaggaaataataataggattagttggttatcctaaataagggccactttatgagcgccagtctaaaacatatatgtatatctatctagactgacgtataatcacaattgctaactaattttctatttgctagttgataatagtatcgttccttgccaccaaatgagctttaacgaaacaatcaccggggtctagtgttttatttgaccggggtcatagctataaaataggaaggagtataaggggactcataagaaatcatcggggtctcctaaccccaataaattgctatagcttcgccctaatgaaatatccatcatccatcgtgcatcgtcgattttaattcctttagtgggcctaatccgacccatccacatggagaggaggttattttagtttggaaaaggtacaccaaaggtccctcaacttgtcatcgagttacgaaatcgtcccccaaccgcaaaaccagataccggacacctttcaactaacaaaaccatgcactttatatcctccagttgttttgaccctggttttgtcctatgtggtggctgagtcagcgtgggacccacgtgggccccacatgtcagtattggcaagtcagcctttctctctcttttcctctcttctctcccatcctcatctctctctctctccattctctgcgactgcgaggccggcaatgcgaggtgggagaggagggcgtcggcggccggcagccagcgatcggcgacgggtggcgcgcgggcggccgggggaggcgcggtgtgcgggcggccgggagaggggcggcgcgcgggctcccccgccggctgccgcccacgaggcccgcgaggcggtggcgggggaatgagttgcgggcgggcggcagagaatgggtggcacccggccgatgggagaggaggaggtcggcgctgtacctgctcatctgggaccaccgcgtggtctctactcggaagcagaacacgcggccgatgtcatagccgccgtttaggatggcggcgtcgcagatgtcacactcctcgtcgctgctgctgacgtcggcgtcttcatgtccgccatcgccgcctccaccacccggggcagctacctcgttgcatccatgtccgccgccgccgccttgtttgggtacgaattagacgccgttgccaacatggagctcgaggacgttggtgattgcttgggcaacgttgccggcggggatcgagggagtggtgaactggcggtcgtggagatacagcggtaggcggtgccagaggtggatccagcgcggggagaagaggtagccgaggcggaagaggtcgaggacgcgggcgacggcggcgtccgggagccgccgccagtcggcgtgccggttggagggaggcgtgagcaagcggcgcggagtggactcggtgacctccgcttgcgaggacttgaagccggacatgatgaaggcagatgcgcggcggcggccggggacctcctcgtgagcggtggccggcggggcagcccgcgcatcgctcctcttcccgctgcccgcgcgctgcccctctcccgccgcccgccacagctcctccccccaccacccgcgcgccgctcctccctgggccgcccgcgcttcggtgtactttttccttttagttttaaattccagcccatgacatggatgtgccggaagtgaggcacatccaatggagacctcattgggccatccattcctcataggttgtcacccacttagcatttaggctcttcatccggtcaaggaataagttcactctgggtccctctatttgtcgtccagtgcagatccccaacttaagaaaccgtttaaataagttccctcgatagtattgtgtctggttttggctgaggtggcacctacatggctcattttggcggagcggcgacagccgcgtccagctcgtcggcatcggtcgtgctgctgctggtggtggtggtgatggcatcgtcgtcgctcgtggcggacggctcggatgtggcggtcatggcgtcctcggcgacaatgtcgatggcgagtggaaacacagacgacgacgactcccgctgctcgaagtcctccagagcccgcgccacggagcgctggacgtcggcggcgctgtggagggtggccgggggcggcacgggcgaggggcgaagcggcgaagttgaggcacgcggcgcggccacggagcgcgagcatggcggcgtcgtgtgcgcgcgcggtggtgtcggcgccgtcgaacgtgccgagccagagcccagagcctgcagccgcggcgcccctcaaaatcaaattcatcagttcttgtaatcttgttctcctagaccctgacaaatgaaaactcgcagtggttcatctgaccaaaaaagaaacaaacagtgtattggtccttggtcgaattcagattcggatggattcacgagtcgaataatcaaatcaaacgcatgactagagtagactcgatctagcaacaaaaacccagtggttcatctgaccacaacagaagcaaaacagctgaccagatgattcggatggattcagtctggctaactctaacctgacgtttcctccgcgagcgtggtaagatgaaggactccccccccctcccatggcgctgctcctcaatcctacacgccgccatggcaatacttgcagttgagcccgaacttgcaccatcccttggtggcgagctccgggcatgcatggacgtccccccgccgccgactctcatctccggcacaattcgttggtcctcctcgccatgagcgtagcgacacgctaccccgttgtggcacctcccctccctccacttcatgcacagcacactcttgtggttggcaacacccatggcgccggcgaccgcgggcgcgggtgcgggcagcagcggtgggaagttgacggcgtaggagctcggcctctctgccgccgccgagtccatcgcgctaggcaagtcccgcgcgtcgttcaacctgaatacatgcgggcggctgccgcggcttccgccgggttatccggaggcggaggcaggcgcagcgggcaacgagaagaggggcggcggccgccatcggtaggcccatgggggtgggaatggaggacgtccttatctccgccggcgagaggagggattagaggggagagatgaagagaggggagatggggagggagagaggaggaagaagaggaggggattgagaatgacaggtgggccccaccattttttgaaattattgtatgtgtgaagctgacatgtgggtcccagaggttttgttatttttcacggtcgaattgccacgtaagcaccacgtcagataaaaacaccgtccaaaccgctatgggacctatgtcactggttttgacagccgagggacctgttgtatctggtttttcagttgaaggacgaaaatcggattcgttgacaagtcaagggacctcagatgaacttatttctccggccaatgagcgaaggctgtgtttcacaccaaaattggaaagtttggttgaaattagaacaatgtgacggaaaagttgaaaatttatgtgtgtaggaaagttttgatgtgatggaaaagttggaagtttgaagaattattttttaactaaacacggccgaaatgtttcggtcgctgtatagttaatttcatgcgggcttttaatctactgggttcatctcatgctgctgctctgttagatgatagggaaaagtacgtacgaggtccttcatcttgtcatcaaactataaaatcgtctctcaaccagaaaatcaatatatgagatccttaacttacaaaaccggtttagtttaggtccttaggtggtacgtaaaatctaaaccaagaggcttctcgctttagtcgtatcacgcgacacgcctcacagctgttcgatcgtgcttgtcgtcctgacgtacatccgcgtggccgcgctctaatggctcaatgagaaggatcaacgtagtgcctgcctgccttttttttaatagatcatgtatgcctttttcctcttcattcaaataaagttttctctcaaattatttatctgatctataatccgattacaattatgtttattacaattaaatctgtcgacgttcgatgtctcgactacggtatttgcatggcatggggatcatcagtgctaggatatacacgagactgaggtaaaagagatggagacaaggacttttatacaggttcaggcccctgaattgtcaggtaataaccctacatcctgttggccaaagccggtattgctcttattcaccataatcacactagtacaatatttggggtagcatatctaactgttgtcgacatggcggtctgaagatctgactcgtagtcgataacatggtagtcttcctcctcgaatccgtgcccggcgagatcagagatagcgctttcgtctctcctgacagtatccggagacaccgtagggtactagccgtgtttatccctgaagtcgatatccggcggcgtgtcttggcgtatgtaggcttctatgttgtggcttctatgtcgattgtgttgggtgttgatcctctgtgtgtgttgatcgtggtggtcgtctttccttattcggaactcctcctatatcctatatccgaaggttgcttccgtataggacatggtatgtagtgggtcctgccgagatttagtcgactactattaggtatatggtatccataaccctgacagtatcccccgacttcaatgcaaataaacgagttcatattctcaaccgcagaccttggaggaactgttatcgagcgcacgtgaccgttctcgataagttcagagataacgttagacttcctttatcagcctcgtgcggacacctaaagggtttgtctgagtcaatctccgacgtcaaacaagaaagtacaaagcatacgactaagtctcccgtcttagtctcccgtcttgctgtaatcgagaatttggattgaagtcaagaaattttatctcggcgggtacaccatttgttcattccgtattccttgtcgagatcgatcaaccgttctcgagtgatcgagaaagtgcataatctgcgacggagccttgtcaatatttgtcgtattcgccttagtcgatcttggtgtagaaccatagagacatgcgatcttcgataatgtcgaatagaattttcctaaaatcaatactcagaaaagaatattagatacaaatagcccctgagcgaatgctcaaagggtgacatgttataatatgtatggaaaactgaaaatgaattaaacttacagaccaatgttttgtatatgagcgtctactcttttaccgactccgatcagtcagtttgttgagttatacactctccctagcccccagccttgtcgtcggagaatcgttctcggaggataagactcttggacctttgacctgcctcggttgaacaagcactgattctagcccccagccgtgaaattggaaaacccaatttccgattacacggcttggttaatacgcacggcgagaactcttacacgaccagatcttacatggtctttcgtctctgaaggatccgacaaggccttatcggctctgggcgtccccagccgaagttcccttaggttcctcagaggccttattaatacggcgtaaagggacattaggataggtttcaacgctaggtgtcttttgtggtaagggatctctgggtaaaacacttggcgattttgtgtatctgatgtcaactttgttggagtagaggtaatggaagaatcgctacacctctggtcgaggactaggtggtagtcgcaagtcgaccactagaagtagaaatagtgggagaatcgctacaccgctggtcgagaaccagatgtagtataaactcgaccactagaggtaaaggtagtgggagaatcgctacaccgcagatcgagaaccaagtgtagtttaaactcgaccactagaagtcagggtagtgggagaatcgctacaccgctagtcgagaaccagatgtagtctaaactcgaccactagaagtaaatgtacgagagatcgctacgattgactggttgagaactagtgagtaggtgtctctcgatcatttggagtcgtggtacgaggaccgctacgctgccggtcgaagactagtcgtaactgttcctcaaccatctgaagtcatggtgcgaggaccgctgcgttattgttgtagtcgtccctcgaccatctgaagttaaggtgtgagagattgctacattttactagttcgagaactagcgagtgagtagaattatctctcgaacaccaatggaagttgcggtgcgagagattgctacgtactggttcgaggaccagcgagcgagtagaattatctctcgaacaccaatggaggttgcggtgcgagagattgctacgcactggttcgaggaccggcgaacgtgtagagttatctctcgaacaccaatggaggttgcggtgcgagagattgctacgcactggttcgaggaccagcgaacgtgtagagttatctctcgaacaccaatggaagttgcggtgtgagagattgctacgtactggttcgaggaccagcgagcgagtagaattatctctcgaacaccaatggaagttgcggtgcgagaaattgctacgtactggttcgaggaccagcgagcgagtagaattatctctcgaacaccaatggaagtttcggtgcgagagattactacgtactggttcgagaaccagcgagtgagtagaattatctctcgaacaccaatggaagttgcggtgcgagagattgctacgtactggttcgagaactagcgaacgtgtagagttatctctcggacaccaatggaggttgcggtgcgagagattgctacgtactggttcgggaaccagcgagcgagtagaattatctctcgacaccaatggaagttgcggtgcgagagattgctacgtactggttcgggaaccagcgagcgagtagaattatctctcgaacaccaatggaggcgctagagttggtttattacatgtgtatctcatgtggccagcatgactcacatacccaacttgtagcatatccggatgtccgttcgcaatcatgtcgggtgatcaagccgacggcattcgcgaggaattatccattaacaaccttttctcgagtagtccagccatggccggtgctatgagataggttgtcggtcttcgttggtaggttgggcgcgacgactctgcatttgtcgagattattctcgataatacagtgtactcgaccacaacctactcgagtgctcaattgttcctgaaaaatattttctagaaggcaaaatatatagcagataatatcgagtatgtactcaaaaaactgcatggatcttctagtattatcaggatataactagcagatgtaaatatcaggtattatgtaaaccgtaaacaagcatgatttatacagaagaaaacagagggagcccctagtgttagactgtagtcggcctaacatcagaaacactcgcgcaatagatgttgtataaaaaacatgctctaggtaaacataataaatcatagatctgacaatgctgtatgatctgaataggtacgataaattgcatataaaatattgcgtacctttgtaaatacatgccggatgtatctacgaaattagtagatcaatttaagaaaccaatctaccaattaccttgttgcgtacttgttcgatatcatgcgatctgacatcttttggtatgtcgcggagcttgaggcttggatgatctcgatagaccaagttgtcgatgacgatgatggttccgatctagtcagaagatatacttggataggttggatctccccacagccgaagtcgccgagtagcttgtacttggagagtccatatctcaaacccatctcatcgaaaccttgaagcaccaaaatccccctacctggcgcgccaactgtcgacattcgatatctcgactacggtatttgcatggcatggggatcgtcggtgctaggatatacgcgagactgaggtaaaagagatggagacaaggatttttatacaggttcgggcccctgaattgtcaggtaataaccctacatcctgttggccgaagccagtattgctcttattcaccataatcacaccagtacaatatttggggtagcctatctaactgttgtcgacatggcggtctgaagatctgactcgtagtcaacaacagggtagtcttcctccttgaatccgtgcctagcgagatcaaagatagcgcttccgtctctcctgacagtatccggagacaccgtagggtactagccgtgcttatccctgaagtcgatatccggcggcgtgtcttggcgtatgtaggcttctatgttgtggcttctatgtcgattgtgttgggtgttgatcctttgtgtgtgttgatcgtggtggtcgtctttccttatccggaactcctcctatatccgaaggttgcttccgtataggacatgatatgtagtgggtcctgccgagatttagtcaactactgttaggtatgtggtatccataaccctgacaaaatcttcacaacaagatcttacatattatattacgatgaaaaaatatttatatttgtaaattacttttattatatacgtaagttacttttatcatatatatatataagttacttttagatttgactaaattacttcttagacatataaaaataaattcaataaagtctaaaagtaatttacatatattataaaagtaacttaaaacaacacaaaagtaattttatcacgatattagaagtaaattcattgtagggataaaaatatgattttatctagaaattaaatttaatcagtacatatcaacacaagtaagtttaacattttttaaaagtaacttcaatgttaattggaagtaacttttgcatggttgagaagtaactctctgtaaatccgtttaatcaccgattgtttttttcctttcgttttcgcttttcatatagaatgagaaaagaagataaaacctttcatggattgtaaataacattgatggaataacttttaggtttattgaattacttttttatgtccaagaagtaatttagtgaaatttaaatgtaatttagatatattatccaagtaatttatatttttttcatcaaaatataatcatgtgagattttgttataaagatttaattgttacgaacacaacagtgtaatcggatcatagattggatgagtagtttaagagaaaattttatttgaagtataggtagatactatctttaatagatggagtggtagctggtttagacaaaccagctaccactagctgtgtagccacatccttggtggtattgaccccggttttatctgacgtggtggccgagttaacgtgggcccacgtgtgtcccacatatcaggatgaccacgtcatcactctctctctctctctttccctttttctttcctttcttcccctctcccactcttctcgtctggggaagttggccagtgagtggacaggaggctggcggggcgagtgtaacatcccggcctagagcttaataggattaatagaatactcgtaccaacaagttgcaacttcttttccggaagccgatcttgtcacgtcctgataaattcattccaaaataaaattcattttctaaaaggaataatagaattaattaaaattcgaaaaagaaattggcaaacactaaaaatacgtacaagaaaaattcaaatgtggcccggagaatttttgttaaattctccttggtctaaaaggagccctcaaattttacttgaattttcagagcaccggaaataattattaagcaacaaaaacaattatcaaagtttaataaaaagaaaaaacctaaaaataattctcctcttcctcctttgggccaagcccagcccgaagtccttctctcctccctctctttctctccctccccttctctccctctctctctcccgggcctctcttcccctcccgggcagcccactccctcctctcctcctccttctgggccgcccctccctcctctccttcccggcccaccttttctccctcctctcctcctgggccgcctcggcttcgcccggcccaagccgagccgcgctcccacccgtgccgcgcgcgtgcgcgcgctgaccgcgcgccccgcgtggggcccacgcgccaggccgccgtcgccttcctcctccagccgcccggccacctctctctctctcccgtgaaaaccctactcctttcctccctcaaatccgtgtgattcgctcatgggattccaaaattaaataggggaaattaatccccattgaatcctcttcaattgcccccaaattcccccttgattcgtgccttcaatccccgggaacggacgcgccaagtccggccgccttccattgccgccggccgtggttcccgccgccgttcccgctcctcccgtggccggctccctccccgcgcctataaaatgcaaccccctcgctccgttctaccattttagcctcctcccaagcccccccccgtggcctcaccacctctccccgccttctccttctctccctccggcgccggccttcctccagccgcccctgccgccgcgtcaccacgccggccggtcgcgccgtcgcctcctccagcaccgcagccgcctcctcttcgccggcctaccctccgtttcccgcggagacctccggaagtgcctccccgccggcaaccgtggtgttgccgccacgatttcgcctccggccgcctctgccgcgtccccggtgcgccggccgacgtcgccaccacctctcccggcaccggagtgccgtcctctctcccggccaggccacggtgtcgcccgaatttcgccggaacgccgtcatctccgcgccggcctctccttcctcctcgtcggctcgtcgccccgctgcaccaccaccttcaccaacatcgcagcggcgtgttccacgccgtcccctcctccgctcagccgctgctgcctgccatcatcgtttcatcgtcgtctccgatcgttctcgtcgtcgacgtcccgtcggtcgcccggctcgtcgtctcgcggcgccgcctccgtcatcgtcatcgctgcggcgtgttccacgccgtcctcgtccccgtgcagccgctgccggctgtcctcgtcgcctcctcgccggtcccggtcgtcgtcgttgccgtcgtcctctcgtcgttcccggtcgtcgtgacgttcgtccctccgtcgagccgttctcgttcgtcgtccgcgttcgtcaagcgagctgctgcagccctgtcctcttcttcgtcctcgcctccgcgtcgtcaagccccgtgccggccgcgtctcgccttcgttcaaggatcgccgccgaagtcgttccctcgccgtccgtctccgccgcgcccgttcgtcgttgtcgttcccacgcctcgtcgcgtggtggtaaggtttcctcctctcgttgccccgtcctcgtcctttcggtgtcgcccgtgcccgttgtgcggttgtcgaccccggtacccgtgtaccggtgtcggtagtcgttcgcttgtgtgtgtggtgaccctgttagtgtgcccactcggaagccgcgtggtttcacgtgtgcagtccgcgtggtgtctagtggagtccgtttgtcggccactcgcctcggttgacacacggggtccgcttccgtcgacccgtggaccgtctctgtgtactcggtctaccgcggtcctttaggttgacatgtggggtccgcatgtcaacggcgcagccttcctgtcttttccaggctagcgcttccacatgttttataattgcaaagcttaattataataatccgcaaatctccatataacagcattaaacttcggatgatcatatcttggtcatacgaactccgaatcgacccgttcaagtctcctaatgtttgttaaaacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtggttttataactttagactttgggaagtctcatatcatttggacactatggaattgttggattatggtggaattggacatacacctctcttcctctttcaaaacccctaaaacctgttttcgatggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcgtggcagagggttggtgccctgctacttggggctcagtcctgcctgcctgtcccggaggttccggccgtaggcgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttctaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtaccccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactggcgttcgggaaaaggcaattttcccggtcgcgacagatctcgaaagaaatctgaggttaagcatgcttggcctggagcaatttcttcccgagtgcatataagtgaggagaaagtgtgcagaaaagacttgtccagatataagcgggcctgtatatctgattttctggttgagggacgattttataatttgatgacaagttgagggacctcatatgtaccttttcctttgatgatattggccatgtttagattccaccctaaaatttttcaccctgtcacatcaaacgtttgaacacctgcatgaagtattaaatatttgaacacctgcatgaagtattaaatataggctaaaaaatgactaattacacatattgcaactaatttgcgagatgaatcttttaagcctaactagaaaggtagcccgcgcacatgcgcgggcaccttatgcaagtggatttttattaaaatatcctgtattatgtcctaaactaaaattaaacttattttgtgtgatttttattaaaatatcttgtattatgtcctaaactaaaattaaacttattttaaaatgcaatcaaacaaaaaagatattattcgatttcttttggggttataagatatccttctgacgagttaaaataccctaaattaaatttgtgatggaaatattagtgcatataacttggcatggggtaaaggcatacgttctaaattttctcccataaaatattgaagtaatggtcatagtatatttagctaatcatcactaaagtggattgtcttgtaatgaatacatgtttctagattgttctacgtcaaaactttacaatgtactatagcaagtttaacaaaaaaaaaagaaatggacatggtctttaattcctatatggaactgacttgatttattgctaacgccactgcaatgttgttccactgttaaaattcctaggtacaacccaaatgcttatcagtatgatgtttaaccaaccacacttttcaacctgttgtctatattgctagatgaatacctgctatgattagtgacttcatagatcatatgtgtaattcggacactatgattgtctttcttaaaagtatttatttatcgcctacaaagatcattctaaaagtatcaaggtcaatttgtataggtacatagccctcatatgcatgttaagagaaattaattaagttggcataaagtcgttagatgcctaacaggatataagtaatagatggaggtccatttgtgtttttttgcccatatggataattttaattgtcaaggagataaaaacagagagaaaagaatggtgcacgttgtacacaggtaggtagggagggagggagggaggtttgggatgtttttctaaatgactaatctaacaacctaaaataatgtgtcagatgtttatgtcgaaaccgatggttggatgttttgttttcttaagagcatatataaaatgtgtaatgaacttttaacaccgcatgccgcaaagaaggagggagggaaggagatttagggtgttctttttaaaaatatatatctaatgacctaaaataatgtgtcaatccattgaaaataatgtatccatcgatttatgtcaaatacgatggttggatgttttttccccaaaatttctaagatttttctttaatttaagaacgtcatgtagcagcttaccttttattgttctcgcccttgccttgcattctcctcgttttgcatgagatgatagaaataaggaattgcagacaagacatcttgcaagtatttataagatgtttaatggattttaacactacatgaaggtgggagggagggagggaggtttgggttgttttcttattaaaaaaaattaacaaatcgatatcgaatgctttgtttgtttttaagattttcttgtattttctttaatttaatagtaccatttagcagcttagaagcattcgtagtatgtttagagtgacaaagcgagagctactagacctaataggtggaggtctatttgtggttttcttaatgtcaaaataattgtgattttaatttgtcatgaagatagtttgttggtacctacgtgatgtggaggttccggatgtgtgctttttgtttagaataaaagatctaaacttctaaattaaaataatggatcgtcgatctaaataaaaatcgatggtcagattagagtgctacttgacaacctaggagtgcttgtaaggtgccatttggcggcttagtcgtattcgtacgatattcaatgaacttttagtatacaatagtcttttttctgaaattgctaagattttatttaatttaagtatgtcaaatagtagcttaaaggtgtttataaaatgtgtaatggtttttaacactgcatgggggtggggagggagggagggagggagagaggtttgggatttttttattaaaaaaatctaacaacctaaagccatcaatttaagaagaaattgaatgttggctgctttatattttttgaagattttctaagtagaaattgaatgtcggctgctttgtatttattaagattttctattattttctctaatttaatagcaccacgtagcgatttagaagtgttcgtaggatattttaagtgacggagggatagctgctagagctagtagttggtctatttgtaattttttttgcctataagaatagttttgattttagtttctcatgaaatagaaaaataacaaaggaaagacagaagggaagtacgtacagtacatacttacgtttgtacgttagtaccatatatgttggtttcggatgtttttttacaaaatagatcaaaccatccaaaataatgggtctaccaattcaagtaaaaatagatggttggatttctttttatttattagagtgccacttgacaacttgagagcgtttatagggtgccacttggcggtttgagagtgtttataggaagtttaatagacttttagtatataatagatagatagatagattgcttcatgatttgacaatatagtgttacagtaaacatttgctaattacagattaattatacttaataaattcgtctcttggtttaccgacgaattctgtaattagttttttttattattgtccaaacacccaaacacgtcgtaactttacacctctagatctaaatcccatagctatagtaggactagctatacatttatcacaaatttaatccgcccgcgctaactaccgaagaagccactgctgctgtcctagcaaactgccggccggggtttttgggctgctcagctggtgccggcaacccgtgctgacctggaggtgatgcgagtgtgggggaaagcttgtcgtgtcgatggagacccaacacatctatgtgatataactaattactccattcgatccagaatataagaagtattagaatttgacatagttattaaaaaaatagatagaaataagtgatggagggttgtgattaaataggtagtggaggtaggtaggaaaagtgaatggtggagggttgtgattggttaggaagagagttggtggagaagttatattttgggacaaatcctaaaagctaaaaattgttatattttgagacgaatggagtaaatcggaaaggatcaatctcattaacattctcacgttttttcaacaactagttgagtgccttgcgttgctgcaggaaaaaaatagtaaattaaaatcacaatgagaaaaatgatgttaaaaaaatcattgagcgtaaatttgttgcaacaaaaacattaaaataacatgaacaataattacataatatacactaaaaccaagcctacaaaactaatcaaacactggcacatgcatgtatgtatattggatttctgctgacacgtgaatttatcgagcaagtataataattttaaccataaaatcaaccagtttgatctcaatcagcaatctacccgcccacgtacaacttgcttttgttttattacttggacatcctcttaatgctacgacattatttgataattgcaaatatgacatccacattactgaaaaatgccttccatgaaacatgatacacatagacctaacattgcaatcgtgcacatacatcaagcggttttagctatatgcatcatacgatgcagatgatcacgttaaaaattaaaaattttatcggccatgatatatacaaaccaaatttatatcaaattcaaaagttactttaaaactgatgagcatagtagatatctccaggcaacgcaatgtcaatcaatagaacggcgacggtgacgatcagttctcatggtatttgctcaggggaaggacttgattgtcatgattgccgtctttaaagggcacaccctgaaaatggatgacaaacaaagtcgtttggtggtcttgttaggtaaaaaaaaaacacaattctatatatctgccatcagttttaaaggaagaaacaaatgatgcttgtatataggggtagttaggattactgaaccataggttggacacttgaaaatattccagtggagttcagggcgttaatagcaacaccatgaaccttcaaatatggagtataaggtaacaatatataccataccatagcaaggagccaatgtaacaggaaagaccaacattgaagtactgttgaaaaagacactaattccatccaaattccgttttagtacctccacagatacactgtggctgtaataaaataaagcattctcttttgtattgactccgccaatcagaaaatgttaatcagaattgtcaccaggtgataatctcaaaaccaagtagacaaatcgaatcaaacttttgcacatcatcatcgtaaatggggtaaatctttttttagttgaaactggccactcctggagaaatgatctttgttgggccactaaaaaatcacattagtcccggtttgagtaaaaacatatttagtcccgatttgaaaatacagtacttcaaccggaactaaatattattcttactcccgattcaaaaacaggtttgacggagcgtggggctcctcaccgggagaccgcgcaggcccccctttgccgattcggccgggggcgctaagtgaggttcttcgccctcgatctgaggaacgtcagcgagagaggaagtgcacaagacacgggcgacgtagacaggttcgagccgctgagaagcgtaacaccctactcctgtgttctggtggatctgtgcgtgaaggaataccgagagccggagagcgagagagagttcaggctctagaacccctctttctctttttttcccctctttttcccccttctaggcctggtcctcctttttatctggtcaggggtcaccacatgggcctctagctgcctaagaaaggaaacatgctttttacaatgagggctagtctacagccggaagtgacctctgacaagcagagcacacgcctccagccccgctcgccagctttcccggtggacgcccatttcaaccttcattcaatggccagcgacttccttgccatgcttgcgctgaagcctggaatggatctgaccgggactgacataccaactccaggagttagcatgccggctccggctagggacgagagccaggaagctctcatcattccgacgggacggggcgaggcgtgtgacaggccgcctgttgccacctaacccgcgatctgaccggtctgtgaccggtcacacgccgcgaccggtcacggaccggataagcgtgcgctgcgccgcattaaatgcggcgtggcgcgctcgtccaacccgctataaatgcggttaggtgagccccgctgtgctcacctaacccacacacgtggcgccaaaaccacagggggtcggggcgccccnacccttggggccgaaacgggggcggcccgacccctcggggagacagaggaggggtggccacgtcaccctcgggcccgaccccccccagggggtcaggccacgtgggtgaccgcggctacccaagcctctagtcacgatacccccgaccccatgtcaccgacaaggttagagccctattatttttagcggttgtttataccaaccagcaccaaacttttaaaaaatacaaaaatccctttccgagccgtcctcaccgcctcgtcgatccttatcccctcatcatctcctcctctcattttctccacctcctccctctccccatctcctccccctcacccctcccttctctgacaacgagaggcctcaccctctctctctatttatatatgaggtaggctgtgcaaagccaacgaatctaacacaacttagctaggactcctaactatgtaggaaaccctctcttgcaagtaaacaacttatctctttccttatctctatcaaacttcccgaattcggactcccttacaaattcgactcctctttccatacgtacacaattcctcttgtatatcatatggatttcttcatcaccacatgcattgtcctctagccttaagtatcccgcatgatctcttgatccttggacatcaacttctcccaagttgactccgatctttcaccggcaacactctcccgaggcctcaagcaacacctacacatgcaacaaccaagagaccatattccgagcccaagttcgtcccaacttgactcacattagtataacaatagtatccatacgcatagaaaccatctagaagccaaatccaacaaatcaacccgaaaccgacatcgatcaggatcatgccggtcagaccgtcgggccggccggtctgaccgccgcaacacccgcggtctaaccggcgacactcagccggtctgaccgccagggtcaaccaaaacagctcacttcacaaaatcaaccatcttataaaatctctaaattaacattagcaaaccagcaatattttcatcacaaaatctaaatcaactccttgattctacaatctccctcttgatgaaaatcattggcaaacaacaaatggtttgtggtgttttgtgaagcaaatccaaaatgcatcttcaatgccaaaaaaaaattttcaaagaaaaatctctcacttttgaaaagaaagaaattccttctacttatgacaattatgcacaatttgttaccttgttctcccccttttgacaatgagttcatcaacattttttttccggagagctttgctataccaaaagtaattcaagaacatgtgttgcaataacaaggtagatggcatgacaatctagttaacaagcatgcatagaagtgtaaacatgaacctaagatattgtcaaaaagatcaaatcaacactaaagattcatgacttcaaacgatttataataaaatatattaacaagcacatagactgaaaaataaacactatacatatagacctattgcatgtattactctttctcaaattagctttagcacaaaaacaatcaagagaattttttcactttgatttgagcctttttctcttttttttttcaattattccgggcacgtcctcgtcgtcaagactgtttccaaggattcggcacccattacttttgctcacatcgaatacatacttgttgtcaagactgtttgcaaggattcggtattcatttttttcatagatatttttttattatttgtttattctcttgcacaatgagcatttacaaagctatttgaggaataacaattcaataaagcatatatataaagcatttataaattaaaccatatgctagcatcaatattgcatatttgcttaattcaagtcataaattatatgtcatgtatcaaatcacttaaagacaatatcaaaagctcatataaaaactaacatgcactcaagctagtctagtcatcacatcacctaacatgtattgctagcatataccggaatatactaaggcacaaacaaagctcttcttctttttcatttttttatatttttttcaacttctttttcttttttttatcacaccatacatgaataaaacatgtatgcaaaaaggaaaaaaaaataagaaaagaaaacatgaatgcaacaaagagccaaaactcccctcaattgatgccaaaaggatgaacaattcccaactcgcctcgaagaaaagcaaattgaggagaatccaacggttttgtgaaaatacctgccaattgcaattgagtatcaacaaaagccaattcaacatctcccttctcaacatgatccctcaaaaagtgatagcgaataccagtgtgcttcgtgcgtgagtgttgtacaggattcttagcaatattaatagcactagtgttgtcacaaagaagaggaacttcctcaaaagtaagaccataatctctcaaagttgaaataagccaaagaatctgagaacaacaactagcagcagtaacatattcagcctcagcagttgattaagcaacattagactgtttcctagaagaccaagcaatcaaagaaataccaagaaaatgacatgttccactagtacttttcctatcaattctacacccaccaaaatccgcatccgaataaccactcaagcatatagaagacgatgtagaacaccaaattccaaattctagagtatgttgcaaatacctcatgatgcgtttaacatcttgacgatgtgaagcacgtggagaagcttgaaaacgagcatagaaacacacaacaaattgaatgtctagtctcgaagcagtgagatagagtaaagatccaatcatgctcctatactccttttgatccacaacttcaccatcttcatccggatccaacacagcagttgatcccatcggtgtagaaattggcttgcaatccgccatcttgaagcgccttaaaagatccttggtgtacttcgtttgatgcacaaacgtaccttgcttcatttgcttgatttgaagtcccaaaaagtaagtcaactctcccatcatactcatttcgaattccctgcgcatagtctcagcaaactacacaaccaaacggtgagatgaacaaccaaagatgatatcttccacataaatctgaacaaaaagttgatcaccaccatgcttaagaacaaagagagttttatccacttttcccattgtaaaacctttagcaagcaaaaagtttttcaatctatcataccatgccctcggagcttgttttagaccatacaaagcttttgacaaacgaaaaacatggttgggaaaatcaggattttcaaaaccgggtggttgttttatataaacttcctcctttatataaccattataaccattaagaaaagcacttttcacatccatttgaaacaatttaaaaccttttgaagcagcaagagccaacaaaaatttaattgcctcaattctagcaacaggagcaaaagtttcatcataatccaacccctccatttgagtaaaaccctgagcaacaagcctagccttatttctcacaatcaaaccatcctcattttgtttgtttttgaaaacccatttagttccattaatattatgaccaacaagaggttcaactaaaaaccaaactttgtttctttcaaaattctctagttcttcatgcatggcattgatccatgattcatcagttaaggcatgagtaacatctttgggttcaaaagtagcaacaaatgcagaatttacatgagtatcacgagttgttaccttagaccttgtggtccattctctaatgttacctattatgtgttctggaggatgtcgtcgttgaatatgaagtggagcagaaacatctaatgaaatttcgtgttctgcatcatgatttgacgaagtagaaacttctggaggtcctctattattagcacccgacgaacccgaagatgagcccccaggccggtttgactgctcctctgcctgcggtctgatcggcggtgggtcgacggtctgaccggccatgacccgttagtcgtcttcctcatcgtcgctttcctccatgaaaatatcctccccttgaacctgtgataatgtacctgaaatatcgggtcttgtaccttcactagcctcatcaaaagtgacttcgcaagtctcaacaactttgttagtgtctaaaacaagtacacggtaacctcgagaatgtgcagagtaaccaagcataagcccatcagtagaacgtgactcaaattttccaaatttcccgatttcaacacaaagcacttacacccaaaaacacgcaaatgttaaatcttaggtgtatgaccaaatcgaagctcataagatgtttttccaagttttgatctcaagaaaacacgattggaaatataacatgcagtgttaacagcttcagcccaaaatcttctaggtgtatggtactcatcaagcatagtcctagccatttcaaccaaagaacgattctttatttcgacaacaccattttgttgaggaacacgtggagatgaaaattgatgttcaagacctttttctttgcaaaaactttcaaaaaaaagcatttttgaactcactaccattatcacttcgaatagttcttaaagatccagaaaattcaagagccaaacgaagatacaaacttttaaagtgttcaaaagcctcatctttagtagccataaagtaaacccaagaatatagagaaaaatcgtcaacaataaccaacatataccactttcctccgacggattgctctctagctggaccaacagtgtccatatgtagaagctgtcccggtgcatccgtcatcacagaaataataggagtatgtgaagaagcaaccatcttagcatgacgacatggcgaacaaaccagatcacgatctttcttaagtttaggcaaaccacgaacaaaatcagaaccactaagtctagtaagatgatcaaaacctacatgtccaagtctacgatgccaaaacatcacatctttagaaaattttgcaacaagacatgtaatctctgaagaaacacttctttcaaaatcagccttaaaaactcttccatatcgagaaacattaagcacaacatcgccagaagaattaaagacttacttccagttttcttgaacaacacatcaaaatcctcat

SEQ ID NO: 64222 - DNA, 961 bp, Oryza sativa
tagtgtatgtaagactttttaatgggctcaaagtttgggccaatgctacggaaaaggaatgaccgtaagagcaagtttaatagtatagccaactactagatccaattcatctatagccaatctaatagctcattcatacaatagttacatactacactattaatatctggtcccacctgtcatacacacactgcgtcttagagtccgtgctatagctggctacaaatctgtagtccgctgccattctctctctttatttatcttcttaaaatatatttacagctggtttatagcctgctactgtacttgctctaatttggcccaagataggtccaaaatggctcgatcgcttattcggcagcccaggaagcagcgagcgtgcaaagtggtgatgcaactgtgtttctttgttgtgagagttaactgtaggctgaattaaactattcgctgtggagttaaaaagtagccttcctcttattgtctgcgtttgtattgtgcttttttgaaaaaaaaaatctgcattagaaggtaacagatatcatatatcatatataatataagtagataaagattgaagatgtttccgtggtccgttatctgttagagtcgatttaatgtatatatacctactagaatattttttttagtcgccgctttcctctcacattttttttcaaacagttttttaatggtccgtccagtttttttttgccattttcttcctccccttttttttctcgcatgcagtaagggcttctagttttcggtttttctttcctcaccgtgtttttccttcgctaggccgaaccctacctctatcaccacgtcgaatttgtctatccatgtgtttcctcctccaatggattacaaaaatcgattccccactcatcgctcatcatttttcctatgattttctccttcaattcggcttggcctgatttaatcaccatttaactgtcgc

SEQ ID NO: 64223 - DNA, 1281 bp, Oryza sativa
tgttcaaaattttcaaatataccatgtttgttcatcgctacaattttttccaaacttgcttacagccacagttatcaggtaatgctattaaggcaaggatttgatgaaattaacaataagatagatgtgggcatcaaaagaagggcctccaaatggatgttggcaccttctttaatcaactgtgtatcaaacccgtctggattcatagacttgagtatgactacgtcatcatgatgcctgccgagtaggattgaggacatcagaccacattatgggtactcaacaggccaatactaacataaccagtcatctgttcagccttatcatctgcagatattggaattggtgcccctgcatcaggaagttacagttagatgcatgcccaaacatgatctaacagctgtaacaatggctgaagaaaactgaatggataactacattatattcatccttcgatgcaaacagaaactatttcattggtctccagtcactaattcagtaacagttgcagtggacatggttgacataataaaatcttgatagtgttaagcaagacaaaaaggacaccacattattcagtactcatgagccactaagttttaggctagattaagaatgatgtagtaacatgtatagcacatccaagcgactttacatttcctacaaggggggatttactgaaagatagtgttgctaagctaacaaagaatatatatctttttccattagattttcttatggagtggctcactgatgttcagattccaaagccctaaaaaattagataaaacctagcactaattccagattctacgcatgaagtatctaaagtggatagaccgaaatagcaaaatgccacatcatttggaattattccattgtgaaaatgatagatccacaatcccacaaggctgaaaaaagcctttgcaatcacacgttctaaaagaagtagaagattcaagtacatgaaagatagcatacaagtagaactaataattcagtgcaaaaggttgtctagcagaaaattacacatgtaaattaacaaaaaaaaaactcccttttactcataattgtctaactttggcaggcccttactaatataactgtggtggcctcaggttccgttgtgccaactttaggtggcaatccaaacatgcccttactctatcaaatcaaataaatgagcatgtacaccaagtatgtataccaagcacgaagggagatattatctttgagatcacaggcaagagaacgctccctttgagattgaagccttttatt

SEQ ID NO: 64224 - DNA, 1597 bp, Oryza sativa
ggctcatgccccagcacgtgcagcctcgccaggaagatcgccgacgccgccaccacggacggcaggtagcggtggaacccgtacgtcagcagcgacccgtcggtgaaccgatgcgccgcctccttcaacagctcctcttcttttccgtcgccgtagtaccttgtgaagtgctgcacgaacgtggacgccgtcgggccgctgaggttgtagtcgagcgcggcgaggatctcggtctccatgcacgacaccatcttgtgcctggtctcgctagtgtagccgcagcgagcggcgaccatgctggcgtcgatcttcctcagggtgtactggtcctcgtacttggccgccaggaacacggtcgttgctgcgacgaggcggagctgtagcggtccaggaagtaggcggcgcgctggagcgtgccgtcggcgagctcgtgcaaccggctgaactcgtccatgaaggcgatcatcgaggcgcgcaccagtgcggtcatccgcccaccttgtgtcgtctccaagaagtacggggagggccgctccacggggttcgtctccatggcacggagggtggcctcgatgtcgtcgtcgtagggcgcgcacagctgcggacgtgtcgtcgtcgctgagttgctggtgaccaccggctgatcggcgcgctcttgcagcagcgatgcgacctcgatcgtcttcttgggtgacaccgggtgatcgctgccttctggcagcggcaagggctcctggaggacggcgccagagagcggggaagatcaccgtagacagggaggaggctgccgtaggtgtgaggggtacggggcgagtccggtggcgccggtgcgagcggagctgccggtggcggtgcaagcggaggcagtgcgccgatggcgcggaggaaggtgtcggtatccaccatctgcggagtggcgccgccggagtaaggatggaacactgggagagctgtttgatcagcaagaagttcggcgaggcagggatgatccatgatcgcgtcctccatgtagggatccaagatcaaatcccccatggtcgccggagcccggaagcgagatcgagggagagcgagaggagtcaagaggcggtggcgggaagaaacttggacggtcgcgtggtggtggccgaggaaggatggtgccgcactctcgccttttatcctcgtgccacgatccgactctgatcaggctgcgcacgcgtgaaggaatccatcaaattcaaagttcgcgcggttttccgaatcaggatcgaactaatgatgtttgattagagaggactaagcgcgtgcgtttctttcctttgtttgcatctccgactcgatctctgtcatgatgaaattcaccgatcatacgatactattatacatacactgacacacacacgcgaaaaaaaaagagcacatcatcacgctaaagaagtccaagcactcaaattcttaaaatccactagaatggtagattaagcatggaagatgacataccatactattatggattcatgcacattgctagagaagttaccttacagtgagcatatgctaacactctatcaaaatcttcaggatttctaagcagctgagcagaacaaaaacatgg

SEQ ID NO: 64225 - DNA, 608 bp, Oryza sativa
acttattaaacaccacagaaacagagacgttaacgagagtagaactactctagcagagtagggaaaattgagggggaaaaaaaatcaaggagctgagatagagaggcaatacatgcgatgatcgagcacctggcaaaccttggtcagcgtgtggtagtacgcgatggcgccacttctcatcaccgcgtcggcggcgctcgtctcgctgctactcctcctgctcccttggaaaccaatgcacattctcagtcagtcaccgccggccgatcgacggatcgagtagctttagcttgctctcacctgtaaattgaaacacgatcgatcgttttagctattcattgcactaatggcgcgcgtcaaatgtctaacaagagctgcatgcagccatgggtgatgggaagaaaagagcgctactcacacgatgacgcggaagaagacgaccaaccggacgaggaagcgcacccacggcatggcctgtgtctcgattatcagtggagattgagatggacgggaagagttggctgtgcggggtgagaagcccaagcgagaggagctaaggtttggtttgttgcaacggcgaattggcgaggaggcaggcacagggttta

SEQ ID NO: 64226 - DNA, 10021 bp, Oryza sativa
ccgctatagttcggggggggggggtaattcgtactttttccttttcttaattattttttatagagggttctcctttggttatccaacatgtttttctatcgtaacagaggataagggagtattttctccatcccataaaaacaaaattagtatgacacgtgatgcatgctagtactataactctggacatgtgcatgtaaatgtttatatttaaagcataccccaaatttcagatattgtacattatatttgtgcttggattccaatttttcttgatcaatgtgtggatctctagttctttggagcgaatatgatcgcttctttttccacaaatttattaagttaataatagatatatgggaaaaaaaggcatgctctcgtatatttgtttttgaagaaaaggcaaaagctttgccttatgtatattaatagagcaggagaaaaataaacataagcaagtgtatatacagggttagtcgaggaaaaagactagcccgcaaaaaaggaatcgagctaagtgatatctcctaggattccaaactcctgcagagttgttgccccttctttgacccatgctctcagatattgacacgttgatttgctctataacgttccggtttcttcagaaaacatgcttgggtgcagtactgaattcgacttcagaaaatgaatagcggttctattccacacttgtgacttcagaaaatctgaaaatgaatacaagaagtttggccaaaatatagatatcattgcacgttcagttgtactgtgccacacgatgaattgctccttgcaatttgggaagcacgttcctagctccttgaccagttgacgacggaccacactcccgtctctgtacgtacgtacgtacgttcctctttggtctgctgttccctaggaacgcggtgggtgacaccgtcggtgcgaccgtgcgggtgcgacactgcgacggaacaaggaacattagtcaatatatattgaagtataggcttcagcaatcatagttatgcatagcagaataaaatttaaaaatatattgttcattaatctttctttcagaaatatactggatgtggtttgattagcataaatataccatcaaaatcgcagttagaaagcgtgataccgaggttcgctacgggaaagcacgatatcaccacggtatcgcattaccaatacgcgagagcgtgacggtcttgcgcgtcaaatgggcgaggagatttgagctagcggtgtcgcttcttggttatacgatatcgacgcggtatcgcgtttccactgagcgagagcgccacgtcgtaccgatttgggagtaacagctggagtggtgccatcggtctcgcttattggcagcgcgagaatgggatcgctaccaggtttagacgcgcgagagcgcgggcccgcggtctcgcacggccgaatcgcaagagcacactcggtatcgctctttcaaagcacgatagcggctgtggagtgggtcccactgggttttttttagttgggagatcgggcagccgcggtttcgcacagtgggagcgcaatatcgctcggagggggggtgttctcgcgcgttggtttcgcgagaccgaagctgacatgacactgacaccctcccggccgtcaagcatgcactcacgcattatcaatacgcattatcacactagcaaaataatggaacaagtcaatagtaaactgcatccgaaaaagtttttcaattaagcagtgtacgaagattgtcgtgaaataagctgcacaccccttaattactaattgctcacgcgtgattaatttattttttatacgaagtttcctatgtaattaacttaggctgtgtttagttgagggagaagtttggattttggttgaaattgaagatgatgtgactgaaaaattgtgtgtatgacaggttgatgtgatggaaaaggactgaagtttggatccaaaatttggatctaaacacagcattaaccttaacaccattaggcgcgcagtgaggctcacctaaccgctctcgcgttcctctagcgcgagaccgcgccgtcgcagtcagggggcccaccgctctcgtgttcctgtagcgtgagaccgcgtgggtcgcggtcgcaacagttgtggggcccactggctcgctctcgcacttttagagtgcgacaccgtgcgctctcgctattcggcaaagcgatatcgttgcaccgcctaggccaccgcgtgcgctccgtcctcgctgactgaacgagcggtaccggcagtatatttttgcaaatcttcacgcgttcggtattttcttgcaaattctacagaaatacgtatatttctaaaaaaatttcatgcatagcaaagctaatgaactgtcatgcttttggttgggtcttgcaaccatgcaattataccgccgtttagacagaaaatgactaataaaacgttaataacggaatttatgtcctcgtaaacaactaatgtagacaacatagctctgcttctgtgtgtctggaggttgaaggaggaggaattttttttatttataattttttttattaaaagttttacaaaaaataattttccattttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcaagggggggcatggaattttgcaggcggcccccttgccgccctccgctagggcgattttgtactgtgggggggccgcctgcaaatgggcggcgagggggcatggaattttgcaggcggcccccttgccgccctggggaagggcgatttttgcctctcccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttctcggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagaaggaagattcggataatgaggaagcggacgacgatgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcatgaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgtcgacaccgatggatctcggtatggcataatgacaaccaatttggcagaggtatacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatatatcgcaagcaagccgtgcaggaatgtgtcttgaaggcggatggtggatgtacctgcagttgtatgaagccgaagcttcatcaccttccttgctcatacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggccaggcaagtgatggtaggcgaccacctggtgaaggaacaacaagcagcgcgcaaggccaaggcgtcgtcgcgcagcaggcgattccatggtgtaacaatgctttcgatttaggaaataaaatactgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgggggattgacaggaaccaccgctcgttcctgtcagcagtcgagggtgcacagctcggcaccttccgtccacgcacgtcgcgcgagtggttgcgtgtcgacctccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggatgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttctggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcaaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccaatacaaccacggcctcgcgcgcctaccgtcggagcaggacctcgacctacggcacctgtttcgcacggtactgctcagcccagaggtttcttaagttttgtttctgtttttctacgaaaacatcaccccgtcgtaacttgatgttccatcctcgcaggacctcgtttgccttcgagcgcccctagcttcggagcagtgcgacctacaacaccggtttcgcacggtacagttcagcccacatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgtccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggaactccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcttgttgacataaagtgaatcacgcccacgcgtgatcgtcttgtcacatctaatgaataatgtatctcattgagttcacatatattgcagtgaaaacgacgctatataattgacaatctgaacgcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcccccagggcggcaagggggccgactgaaaaattccatgccc

SEQ ID NO: 64227 - DNA, 1583 bp, Oryza sativa
  unsure (1)..(1583): unsure at all n locations
gggcggagctatgtgtatcaagggggcgttaaaagtgaccagagaacccatccacttcggcaattacctgccacactaactcacatgtttcgagttgggcaaggctctcactatcatgcaagaagcccagaacttgaactattcatccacaatgacacgtaaatgagtaaccatgttaatgacatcatcattcttcttcacacaagagcttggtgtctacccacagaaatagtcatgccaagaagaggctgcagggataaatacttgcaacaagcgttcgcaaatttgcgaggaaacatacgaatacgagtaactagaggaatataataaggatttatgtacaataatacgctttgttgcatagtacctaatttatcaagactcgcggacacttcacacggttttatcctgaaaaaagacgatacctgcaagatagaagccacggccaccagttgggagttgagttatcaggcatggcttgatgttcattccattggaaatgataacgctacaatctgacgagaaagagcgtacctttcaaattctagcttctgggtgacaataccattaagcacaagctctgattcaaacacctcaaaacctgcaacggtgcaacatcaaccagcggtttacgacaaatggagtaagccccagaactttattaggtacagggagcgtagcacacaccgttcttaatgaatggcacgcatattttgtagtcttgttcacaagagattacaaaagctcccattaaacttctattcttcatcttggacattgcgtttctctccaacacctggcaaaccaacaaatgtaatcgttgtgcaagcaatttaagaaatggaaattatgtatccaagtatgggatcctaacatattggcatgtaatgaagtagtgttcttaacagagaaaatgcaattaaaaacgaaccacaaatcatttgataactttcatcacacctnttagctatatcttgaaccaaatccagtaatattggcaacaacaaaattgaattaaacacatgtcactagaaatctccattgtaaaaaacacaggtcactagaaaatgttccagattgatggtaatccacgttgatcctactcgtatttgttgttgcatcacaaacacaatgcctccagatttttgtgcactttacataacaatgtgaagaattgaagtcctttatgtgcattaacttctaagcagctggaaagttcatactgttgcagaaacaagtaccatctaaaatctggagatagttgagatgacaacacagaataaatgaatgcaacaaagggtagattaccaaagacaaggaaagtgctccaaaagaaaattcagattgatttgaacagaggtatataacaagcgtataccttgccatgagcagtcactactaaacttttcaaagctccttgctaggtttagcatttggtgtgattagcactctactccctggaaattcaataaatttttaggtaacataaacatttcatattttggcatactgaagttaaagtatctcttggcatcaagataatataattgccaaaaattgctagtatttgttctcattttgat

SEQ ID NO: 64228 - DNA, 56626 bp, Oryza sativa
agctttgccgtgacatgtctcatgtgttgggacgaggctcatgtgttgggcagtcgcggagtgcgggtaaagtgtacatccactgcagtgtgagtaaaccaaatctattcgaatagccttgctcgcagttattgagcaccgggacgtgtgttacacttggctagactctaaattcttaacttgtgtgggatgggatattgcatgatgatttttatgctgttggagccacttcctaagaggagggaaggtggacgtcctcagaaaaccatgacgactcaatggcgggaagctatccttgggatcacaatggatggtggacagaaccgtcgttgtttaatgtgaacactggtattaaaatttgatcagtctatgctaggttttaggcttgtgaaaagatttgcaaaacttgctttgcgcaaaagaacctggagccattccttgaaataccctctatcatatgcatcgttgctgtggtggcttgctgagtaaggttggtactcaccctttctatttaaatatcttttaggagagtgatgaagagaagcccttgtcggtacgcttgcgtatccaagaagatgatcggagtgcggtcttgttctaggtctcgttccccagtcggctacctgtagcatgtcaaccgggcccttatattattttgtcttccggtgctattctctgatagttgttggcctacctggccctaatgtaagtatttaactattttagcctgaattcattcgtgatatgttgtgattcaactatgtatgtgtgtaccaactaatgatccagggattggtacggataaacatagatgatttccgatttccaaaattgggggtctacatagcatatccggatgtctgttcataatcatgtcaggtgatcaaaccgacaatgttcgcgaggaattatctgttaacaaccttttctcaaatagcccagccgtaaccggtgctatacatgagataagtttttgttcttcataggtatgttgggtgtgacaactcacattttttcgagaacgttctcgataatggggtgtactcgaccacacctactcgtgtgctcaattgttcctgaaaaatattgtctagaaggcaagatatatagtagagaatatcgagtatgtactaaaaaaaactgcatgaatcttctaatattattaggatataacgatcagattaaatatcaggtattatgtaaaccgtaaacaagcatgatttatatataagaaaatagagcgagctcccagtattagaccgtagtcggcctaacaccagaaacattcgcacaatagatattgtatagaaaacatgctctaggtaaacataataaattttggatccgacaatgttgtatagatctggaaaataggtacgataaattgcatataaaatattacgtacctttatagatacatgccggatgtatctacgaaatcagtaaattaatttaaaaaatcaatccactatttacctcgattagccgtgctaatcaccttgtgtagatgtagccaacatgtcttgatcagtgcacatttcatctcgaatgttgtttgttgtgactatgcagaataccgtggggacacgctagcttgctcgatttgattggtgatgtgcttggcttggacttaaccagccgatgccctgcaccgttcggatccgtcatcaagatgcaggaaaccgaagtctctcaaaaccgacattgctgagtcattattccccgcgatgacgtcttgaagcttaagcgatctcgatagatcgaatttgttgacgatgatggttccgatctcgtcgggggggggggacacttcggttgggtcagatatccctacagttgaagttgtcgagtagtttgttgttggagaatccatctcttaaacccatctcgtcgaaaccttgaagcaccaaaatccccctaccgggtgcaccactgtcggtgtttgagatcacaactagggtatttggattgtatggggatcattggtaccagggtatatgtgagattgaggtaaaagagatagagacaatgatttttatacaggttcgggccccttatctgataggtaatagccctactcctgttggtcaaagccggtgtcactcttattcatcacaatcactccaatacaataattgggatagcctatctagctgtcgtcgacttggcggcatggataactaactcgtagtcgacgacaggttagtcttcctcctcgagtccgaactcatcgagatcagagatggcgctagatccctgttgtcggcctccgtaggcaccggatggggtatgtctaggcttacctttgtcatcgttatatggcggcgtgtgttggcttgtgtgtatgttgtgtatgttatatttacacccatagatgcctccttgtccaagtagaactagggagaccaatatggatacgatccgagtagtccttgtcgttttcatatataactctatccgtccttccttatccggaactccttctatatacgaggtatgattccgtataagatttggtacatggtggaccctgccgagcttagtcaactactattaggtatgttgtatccataaccctgtgtagcgcccgttccgtcgtggcgcctagcgggaaaatttaaattctaaaaactctaattgcgaaaattgtttctttgcttgttgtcagtctccgtgccaattccaaatctcaaatccccaatccatcgtcaaattcaaatccctaatctcaatccttctcgaaaagtctattttgcctccctcaggttcggtgggccgattccctctcggcccatctctctctctgtctctctctctcccctccctcgctctgcccgtgcgccgcacgcgtgtgcgcgtgagccgcgccgagcgcctctccctccctctccgctctcgctgccgttcccgccgacgccgcccaaatagccgcgctgcccattgcttcccgcgcgcgcgcactgtggtggccgatcggccagtcgccaccaccgtcagccctctaccgcgcctgagcccgcgcctgccgcccgtgtcgccgctccgttccaaaccgcccccgccgtcatcgccgtcgtcacgagtcggccccgccactccgcgcgctagcttccaagggatggaggcagagctcctcctccctctgccgcgtagccctctctccctcctccttttcctaaagaggcaagaggaaagcccccctttctctcctcctttttcccttttctctcccgccggcgtcacacccccccgccccgtcgccgttttggccgcgaccgacatcgcctcctatttaaccaaggcgccctcccatcgattcctcctcccgtttcgctcgccaccaccgcgccattgccgcccctctgtctcgcctccgccgttcatcgccaagcaccgggagagccggagcgtgcgaaggacgcgtgaaggggacttcgggcgcatcgtcttcctccgcttccctggcccgaggccggagagatcactcccgtgccgtcggcccatcgtcactgcgccccgtcccgcacggtagtgcatctccccgttcttcctcctcgttccccctcctccccttagctttcggtagaagcttgtgtagcctccccatagctagctggcgccgccccaagccttgccgccgcccactgtgtgctcgccgccgtcgccgcccgagctcggtagcgcctctcgtcgccggcctccctcggtgcgtttccctcctaatccggcgcaaggaatggattcccggagtcgcgtagatgctctagctcgcccgaattgatctcccgtcacgctgtcgccgtttccctcttctctcaccgccggatgccgccgccgcaatccgccgccgtcgaactccctccggcgaatccaagccgttggctcgtctcccctcgtctcgtgcaaccacccggtgtgctcgctttcgcctgtatcgccgtggttcgccccgccgttcgcagccgacatcgtcgtttacctcccgctggaccgcgtggcagccacgtaggcgccacgtcggcactagctcggccaagaccgggtcgagccgaccccagtcagctgctccctctggccccgctcacgcgcgcggtccaccgcgagccgtgaggctgcgcgtgggcccgccgcatccgcgtcctccgcgaaccgcgcgcgtgcaccgcgtctctctccccgaaccctagcgcgcgccgcgtgctccctccgcacggtgagccgagccaccgacaagcgggtcccactcgggaccacgcgagaaggatccggcctaccggctccctctctcctcccctctcgcgcgtgccttgggctgccttctcgggccggccggcccattaagctcagccaagccgcgcccttttctctcgggccgcgccctagccgcccgagggaagtctatttctcctccctttatcttttcctttttcaaaagggtttaattaaatccttttcctctagatcaaaaatccaataatcttagaaattcaatatctcctcaaccgtatgtccgtttgactccgttcaacttccaaaattcctcagatctcgagatctatctaatggcacgcttagaggtcaataatagggctttattttcgccgtttgttgagttgtcccgtttcgcgtgtagtttcggagcccgaagacccgcagtgcgaggatttcgaggatcaagctcaagatctcgagcaaggcaagtcacctttgatcatcttgcacctataatttaaatctaagtatttctttttcgcaaatattgcataaataggattatcacgagtaattcggccgcggcttgcgagatagcctgccggcccccaatcctaaattgctgcaaataccctccgtgaattattgaacacttaaacctcctttgtcaactgttgtgcttcgatgcacgggccttcgggcacgcgcatcggaacacctctcctcaaatttaaaatatccaatgatgggtaaaacttggggttttacaaaagacttggaaaaactcgacacctaggtcggcgcttgcgaactaaatgaatttccaaaatcgcagaccggtgaacgtaccgggagtacggtttcccgctcttgcacttaaggaccgtttccttggaatttcatccgaacataaggcaagtgcgaccacatgggtggaatgggacgcccctggctgagtaattagctaatcaagggagccatgatgccaagagacatgtggattcaacggggtggtgccggggagaacccccgggtttcctggcatagtatggtccgggacctaacctggtgttggtttgggacccctctcgttggcatatggtgaacctgtgtcggctttcgaaatgccttgttatgaaagcctcaaggtctccagacgtggccgttctgcacgggctggatgatccgggttagtaatgtcgtgtgggtaaagtataccccctctgcagaggttattaaactgttcaaacagccgtgcccacggtcataggcggatgtgaggtgattactagcgtagttttgtttgactactgcttttgtgaaattgctgttgtggaatgggttcgatgtttggaaaatttgcggctgatgggatcagccaggcccgggtggctgtttgaaagctgttgcccgggtgccaaccttgatcaattcaaaaggctgatacattgcacatactccgaccgggcgagacacactgtctcatccgtgtcgtttgagaagcactcacttagttgtttcaaaaaggagtttaaataaaatcaattgtaaaaaaacaacagcctttcccttgaagcctgcattaaacacttaattcccatggcttgctgagtactcctgtactcacccttgctctatataaataatctccccccagttgctgaagaagaggagttcttccaggagcaagtcggctacgatgagttttagggtttcggcctagttcccaagtcgcgcctgtgatgattggtccaagtcttggcttccgctttccccttttgtaatgcagttgtgagctcgggatctgtccgcagcccaacatgactgtactcctactctgtaataaagagacctctgttgctgtgatattctgtcttcctgtgataccagcactgtttcctgggactaatatcgataaacaggttaatttggagcgtcacgggctagttccgttcggggctagttcggggcatgacaccctggcaatgcgtagatacacagggccgagaataccgatttcttcaacaaggtgacatagaagatgcgtcattatattgaagaaggatggtgaaaagatcatctcaaagctgataagacattgcaccacgtcatttggtagggttgttaatatgtctaaattgatgaacttctgcgaaattgcattcaggaaagcagacaactttgttattgttgtatgtacattatcaggaagcaattatgtcagcaacacatggcagtctcttgtgagactttaggtttgtgaacgtcttctcattcacccttgttattccctttatattcgatgagtatccagacggtaccctgatgcaatccaagcattcagatatagtttccttctctgccttgctcagagtgtggctggttagatttaagtaatggcttcatttcttttttttttggatgaaggtcgtcatgttgtttcatatgtttcagatcatggcatgcttcaagtctatctttcgacttaccatatacacctaggaaccccagcaggttgacatgaaggttcttagtgaggttcatcacgtcgattgcgtggtgtacctctaaaactttccatcatggtaactcccaaaatgagactctttcttccacatcatcgcaagatcatcttcacttgctatggagtggctaccaggtccctttccaaatactatttttagatctttcactgtagcaatcacaatttttccattacgatgtttaggcctagtacggtggtctgtggtctgccttctgtttaaaatgtttgcctttctttcgtacaggatagcttacaacaagaaatcgatgatggcccatgtacacaactctcctacaatgtttcaaatgcatgctgtcagtttcacccataccacaactgtagcagcaacgtaaaagttgcagttttgtgataatttcccatgctatcgttgtagcaagctgaaacatgtcgctaatgttatagcaaactaatagtttgatcaatttaagttgtagttttctaaaatttactcataataatattaaaatagcctacacctgttgcaacgcacgggcatttttttctagttttatctacaaatttattctctgtaccctttttccataacctatttgtaagagaatggcgtatagaaacatagctagaaatgtaatatgttaaccatacatcaatagaggatgtagtttccccttaaacaaattgtttttgattggctacaacttttgtaatctctttgttttcaacttgtaacttatactctacataaattcctgaaatatatactgttgggcaaatgtggggtagtttccccttttaaaaaaaaatagaggataaagttactaaccttttggatcttttcaatttgtctaatatcaccaaaatactgtagcaagaagtttgccatgacatctcttcctcctcttcttggcagcaatggctagacgaggaacatatataggaaatgatctttagtactaggggcctaacatggtctgataatattgaatcgggactaaagattgtacagtatcgttggtttaccggtactaaagattatctttactaccggttagtattagatcagagaaatttgaggttttggtaacacaatgaaaaatcagttctccagtagtggtgatgcacagcttgcgcccgattctgtagaggggatctaggcatcgtctactgtgaagaacggcagcacgtagggaggacaaagtgaggatggggaacagctcttccgcgtgatcgattgggctcaggcagcacaacggcgagccacctctgaatcttgttagtcaactttgctatcaacatacaaataggggtcagaattcttttcttttaatgtgatcagtactcttaggaatcaggaagatcaccccatcattcagtcttttcagctcaagggtaccattaaaaaacactatcaaacatctcaaagggctctacagaagtgcacattgaaaccatctgggcttggtgcagtgtgtatgtatatgcatagaatcaaagcaaatggttaacatatatttgtttataaaggataatatcaaaccaaaccaactcttattatattacataatgaaagcacaacaacaacaacaacaacaacaacaacaacaacaacaacaacaacaacaacaacaacaacaacaacaacaacaacaacaataataataataataatcgtcttacacacctcatatatatagcatacacatataagaagttgcgcgacaaaccgtttacaatatgattacagtcacacaatccatcacaaatagattcagaaggactcctatgtaggagtaggagtaggagtatatatatatatccaccgtatatatgtcttgtactttgactggagcccacaatgcttgtacgcaacacagagaagccgtccattcatggttacttatgggtttcttctgcgcccgccgtcacgaccacctggcattgttcaaacaaaagatttcaaataatgtatcagtataactgatagttatatatacttcagtgaattgttttgtatatacatcaagtacatgcgatttattttgttctgtgttataattttgacagttttatattcttaaaactgccaagattttgtctttttttttctggctgaaatatattgaatttagatatggtacttcgaagctaggtctaatactatcgatattacatgtccatttttttaaaaaatttctgatgacatttgttagtttatgtatggatattgattgtgcaccggaagcttatatgcatatgatacgttgtccaccataataattatagaaggtatactattataaattatttcgcaccgagaaaggttttccttttttagagaaaatttcacaaaactacaagtaatttgaggtgatatatcactaaactacagatttaacaataaaattatcacaaaactaccggtttaagactaagtatcacaaaactatggatttaataataaaattatcacaaagctacatgttttggggtttaaattcttagcactaatgttatgattgatttataaccatccaagttttataattaaattgatgctaaaccagtgataactttgttattaaatctgtagttttgtgatattccaccttaaatctgtagttttgtgatatatcatcttaaaatctgtagttttgtgataattggtaaatatatctgtagttttgtgaaatttactcttttttttaacatcgaaaggccttctttgatctgcaagaggggtatacgtgctctgtttcgaagtgtttctgatggggatgttacctttaacaggctttctctgattagattgtgcactacctaatgatgtgccagcatctgcaacaaggaaaaataagagagaaattagtcaggcatatatgtatacccttgctttgtgtttacacgattgaaaaacaatcttttcggaggagtctctctctctatatatatatatgtacgtgctgtgtttgtagagaaaaactgccactctttccatctgcataaatgtacatgcgtttctgaaaaatgtacaatatcgtgacgcgtgtcactgcatatatatatacatgcatgcatgtgtgatcgatcgacgtgaacacgaagaaataacaggcgtaccaacgagctagaacgtactcactcagctcgctagtctctgaatgcttgcatcgtctaataattaatttcttacctcctgtaaaagtatgcatcttgccagacggctctaatacttgtggaacaccgtggggagctgttcttgatagagttagcgatgcacccccatcgggggtatgccctgatcgacatgaagaaaaagaatataataacagcaaatgacgatgctcggatttttcatatatacagtacaatggaagaaattaaccaactggccgtaggtatgcatgcatgtgcctgcatgaggtcgatgtcaacttgttaataataagtggtactttatctgttttatacttcctctgtttcagattataaaatatttttgactttggacaaagtcaaactgttttaagtttaaccaagtttattgaaaaaaaatagaaatatattcgatctaagataaagttgttataaaaatatatttaattattaatttaataaaactaatttggtaatgtaaatattactatatttttttataaatttagttaaacttaaagaagtttgactttaaccaaagtcaaaacatcttataacctgaaacggagggagtattatataagacgtttttttttgtcaaatatctttttgtttgttcaatcagttcataataaaactaatttggtgtcgttgatatcgctatatttttctataaacttcatcgtatatttttaaagtttaattaaaacaaaagtcaagacgtgttataatatgaaacagagggaatagttatatattttatgatgaaattagttagttcatgttccatcagtcgttgtaacttattaggtactccctccgtttcagtcgttgtaacttgttaggtactccctccctccgtttcaggttataagacgtttaacttttatcaaagttaaactgtttcaagttttactaagtttataaacaaatatagtaatatttataatactaaattagtttcatcaaataaataattgaatattttcataataaatttgtcatggtttgaaaatgttgttttgtataaacttagtcaaacttaaaacagtttgactttgaccaaagtcaaaatgtcttataacctaaaacggaggtagtatttaattttatttaaaatgaagaaattatatactccctccgtcccaaaatataatcattttttgattctgacacggcctccgagatgctactttgaccaacaatatctgtaaaagtaagatgtcttaaataaaggagtaacatatattaggatagtttggataatgataaatctagtaacatcaattttatatgattgatctttttttatttttttactattaatagtcaaagttgaaaatgtttgacttgtcactatgctaaaaatgcttatattttgggatgaagggagtattcaatttcaagcacgaagcaggttttgaaatttccaaaccccccccccccaaccggtaagatcatatctcacccaaaattttccattttatgcaattttttgtgatttttgtcaaattttattcaaattcattcgaaatcagttaaaatttcaaataatttcggccaaattttttttgaaatttccaaaatttcgcccccccccggggggggggcagaaatagcaatttcgaaatttaaaaccttggcacgaagtacccacttggatcggcgtcctcggccgggacgaacgtccagagggagagggcattggccaagcgcttctcctgcaggtggacggtcctcttggtcgagacgccagtgaagatgtggttggagtagctcccactcttgatgtagcatacgcccttgtgtatctcctccaacgtccagcgttctccaacatctcttccctggccaagaacaacatccagccgctgccgcccgtcgccacgactactcttgacgacgaggggcttgctgttgtttttcaggacgaagttctggttagttgtgctgccgccgccgccggtggcctcgtcgacgaccttgtaccatatcagctgcatgcagagaaagccaattataccggaattcattcattaattaattaacaagatccagagaagaacatatatgcatgcctgtcggccataggagttgctggagggttgcgttctctccggatcttccacaaggacgacgttgccggacgtgtccacggcgaggtagttcttgcctccgttatcgacgatgaagatcctgtaggtttcatgcccaatatttgctgtgcatttcgacatcgaaacaagctggatctacgtttctcgcagcaaaaaaaaaaggtccaccgagatgaagtggaggaagagaggaggacgaacaggcgaacaggagatattatggaatacggatggatgtgttagctgaatacagaatgtattatttataatatattgtacgcgcaaataccagccaatctgaatgtttatctagagatcgcgagagagtacttctcggtatagtactccctccgtgttttaatatatggcgccattaaatttcgttagaacattttgtcttattaaaaatttttgtacaaatttttaaaagtaagtattgcttaaagttctttagtgataaatcaaaccacaacatgtgaaaaatatatttatttaaaacattttagtaagacgaatagataaacatgatatataatcctgtaaatgacatcatatacatatttaaatcagaggaagacaggtagtaatatattggcaataaactacccttgtggatatagaggccagattaatgaaaatctattatctaaaaaaattggcaataaactagctatagcttgctcactaattgtaaattttcctgccgtgtactgtatggcaggtcagtcatcgcaaacgaacaaaaactaattttccggttgtctacttttcaagagatagacatttagatggctgatcacatatagagtagtgataggtccataaaaaccatggcccactgtaataatccgtatatgtaggtctgttaattatttgttcttaaaaaaactcttactaccacaattggctggctacatgtagtttactttacttactataattacttgtgtacagtgagagtagcatataaaaatatatatactagtaatgtgtgatgatatattacttgctacaattcatgctacacccgttccaaaatagatgatctcctagaatacatgttgtctcaaacccttcaataaaatgtattttagatgtcttgtaattaagcgttgtataattgaaataataaccacgaaatatgtgcattaatttggacatatatatcatcttaatgtgtttacaatgttaaggaaaaagaaaacagatgtaacattttatttttacatacaataacacacaaacacacactctctttaatagactctgcataaattgaactttcgccgaaggacgccacgtgtttgttggcaaacacggttccccgggcccggtgctgtacgagcttcgactgggaaattaattaatcttcctatgcaaacaatgttagtaattcccattggcggacagataaaaacaaatgaacacctagctacatcctggaaaaaacgacagttccgatcaactccatcacgaagaatgaattaaatctatttggcaaacttaaacttccacgcaaatcctattgcatgctgacgaacaatagcgtgtttttgttttttgttttccacattatgatcaatctttctatctattacattattaaagatatagttgaaaagagacgtcgtgttatttctattgtctagaaattctcatattagtcatagaaaaagagaaaaatcagtgtcattagataacactatccaggacaaggtcatcactgacagatacaaaccgtcttctctgacagcttcggccctcgtcacatataagtatgtggttcataatgacaaaatatcatttatgataggtgaacaatcgtcatagatgagtcatctatgatgggtgtgtaagttatgtgacatgtagtagcttccatccatcaccgatgactcatctctgacaagttgtaactcacgaactgttattgaagacaaattaataatcatgattttgaattttaaatgcacaaaaaaactaaaaaatattatttttaattttaccaaccatactatacacggtgatacatcactacccaccaacccatgattttatgagctatatagatattcacacatttgttgagtattgaacacaaagacttccctatctacgaagactacccttaccaactcacctatagagcacttgttgattactttttgaatactgttcttgtaaggaataagttcaccacaggtccctcaacttaacagcgagatattttgacatcccttaaccgcaaaaccagaaatcttcacccctaaacttaacaaaaccgtccaatttaggtcctatggcagtatagatacctggtttcgctgacgtggcatcctagttagcaaaataaaaataaaaaaatgtggggcccacatatcagccccatcaacatctctctcttcttcccaggcagctggcgggaggggggttggtagcgcacctgtgggagaggaggattggcgagagaggcagctggccacaccggcgagagaggtgggagaggaggtggcaccggctatgtggtggtggcagcggccactgtagccatggcggcgaggaggtagcgtgggggcatgacccgctgcaatgacaagcttggggcgacgatgacaagacgccgactagggacggcgaggaggaggcggcgacttggcaccggctgtcggggggacgcggtgctggtgccccggtggagccccaccccgagcggctccctcccgctatcctccatcgacaacgacgacaagaccactgccgttcgcgtctccatcaacttcatccaagtattcccctctgtctccgctgaagccgtcgaggaccaggccgcatcggtcgtccactacaaccctgtcgccggccgaatcacgaagccagtcgtcggggagcctgagatcgacagtaccggcgaaggggtgtggttcatcggggccgaggtgagctacactgcctgcgtggactccgtgctcaccaccgacggcaccgtcgagattgagggcgagcgcctccccttctctcctccaaccccctcttcacttcctcctccccttgccccgcctcgacctcaccagccgccgccgttgcccccactgccggcatactccgcccgatgcgctccgctcctcctctagccacctccgctgtcgtggcatcggggcgcatctagttccggtcgagacggcgacgctgctgatcatcaagcaacgtcctcgggactgcctcttagccgtcaggagcggagacgcagggggcaggggaagcgacggcacaaggggcaaaggaagcaacaacgggcgagcgcgtgtgcaccagtgcggtggtggcggcggagctcggccaggctcaccggcttgcctcgccccatttgccgtcggcggcagcctcctggggagaggagctgaagagaagaaaaaaagagagaagagagaagaagagaagtggtccccacattttctatctcatttcacttacatgtggacccacatatttttttatttttattttgctgactcgaatgccatgtcagtgaaaccaggcatctatactgccatgggacctaaattggacggttttgtatagtttaggggtgaagatttctggttttgcgattaagggacgccaaaaaaaatctcgctgttaagttgagggaccttcggtgaacttattccttcttgtaactattcctttccaaagcatgttgcatatacttaacactttcaatgatttcaaatcaaaatgcaatcaactaaaatgttttacatcttagtgtgttctataatttttatataatgaatatctccatccaaggtagtttgaagaattcaaaatttcgtctttcaaaatagatctcaccttataatggatattcagttatgcaaacaatctcaaataaaaatattgtcaattataatgttgtagatatggttgagaccaacgacttcgatatagggcatgtttccattcgaggtcatttgaaaattcaaaattttgttgttaaaaatagatctcagcacttgtattcatattaggggatgtagaagatctctaatgaaaatgttgtcagttatgaagttgtagatatcgtcaagatcaacaacctttatatggcatgcctccatctgagattattcaaaaaattaaaaaaattaaattctaacccatcattgatagttcataactatcacttgtaaaagataatgttatctgtgatgacgtatggtagtgatgacggaaaacacggtggcctgggagatctgcttaactccagtgcagttccaaggctagcctcgagtatgtcaagggcgtactagctgattttatcctgtaatcagcaagaaagacaacaggccgataggatagcatatcgttggcggtctcatacgatgtagttagaccaaatcggctatggactgggtagatcaaggaataaaagaccctaaacatgcctcatcggctataatactgcttgttaggtttaataaagagcttaagacttggcccacctgcacgaagtgcctttttgggtagctctcttccattttttcgacggcccaacgccatcgtccatgatgaccactttggtggggtttgcccagggaggcagttcgccgtcatgcacccggttcgcccgcccctcaatctgccatgaaagcagcaagtcatattcgcgagtggtcaagtccatgttcatcttttttgcctcggtctccgcctcccgcagcgagcgaactgataaatcaaacatacacaaaaaatagaagtatgctttacttcggcttttcagaagacaaaataaggcgaagagtgacttacgattaacgctcgcgggaagggtgaagcgcagaaggccgaggacctcctcgtccgaaataagcgtaacacccgagtctcataacaagaggtaaatccgaagcatgcagtactccacaacaaggtctcggcagctgagccaaaaggcgatcttgcgaaggaggctgaaacgtgattccattgtctcgtccacctccacgtccagcttatactcgatcgatatggcccggcagcggatgcgccacaccttcgcccagttggagcctgcttcataggggacgttgtggtaaaaccacttctccatccagtggcggaagcatggaccagccacaagtcagatatttccagacgaaggatgaagttaatgctgccgaagaccgttttcttcggcccagctggtgtcttcatcgtaggatcgtggcggtgaagatggcgttgaagagttcggcgtaaggggcgaatcctgacgttcggcacatccggtcgaacactgcaatctgtacaagggcagaagggctcaactggggaagctcgatctcatacatgcgaaggacgtctagcagaagaacctcgcaaggaaagcaaagtcatgcgtcgaagaacgcagagaaaaccagcttccgcccttcacctggatgcggaacgagagcatcaccagacacaaaagcttggccttcgacgatcgccctagacgccactagcgtggcaagatcaccctccatgaccagcgacttgcccagaaagcatgagacatcctcgcccaatcgcccggggtcggggctagtcacgacagccaaagctggtttgcgaggggccacagtctcgaggataaaaagacgcgaagtggtgaaagttcaagtagcgaagaggctcagaaaagacggagagcgagagcgttgagagatctgcaagactcggaacaattgaccgcagcgaaagtgagaatgacctcgggggagggggattatataacttcacccccgcgatgcttcaacttccagccaatgacggcaagccacatggcatccaaatagcgaggcaatggtaactctcgattcgggccaacgggccaaacagtaaaaggccacattgaacggaaaaatagcaatttctgaaagatgcagcccataacattcattttttggagaaattcaaaattcagaaaaaacttcaaatcaaaccaaaattaaactctattccaaacaagtcaagtgttgcttcttttgcaggaatgaaattatggttttggcaagaacatcggccgaaaggggtgcctcatgccataccttgtatttcacacggtctcggccgaagctcccaacttatacttgcgcgtgaggggcttgttggaggcatgacacgaggaccttcgaccaaggatgcctaaaccagatgcgttggggcgaaacaccagccgaaggccaaggcttttgccttgggcgaagcaagaaggattcgctaggagccttgatgtcttcgccacagccaaagaagctgtaaggcctaaatgggtcattcgtcacttgagggaccatagttaacccccattaaggggcccaaggcaaaataagctttagttaccctcataaatgtcaccatcataagggtacccatgtaaattccccagtacacattaactctacggtgcatgagcttgtactaaggctataaatagccccctaggggcatgttatggggggttctcaaaaaaattcctttaattaatacatattgctttactttctagtgtgtgaactgtgtgaaccacgtctttcgatgtacgcagttgtcattcgataacatatatattatatttacttgttatatatttgaacaatcgttgttacacaatgagtttcgtgtgttttcatttccaaaggtacttgcttgggtgaaggaaaagagatcgagcgtaaggaatgcatggatgatcaaaaaagttgattaaggaccaaaccaagaccttctccaagtccacttgtacctcaccacgtcacttttggtccatacaagacaatagataaagttcaatacgttttggattcggatttggacctcaggacaggatcaatttcaaacggacctagccgctgatctagaaggaatctcagggcccatgagttcttgctggaaagcttatagtgtctactttgagatggtttttgtcccacgtcaaaattcccatcgagctgtcgggaatatacaaaacaagccacatacatccagtccgaatctgatttgagtcttaggtattataattatgtcgtgggctaaacccaatgggttctacgccctagggaaaccataggacatcctaaatcatatttattcagtagtcatcatagtttggaattgggatttgcttaaattatttctgtcattgtaatttcgccgctagatcggtttgtggaaccccaaagtcaagtgcttaatcattgatatgcaattgtgttgcaatctatcttgctcttgctttgtgttcttcgattcgcatgtagggattagccttctcggcaagatcaatcgggcagtgcacggttgataaacagaggagacgtggtgctgcgtttgtagggattggatcgtctttatcagaagccagaacatatatgtcaagtttttgccaaatcgagtgttgtcaatacctatcgaaagatttagacctagtttcctaattagtatctacggtcagactgatctacatcgattcgaggataacttttaactccattaaaagttttggtgtttgggtactataaccatattcatcttctggttggcttagtttgccgtgtgtagtgtgtatgtacagtatacacaaatatgcggccagacaatcagacatgctgtgatgcagataacatctaaaaacaataaaagaaaaaggaaactagcggtattgacttgatgatttttaaatgtctctgcggtaacgaacagaccgggataagagcgagatgaatggaggagcggcagccaacgagaccttaaaacaaaaggaaccccgatggtaataagtacatgatgacaacgaagagggggccgacgacaacggatggacgaatataggggatggaccggcagggtcaacagatatagctactccttccgttaaaaaaaaaacttatgactcatccagatacataatcaaatttattattaatgggaacaataaatgaatcctatagaggatatttttttataaaaattcattacagtgcgcataattatacgaaggacaccctacatatcataatttcagaaatcgatggatcagtatgcgtaggttatttactcatctatatgccaaaccatttggtaattaattaaggctttggtcatgacatatcttattgtggcattcagcattagagcaagattaatacaccctccggttataagacgttttgactttgttcaaagttaaactaatttaagtttgactaattctgtagaaaaaagtttgactaattctgtagaaaaaactagtcagcataatttcattaaatctataattgaataagttttcataatatatttgtcttggttaaaaatattactattttttttataaaattagtcaaagttagagtagtttaactttgatcaatgtcaaaatatcttataagctaaaacggaggtagtagcataccttgctatatgcagcagggccagttattagtttgtagatgagctacaagtttgtagtgatttatatatatatatagttcacattatccttgctcaatgttaaatattggctccttaattataaatcaatctataaatcactacatatgctattttaatcatattattgttagatttttttatctaaaaaaagtttatgggaattttattttgatagtattgatatctaagttggaacttctatcgggatgatagccatatcctataagttgttttcttatggtcttgtaagaattctgaagcaattaggagtccaactctcgtcccagttaatatgcatgattcttgggaagagaatcagcaaaaaatcaccttggacaatttatttgcaaaaaatgtatgtctatttaaatcgcacataaaaaaatcaggtcaaattttcattgtaaatatagatttctttattatataagagcagctaaaccttatttgcagccactacaggagcaaccgttcatagtcattatggataaatcctttacataggatgtttttaaaataatttcttatacgactccttatatattttgaaaagtaaacgaacttaaaaatcgactcaaatactaacgaagtataaaagtatcagccaaagcatctttaattttctttaatttttataataatagacaaaacatctttaatttttttaatttttataatagtagacatatagatatatcctcgcgatagcattgtttttgaatagtccgtaacgcgttttacgccctcgaattaattataatcgcgtagactgactaggtagagcctcgtagaaattaatgatcagctgcctagcaaccagggcgaacctggtatcggctaatgcttctctatcaatgccagcgcaaaacgccatcaaatgttaaagacttcagattattacaatcaactgtggttcttacacgtttcttgttgctggacacaagcccagaaaacggcaaatgctccgtcgtaatcagataatggctgcactatgcgctgaccggtcgagagaagactagtgtagtaattcgaagttaatttaccaccagctactcctcctagctgtacagatttatcgtattagacgaaccgagggagtattttacatagagttttatattttttttactataagattgtttagtaaaaattaatttcttatgtacttatgaaagccgctataatgtaacttatacgattcaggttgcacgtacgcattcaaattatctctgttcaataattaagtagctataatttttgcaaaaattatactcccaccattccataatataaaccacaacttttttaagatgtttcataatactccctccatattttaatatatgatgccgttgactttttaacaaacgtttgacctttcgtcttattcaaaaaatttatgtaattataatttattttattgtgacttgatttatcatcaaatgttctttaagcatgaaataagtatttttatatttgcataaaaattttgaataagacgagtagtcaaatatttgttataaagtcaacggcgtcatacattaaaatagagggagtataagacatgcatgaatatataccattaactagcacttctttcccactaaattattatttttttatgtcccccatcctcaatatatatgtttaattctattgggtacacgcattatatttattagggtaatttaaactatgaggtgataacttataataattatttcttgaactttaggttgagagtggttgcgccttatatttcagaatggagggagtactgctaattactactacgcattatggtatcatgatctgatgcaaattaatcatcgacgttgttggagtccatgtcgaagttgtcttcagatacggtggaggctgcggatcgacggccaccaccatggctcctgggtccggtcgcgggcgcgcctcgaccacgcccttgcatcagccgtccggtcgcaggcgctctacggccacctccatatggtgaggaattgccgcaagcggcaatggcacctcgaccaccgggagggcaggctgcgcgtaagccaagggtctgactgacgccgcagccacgcacgagagggaggtcagcggagccgcctccttttgaggcggagcgaaggtggctcccagatccgccgacgtcacctccttgtgcatcggcccaaattaaaggtggctcccagatccgccgatgtcgcgtcctcgcgaaccggagcgaaggagaccctcgtagctttctagatccggccacccatccccactggagttgaggtcaagggcggccatgcctatcctagaagcaccgccgctgccaaatccagtgaactagtgcagggagtcggtgtaggggtcgagcccatcggcggaggcgtgtgaatcggactgtgacatgaagtccctcgtgccggagccgtcatcatatccgtcgccgtccatctccgcctcggactgttgcggcgggcaagatcggccgaggtagaggctgccgtgagcagctgcggcgggcgagatcggcaggggcagaggcaggcgtgattggcggagatggaggcgggtgtgagcggcggtggcgggggagatcggcggaggaggaggcagagctggggaggaggaggcgggcgagatggggaaattttgggtgcaagatgagagagagcgagcaagtgagggtgagagagcgaccggggcatgcagtgagcgtcccgcatgccttccaaatgacaaatgcaaagttgcccacttttgataatagtgtttagatctattttaccaaaaagtagttcaaaacagtaaaaattttaccattttggagggtctaaataagccctatatatacggctaataataaccatgcatgatatcatcgcgtgcgtggcattatacgtccgatcccacgggagtttgactgaattttttcatatactggacgtcacaccaacggtgactgctgcgattcaattttagtatatacatagcttaaatccaaaacttatgtactgtacataaatatttgcttggtcgccgattaattgatgcctagctatatatgtccaaatcaagataggattatcaaccccgcaaaaaaaaaaagataggattatcagtttgttcactagtaacgttagaccagtccgcgtgaaatatcagtttttggatttatatgatgcccctatatatcaatcttatgcataattgtacatatttagaatttcttttgctaaccgaaatgcattggatgaatgttaaatggatagtccccgtttaaaagatataaagcatattagattttgacagcgtccaacatttgaccattaatttatttcaaaataaattatcaacaactgcaaaatagtatgaagatatttctaaatacgagtctaatgataataaaggcatgatactaaacacatgtatgatactaaataataaaaatggtcgatcaagatgtagaaagcttgagtcagtttgatctagggagttgtttgagtcagttaaacccttttgtagcttgaggatgtgctgcttgaaaggaatgatgcaatgttatgggtgttggttgatatctggccaccaagccagaaagtgaagcaaacggtttggtccagcaatgcatacgcgtgctccctagcgttgaggagcgagtcatacacatttctctccttagcgctataaccagatgcgtcgtttttttcttgagaaggaattattccagatcccctcaacacacgtaaaaaggaaccttgatcttatgcacgagtgacgactcacgtacgctaagccattcccaaaaccatcagactaccgatcctaaggtgcgttaaaggggaccgaagggcaaattcccatcatcactatcgcaccgtggggttcccgtcaccactgccgcacggtgatcccatcaccggcggcctactaccactagaccgacccaacttatggttttagcaagatccggtcagtaaactataaaattccacataagaggtgatcatgcatagcctaagatcatgtttaagaattgactctaataatagcatcgggcctagagactagggcccacgggcaacccagctcaaagccaatgtatacagtaccctcagatgaattgtatttactattacaaaacaccacatagtgaccggtcttataggtgctggtttgcttaaaaccgacatctatgaagcttttttcacctttttacaatataaaagtaagaactggtacatataatcactcattggcactggtttataacaaaactgacataattaatcccccaaatcataggtgttgattctttttataaaccggtacctgtagacatcacacaggtgctggttcttataataaactggcacatacaagtgcgatgtcataggtaccggtctttatcatgaaccattacatatgggtatcacatatgagtcgtttcttaataaaaaccaacacttataagcccaaaggtgcatgcttactattgaaactgatgacgtaattcatatatgtgtgttttttatctaactttttcatataaagtcgaatgaagaacaacgctataacaattgtagagctcaatgatatctacaattgtgtagttgatgacttttttatttaagatcgtttggatgtccaaaaatgtgttaaaaggtctcggatctatttgcataagtgattttttcaaatttctaaacgatatcgggtaaagacaaaaactatatcaaagttgtagctctagatgagatctacaattttgtagttgataaacttttcatttgacctcatgacagtagtctcaaaagaatagcatttatttccaatacatgaactgtttgtacgttagatggtaaggaagctttagatggagagaaagttcttatattcaaatctttcttaatgaagcacttacaaatcgggtagggtggaaaaaaagctcgggctcgtgagctcagctcgggcttggctcgagcttggttggcttgccttggctcgtaggccaaacgagccaagcccaagcctccttttcagctcattgctgaaatgagccgagcccgagctggctcacgagccgcttgttttggctcgcgagcctagcccatcatgtgtttatatcgagtattttattttttatgaagttattatttgtaaacttgaaatttattattaagattttgaagaattgaatatataaacttatttaaattttacatgttgatgatttgttcttgcttttttaataattataaaatatatatgaagagatgtttcaacaggaaggcttgcaagccagcttgagctggctcgagccaggaaacaagccgagccgagcccaagttttagcttgtttccgtaactgagccgagccaagccaagcctagtttgttgtgagccactgcaagccgagccggctcagctcgtttccacccccttgtaaaaaacgtttcggtactgaaaattctgaagcacaatcaaaacatgtattgaaacattttaatacactgtatgaaacaatagttttgaatatattggaacataaaacacatcggagtaaaaatcgggcgttatttcaccccttgtaaagaaaaggtttcagtactgaaaaaatctgaaacacagtcaaaacacgtaataaaacacttttgatacaatgtatgaaacaattgttttaaacatattggaacatgaaacacatccgagtacgacgaaaaaaagaatgaaacactatagaaaacctcactgcaacatttcaatccaactaatgaaacatcatggtacatgggccgatacattaaaaaattagagagaaaagcctagatctactgcgagctcgcccgagtccgctaaaaccacgtggccatcgtcgtcgatgccgtgccaagctcggacgagtccgctacaaccgcgtggccgccgtcgtcgacgctgcacggagctcgccatgcagagctcggccgccgtcgtcggtgccgcacggagctcgaccgccattgttgacgtcgtgcagctcagccgcgtccgcgtgtccgctatcattgatgacgcacggagctcgtggccaccgtagttgatgccacgcggaactcagctacgtccgtgtggccgcctccgtcttctccgtcacctccgtaaccccgtcgctgcctgcgtctggactgaatctaaaggagttgatgaaagggtagagagagaagaataaaaatataaggatgcggttgtgttggcggaaatgagataaggatgcggttgtgtcagtggaaaatgaggtaggggtgcgggtgcccgatatttctgtcgatgggggataaccgtagaccggatatagagggtattggggtacattggtacgaggatctacgtaatacgacatcaagcaaacagaaggcaaggattatactggtttgagccccttgataggtaatagccctaatccagttggtatgggattatatgatggaaaccacagattacaaagggaatagcggaactcgatgataccgacgatactgtagtcgagttggtttgactagatcacccggcgacttggctcccgtaggctccggcttcgtaggctgtggtggatatgttggcagtgagattcgatgccttaggtcctgcctagggggtcccttttataccgcgggtcagttgatctccaagtaggactcggagatatcggacccttacgatatggtaaagaccaagtcttgtacgagtaggactcctcccatctgtggattctgttcctatcacgtgatagatttccttaacgtatacagtaactatccatatacacgcgggtataccgtatcagtatacaacgtacatccaagaatagagggtataccttatccgtgactctgacaatttccttcatgcatcgggcacccattgataagcattttttctttcttaaacaaatatctatgaatatgtgttgaaaaaatcatgtgacttataggaactgaagtgtgaccgtatatgtgcctaataataagaccaaatatttttcgggttttttgcaccaacaaaaataaaaaacaggtacacccttacaagtgtcgattctatattagaaccggcaccgtgccgttttttgacaaattgatcctttataaaaacttattttgaaaatagcccctgccaaaaacttcaaccaaaactaagccgtcggctcaacgccatcaaggttggcgctgaggtataacgtctcagcgccgataatgttggcgccgagatttttgttgagctggcattgagccacgtggcacggcctagaattcacttcaaattcctgtgaaaccatagacaaaattcaaattcaaattcctctcaaatatcctcaaaattcaattctacaaaccttgagaaaataagaaagttcactgttcattttgggcctctcttcctttctctcccaggcccaactctcctcctccttttctcggaataactgcactttgactccctcaaaagtgacctgaatctaattcatgaccctaaaccgcaaaaccggatatctcgacccccgaactattaaaaccggtgtaatttgactcctttggtggttttggaggatggtttcgctgacgtggcgctgacgtggctgtgttgacctagtctatgggttaacgtggcgcttaggtggcatctaaattaaaaacatataggtgggacccgtttgtcattcacacatataaaaatttgtgggggccattggcatatgggccccatatgtcatcctctctctttcttcttcctcccctcttcctccattctctctttctctctttttctccccttcggccggcgggacctgatgtggcagcggcgccgggagctgacgtgggagtggcgatccccggagtggaggagtcgacgatggtgaggcagcgctcggcgagatgggtttgacgttgtggaggaagtcgaccggtgggggttgtcgttggcgtcgtcggtggccgacgacggaggtggaggtctaaggcggcggcccatgcggtggcatccattgaagctccctcgccgagctctatcccgttgctatcgccgtccaccaccggtcgccgtcccgcactccctcactgtctcctgtgaagaagaaaaggaggagacggggaggcggagaggccggcgagccgctcttctcccgccagcaggcgcgtgccgttgcctcacctcctctcccaccagctgtcacgcgccgctctctcctcacccgccggccgatgcgcaccgctgcctcgccttctctcctggcgattggcgcgctccgcctcctctcccgccggccgccatgcgccgcttgctctttcgctggctgttgtgcaccgctgtctccttcctcgctggcgaacgacggccggtgcgtgccggcggaccgcgtggccaactcacggcgccggagctcctccgctaccgccagatctgaccgaacctcgagagctaagctcggcgttgcccagatgcggagctcggcagcagcacctccttctcgagcgacgaccgctctcccgccgctgccgtcactctagcccccgctcgccgtcgttgccgctgccgccggcggtccctacttgccgaatggggagggagagagagataagagacaagggagggagagggatagactgacatgtgggccccacaaattcttcagtgcgaatgacaaatgggtcccacatgtaggtttttaatttaaatgccacctaagcgccacatcaacccatagactaggtcaacaccgccacgtcagcgccacgtcaacgaaatcgccctccaaaaccgcaaaaggagtcaaattgcaccggtttcaatagttcgggggtcgagatatccggttttgcggtttatggtcatggattagatttgggtcacttttgagggagtcaaagtacacttattccccttttctctcctctccttcccacctaagcaggccggcccacggcctctctcccgcagcagcccagcccaaccgccactgtttgtcttcctccctgagccagccagtgcatgcacacgagccgctcgacgaaatgccgacccgggcgccgaatcgtgccgagccgtgtgctgcaccgagccgcctacccgtgcaccgcgcatcgcgccaaggccgcgccacgacaagccgcgaatcccgccgggagacacggcacggcgtcaccttgcatcatcgtcgtcctgtcgccgtcccgtcccagaacctccgcggacgcgcgtcccctcgccgtcgcctcgtcgtcttgtctccgtctcctcccgggaagccgctgagccgcgtctctccctctctctctcgcgtcgcgtcgccaccgccgcatgcgtcacccccctatagccctaccgccccaaatcccggccatagccgtcgtcggccgtgcgtcacccacgtctcgccgccgttcccgctctccgcgcgtccgtcgcttcacatcgcgtcgccaccggtgcctgacgccaagccgtcgcgtcgccgtcccttcctctccgcgaatccggccgaagcagctagccccatacccccggttctcccgcgccctagctgccagctcgccgccgcgtcccgccaagccgcgccggctataaaaggagggccgagcccctttcaccccacaccattgccatctctctctctcatctctctctttctctcgttcttctctccgtgtcgtcactcgggccgccgcgctcctcctctcggcgccaccgacgccggcagaacctcgccggatttcgcggccgccttccccggcccctggccgcggagccgcgcctcgccgccgcgacacgcctcgggccgagccgagcagaacgcgaggacgaggaagaagaccccctccagtcgctgacaagccggctccacgacccttttcctcctcagccactgacaagccgggcccgcgcctccttcttcccatccttcactgacaggtggacctccttgccgtcaacgctagcggaatattcccttcccgtccaataaataaaaatctcagaaaatccttttaacctttgaaaactcctagaaaatcaacagtaactccgattgaccccgtttaagttcttaaatttttctaaaattgagatctacacagtggcactgttgtttatctgatttaagcttgttttattgccttttcttatttagctttgttttcgcgtttagagcctgagttcgaagaagccccggacgccgctttcgaaagagaagactccaaccctgtgcaaggcaaacccctttgatcacattgcccctatatttttaatgatatgttgtttgcaaagatgcattgtttagttcacacgattaacatgtttaggcctcggattgtttatacaaccgacggaccaacctagtagttgcacttatatttcataggttgatgtttccatacctttgatagctccacaaatatttgcgccggtatcgttatacgattaccgaggtagtttcgcttagccatgcttacgttattgccgtgtgggaaacttgggttattccaaatacatgcttaaaaatctggtacagtgtaccggggagttgtgaaataaaatgtgttgtgaaagtggtgatgatgcggagtcacgcctttgtggtttggctacgtattattgttaaggaccgatttctttgggaaatccatccgaacacgttacagtgcgaccacacagatatttatgggatgcctctggttaagtaaattgttatcacatgggagttggtgtgccaatggttgtggaatgccgaggatgaggagacgaagtattacacatttattgcccatcatgggtgtctttttgcctctattgtggcgtgataccagtaagagtaggaggcatcctcggtatttcctgagtggatgacggctgtcattgcctaatactcggctatggatcttagcccaactaggtggcatgcgattttcatgtgttagctttggaaaggccttatcacgaacttccggtactggccagtaccagtgtaagtttcgtgtcgtgtgggtaaagcgtgcaacctctgtagagattaatgaactgttcgaacagtcgtgcccacggtcaagggcgagtgtaaggtgtttctcatagtgtagatttgtttgacaaaggtttgtgaaaaaagtggttactgaaaagggaacgttaccagagtccgcctgtgtagcagacggctaacctttgtggttaggaacgggtctgtgtgacctggggtgtcgtccgacaccgacgtgttgttagggccatgatggcgttgatgtgctaaggtaattgggtgaactatgtgttgttgtgatagtgaaaacgagttaatgagggaacaaattaattgttgttcgttaatcttgacaagttgttgcaaagcaacttgtggaatgggttgaggcgtgagcctcctcccgacaactaaaacttgactcactcactaggagttttgtgaaataaatcactttgccaaaaaggcagctttcgcaaataaaaccttagcctcgttgtgtaaactaaacatgtcattcttccccctggcttgctgagtacgttaagtactcacccttgccccttataataacctatagagtgtgaagacgaagatgtcgacccgaccgccgaggagtatctccaggagcaagccgagtatgaagacttctagatgtttcgtgcctagccccaagcctcgcttgtggaataagttagttgcctaggttctttgcctagtgcatagttgcttagtcgcttagttctccgcgctattcacttctgcgccgtcgcttttatggttttatgtaatgttgtgttgtttatctatgggcctgtccatgatggcaacttatgtaagtactactatccagtgatgtaataaagcagtttactttgattccacatttattctgtgtataccagctaatgtatcctgggactggtactatatcacaggtaatgcataacactccggtgtgagttagctgtgtctatggctaacgaatgtcagggcgttactgctcctctctctcccctcagcgcccctctcgataaccgatgtgatggttcccaaccatcgtgtccctgcggttgccaccgcttcacatttatatgtactcttgatcaatgagaaactatcaattcgctctattatgtcgctcaattctctctcgcttaatctgtcgattctattcactctcaacatgtgttacggatgcatcaatatatacccaggtttttgtgacatttactcttcttgttttgttcaagtgacatgcatggaagatattttaaaaggcaattaaagctacttgtacggtgtgaaggaattctcatgatcctattgaggatgtatatacagaaagctgcactaagatattactttaattacttttcctttagtactcttctttttttttattggcggagcctttcatctttttaaagaaacacactttagatagtggatatgcacatccgtcggaaattgcacctaatattattcgatggaagagtcgaagtgaaaaggacaaagatgggatcggaggaatggaacacacaatatatatgtgtgtgttaacttcgttttattttgtacaatgaacatgccacctttagcagaatgaaacaagacagaaacgttacaaggaaatgagcatcgatggagtcacaggtaagtaatgttcatgaagtaaattaaggaaatattcccttccattgccacatatatacagtgctagctctcttcattttcaatcgcttttgaggtgcctctgtcgagtgtagtctatgccaaatggcctaaaaatttatatgctatatttgtgatttgcaatttgacctgattatttctttcctcagattcattctttcgttgcatatttatatttcaataattcataaactggtccatagtcaacagattatgtattattatatgtgcttcagaatttcagatcaccatataaattataaagatttcgcaattaagcatatcatgtgcttcagatcaccatatattatatatatgacacttggcatgcttaaccagaagaattttcaggggattaccaaacccaaattgacatcaatcttctcgccgaccaactagaggcaaaactatgcgacgttcctttggacgacggcggccggcgacacggctcgccggagtgccacatttccatcgtgaagccgcaagtccgcctcgtcgacgtatcgcagtacgctccgcaggtgctgctcgtcggcgcctaccaccacaggtcgctggaccggtgtgagctggacaagctggcggcgctccggcgtgccctccccgacggcgacgacgagcgggcgtccacgctgaggcgctacctggcggccatcgccggcctcgaaagcgaggcgcggagctactaccgcgatgacacggatgacatgggcgcggaggagtttgcgttgatgctgctgctcgacgggtggtacatactccactacttcggcgtcggcgtcggcggcggcgggagagcggtggacatcttcgccgtgcgcgacgtgttctacctgctcgagaaccagatacccttcttcatcctcgagaaggtctacgagctgatccactctccccctccttctccgggagctacagccatcgccggcggcgggtcgtcgtcttcctccgtcgtggttgtcgatgggttcgtgcgccatctccggtcactcctccgagaccagggctactcgaatctggaggtggacatcaccagcacacgcccctgtcacctcgtccacttactccacatgcacttcacacccatggcgatggcgccggccgccgacgacgctgccgctgtccccatccccaccaggcgcgcgcgcgccaccgtgtaccgctggcgcggggcgacgcagtaccacgccgccggcgtgaggttcaagagacgggccctcggcctcggcgacgcacggtgcgtcctcgacgtggagctccggcggctgacgctgcacgtcccgacgctgacggtggacaacaacacgtggcgggtcctgcgcaacctgatggcgctggagcagaacaacccaaacctgggcagccacgtcacggcctactgcctcttcatgtcgcatctcgccggcacggcgaacgacgtcgcgctcctggcgagcaaaggcgtcgtcgtgcacttcatggggtgcgacgaggacgtcgctaagggattcgccggcctgtgcaggggcgtggcgctcagcgtcgacgacgcgcgccagaactacctgcagccgacgtgggagaagatggagcggcggtacagcagccggccagtcaactggatggcgctgctgcggcggcggcatttgagcaacccgctggtggcgaccgcgctgctcgccgccattgttggcctagtctgtgaagttcttcaggctgtgtatgccgtcaagagctacaagactagaagctaagccactgagacgtatgcccctgtatgcctaccgattttacgttcattatcgaagtaccaatcattctccgctgcgttggattctactccactatgtatagatggccaaaatgagtcgcccgacacggcctggccgggacacgactaaggcacggtccaagatcagtcggaccggctcggcctgagattaaccatgtcgcgccgtgcccatccacggcgggcgcctacacctatatcccaggcatggcccaataagactcggatcatgccatgctggctcgaaggcacgactagcataccgtattgatccttggaataagtttattttgcctccctcatttttttaaggccgtgccttatatggctagaataagtatattttaccccctcacatctttatatcatgcattatatggctggaataagtctatcttgtatccctcatctctttgggccaggcgccaatgggctatggcgcaagctaccattgagccgtgccggcctgcgggagcgaggtaccgttgagccgtgttgtgccggggacggcacgacgttgtcgtgccaaggaagaggcttatgcgtagcccaatagtcgggtcagactggcacggggccgacaactgtcaaaaaataccatacctgggctgggccaaatctttgtgccgtgtactgagctgtcgagctgctggccttttggccaactatactatcacaccatctatggctgaacgcctaatttgtactcctttcatactcgtaaagaaagtcgtttaggacagcgacacgatctccaaaacacaactttgacttcttgtttctataaaaatatttattgaaaagtgatatatgtatactgttatgaaagtatttttcaagacaaatctatacatataatttttatattttcaaactcaataatttgggagttattcatgatttatattcctaaggtttgacttaaacattgtcctaaacgacttcctttatgagtatggagtgagtacataagattggttgcgaagcaccccgcctactagcatagaagaggaccccgaaaagttggccctaattgaacaaggtaacaaaataaagattacatgcttttgtttggatcatgtttcagaactggttgcaaaaaaagattgttgtacttccaagcccccccatggctcctgcgtccaagcctagttctcctaatccctaaaaatcttgtacgtatcaggattcaggagatatcattttactagcaataggaggtggaacatagtttttctaatcttgattaatttctttggttttcagctttggatgtgagctgtggtatgctgaatttggtgggcagctgattgcgcagtcaactaatcaagtctacttttggccaatacttaagctggggtttcttgtaacccagttttgctgtaacttcggcgttcaaaaaaaaaagttttgctgtaacgttgctggtctgctgcacatgtattgcagtatgaactattgatattcatgttggacgtttgttgttgcttgtcagacagatgattattgtgtggttttagaaacatcattacttcaatatagtattatctagtactccaaatatctggtggaatcgtggcatctattatccaattatatatgacctttttatgctcttggctgttcagtttaattcttagcttttgcttcagcatgcgctacttgctagcgtacatttcaaacaagggtcacagtctgttcgggttcaccgagaaccgaaaaaacgagccgaatttgttcggtttagtcggcttggttttaccttattttagacaaactcggttgccatatcttcaaaaccgatcttctccaaaactgaataaaccgagcaaaaaaaaaccggaaaaccgaacacccactcctattatgtccgtgctcgttgtttggaaaaataaataaaaaaaccctaatttatttccgtcaattttggatggcttagatcacgctatgattcatgcaagcacaatggcctttttatatcttctacccccgtacacgacactcattttcttcaccaaaatctaacccatgcagtacgtcaccccttagccacattggcaacagaaagcacaaatggcatcggcgcggacttgcctagtccttcaccctgcccgcctctcctcctctccaagtcaagtgacaacgcggtggccccacccaccttttaaatggtcaagatcctagcccccggcccatcaacactagcccaccgcctgttgctggtcccatggctttgttggcgccgccatcaccttactatcccacattatgtattattattctttttttcaacattataaaaaactacataatatatcctctcaaacaattatattacacagtttttttcacctatatgttggcgtcccagcattattgttataaagccagatcaatcatctgattgttgtaataataggttgttttaacaagtccatcatcattagatgtcttttgctaagaatgtcgcgtcgaaatgaacttgcgtataagaaatagatccaattactactatataaacaggcattggtaccgattcgtaactactggtgccggaagtcaaaccgatacaaagagacggaataaaaacggcatatttacaaacgaaaataattggataaaacttttatattcatattcttagcgaaaaaaagcaaatgttaaaaaataaatttggatgaaaaaaccccaaaatcaactctaaggttgaaaatttaaattttggctgataaacataaccgaaaagatgagaacgtttgatcactaccaactaagaagaaataaaagaaaattaagactatgttcgtactggatttttcatggaaattttttttgtacgaatagctttttagtcgccgttgattgtgttctgtcgagatggaaccctttcagcctttcagatcgttgacattgatcttaatccacatcagaaaggaatttaagggaattaaagaggattaaaggaacaatgcttaaagattatttttagatagtacgtaaaaattccaaagttcccctcaaattctaaacttaaaaataaaaacattcctcaaattccaagccgtttggtcccaaataatcccctttctctggaccatttgtggcagtccatcatctttcttcgttctcctccccttcccttgccgtggaagtcgccatggctcctcggatcgcggtgatgccaccgccacactggctcaaactcaaactcaatcctcctccgccttgcgcaactccggaaacggaatccccatcgccgggaacacatgcttctcccccgttctcatccgttaattagttcctccattagagcaatgatatgatcatatgatacactggtggagaaacccttcgtagtcccagttcgtaacccccctttagtcccggtttccaaaccgggagtaccaatccgggactaaagatcgagctgacctttttttttttttttgcatggccctgttgctgcatggtttatatatatatatatatatatatatatatatatatatatataaaccatgcatatatatgtttgaatacatatatatgcatacatatatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccgctgcgataaatttcttgtgtgtggtcaggttatccctcatgcgaataaattatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaagtctttctctctagttgccgcggaccaaatgacggaaccgataccaagccctacatggagtttaaagatatgattcgtagtagaaataattaacataacaagaatttcttaattaacagagaaacttatgccagtacctgtctataagttcgaaaaccttgtcaaacgtagactcttttttatccattgagtcatatacattgacggtgcaggccgacaggtcgaagagtaaaagcacccagtggaatctgcaatgtgcgtgggatgcattacatatgaaacacttagcaagttcgtacgggaataaaatttggtatgtaggaagacagtaaaattaaactaactctgtgttgtacggtaacagtataaacgtcttgtaatgctgcgccttcaggagatggacgagattgtcctctatttcctgcggatattggtcgagcattgcaacgtttactctccgagggtcgatgaatccagtatcgaaaaccctccgccgtcgggccctttgaatctccattctacaacgataaaagggagtattttattttatatagtctacttatatacaaggacctaattaattaaaggagacgtagtaattaagaattataattgaacgatatacttacaaagtccagaaactcataatagagacgtcgagggcgtccagctggtatacttcgtagattcccttgaaattgatccagagaatatcatctccttgcaagaagtcgaggtccctgatcctcgctccgatcatctctctaccggtggcgctcatctccacgtacagctgatggaacttgtacatttgtgtgggtagggactgcaccagctcgggcttgacaagcggtttatcgagttcgtacatgtatttcaattcagccttttctattggttcaactcctagcaattgatccgtagttagatcggtgtcaataataaattcttctatcgtcatgtctttcccggtcaccaacggctcgatctcctggtttggttgctctccaagctgagggactggtttggactttccagaagatgctttcttcagcgttcgctcatagtccgatagcttgatggcctccttgacaggtgcagacatacccctgaagaagttcatgatactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcagacggtggagctgggggggcccttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccattgggatggccatgcccgacaccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttataagcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgtaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggctggggcactaggacgtccatcttcttccacttccgttatgatgtgccgaccctcaagcttgttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcatacattagaaccctacacaaccttacgtgctaagtctaattacaaatcgtgatataacctaagtctaggtgacgtatattatacaaccctagctagtaaataattatatactaagtctaattacaaataaaataatcttatattaaaactcaaataatattacatgctaagactaaaatagtcatgtatattttaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcacaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttacactcaggcttgacggacgactccgacaacacgtcttttctgcaagatacaaaaagatgtattaggataaatgcgaagtaacatatatatatatatatatatatatatatatatatatatatatatatatatatatatatatatatatatatattgcatttcacgttaacgttcgtcctcgttcgttcgctcgttcacgttccctagctcgttcacgttcgttcgctcgttctcgttcacgttcgttcgcttgttctcattcacgttcgttccctcgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctcgttcacgttctcgcggcaacgtacgttgacgtgttcgttctcgctctcgttcgttcgatcgttctcgttctcgttcgttaacggcggtgtggcggcatcggggcggcggttggcgcggcgcgtggcggcggcggcggcggcgtggcgacggcggcggcggcgtggcgttgcggggccgtggcggcggcggcgtggcgtggcggcggtggcattgcacgcgcggcggcgaaggcggcggcggcgtggtgacggcggcggcggcgtggcgttggcatgcgacggcggcgttgcgcggtggcgaaggcggcggcgtggcgtgccggcggcggcattgcgcgcgcgccggcgaagacggcggcgtcgcgtgccggcggcggctcggcgcggcgtcggcgtggcgcgtcgtcgtcgtggcgcggcgtctcgtggcgggcggcgcgacggagagagatcgagatcggagagatcgagatgaagggagatctggcggcggcggctctcaccccagagatgcggcggaagcggaggaggcggaggcggcggcgaggacgacgagctcgagacgacggcgagatacggcggcgtcggcgcggggatttgccctaggcagtggcggcgaaggagagaggctgagagagatcgatcggccgaaaacgtctaagtgttggtgaagaagacgagggcgcaccgggaatatatatacccccggatctttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttattgcattaacattatttaaagtacaaagattaatgacaattacttcgaaaaattatttttgtctgtaataaattaagtggataaatcgtaataagcaaatatatgacttataattaataaaaattccaatatatatatatatatatatatatatatatatatatatatatacttagcatagatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgactgcacgtactttctcctcactattgttcccttcttgtgatcgctgcatgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttattccatcgtgtcccatggcatcgacacgaacagcgctgttttggttcgtgctcttcatgtcttgggctcccgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcctgagaatacggatctctttcacaaggtgacaaagcagatgtgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatattttccttctctgccttgctaagagtgtagctagctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacttccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacacctttcttcttccacaactgtttaagatcttcgaccagtggtcttaggtacacgtcgatgtcattaccaggttgcttggggccttgaataataatcggcatcattatgtacttcctcttcatgcatagccagggggggaggttgtagatacacatcgtaacgggccaagtgctatggccgctgctcatctctccaaaaggattcatgccatctgtactcaaaccaaaccgtatgtttcgtgcgtcctttccaaattctttaaattctctgtcgatgtttcgccactgcgaaccatcgtcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaactttcagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcatcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttacgactttagtcccggttggtcccgggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgatatcacttcgtccacacccaacattgctctgtcaccggtgaagaccatcgttctctgtcaccgagaagtctatgacaccttccagattggaagaaacatgcgaagttaacttggtacgcaaaattgtcactcggccagtcagcaacttgttacaaacgctactgtggggtcacctagttcggagtcatcatcaagcgctactgtggggtatatggttcccggttacctcatgttttgcctttgtgccgaatagcatgggatgggccaagtgccctaggcccacgcagcttacttgtaattaaagaaaaagattaaggattaggcaattattcctatcccatgtaaatagatggtaggtattcggattatacgggataccgtaccatatccacccggctgccctagcttctatataaacaggttagacacagccattctccacatatgtgctcacgtgctattccaacgccgtactacgcatacctacacagattcaatatacatacaactggactagggtattacctcacatcgagagcctaaaccagtataaacatatgtgccaccatctctccttgatctagtgcaccctataaattatattgcagatcataagaatcgacagtcaatggggacgaacaacctcggttggcccgagaagcagagcaacacacagtagaagaacgcaaaagaaggccgaagatgaacaagcaaggatcaaggaaggacgcaaacgcaaggaagtggaagaccacaggaaacacaatctgtccatcacagcgtatgctgcccacaaagcgaacctccagactccattgcagaggtcaacaccaatgtcttcatcacgccaaaacagaatgctattgcagcggctacagagctatttcacaagagggtatccaggagcttaccatcatggcttaccgtctacaccctgaccatccacgcagcaggaggagattcaaaagaaatggcaaactagttgcccgttacactcaccgattccgctaggagttagctcgccggcttaccaaggggcgcaatcgactcttggaggattgccagtaggatcgtagaaggagggaaggtgggtcaatgtcgcgaccgggaaaattgccttttcccgaacgctagtgtattgatccccgtcccaggaaaagccggggtacaccacacaaacatgatataaaagacacatctttattatatcgacaatacttacattattacaaaggcgcttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacggtactcagcaagccacaccggcagatgcatgattaatgcaagggaagtacaagggaataataatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttacgccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccataactggcatgcacccaaaccccaccgaaaacaggctttaggggttttgaaagaggaagagaggtgtatgtccaattccaccataatccaacaattccaaagtgtccaaatgacatgagaattcccaaagtctaaagttataaaaccacctaatgttgcctaattaatcagcgaagcatctacctaaattcatactagtggaaccatgaatataatgtccactagttggggttttgtttattctagggtgaacaaggtaataataacaatagcaataataatgtcataacaaaggtaaataggcatggctaaaaaaaacagtgataacgcgggaatttaaacaaagcgataatgcaataatttaaatcaaaataattttataaactgggattcaatatgctcaagggtgatgtgacttgccttgctcactttcccaaacgccggcttcaacttccacgaagagcggatcttccgaagctgcagcgtctacacgaccgacggaaaagaaaaggcttacacactaataaactccacataacagcaggaacaaagcacaaaaatgggttctttacttcttaaggaaaaattagagacttgaacggtccaattccgagttcaaatggccaagttatggccatttgaagtttatatgctctttaaatggatatttacgaatttcttcatttaaattttaattaaaaatcccatttattgcgtcagccgagggagagggcgcgcggaccgggtccacgggagtggggcccacgcgtcagcctctcggtccacggtggaccgggcgcacgcggctggcggcggtcggcgccgtgggtcccacgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgacgagaacggcggccggagaggaggaaagcggcggcgcggttcgggatgacgatgacgacggtgctccggcggtcggcgggcgaagcggagcggcggacggggtcggcaaccactcggcgaagccgatggaggtggcgccgagtcgggaggacgtccggagcggcggcggcggcgaaccggaggtcggcggcgacggcggagagagaggtggacgtcgcgagcacgaatccgacggcgagagcaagcggcgaacggcggaaacggaggagggaggcacggggagcaaatatatagcgccgagagggggagagcgcggccggagagagaggaaaccgcgcgcggagatctcgggcgccattgaagacgccggcgaacttcgcgggatgaatccggacgaatccgagggagagagaaagggaaaagagggggaatcgggagagggaaacgcggggagtaattcccctctctttaaggcgcgcggggaaggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcacgcggggagccgatgggccgcgggggaagagagagagggagggactgggccgagccggcccaagaggggaagggggggggaaacagacttcttttagggtttttctttttataaaaccttttcactttgtttatttcttctcaattattatttgtgctctgaaaattccactaaaatttgagggctccttttagaccaaggagaatttaacaaaaattctccgggccacatttgaatttttcttgtacgtattttagggtttgccaatttcttttcgcattttaattaattctattattccttttagagaatgatttttattttgggatgaatttatcaggacgtgacagtcaatcctgaatcgttggatcttagagagaccatcctgaccgatcaatgaggaatgaggaatgtaacattgtgttggtgaatgaattatagggtagataagggaggaaggaaagaagcaggagagaagaagaaagaatagaaaaggaagtgggacccatgggacccacattccccttctcctttgacctctttcacctgacaaccggacatcacttgggatattcactggaatattcctctctgttatatttagctggacaccaacgggttatatgaaaggtgccgcttttgagtaagaaccggcatctatttcttttgtccacaaaggtgccgggcgggtcccacgctaactaaaagatgtcggttttaatttaaaaccagcatctatctctgacagaggtaaaaggtgccgatttttttaaaaaaatcggcacctattaggatataaggatgccggttcttggtattttgacgggctcacgggcgcgtaggttcgaaaggcactatagacgccggttttatcacttccggcacctatagtgctggcatctatttgatgttttgtagtagtgtacgtaattaaattttaatattcatcacgctgacctaccatgcaatttcatctgttagttacgttacaacttcagctaagattttgtaacaaaaaatcatctcgcgtataaaataggtccagcgatataacgtccattgcctacatattttcactcacttcccgttctaatatcatagaattgtatgccatgatatcttgcaacgtcgaatgcaatcatgattgaaaataaaacatgaaaaagtctcaaagagagagagcatgttcaacaaaaggttaagtaggacggtggtgcgaaggaagagggactgggcggttgttcaataatagagggagacgatgacatgctaaaaccatagctaattatggtaagagaggaggagagaatgggagaaacaaaatcagaatcgaaccctaacacatgcatactttgaattggaccttctcacttcggcatggcaaacaccccatgcatatatatatatatatatatatatatatatatatatatatagtattataaaaattgaagatatttttgccggtattttgatacaagaagcaattcaagaacatgaagatgaagaagttctatcagaaggcgcttgatgaggcatttgtagctgtccaagaatcaagcgatattgagtttgaaagtgatgaggatgatggcaaggggaacaaaggcaagaatgatgtttgtctcatggctagaagcgtggatgaagattctaattgtgataatgaggtaactcatattcctagtgttgaatatcttcaagaagttattgctagacttggttataagatttctagatttgagaaaaagattaaccaatatgaagctactattgaatctcttaatgcttaaaattctagaataaaatctcttgtttctgataatgatgagtgtaaatcttgtgaggttttatttgaggaaattgaagctgttagatatgttaataggtctcatgttaaaaagattaagaaatctgaatcttgtcttgctatgagttttgtcatgaacactagattggttgatgaattgtttttgactaagagagctttgaataaatgtcaatttgctttgtttgctagttcgatgtttaatgtgattagctctaaaaggattaaacaatctagtgaaaaaccttgtttgacatgtgttgctaatgagatgaaactaaaagatgcactaggtcgtgttaagcacatggaagaaattgtcaaacaagatgaggtgttttcttgctcaaattgtagaaaacaaaaaggtcttttggatgcttgcaaaaattgtgctaatcttactcaagaggtttcttacttgaaaagttctttgcaaagattttctgatggtaaaaagaaactcaacatgattcttgatcaatctagggttagcacacacaatcgtgctttaggttttaatccttatgcttatcatactagacatcctcctgttgttttaggtgctggtgctagaggtggtgaaattttgcttaaacctgagcctaagaacactgtgtttaaatctgctggcatcatgactagtttaagtgcattatcttcaaaaaccaatgttatgcatgcaaaaccttctattagtgcttgtgttgctaagccatatgtttctataattgcttctaatcatcatgataaatatacttgttcgttttgtggaaaagatggtcatcttgttggattctgttttagacttgctagaaaacagaaaaaggaacgggaaattgcttttgcgaaaaagagatggcaaaaactgcgttttgtcccgagacaggcagtcagaccggtgctttacccccagtcagaccggcggtaagccttcggtcagaccacaggtacctcagcggtcagaccggcctcgggtagatttttctaacgggaaatgggttgaattttctactggttatgctcctgttggttctggtcatgtgtctcagtatttttattatctaaccccagtactgaggcttcaacttctgcttgtgtgtaggcacttttggcgaggaaggagaacgtgtggattgtggattcctgttgttcgcgacacatgaccggtgataaaaattggttctcctccctcaagaaggcatcaaggaaggattcaatcatctttggcgatgcttctactagtatgatcactactactggatctgtcaaagtaagtgacaagtttacattgaatgatgtcgctttggttgagaatttgaagtacaatttgct

SEQ ID NO: 64229 - DNA, 769 bp, Oryza sativa
atacagttgtctaatggaagctccatgacttgatcagtttccaggcctttcttgccaagtttgtagtttgagattgtaccttttggcttaaactcatctggattaaatctcttcagaagacgtaagcagtgaacaatctggaaaagggaatgatttatacagcttgtaggtgcatgaagtatgcaacagcataaaatggttgcagctcacaaagggtactgcatagtaattaacacctttcatgcctaacagattgtattatcgcttttcattgcagtttcaaaataaaatattgcataggttgttgcagtggtaaaaaagatcacattattgaatgcaactgatacaatcatagagatttgttgacatagttttatcttgaatagcagtttttttcccttcagtatgagttattaattgtcaattcatagttttatatctcagggaagtctctagtccagcttttattgtctttcaaataagaccgttttatttggattcagggtctcagttctgtcaccttgtgcactccgtttcagattagtatagtggaaaacataactgtggatgcagctttgttggacaaaagaaaaggttccatcgccatctgaacaagggaatggatcatgctggtgtgtaattaaaattatgaaggaccgatttttaaagcatgaacttttttaaaagatacagagtcaatttcttgaatttcgttaacaagaagcaaatatgttaggaaaggtaaaacgataaatgtgggctgcaggaa

SEQ ID NO: 64230 - DNA, 779 bp, Oryza sativa
ccccctcgccgcccatttgcaggcggccccccgcacagtataaaatcgccctatcggagggcggcaagggggccacctgcaaatttcgttgacggccgtcgcccgagagcgaacggccggctgccatggcattttcgccgccctctaggagggcgattttttaaaaatcgccctcccagagggcggtaggcgactacttccgtcaattttcaaaatggaaaattatttttgtaaaacttttaataaaaaaaattataaataaaaaaaattcaaggaggagattttcgcgatttgggccggctaccaaaaactaggaaaaaaagtacacccaaggtccctcaacttgtcatcgagatacaaaatcgtcccctaatcgcaaaaccagataccaggcatcctcaagtaacaaaatcgttcgttttaagtccctcggtggttttgacccctgttttgtctgacgtagcggctgagccagcgtggaacccacgtgggccccacatgtcaggatgccatgtcatctatcccttcctcttgtctcagttttctcctcatctgggtaggcaggctagccggcaggttggggaggaagtcgacagggcgagccgggaaaggaggaggttcggcggcggtggccggcgatcttcgatgcggcagcggcgacgaccacgcaggagcaggctggtcggcggagcatgaaagcgacgggcggagcgacggcggcagctgcgcccaccgcaccgacctgccggagggccgggcaagtggtgggcgaagccggc

SEQ ID NO: 64231 - DNA, 5612 bp, Oryza sativa
cacgttcaaactcggcagccgccgccgtatgcaaatgcacggtactcggaggccgagagcaacgacggcttctacaaagctttgctcggcacggcgcccaacgaggccttcgcccttgccatgtgctacgccgaccggaactggacggaatgcgagagctgcctacgcgcggcggccatcgggatggcctccctctacccgcggagccgtgcggcggccgccatgtacgacgcctgcctcctccgctactccaacgcgtcgtcctccttcgccgccgccaacaccaccgtcgtctctgcctactccgtccgactccgcggggggctacattgttgccggcgtcgacaccagcgcctcgagcttagacagcgacgacgcgcggcggcagctgctgctaggcctgctctgggaagaggccgccggttctgagaagaggggaaagagagagataacgtggcatgctgacatgtggggcccacgtgaatcccacgctgactcagccgtcacgtcggacaaaaccggggtcaaaaccactgagggatctaaagtgaacggttttgttagttgaggaacgtccggtatctggttttgcgattgggggacgattttgtgtttcgatgacaagttgagggaccttgggtgtacttttccccaaaaacaacctacatgccacaaccacataatttggcccacaaagaggcctagcaaatttgggccactcccaggcccagaaaacattaccaagtcgaacaccgcaccagccatcatcgctgtcctctctcctctcctcccaacgcggcgaccgacggccgaggaaacggcgacgaggcggcgcccggccggcaacacgggcgcacggggcaagaggccaagcaagctgcagcctgcaggcgaaggagggaggacgggagcgagtaggagattcaaggcggcggcgcggcggtccggccgtcgaccagcgaggcgcggccgcacggagctgactgggccactgggcgcaccaaaggggcaaatcaatttcaagatctgatgatatgctacactgagaaacagatttgattttaagaactacaccaaatcatccaaaggtttgaatagatgaaagagcgtccaaagaatttagtggtatcatgcttctccctaaatctctaaattattttaaaccattatttatctgttatcattattcattaatctgtcatttctttgttttttttatagattgctgctcgtgaagaaaaatgggtggttgatcaccgcacatcatttattggacaatggtttcgtactgtaaattctactccctccgtccaaaaaaaaaaaggcaaaccctggtttccgtgtccaactttgactgttcgtcttatatggaatttttttataattcgtattttcattattgttagatgataaaacataattaatattttatgcgggacttgtctttttaatttttttttatatttttttcaaataagacggacggtcaaacgttgggcatggaaaccaaggtttgtcttttttttttgggatggagggagtatgtatttcagtatgtgtactccgaatcagatatgtagcctacatgaaagatgcaccaaattgtgttggcctaatttgttaagcctcacgtattattttttcatgaatctatggtattaatcatatggtagaaagatgcgcatgcatgtcttagggattgggatcctctgacgtgaagtcagagagacgtggtgactgacatgtgaaccccaccactcgcggacccacttgttagtgaccatgtcacggagcagttcacgtcagaggatccagttccgtcttacagacactcaaaaaaaaaaaactaagcccgtttaacaagctgagcacggagcggctttgccatcacagtggtgaactcattcttctcggtcaagtccacctcgtcgccggccacctccttccactcgaactccttcaccaaattcgccacgaaatactccaggtgtagcatggcaacgccgagcccggcacagatcctcctcccgacgccgaacggcatcatccggacctcccggctgcccgtcacgtccactccctcgccgtcgccgccggcgaggaaccgctcagggatgaactccatcggcttctcccactccctctcgtcccttcccatctcggccaccatgaagttcaccgtcgcgcccttggggatgaggtacccgccgacctcgacgtcctccgccgccttgtgcggcagcacgaagtgggccggcgggtgcttgcggaggccctcgaggatgacggccttcaggtacggcatgtcgtgggtgtcctcctcggtgatctcgtcgtcgctggtcttggacttgatctcgtcgtggagcttggattggatggatgggttcttgaccagctcggccatgatccactgcagcgcggtggccgtcgtgtcggtgccggcattgaggaactcggagcagagcatcaccagctcgtcctcggtgagggcgctgtcgccgtcggtgtcggggaggcttacgtcgagcagcgtgtcgacgtacgagtgctcgaacgtcgtctccttctccggcaccggtgggccgccggcttgctggatatggttcttgcgcgctcgccgggcatcgatgagtggcacaaagagctccttctgctgccgtcgcagggcgaggcctatttggaggcggcggcggaagatgtgcttggtgaccgccgggtagaacgcgaatacgctcgtcttcctcgcgacgtacaggagccagtcgcgctgcgcggcgccgatggcgcgcaccgcggcctcgtcgagccgctcgccgaagcacatgagcacgaggaggcagaacatggcgtaccggaacgtctccaccaccacgcgcgggcgtggcggctcggactcggggcgcgcgccgtccgcgagcttgtcgacgagcactcggcgaacccaggagcgcgcgggcgcgaacaggcggacgcgcgacgggtgcagcgtctcggcgacgaggttgcggcggaggacacgccacacggggccgtagctggagcgcgtgatggtgttgccggtctcgccgagcagcgagcgcgtgacgtccgggcggtcggcgagcgcggcgccgcgctccaccagggccgcgtgcgcgacgcggcggtcggcgacgaagatggagaggcgggagcccacgcgcagcgacacgacggggccgtaccgcgcgatcaggcgctggaggagcggctccaagttcgccgaggagtgcctcagccacaggaggcttccgagcaccggcacggcgagcgggccaggcgggatgcggcggctgccaccgccgctccggcgccgccgcgcgaggaggacgacgagcgggaggacgagagcgacgaggagcaggagccatgaggtgtccgtggccatggcgtcttcttgcctttgctctgctccgccgcctcgtcagttgagctttagtagcttcggagttcgagtcaaagttctttcggctgctgacgtcatggctgatggatctgattcggtggcgtttctagaggatgagcatgtgcgagatgcccttggcttcaaagctcgatgacagatgctttggttatcctggttattgaccttattaaaaagagaaaattcgatccataatacatgaaagaaagcggtaccaaaaaataacataaaaagtttccactttcaatctatagcataggccaccgatttttctttgtcccgtagcacttccgtcacattctgaagtaacggcgttagataggagtggagaaaattttcgttgcactcatttgccctttgttcccccaccaggtctcctcttttgctcccgcgtggacggtggtgcggcggccatcagcgtgccgagtgaccacctcgtctccccgccaccgccgagagggctgcggtgcacgctcttcaacaacatggacgcgtggctcaccatcgccaccgacggcgaggtggaccccgtctggcgctcggcgctgctgatcgagggtgagccacccacgccggcggtcgtttgacgacaaggacgacaacgatgacgtgggtggccctatcttcggcatggatagatgtggcccatggtggccgtactcgccgccggagaactgcctcttcctcgccacgacgccgcaccacgccggcttgccgctgcttccctctacatgcacggctgctccaccggctgcagcacgctccgtctcgccaaggacatcgccgagaacaaccgcggcgcgtgcgtgctcgtggcctgcgcggaggtcttcctcatagcgttcgccgcccccgatgatgcccacctcgataccctcgtcgttgcgtcactgtttggtgatggcacctctatgtcttcctcctctccgttgcagatggtgggcggtgccggcgcggttcggctcggcggtgcgcttggagacagggatggtggcggcgcggctagggatggggatggcagcggcgtggctggggacggggatcgtcgccgtgtggctgtttggtgacggctccggcgccgtcgtcgtgggcaccgacccgagagaacgagatgatggtgattacggcgaggaagatgaagggcaaatgggtccaacaaaatttttctatacttcgatctaacgttgttaactccaacctgacggaagtgctacggggcgaagaaaaaccggtggcttgtgctgttgatcgaaagcaaaaaaaaattcttgtgttattctttggtaccgttttttttttctatactatggatcgaattttctcatgcatagtaaaatgcatcgtgttgtcatcgtcacatgaactattctgggacaaaccaaatgctccatcgggaggaatttctgaagaaaaatcgaccatcttggatgatcctgaattcctgatgtctgaaagcgcagacagaaacagttgaacggtacacgggccacacggcttcgtctaaatcagaattcttcagaaaacgatgccgttttactgttcacttgttggaagcaagtcaagctggatcaatcaatgacacggcgaatgcaagttggccatatcgttgcacggtggttctccgtcacataagatgtttgacaataatttgaagtagtaaacatatactatttacaaaactaattacataaatgaggcggaaacttgctaattgatgcgaaaaaaaatcaaaaaatgagaaaaaaggaaaaaaaatcgtgaaaaaaagggaaagacacgtgggaaaaaggaaaaaaacgcggaaaaaaaaggaggggacgcgtggcgtggtgggggccgagcgcgccaattagcaattgtgttcaccggaggtctcttaagttaacagcgatatttttttaggtcccttaatcccaaaaccagaaatgtgtaccctttaccttacacatgccgtgcacaaggtcctataccagtatatatgggaagtttcgctgatgtggcatcctagtcagaaaaaaaaattaaaaaattacgtgggtccacgtctcagctgcacatttttttcttctcttttctctcatctctcttcgccggcagcgggcggcgatggcgagcagcttcacgtcgccaagcatgtggccggaggcaggcggagcagcggcgtcga

SEQ ID NO: 64232 - DNA, 565 bp, Oryza sativa
tgagtggtgataaaagattttaccactggacccacatatcataaacacatgaggccccacatatcatagatagtgagtagcaaataattaattgctacatcttaaaaaggtaaaaggttaaatatcccaggaggctaggggatccatttttaaaataagttttattgaggtatatttgaaaaatatgtttcaaatgataaaaattgaaaaacacataaatctggagtactggagtatttcccccgtcccctatgcgtcattgaaaatctcccgtcccgttccgctccagcgcttgcgccgatctccatctcgcgactcgcgagcagagcagggttggtaggggcgcccatctccatccggcgagcagagcagagcggaggaggtgcgccatcgtcccgctgcatcctggtgagcatccacatctctttctgatccatcgctctccccaaccggaagtacttttgtctcgaatttgcttgtgtcaaccttaataaagtaacagtctgtttgttcaacccaaatgttggatcagcccccgacacgcatcctctctcaaccctctctg

SEQ ID NO: 64233 - DNA, 4610 bp, Oryza sativa
ccgccatcgccctgcccgccgaagaagacgagagaagagaagaaaataaaggagaaaagagaagaaaggtgaagaaagaagggatatggggcccacatcggtttctctcacttgcatgtgggtcccatatactttatttatttatttttgctgactagtatgccacgtcagcgaaaccactcatatatactatcatgtgccataggaccttgtgtgcacggtttatgtaagttaagaggtacacatttctggttttgtggttaagggactaaaaaatctcactgttaagttgagggacctccggtgaacttattccaatccaagaaaacgaacggttcgaccttcaagtccgggtgatttggcaatgggccggcccttccaattcggcccgctcgacctacaacgccttctttctcagccagcaattcttcccctgcactgagtgcaaagggatggattgccactcgttgtgcctcttttatgcgcattagggaggagacggccgaaacacatcctgatcatcggatgtgtcttcgctcgtttggtttggcttcgagtgctcaccttgatcattggtaggggagatttctcatcggacccgcatgccctgttgcatgattggtggcagctctcaagggatcgactgggcaagcagctcaaaactccagttatgttcactgtctaatcctttttattgttggttctttctgttccttaggagcttggaggaactgtatggaatagaccgtactgaatccgacttgttcagagaatagaattgcccgtttcaatgttcacttgtgacttaatttgtggttgtataatctactactaatatccatctcgtacaacagaagacacgggagtctcgtgaagcatcacacgactacacatctggcgattacattttgtgacctcaagggtgaagccttctacagttctatattggatggtagaataccaggcagacgtaaaagagtggaatttaaactttcgaggatgtgttccctcgttgtttgcaatatcacttaaatgattataaaaaaaatgagaagatgtattaacatacagtataatatatcatttgaaaatttacaagttcaagctcaacatatcgcaacgaaaaaaataaattttatatttagttcagaattagctcatttggcaggcatataagacagtaaaacaaaaatggcccaaaagaatttaggcccactagttttttaactactaaatacaaactcctaagaaagcggtaaaaatcgttaggctcgtttaattagccggacgcggagcgactttgccatgacggtggtgaactcgagcctctcggcgaagtccacctcgtcgccggcgacctccttccactcgaactccttcaccatgttcgccacgaagtactccaggtgcagcatggcgacgctgagcgcggcgcagatcctcctcccggcgccgaacggcatcatcctgatctctctgctgccggtcacgtcgacgccctccccgtcgccgccgccggccatgaaccgctccgggatgaactccgtcggcttctcccactccttctcgtccctgcctatctcggccaccatgaagttcaccgtggcgcccttggggatgaggtacccgccgacctcgacgtcctcggccgccttgtgcgggagcagcaagtgcataggcgggtgcttcctgagaccctcgaggatgacggccttcaggtatgggaggttgttgcgggcgtcgtcctcgttgatctcgtcgtcgttgtcgccgctcatcgtggccttgatctcctcgtagagctttgattggatggatgggttcttgaccagctcggccatgatccactgcagcgcggtggccgtcgtgtcggtgccggcgctgaggaactcggagcagaggctgaccatctcgtcgtcggtgagcgcgcggtcgccgtcgccgtcgacgtcttgtagtcttatggtcagcagtgtgtcaacgtacgagtggttgaatgttgtgttgtcgtccttcttcttctctgatgccgctgaatcaccggactgttgaatttgtttcttgcgctctcgccgggcgtcgatgagtggcatgaagagctccttctgccgccgccgcacggcgaggcccagatggacgcgcccgcggaagaggtgcttggtgatcgccgggtagaacatgaagacgctcgtcttcctcccgaggtacaggagaaaatcgtgctgcgcggcgccgatggcgcgcaccgcggcctcgtcgagccgctcgccgaagcacatgagcacgaggaggctgaacatggcgtacctgaacacctccagcacgcgaggaggagacgcagggtgcgcgcccgcgtccgcgagcttgtcgacgagcacgcggcgaacccaggagcgcgcgggcgcgaagaggcggacgcgcgacgggtgcgtcgtctcgacgacgaggttgcggcggaggaggcgccacactgggccgtagccggagcgcgtgatggtgttcctgctctcgccgagcagcgagtgcgtgacgtccggggggcggtcggcgagcgcggcgccgcgccccaccagggcggcgtgcgcgacgcggcggtcggccacgaagatggagaggcgggagcccacgcgcaacgacacgacggggccgtgccgcgcgatcagtcgccgcaggagcggctccaggttcgccgaggaggagtgcgtcagccacacgaggcttccgagcacgggcacggcgagcgggccaggcgggacgcggacgccgtgcttccgcttaacggcgccatgcttcgcgaggagggtgaagaggaacgcgacgaggaagacgacgaggagcaggagccattgtgttgcatcgatggccatggcgatggcgtcgtgtcgtcccttgcgttccgcaagttaattatcagctccgcttcgtcagttgttgttaaagatggtttagcttccctgccttgtggctctagcctctaggcctgtagttgatggatgggtttccatggcattccggacaatatcgatcgatcagcatggccagttaaatattcactcagattcatattataagttgtttgattttttcctaatcaaactttgttaagtttaattaagtttacagaaaatttaacaacatataaaatatcaaattagttttattaaatctaataatgattatactttgataatatgtttgttttgtgttgaaaatacggatggctactcagacataaacgtttagctctggatttggtctaattcttaaaactttagctaacgatgactatcatactttagtttataacgataaaaatgatgtacaaatatttgacttaaatacttatttttgtgattgtataatctctagtccctccgtatcgtacaaggcttgtctgattccgtagcatatcgatcgatcagcacgtgtacgctggatcaattatttatcacgacaaaattcagaagaaaaatcggtcatcttgaacttgatgttcgaacataaacgtgcttggtttgccgacttgcccgtactgattccgattttgcagaaattggtagccatttagcgcctcacttgttgggggcaagcagccaagcaatcagaatcacacgatgaatacaagttggccatatcatttgctagttcagcaatagcacacaatgatctgctctttgcagaacacattaatctactcgtatattgctaacacactccagcttacatacagttactacactcacgcctctatacactcgcatatgacctgcgctacaacgagtagagcactaactcttaccaaaaagtaaacaaaatgactgtataggacttgacaaggctgagtttacagtcacagagcctgatgccgatggacttagaagatttgcacggcacaagcacaactagcagcacaggactatgcacaatgcttctgagatgtggccccagcttagtttctgtggggctaagcaggggccacaggtcagaagcacaatgttcaaagctgtgctaccaagctgggcgcacacttagccacacaaacattatacggcaagaaaccttacataaaatatcaagagctgacctcggcgaccttgcttgctgcatctgagatcctgaggttgcagagcaatgcatcacgtcccgtaagcacgatctgaaagaagtcgcctacgcgcttcgatagggagtccaacccatgccggagcccctccgcgcttttcgacatgctggatatgcagtttaatagttcctccttgctttcctggacactggttctctcaggaacaaccagggcgctctcatcgctgctgccattcgcctgctttacgttactatcttggtgctctttgtaactgattctctcaaccattgccacttccttttcatagctgatatccttcttcatttcagcttcttgtgttcccccttctgcaatactctctgaaattactattccaccctccctggtagtgtcatcagcaagtttaagaccacagtgatggtctccttcctgcgcaatgctgtctgacatgacctcttcctctgtatggctaacagcatttgccaggttggcagcttcttcttcaagctgagaagtgctaaccaaa

SEQ ID NO: 64234 - DNA, 1483 bp, Oryza sativa
tgcgcacgtggcagtttcaacgtagccacgcccccttcacatctcatacctaagaatcctgcaatttcttttagcatatttccattttgttggtccttactgaacggcttccttttccccctgagatttctatagaaaataatgcgaatgtgaggtagcttacataaagtcgaaaacaatatcttttctacctacacttcaagaaaaagtagggggggaaaaacacagtaaattccgtagtaatagcaaataaatgggccttacatagacggcccagcccatttcaacagtaagatctccaccgagtcaataaaacgcagcgcctcctctcctctactccgctccgccgtcgctgttgctctctgatccctagggtttactttcccctcctcctcgaactctagggtttttccgctcgctctccgccaccatgacggccgccgagacgcaggaggagctgctccgcaagcacctcgaggagcaaaagatcgaggtgatccgtccactcccagcttccctccccccgccgctgttgccctcttcttgtgtgatagaagtctgttcaagaaggatacgatcttttaggatttgtgcgactttagatcggtgggtttggttagatcgtagtggtaaactgccggatctcgtttgctgctgaggttgcgcggcttttaggtgcgagatttgggtggcgaactgagtggttgttggagtgtggatttctggggatcctattgtcctctgcgatcaggagttctttttttactttatggggattctcgttgatgaactctgttgacctctgcaatcaggagttattttcctttcttggaattctcgttgctgtaagtctataggcctcttgcgtgctagtagtagttatgtgctccatgttgtttggcgattcacctatgaagagagatcggtacttctgctttcatggtactcctgtattaaggattacaagttctaaattgattatgaacatgctgaagctagattaaaagcgttataattgtttagcaccctgaagctagattactgctgtttaactatagtgattgttacattagtaacttgggctcatttgttaattagattgttactctaggattctttgttttcctgctgcacaaaggtacaagcctttctcttttactcttgagaaaagtccttccttttatgcatagcatgcttattttcaatttggaaatagcatacactggcgtgaatactcactattttattctgcatgtggcttggtctgttgtgggttatggccctgctttgcagggcatgtttgttacttgacagtcagttaaagaaaatgtcattttgcatgctttcagggagatgagcctatccttgaggatgacgatgatgcgaggatgatgatgatgacgaggatgacaaagatgatgatgtagaaggtgtgttggaatccatccttagttattgtaatataaaggatagatatatcagg

SEQ ID NO: 64235 - DNA, 10471 bp, Oryza sativa
tggttgagatgaggagataggtggagaagtagctgtatttgagataaatttaaatacttctaaatttaaatcctagaagtagctatattttaagataaagagggagtactatgctagactaaactgctctttcatggatacatatataatgatatacatatcctgtggtgtggagtgcagactctagtccatctccatgatagtgcaaaatctgcttttatcttttcttgttgggagcgttgccggtgcttgtgcctgtcgcaatgccatcttctgctccgtgtcatttcacctgtatgtcggcgtcgctgccggtcagaaaggaagtgtagtgctgctggccggtggtggacttgccagatcttgtttctgattgtattgttgtgcaagatgccggtgtttgttggttgctgctccagcgctgtttctgttgctgctgcagggatcgcaacatggctgcacaaatgcacaatgtccttttgttcacatcttgatgtcaactggctttgttttccagtgacatacattagtcagtaagcaactgaactggtcccaaaaaaaacatgaagttttctgtagagacagcgaaactcatctgtgttcagatcaggttggtacagtgagtgaagaggtcttcatgggaaaggcagatagatatatctattgatctttcttctcggttgcaatgtcaatgtctctcctcacaggcttaattgctttgcagttcgtcactaataggactcttttttcttctttagaggtttttgctatcacgatgcatgagttttgtcacgaaaggagagaaatgttgatgtcactcagatgtgatccgtccaactaacacatacagaggtcatgcactgtgccaattggttttctgttttgcacggcacctgcttttattattgccaactgtggctggatccaaagaggacctcactcctctcaagggaagagacctcgtttacagggtagtttacaacttgtgttaacactgataaggacaggtaagaagtaaacagaatgctgaattctctgaagacatatacaattagtggcagagattgtgatggaaagccaataagattgtacatacacatcccaaatatttagtactagtagcaatcataatggttagtacagcttattacaacatcaaccacacaacaacaaattcagccttataattagtaggaagttcagataaccagcagagagagagagcaggaaagatgaaatgagcgaaacagtgaaaagatgactcacaaagatggccaaaaaggcaaacacaaagcagcacatttggggaagccgatatcatactgtcttcaccaacacgctcacgccttagaaaaagtgaaaagcttttgcatacgaactgaactttggtacgaaatttccagacatatttacagctagctagacgaccccgacattttagagtacaaaacattttgctggcaattttgcatgcaacgagattttcagtcgatcgttcgaagaatctcgtaccaaaaatctgttcgtacgcagcaattcaaatagaaaagtgagacccaaaaaaaaatcaaaaaaatggaagagaattaagaaatcaagaaagcaaaagggttcaatgtgactcgtgcaggtgggcggcccacggcgcggggctcgccgtcgtaaggttggcggccgcggtgatgccgaagaagaggtccgtgaatgcgctgaccacgtacttgtgggcgcgccggtcgttgagcgcgaggtaccaaaagagcagctcgtggagccgcgccctgtcgccgcggcggcgcgcgtccagccgcagcgccgccgaccatagcctccatcgacctgaggaagtcggcgtgcgggtccggcgagtacgtctgcaccgccaccccggccgcgcccacgccgacggcggcgccgtgcgccgacgagtcgacgatggagttggacctgccgggcgaggagaggaagaaccggcgcgacgcgatggccgacgacagcccggagtcggacagcgccgaggcgttctcagcgacgacggcgccgccgccgccgacaccatcgtcgtcgtcttcaccgccgacgccgcccgagttcttgcaccggagcgaggaggacgaggagcacggcgaggtctccgcggtgcagccgccgccgccgccagccgaggtcgacgtcgacgcgtcgtcagactgcgccatgggcgccggcgccgcccccccgacgccggccgccgcagccgggagaagcagcccagcatctcgcctatagctagctagctagctaagctaagctactccccactaggcagctaagcttcagctaggtagctactactcctagtcctagctaagctaaggacgaacacgatgacgttgtgggctgtgcactgtgaggagtttataggagaggaggcgtttgcagctgttcagtggctcacctgttgctggacaaaaccgagttaagtactccaagctgactaagcatgcattatttgttcggattaattactcctaaagtcctacctatacttaacaacattagcaacacgtggatgatcagtatcatcaggagatagtgcctttttcgtttataaataaaaaaaagtaaatgagcagcagaaaatatcatactaccatgcattctgtctcagacactaattaattatcacatcattgtattattcctccaagttagtaatccaagtgtgattaggtccaaaccagccccatctatttcttatgcttatacttatcaaccaaaatttaaatttttaactttaaatataaagttgattttgagatttttttcatcgaagtttatttttcagcctttacttttagatcgttaagaacacgtatataaaagttttattcacaaattacttctcgtttgcaaatacgcgtttggcttattcctactgcatgatactcctactacatgtaaaaagcacagtgttttgtacttggtcagatcgatcagctacgcatgtacagaaacttagcctgcaaatgtattgagagtttgtacgcgttcaactaccgcatttgcttcgcagtacatctctgcttagctacttgtgtgactggtcctaactgcgctgtaacaattcgccacgcattttgtccgtttgtcgccgtaagtacgtacgtacgtacgcaattccagctagctcgtacgtacacatgcccccgcaccgaaaatcgctaatcagctattagccgcgcgcgattgctttctgagcccacgaatctttgtatgtatacgtgtacgtataactttatgtgcatacgtataaagtttgtgagcatataagtgaaattttatacaagtatgtgtgtgaacttttttacatccaaaatatatacacacgcgtacaaggtttctatataaaatatttatatatgtaccatccacgggtgtgggcgcgcggctgaccgcacgttagtgccccctcctctatatatgtacatatatacatgtattatattgagcatcagggtactttctccgtttttcaaaatgtagattgtttggtcgtgtttttttcctcctaataacaagtcgttaaattttagtaagtttgataaagtttatagaaaaatacagcaacaatctttaaccgcgaggtgtatatgtgtgtgtgtgtgtgtgtgtctatatatatatatatatatatatatatatatatatatatatatatatagagagagagagagagtctggaatccaaacgtgactagcacaatactccctctattttttaataaataacgtcgttgactttcgaacacatgtttgatcattcgttttattcaaaaattttatgtaaatatataagatataaattatgcttaaagtactttgactgataaaacaactcacaacaaaataaattataattaagtaatttttttaataagatgaatggccaaacgtatgaagtgaatgacgtcatgtattaaaaaacgaagttagtatatacgtactcatgtctgtgccatacggtgcgcgcgtgcaataatcgtgcatgacgagagagtacgtgtactatacgtacgtgacctggttggtacttggtactacgacgtggctagctagctgtgtgcatggatgggttcacatgaccaattgctaccagcatatcgatatgcaacgacacattcaagtcgatcgatctgacgggtcaattgaagcgtactcatgtatagtatacacatgtatgcccgtactgcaggtagtagttagccctgtataaatgtcgaccagaacgaattgattattagtacattgtaccgtattatctgcctgatgtatccccggcctgtggccccacatcgtcagatttaatacgtatgctactcagctgccaccgctgaattttctttgatttttttacagcatcagtcttaattaagctactcccatttacagataaaatatttatgtctgcatactattcactgtataaaagtcaaaagtaataatagaaaacagattacacaacttcagaagcattgaagacaaaaacaacaaattcgactttaaacagggcgcgtaattcgtagttaaatttatttttctctaattatacgtatcgaatttgaactttatatccccgcaaaaaaaagaatttgaactttatataataaagtgatgcgttacctattgatcgatctttcttaccaaattaatgtttctaaaaatttttatgacttttttagacgacatcgaagggccatcgaagggctagctggagtttctcaaaaaaaaaaaggctagctggctgatgaaagaggtttcttgtcacaatctgggagaaggtatacgtagctgtgagcagtgtacgtacgtacgtatgaggtatactcgactgtctacatcgacactacacgtgatctcctgcctttcgctcgcccatctcgatctgtatcgcgtctgtgtctctcaccggcctttcgctcgcccatctcgaaactggttgtttgattaggcaacaggaaaacacgaaaattggatgaaagagatagattcattttctaaaagattggatattttttttttaagtttcttctaaaatttacgtgcaatgagccattttataggaatttcaattttgaatgcttcaatgttttgtatcaaaggaccaagtacggaaattttatataagatttaaatcttacaaattttcccataaatcctttgattcaaatggatctaagtaaagtatagaggatccagctggctcggtttacaaatataaacgagactatgtctaggggtgtgtttagttcctgaaaaaagttggaagtttgaagaaagttaggagtttgaaaaaaaaagttaaaaatttacgtgtgtagaaaagtttttaatgtgatatgatgtgatggaaagttaaaaatagggggaaagtaaagacagcctaggattctagctacatgcactggatgagtatagacaagtaggagtaattaaataggcacttttgtaggtgcagccaggatcagcatctcccaatcccatggttgatactccctccgtcttaaaatatatatatagtaacgtagaatgagataaaacacatcctaaaacaatgcatctagacactccagatacattgttttaggataggtcttatcccatcctagattgctactccctctgtcccataatatgagggattttgagtttttacttgtattgtttaaacactcgttttattcaaaaaattttgaaattattatttatttatttttacttactttattattcaaagtattttaagcacaactttttattttttatatttgcataaatgtttgaataagacgagtggtcaaacaatacaagaaaaaactcaaaatactttatattatattataggacggagggagtatattttggaacggtaggagtagcatatgagagcatggctgtatgggcaactcatgctgtcatgcagatgcaacacaggccagggcgcctggcaaagcaatggaagcaactgaaaatcatatcatcgcgcaataagtgccaactgatttgtggatctcgtcatctcctcgcaacaagatcaagctggcctcctcaaggcagcgaattcatggttgtaagttgtagtaacatgtaaaaggccggtgtaggtgtaccagctaacgctgttaattaagcttactcttaattaatctcctaaccccgtgttcatacactgcacctgtgcttcgattttcagaaactcacaactaaaccggagaagacaagtgaactgatgaatcgaagcaccaattgggagaggtcagagttgttgctcgatctgtctcaacaacctcgaaacgcagaaaattgcagggcccccagttcgctgtttctccggacaattaatgccgcacacacacaggtgacacacaacatttgagaagggtactttttaccctatctatacatttaacgggatatatgcaatattttaaattagaaacctagccacttaaacaagtcgatttaaaattcgttcgtacgaagatttaaattcaaaactttaaattcagaactttaagatgcatatagaccttagatcactgtactaaactacatgtccttttgcacgtaagtgacacccgggcctgatctatacgtccaaccgatatatacgatctttttaaattgaaaacctagccacttaacaagccgttctaaaatccgttcatatgaagatttaaattcagatccttaagatactattcgcacgtagaccttatatcactgtaactactagattacggtgtccaatcgcacataagtgacacacagggccccaatgtgctctccaccttgccagtgcagtggtcaccgcgtcgcgcctgctgctttgccccccgcgtctcggctcagatcggcaccgcggagcagccggcggccggcgtgcacgcggacacgatccgcgtctcgtgcttgtcctcttcgcgccgccataaattccatggcggggcgcatgtccggcgacggcgagcggggcggacacgcgcgcggcgagcacgcgatgtcacgccgtggcgccatccgtcgccgcggttttaacacaagtttaaagcgttgtgatcagtggtgttagaatcaaaactcacgaactctcgctctcacgatctgtcaaccttttatcaaatgtgaacagttaactgaagaacagactagaacgagaatctctgaactttttatcgaacgtgaacagttagctgaagaacagagtagaacgagcagagttttggtgcagcgtaagcttttctggtttttctatttattctcctcgattacagactttgttacatgcataacagaaaaaaaacacctgattgatctggatccactcctgaccgtactcccacgatccaattcagtccaaccgaaccaaagaactagctagagaacagctacaggctaactgaaaagaaacggcttctgacagattctaacatagcttcagccacccatatggccatatgcaatgcaacaacggaaactagaagggatggaagcatataaaacgtacaccgaagcgtgttaattttacatcgcgctcgcgtcgcgacacgagctgtttgatacacatggatcgatgcgtggatcgtatccactcatgtcgttgggccgcggttgaggcgcgcggccgcggccatggacgcggccacgccgcccggcctcgccgccgcgccgggcttgttgcgcatctccgctccggccaccctcgccgcgtcgccgctctccacctccttgtccgccgcgagcttcgccgtcgcgttctgcatgaaccaatgttagtatagtactcctacctacctagctagcttagcttgcaagatcgatatgatcaaagagagcgcgcaccgagaggacgtcgccgagcttggtcttgtcggcgtcgcgcgccgtccagaggttggccacggcggcggactgcgcctgcgccgccaagccgccgggcatgtaggtgtccgtgccggtggcttttgcttcggccgcctgaatggccgccgcgtcgctgcgttccaccggcgtccctcctgccgccagcgccgccgcctccagcgcctcgccgattgttatcttcgcaggttcctccacccgtaccgcgccgggggcggcgccgacgactcctgcaaccacggcggcgccatcgtcctgctccacgtagtgacccaccgcctgcaaaaaaaaaaaagaaagaaaagggagatcgttcacgctgcacgcacagcggagagacgtcgatcgacgacgaagtgtgtgacctggccggcgacgaactcggtgacgatgcggccgccgccggggacgagggtgtcggagacgttgacgccctgctcggcggcggcgtccgtggcctggtcatgcccgacgacgcccatctcctcgttacgactcgccgcggactccatggcggcggcggggccgcccttgaccgtcttccccagcacgaggttctccgccgactgcatcgtcgccgcgtcccgcggggcgatgggcttggccgcgaggcttccggtcaccgggaacacgtcgccataccggatcccctgctcgccgccgccgccgccggccgccttctccgacggcctcctcggctgctcctggctcatcgtcctagtacactctcgtcgtagctagcactattgtagtgagatcgtgtgtggtctgcgctgtgaatgtgtgagagagatcttcgatttcgaggtcatatatggcgcggctcgccgggtagaacgggggacaggtgtgggagacggcggcgacgtgggcgcgttcgtgtcgcgcgcgaatgggagcggcatgcgtggcgcgtgtgagcggtgctgtttgttcgcttcttcctccgccacctctctggtctttccgggtgtcgacgaccacggtggcggtgcatgcagactaaactcactcccatgaacacgtacgctagctgtcatcggacgccgttggcggttggagactacgtcatcgtcccggcctggcccatattgattgcagtgtacgtgacaacttgcggcccatacttattaggcccgaacaggattgcgtcctctttttattgggctcgagcgagattgcggagtacgggcggtctatacttaggctgtgtccgtttctcccacaagagttggatgaaattttggatactagtggcatgctttttaagttctaaacggtgtgtttcgtgcgaaaactttctatatgaaagttactctaaaataccagattaatatatttttcaagtttgtaataattaaaactcaattaattacatgttattaccatctcgttttgcatgaaacacttaatcttaatcttcatcttcattttcaggagattcaaacaccacctaaggtgtatggagggaaagggagggatcataagtgaacttactgtcgcttttctagtgacgtgtggcccatacttattgggaagaacgtattgtacggactataaattttgggccgtaattgtgttacggtggatgagaggcccatttatatccacgcgattcactggcgaagcagaagctaccgccgccgatcaccgatggcgatcgccgccgcgcgccggcggctgtggcgcgggctgacgactgcggccgccgcctccgtaggggtggaagcggacaccagcgccttgctcgcgcgccttgtcgccgagcctgagtaccgcgtgaaggcgacgatggaggaggcgagcggcggctcctccgcggcggccgccttctgggagcccctcgccgccgccctcctccgcgcgtcgtccccgactaaggcaaacctcgtgagtgagacacccttcttctccccgcttaactgtcagttgagctgttgttttgtttagttagtatcagcgttatggcgcagagaaatttccccctttctcgtatactaggtcgggttcagatctgcgatgcatttggcggtaccatgatttagcttatagagtggagtagaactattggatcgcgagcttgcggtgcatgattatataatgcaaagagctaagctattgatagcctgatgccctgatatgattctgttggagtgagtacattggtgctgattctgttgtagtcttcatgacgattttaccgaattatacatgtttgtgcattctagtgagagatctttgtaattgcgtgctaagatagaatcaacattgattcaggtcttggaatggaagctagagaagctaatcaaggaagggatccgtgattgtgagccctactcagtgataatccgtttctgccgagagacaaagaatgcagaatttgcaatgaaagtctttgaattcgtggaggagcttggaattcagctgaacactggcattttcaatgcccttatcaatgctttcttgtcggtaggagatctccttgctgcaatgaccttatatgaggctatggaagacatagaggattgcaagcccaactccgctacatatg

SEQ ID NO: 64236 - DNA, 5268 bp, Oryza sativa
atatggtcataaaatgagctttctataagccaatttagaaaaacttgcggttcatgcaaaccataccatattcttctttcatgtaagttcagttactccctctttcctattttaaacttagtcatgaatttccatgtcaaattttaatcgttcgtcttatttatttttttcacacgtaaaatactatttatgttttgtcatctaataacaacataaatactaattataaaaaaaaattaaaattagacggacaatcaaagttaaatacgaaaaattatggttatgcttgaaatgcgacggaggaagtacaagttataagaaacagacaaacgcttgatttaaactgtactttccatcttgttaagagcgtcccctgtcaacttctcatcctcccatttgaaaacagagaccagaccacatccgagcgccggtcattatcacgaaaaatttcaaattctaatttcaaatcacatcgaaaacaacaacaaacaacaaaccaacgggttgggaaaagtgcaataaaccaatcaaaagctggtgcgccaccgcaccggcacaccacctgcccttttttggggtatttttttcacctcgccccctacgcttctccgcttttcactttttacccctccccgaaaataaataaacacccctcctcgcagttattcccgcccaccacccgcaacctgtccacgcatttcaaattaccgagccccaccgccgtcactggtaggtgggcccgtgcaccgtgggccccgcgcgtcagcgccgcggaggctgacacgtgtagtacagtcgcctcctacctccctctgcgtcgcgttggcgtctcgctttaaaaactcgcaacgccgtggcctctcgcctcttttggagcaaggccatgtgaagcctctgaccttccgataccttcccctcttccgccgcgtctcgcctccgcctccgcgcgctctcgccgtcgagctcccccgccgcgccgcgtcgcgccgcgcagcgtcgccttgcgggggggaggtggggggagggaagcttcggtttccgtgcgggatgtcgtcgaggccgtcgtcgtcggcgtcgtcgaggcggagcagctcgccgttctcggcggggagcaggcggcctccgacctcgtcgtcgtcctccgccggctcgtacctcacgggccgcctcatgccgcggtcgtactccacggcgtcgtccgtgtcctcatcctcccatttcttcggcggcgggggtgggagcgggggaggctcgaggtccaccaccccggggcggagggggagctcctcctcctccttggtggggccggttccgtcgccgccgtcgcccgtgccgttccccagcgcggaggagctcgtcatcgaggacacctcccgatccggggacagcatatccgtcaccatccgcttccggccgctcaggtgagggggatctgggagtgtgagctgcgcggatctgtttgcggggcgtggttgtgagtatttcgactgatttgagctggatttgggcgtggctgcagcgagcgggagatccagcgcggcgacgagatctcgtggtatgctgatggggaacggcttgtgcgctgcgagtacaacccggcgacggcttatggttacggtaagtactatgcttcagttgcttgtgcggttaatttggcaatgtggtgatttgaatagtacatttgagctttctgtaattttggggcttgggattgaattcatgggttcagccaatgtcggatgttcacagccgcagatttatgggataagtcgcacaatgctgaaatcactaaggagaggcttaggattttggataggcataaatgcatcagcgctgggacaaggcttgatgattaattgaaaattgaaaatgcagttcttcgttttgcattttcgcgacattttaagagtcagcttttactgtgaagttgatagccagctaaaatctaaaacactgcccgtgaggtttcattgccttgttgccttttcatgctgcttgtactgtggtcgtctttcagaagactgctagttcccgattgcaattatttggtatgctataagattaatgaaattgacatcaatgttttcattcaagaagtttcatggcctactccctcaaccagttattaagcatttgttctgtgctttctggcgactgtaattatgtttctggtcatggtcaatcaacttgactgaaatcaatgcaaaccttcaatgttcatattaagaacaatatcacattttgtgatgctgttctctatggtatcatctggtttctacttaataaccaatcatttttttactgctgtttcttttcagatagagtttttggtcctaaaacaactactgaggctgtatatgatgttgctgcccggcctgttgttaaaggtgccatggagggtataaatggtatgtcacctatccttatttagattgtccgacacattgtttcatgagttttccatttatttatatctgatggaggacaattattgttcgagagttactctatggtcatattgtaatatattatcaccatgatggcacacacttcattccaaactgttctctaccatatcatattgaacaaattacctttccttgtacaatgtttgttgctgttgtccatatcatttcatttagtgttttaacttctgagatgtttcagacttgcagtactgacattcacatattaactttatgctttacattgtatgttgagtttttttgtttatcaatgtaatcacattgctgagcacaaatctgtgccaacttgtaggtacggtttttgcttatggtgtcacaagtagtgggaagacccacacaatgcatgtaagttcttaaatcctacagggaaaaatccttggtctgttgtcataatgtcttcttctaggaaagagatacgatcctgtatttagtgattccaggttctctaattctctgttgagccgtcctgaaaacttcctctatatcattcctttgaatgcaatttatattttcaagatattctgggatcctcctattgcaagtgatcacagttatggttgtcacgtgtacattttcaatcatgaatgttgttgctaaagggaaagctcaattgtgatttatgaagacttgatcatttgatccatacttatatctatccatttatttctgtaatcttttgcagggtgatcagaattgccctggaataatcccattagccatcaaggatgtattcagcttaattcaagatgtacggaattaaatgctttacttacataatatttagccgtctatttttttccaaatatttacactgttgtagtgcatatttttatttgtttaaatggagaaacaatttacattggtttcttgttaaaaaaagtatctccaaaatatgcagtgctgtctcctcttgggatcctgcattcctgcttctgcacatggttaatgtccatgtggataataccgaatttgaactattttataaagcatgactcacatattttttgtaatggtccaagcccatctgaccataataatctcaattgtaactgacacagctttaaaagggagtctatgtacctttgtgctactgtgatggccctttctttaagattagctgcctgtcaacctttcatctatattcattttaaaaggctctagttgactagtggtggcagcagtgaatctgccaccccacctcttgccactgcagtttttataaattgtcccctgataaattttagtattagtattacaaaaaaatcctataaaaatgggttaccccattatataatcaagctgagcaccccctacataaaaaaaatggataatatatatgatgcaaaattatagtttatttatttcaggtaatattatgacattttcttttatctgtagcaaattactggcatttagctaaaggaaaaatattttttatccatttgtttgactaaaagttatagggtttaacgacttccagaagctgcaatcagtgatcataatgctctgtgttatgcaaatgcaatcctaaatcatataatttttgcacattccattttcttgtactattgggtgtacttttcactgtttgctacccaatctactttgttttgtcatttattctggatatcactcaattgctatcactgttttatcttaatttacagactcctgggagggaatttttgcttcgtgtctcatatctggaaatctataacgaggtattctacctcacagtccaggaaacgcatcattttgtaattttgatatatttctcccatggcattgcattttgtccagccccacttatgattactccacaagtgctatgtctcttcagttatttctgaacttgcccttcatgccttcaccaaaggattggttgatgacctacccagattgtgcataaaattgttctcatatatacatatagaatttactggctgcaccattgcccttgtaatccacaaccatttctgctggctatattcttctgtttccagctttgcagttagttactgcctagccttcatatttccaatcctatagtgtaaatactgtccaagtgatacctatgactatgggcagtgccacatttatttaagaggtcttgtcaaattttgaggtttgttagatttagttgtattctatatgtagttatgtacattcatctcaatggatttaatttctctctcattgcaggtgataaatgatctacttgatcctactggccaaaatctgcgtgtgagggaagatgcacaggttaatcctctacagcattggttatcatgttggcatgtacttctatataatatcggtgctctaatttatttgtttgcataccccccttgagatcccttcttttgctttcaactgttacatctaattgtcctttttaggcaagtaaacttctcttctgttgatatagataatgctgtagcagacaaactaccttccttcagaccttgtttgttttatcatggcacaatggttcttttaaaagttctaaacttctaacggaatatttagatctctatgatatcagaacagaggatttgattgttgtgtagtgtgtactgaaatataaattcactcctattttgatgcgtggaaacagtttgtgcgattctcattttgtaatgaattcgttaaagtcaaaatgtggcctgttttttgtggagtgccatttggttcagacattgatgaacatgaaaagtttttaatcattttgtaatttatattcattgtgcgtgtcataatattttcatatctaactttgcta

SEQ ID NO: 64237 - DNA, 26551 bp, Oryza sativa
  unsure (1)..(26551): unsure at all n locations
gttcagctcttccttgggcaaaaccgctgtagtcacctttcctgcaaactcatccccactcggctgtcgctggatgctactctccaactgctggactttatgattcaaagtggcgagatcagagctgaggatctctacctttttctccactgctggaagacgaacttcgagagatttcttgagatcggcgaagtccgtgcgcgtgcgcccatcaacctcctccctcttcttctcattctcctccatggtccgcaatagcaggtcaagcttgccctcctgtgccatcagctgcgccgcctgcttcattacgtacctcggcttctccaaataatccggcttctccagggttctcgcccaaattcgccacactccgagctcagctaacctggggaaggcaagttgccttttcgcggggtctgatccgaagaacagccccaatccctcccccggaatttcacagccaagccaagagaattgggggcgaaattttaggctctgataccaattttgttagctactcctaacaaagacacaagaacagttggacacgagtggatacgagaacacgatagataggtttcctctcgatccgacaggatcaagccgccgccgccttcgcctccgccgtgttctcagttcatacctttcgccatcgttctcctctgtttaatacaatctcccacaacccgtgacagctgtcacagcacacgcaactcacacacgccatcgcacaggatggattactcacttggcccacatcggcccattaacacgaacactgggtcgtttagcacgcaggccgcgccccaggtcctttcctgattcacctccctgctgtagctcgtcatcttctttgtcaactcccagtgcaactgcagacttgtcagaccttcccgatgtagttatgccgcttggttgggatggtctgacactaattcatcatacggagcacacatgtcagcggcatctctctttctctttcccctcctctgccacgcccttgactcgcgatagctccccttcctcgtgccctgtcaccgctaatatcaccatcgcggcctacccagccctttccacacccgactttgacgcctccgcgcggggggggggggggggtccggatgggatggcttgatcttgagcatgcagaatggcgacgaaagagagatgtggctaacatgtgagtctacatggtaactcagttggttggaccagatcaacaagcccacgttaataaaccaccattgtcaatccttctcaagagttaaattatactaggtttaatagttagaatgtcgagatatctggtattgcgattgagtgatacgaattggattagacctataattgagagaattaaagtggacttattcgttcattcaaacagggaaaaaggcccatctatctatatgggctcaagggtataactgagccatctaatcgggctagtttacattgtcctttcactaattggacgtgcccaacttctctctcaaaggcattaaggcccatgtgcgacatcctctgagaaatcccataaattctggcccctgtatcccaggaaccaatctttggatcagcttgagattcattctcgagaattgtcaacatgtcatcctcttctccggccaaccaccggccggcgcgcggcgacaaggctactactaccatcatcgccgaggtgcctatcgcgtacgcaaacacgcacggtaaatgcaaccaaaatctcacctcaccgtgattaatttgtcgcttaatttcaccttctcctgtttgaacattgcaacaaccgatccatctactccggcgctctcgcaagtcgtaacctccagatcgattgatccgatccatcatgaggatttgcacgagaagcttcacgtaaaaaaagccccggccgcgaaggctttcggctcctactacgaaccctagcctctcagctcacctgtcgcgtcgtgtcgtcatcggcatcaacaaaaaacgcaatcaccggagtgcaatagaagcaaagaacgagcatcctgacagattaatcagctagctacagcagtagggtttctgtagatcagaatgccatcttctcttgtactgatccgtgttctgcattattcgatatccatccatccatcgattagcagcagctgtgatcgcttttggaagattgcacagtggtggtaattactttcaggtatctgatgatgtgatgtctcactgtaaaattataagcgtcggcaaccgctcgttcagtttggctgtggatgagcagtaaaaatcacattttctgttggtgtttgattgctcgctttgaacctgaggacgatatgcattgcttgctcagttcaagcaccagccaattctcaccatctccagtctcctccctcgtgctgtctcccactaactgatgacatacacagagagaaaaagatagaaaagatgcatatggcaacgacgaccactgtacgaagtgtttgtgattcgttcgatatcgatcgatcgtcattgcaattttgcagagacatgatctcactcgatcatttcatctcggcgtgaggtgaggggggagaacaaaagggagatcttgaggccagcaacactccgaggctggccctagcttagctcaaaactgagtgattcctggcctcaagttgtacacatggatgtacattctttttgtgtgcttttgttcagttcatgtgcagtacttgtgcatgtgaccaaccaacctgtcaagaacaaatgctctctgtagtatgttcgactcgaaagaatgatcagtttttgccacacgggtcacatcctttctttccatggaccatagcctcacatcttgagcttttactacattcaggcttcgaaaaattcagagtttcaggtctcagaattgcagctatgaaaaattcagacttcagggtttccctgctctctcattgggtctctactcatcagcaaatcacaaggcatatggatgcacaaacaacagatggttcagaaaaaaatactcaaagtttcaggttcttctacctaccctgctgctcaactactgccatgcatgcgttctttgcaagttgagccatgatccgatcaaaaatcctaaacgaaaagcatcagtagtgtcctagtcatggccgtgcttgtgcgtaacacagacacaacacaattccatgtgcttccaagtaccacaacaccatggccgctgctgctgcagcagcagctagccattggcatcatcatcagctagataattggcccctcccatgagcacaaattctctcttgcctttttttaaacacactttgtgactctctctctctctctctctcatgggcatcattggctcgaggaagattgatgatgacaattgacactaaacttttccctcatcatccactttatcgtcgacttttcggtggtcgctggtgatcagcatctcatgcacgccggagccagctctagattaatcgggccgatcgattcgtcactgtcatacatttgacaaatgctaaagcaacagttcgatcgatcggtcttttcttaattagtaattgtggcattctaaatttctaacaacgcctttcgatggatcgatgggtaatgcaaagaatgccaggtaactcatctttgatcgatcaatgcctaaagaactaggcaatcatacatttttttaataggatataatactttaccttttgtgtattgtttagtgtgatgatacgcaaccaagtgctagaaacactccattaaattataatctactgaatagttaattgactagagagttggtgagaaattattagttttgcggagacaaaaatattaggggtttaggaggacgaagacaagctgtcagatagatgttctcgcttgcagaggaagccaggtatggtccaaactctgcacattgccagcaaaacaaggatcatgtactgtagtctgtacaaaggatagatggattggttggcatggagcaatggagaataatgatcgataattgatgccgttgtccaatgtcacctatggaatctgacgaaaaaaaaacagcaggaaatcaaaaccggcctttctgaattaaattcagtacagtgtagtgttcttttctgaattctgaattcttgatgcctactagagtactgccaaggcatgcaatgcatgcaagcgagctgatcaaggagacaaactgaacaattaggtcacacgtatccgattgctctgggggccatgtcgtcacatcaccattaatccatattatcgtcgtcgtcgcctatgatcgccaggagaagacaagctaagctaaacctagacagacagacgccatgggggggccattgccatggacgagagacctcgagaatttaatttcttcctccatgatttgggccctgttcttttctccaacaaaagttggataaacttttggatactcgtggcatgcttttcaaactgctaaatgatgtgtttcgtacaaaaactttttatgtgaaagttgttctaaaatatcatattaatctattttttcaagtttgtaataattaaaactcaattaattacacgttattaccatctcatttcacgtgaaacacttaatctttatcttcatcatcataacatgcaaagtttcaaacactagcgcaggaaaggaagcaaagtaaaagctccaaacctgagcctcacgttgccgcacgggccactggagtgtgggcccgcatcccggtgtcccaggttctctctctggatcatcagagttgataggattgtgcttcttccatgcgcgcatgatggccggagttcgccagaagaagcggctgcggcggcgaggaaggaggtcggtcggccgcatcctcgccgcacgttctcgtctcggatttggggtcaggtcaccaacctcacctggagctggggacctgggggcaaggtgggggggcttgagcttttactgtacctgccatggccggggtcaatggagggaatgatgcaggtgtgggtgtggttgtggtgggcgccgccgttttcacatgccaacatccatgcattcatcgcttccaaactcccaggcaaaggccattaatggcggctcgcttctctacctttcttcatggctactactggtagtagtaggcagtattagtccctccatccaaaaaaaaaaaaagtaaatctagaactgaatatgatatattctagtgcaacgaatttatacagatatatgtctaaattcattatactaggatgtgtcacatccagtactatgttggttttctatgagacgaagggagtagctccttgtgaacagtctgtgaaatcaaagtgtagttttttattattaatttgcgatgaataattgacatgatatataattgattttaatatttagtgattattagtgaagtggtgatctccgtttggagcgggtcagactacataggttaggtcggttcaactggcgtcgtacgtatgtgcggtcaaaccggcaaaaccgacggtttgatcggctggatcctgattagggtcggttttcggattgtttattagtatactcgtgataatgagttctagatgatttcttcatgtgtgtaatattgttttgtgctaatgttgagtcaagttgagaaagaacttgtgctcggatatggtttcttgtttgattcatgtgtaggtgtgtcttgatgccttgggagagtgttgctggtgatggattgggaatcaacttgaaagaaggtgacgcccaaacaatcggaatatcctacgggatgcttaggctagaaaaacaatgcatgtagttgatggagattccatgcggcctacgattgaagattgtgtgtgtatgaaaagcggagtcaaattagggaagagtccaaatttgggaagattgaaattcgaattgtgataagataagtttgtttattgtaggggaagttttccaatggattaggacttcttgtacaagttagattcgtgactctaggctgcctacctcgggtatacttagagaggggttgagaccttttggtattaattttgtgggagttaagtttagagaaaagttaggatttcgagtttagtcgaattttgtaagaggagtgttattgttacactttgtaaacacgaataaaagtagtaaagttcaatctactttcaagatattttcgatttgtgttttcttgggtgcgatggtcacatcagcgggataccaccataccggtggtcagaccggcggtaccacgatggttggaccggatgcaatgacaagtgacgatgacatgaagggtggtcggaacagctaatcttcttcggtcagaccggcgacatctatgtgatcaaaccaatgatcaggcaacggtcaaacggatcttcatcgaatcttgagggtaacttttaattccgttaagagttttaggttttttgtgttactatcatttgccccttccccctctggtacgtttagttattgtttttcaatcctacccattcaatccccgacccttgcgatcggtggagggggatggtcatttgaagtagcaaatccgatttcctaacatcaagttacatggaaaaaaagagaaatttatgttgtacggagcggataatagctgaatgattttgtgatcaccattccaaggtatagtgaaattaattaagtattatcaagttaaaaatgaatttaaaacagttttttttaaaaagaaattcatatatagaaagtttttatggaaatcgtgccaggcatgtacaatggttgtcaatagtgatctcttagcgttgctaagtaggaatacttgttgacatggaggaaagagaaagaggagagacaaaacatcgttgttatgtatgacaacggcttaacaacgactcttagtcactataatatggaaaaatggttgcatgaggataaacatatggaaagaatattaacaaaaggaatattttttcagttaatgattagagcctttgtcgtctcaactattgtaaagacatggtctctaaataatcttgtattgtttaaaagaccatacccgtctctaccattgaacatgcccaaaagctcagaaagcgtgtctcattcatccatcctaatggaaagaacattccccgtaaattaaagtccagacattccgttcatgcacgactgcacgagaatttctaccaagtttgtctctctcttttttttcttttggaagctgtagctagtaaattaaccacttggcaattttttggtcaagaacgcacttgctgacatgcacaatacgcactgtcaatttctcactgcagcgggttggatggatgctgtcggctactctatcgatttggcaaatcaggaagagtgaatgacgagtggagtaaactgtaaaagccaatctgagctcaataatcttccctttccggcatatgcatgcacctgcattttcctctccatccaagagagaacaagtgctccacccctcactgattcgtgtagtgaatgccacaaaagagctaaaattaagctaatctagctacccaaccagcttcgaacatgtttaagaaacttaagattctgagaagcagattctgagaagcagctgattgatagtcggttttaagaatttgaaaaaggtgggttcttcagtttataaactgacttctagttcattttttttattctacaactatagtttcttagagtatggatcaaaaactaaactgtttagataagcttcttattctaagagaaactgtagcagtcagaagctccctaaacatactttcttcattggcgtaacggcaaacaagctgcacacggcgccaatgacggtgaatcgatcccttcttcttttttcttttttttttggcagcgacccgcgtgaattctcaggcaggcacacggtaactcgaggtatttgtcctcctcatattggctatcacctcaaaagtgttcataggttcaggtttcaggctgctcgcccaagaaacgaatcgtgtgtcaacatgatctttgattcttctctttctcttcttttagatcaccaaagcatatgattttgcaggccatatgtaaaaaagcgtacataaagcacggattatagtgccttagtgggacaaaattggtgctaggctctgtttaagtgagagggagactctaccggtgagattcggaaaaatctggtaatttcgatattttttttgtactatgaggattttgacttctaattcacttttttgattctatagtttctgatacaacctaaatgaaaaaatgaattgttttggaagctagttgaagaaactatggccgccagaaattccctcaaatatagaggtaattttaccatacttagaaggtatcaagagataacatattttctaatctaaaatttgatacctttagatattaagtattttaaggtattgaatattttaatgtaaaatttaggtatcttaagatatttttttatggattataaaaaatttctccaaacatagccttagccgggctaagtgctataggctatagctgcttgcttaattcttcggttgtaattttctagtactatgcaatgatgatcgatttgttttgggccaaattctgagcatattctttttgatagtgctgttattagcagctaaaccaataggttatgcacttatactgggctcaagggcaaaaggccttgccaaaggcacaaatctggccgtcactttacgcacttggatgattcttctcctgtaatccgaccttatcaatagcatctgcgattaatcagccattgaatgattaatggtacgaaaaaatgaggtttaattcgtttgactcgagcagacaaggacgcatgcggctgcctctgctagctgctgttctctgctcagactttcagagattcagctcagtttcagccattcgtctcgcgatgttctggcgatcgtttcgtggccatgagctaatcctaccagtactagcaattcactgttcagcaacaatcgatgcattgaattgtttctacatcagtagagtacagagtttctttcactagtggtgtaaatgtgtgtgatcacatcgattggatgagttcagagttccacatatcatactagatcatgacattgtgataccgtggtagcattaataccactagttgtcatgctcctacacaataattttgtatggaatgctgctcatcaacaaatcaggtaagacttaacaaggttattagcaccgacctgaacatgtgtggaaagatgcattataaatgatttgacccgaccaaattgattaagccacatgtccagttaagcaggagctagtatagcatgaattgattggtgcatatatatgcatgcagtcttggaactaagccaagcttgataaagatgggacaatcatagcaggatcaaagtggagaggagactgatcagctctcatggcaggtggtagtagtatgatatgagtaggacacaacatcactagccaaaatggtactactcagatatccacactgtagtagtggtgggagagagatattggagctagatagccccattcctcttttgccatgagttggagttgaaagttcactctgaaaaaacagattttcaaaatcttcagtactttggctgccctcctgtttgtgcttattctcattcgcgcgcttttcggtcccagaaattctacgataatttttcgttagtcttatacgttatagcccgattttttttacggtaaaaagtataaaatcatgtgtttcgaaggagacttggtctgtgtaacatgctgtgtatatggtagcatgttttgccactcggtagctctgaccatttgctggcacacatgacaagcatgcaatttttataccagttctaatgtttggtatattcggatttaccggagtcatatgtactcggttgttggtgcatgagtcctgtgtgtgtatcgaactctgcgtgagatcatctcttgtattgtttcgatcagatcgcacatgcatcccaatattttttggagaatgacgattaatcaaagcctaatgattcatgttgtcctagcttcatacaaatcgatactacatttaaaaaaacagtattattattgataagtcaataacggctggcagcattgcatagatatggtaaacaatgtgggtatcacatcatttaatggttttttcatggcaaatcagaagtcaaaagtcaaagagatattttggttggatataaaattcatgctaaaaatctgttcagcatttggacccataaattgattctttttttcaggaatttttgtgctgaaactgaatgtgcaaaccccactactgcatttgagggacaacatcatgtactactggtgctcacattgcaaaacccaaaaatacaccctcaaagtcatacaaaaattacaaaaaaaaaatacatttacaatatcatcttcacaatatatatcatccaaattgaaagatttaaacccaaataaagaagagcacactttgtcagaaatgtaccacaccaatgagtgcatgcatggtttctctctccccctcttcttttttcctctcctgagctagctattgggcagcctctccatgacagtttgtcctctttaactcatataaaatacttaattattagtactagttacttcacaaacttacaaaattacagctactgcttcttctgattaagctgatgcgatccccaagcctttttagtacttcgcgttgcattattcgggcggagcagttgggagatacctcgctagcagtggacgccattgacctcgatccatcgcctcatgtgcgcacactacgcctatatacagtcgcaccacacacagctacctccaccacccaaccccccaaacacctagctcactgcatcttcttcctcctcctcctgatcaaattaatcatcgtctcctccattgcattcttgcatccatccatctagctagttagtgttgttcttgttcgtgttcttgttcttgatgtgcattgatctttcttctctattgatctaattgttcttagattgagagtgaagttgtgagagagctggacaccatttctctcatcaatatcccttagccaaaccttgagaaaagcctgtgaagcatgtaagaacacaccagtttgttccatccaaacccaacccaaaaaagcaccaaaaaaaaggtcatcagttccaagtcccaaaagcattgttctttcataactaggcatctcggttaattagggtggatattcctccactaatcccttagcgaaaaatctacaaaaaccactagatcatgtaattttcggcgaaatcattccacccccagctgaagaaaaaaaaacaaaaaaaatataggccaagagaatcatattccagcatgcatcgttagctagtagccatcatctcagtcgcagtccggtagtaatactggacacaatcctcccattgctgtagcatttacctctgcaaaagccatcaaatcatgtaattagtagctaaaaacccatcctatttctacctcatcattcgcctgaaaagagaaaaaaacaagaacaaaaaaaaaaagaagttgcaagaagaggagagcaagaaagagttgatatattaatggagatggcggcgccgaacgggggcggcgcggcggggatgtcgtcgccggtgaacggggcgtcggcgccggcgacgccggggacgccggcgccgctgttcgcggggccgcgggtggactcgctgtcgtacgagcgcaagtcgatgccgcggtgcaagtgcctgccggcggcggtggcggaggcgtgggcgccgtcggcgcacggctgcgtcgtggagatcccggcgccggacgtctcgctcacccgcaaggtacgcgcccccatgcacatgacgcccccacgtggacacccaccgcttctttcaattccctcctctcactttgggtgttcttagttcacgtcaaaataatgtgatggaaacattgaaagtttatatgtgtagaaatgttttgatatgatgaaaaagttagaagtttaaagaaaaattttggagctaaactcggtcttcgtctcaaaataaatttaggcacctttctttcttctgttgcttcggttcgttttaaaataaatcaactttaagcaagaagtactctgtaaaataaaaagaaaaaactagtatcaggtttacaggtaggattgatttttttttctttttatggaggggatatacatgcaattatttgagttccatccatttttttttaccttttttaaagaaaatgtttggacactcttagctagctctcttctcccactcagctatgtgatttgattattcagtggattattgctgaggactattggtttgatttgtaggtatgaataaaatatttttgaaaataaatttaataaatagctccaaacaagagatataagcaatataatgaaaaaaagtttttcaacatgactaaaaaaatcgtattttttgagcgtcgagcaaataatctatcaataattgggtaaattaataagctggatataacatgactaacccttcatcttttaacctttttttgtatgtttttaaaatggttttttggggtgtttttgtactatggagttgaacgtgctggtactttttggtgtacttttactctgcttctgaaattgtgcgcgagatgtcgtagacgtagtcgtacgtacacaaccagcacggtataatgtcagagacatgtactgatgtacaaacatgcatccggtacaaaaatactctctggcatccatctgcttcagaaaaataaaaataaaaagtcagaggaactgatcgatcgtcctattcctagcaggaattttttttttcagtgcaataaatctggattttttttttacgagacaaagagagtatacacaacagacaatgaaacacatgatttttgtttgtcacgaagcttcagaaataaaaaagtcagaggaactgatcgatcgtcctattgctagttgctgaatagtactagtatttttttccgtaatatacacggtatattatacggccaagttgggtatgatccaatgtccttttggttagttttaaattactaggtgccatttctaaataagtgacgattaattagtctctaagaggaaaaaaattccgtatattccccctaaatattgaacagtttctccccttatatttctcttcttagaaagaaatcaaaaataaaaatggagggttgatatatagagtaccaacatgctcttctatttggccaaagtgctcattcagaaaaccatatatcatgcaaaatcattttttaaaaagagcaattctacggtccttgaggtaccaaaattttagtgtaaaatttaataactcatggtacctcatagtacctagttaccaagaggtaccaaatttacaatagaaaaaataataactcatggtacctctttaaggaccgtaaaattgctaaaaaacgttatataacggtggtataaagtttggatgttacatggggtacatgtactttttgaaacgaaatgtgttaacagtgacgtatggagacaaaagagcaacatcacactgacgcggtttcagtaggtgattaattaaggaagtgacagtggttagatctgtacttacacagtgctaacacactggaatcaggggtgccgtcagcagagctttgttggatccgaacctgcagactcaaaattttacacaggtccactctggcaatggtcctccgtgagaaattttaaaatattctgacgattcaagcaaccgcattgtattcagtgtgtttcaaacaaacctttaaaagtttcaaaattcagttcgaacgttgaaatcaaactcatgtgtggtgtgtgaagatattgccgtcatcaaacttacggagtcatcaattggcttttgcttatgcatattcgtagtttttattagcaaacaaataaaaatttgggagtaaaaattttaacatgttcttagtatttaaaagctagtgttgtaaaatgaattacgaatttcaaaattaagttttagaatttaaattttagcttataagtataagcataagtgaagaaaaccaataatgatgttataacgaagttaaaccaaattacaatgaaatacataccaaattaccgtggaactcttatcttcaaaacaatcccttaggacatcaccaatgtatatggcaaaagtggtctatatagatgggacccatataataaactttaactatagcaatcctcacaatgtatatagatacaatgtaatattaggagaagacagagaagtagagatagataatattatttatgttactagatggctgaatggaatagtttatttcctatagactactttttgtagtacattgtggatgtccttaatcgaaggtccatgtactccatttaactaatactatttatcttgccgtctacaaagaaaacacgcaatgctcatctttggaagctgaattttatattgtcaatgatcactgatgggatcaaacagtacagtactacctaaggcgattaggtcctagctagcctacatcatgtttgattaattttgtgagtataaaacctgcaaagatgctgaattttcttggccttgctcggcgtcagtcggcggcggcgcgcgtaatccggcggtttgtctgtcaagtccgcgtttactgttcacgccatccctgtgtgtcccataacccatcgcaatttcagaaatccagaactgatgattcgattaaaaatttggtcatgttgtactccatttggagtacttaccatttggaaaaagaaaattaaatactactcctatcaatggcactgttgaagtcgatgacaaaaatgcattttttaaaataaaaaaacgtgcgagcgagaaagtacaatgatttttggtgataaggttttttttggatgtgacatgagagggccgtgtccaaaattcagagttgactcaacgatcgcttcgagccatccatccgtgaggagagagtggttgctttgctatgtgcctgtcatgtctaatctgtccctggttttcgtttctttttctgggagggtaatcagttcatgatttgacataatcgccgcagaattattggttcatgattatttgcgaaaagcgcatggttttagtgtaaaatttcaacgggacattgctgtgtgattcttttggactaaaagcgggtaattttgttatcatgcacagaaacaaaactttataaacatatatgtcgtttcagcttttgattagtgcctgatgatcccacattcctactgttctttttgtcacgaccaaaatctcgctaaattcagaagtacgcaatcacaaacttttgtgtctgattacacctttttgcagtttagcattgccacataatcaatcagacgcacttgaaagtatccatagacttttggatggacttttgaaagtacttctgaaactgaaatgtccagctcaatttgcttgattgatcaatcaaacagtaaattaatcatcaaagagagagtgtcttaaattgattgcaaatttacacgattcatatacagttacagttatggtgtgtttagtttttaggtgtaaaatttttgaagtatacggacacacatttgaagtattaaacttagattaattacatattccgcttgtaaactgcgagacgaatttattaagcctaattaattcattattagcaaatgtttactgtagcatcacatagtcaaatcatggcgtaattaagtttaaaagattcgtctcataatacatacaaactatgcaattggtttttttcccatatttaatgctccatgtatgtgtctaaatatttgatgtgatgtttttggccaaaatttttttagatctaaacaaggttttaactctattatgaattcactttttttttaaaagagagctccactatgaattcatgaactcgtaaattatagtaatctgtatgagtgtgttaattaagctgggagattaacgctgaacaaataattaaactgcggtgcagcttggagcggagttcgtggggacgttcatcctcatcttcttcgcgacggcggcgccgatcgtgaaccagaagtacggcggcgcgatctcgccgttcgggaacgcggcgtgcgcggggctcgccgtgacgaccatcatcctgtcgacggggcacatctccggcgcccacctcaacccgtcgctcaccatcgccttcgccgcgctccgccacttcccgtggctgcaggtcccggcgtacgtcgccgtccaggtgctcggctccatctgcgccggcttcgccctcaagggcgtcttccaccccttcctctccggcggcgtcaccgtccccgaccccaccatctccaccgcccaggccttcttcaccgagttcatcatcaccttcaacctcctcttcgtcgtcaccgccgtcgccaccgacacccgcgccgtcggcgagctcgccggcatcgccgtcggcgccgccgtcaccctcaacatcctcatcgccgggtacgtataatcctcttcctcctccttgtagccaggttttaatctttcagtttgaatgtttctatcggaacgtgtcgatataccgaaatttggatcaaattttagtcaaattaagcaaattattaccaaaataaaaaaaattggccgaaataatcacataggggatccaaaataaccaaaattttggaaatttcatttcagaatttttgaaccctgctcgtagcacgttactgcctctgtgttatattgcaagtttattaaatttatataagaatatagtaacatttctaacataaataaacatattaaaagttagttttattaaaaactattttctataaatttggaaaaggaaattttgaaaaaaaaataaaacgacctataatatgaaacaatgagcactaaaaatggatggatttccaaaaaaaaaagaaaatttgaaccatgccacacaaattttataaattttgtaaaatttgtgatatgacaccctgacccacatgacattaacttatgtggttcctacgtgtcattgagatacgggtggcatattttaaattttacaaaattagggtgtcatggttccaacaaacaaaaaaaaaatggatggatttgatctccggctaaccggcggcgtgggtgcggtgcaggccgacgacaggagggtcgatgaacccggtgaggacgctggggccggcggtggcggcgggcaactaccggcagctgtggatatacctgatcgcgccgacgctgggcgcggtcgccggcgccggcgtgtacacggcggtgaagctccgcgacgagaacggcgagaccccgcgcccccagcgcagcttccgccgctgatccaaatcatatccaaatccatatccataaaaacaaattattatacacgacgtagttaacctgaacaaattatatggcttccaattaaaaaaaaatcagtcgtgtcatccttgggccttgttccacatgggccgaacaccaagagaaatccgcgtgaatatgggccgtgattttggttgaaaattttcggtccattcacgtagatgggccgggtttgaggccttttcaaatgagaccttgggggcgtgtaataaaccccgttttgcttcgtccagaacggcagagtataatagttcgagttgtgtgtgatgtgtcagaactcagaataaaaatgcacgccgatgcaccggggtgatgggcatcttgctgtgcgaatggtgtaaggttttatttaatttcctatttgacaaattgtgtaattttccctgttccgacattgataattgagaaaaattgtcccaaaaactgcgtagccaactgtcagtgagacgttaacaaaatgatgatgggatctctgcaatgtatactgagcaaaattgtgcttagactatgtgtgatgaaaatatgtcccctctgctgtaaatccatgcaagatttgtgccagtatataccactcaaaacgatcttagtaatctgaattttcgggatttctcctctctctttttttaattattcctctagatgtcatgcttggattggaatttcagtacggcgctttatttaccatacccaagtggttttgttcacatttttccattacgtttcggtaagtgaaatagctaaaacaggtgataatatgggggtcggccccctgactcccctgcccaacaacatcgacaaattagtaatccaatttagatgggtcgtattagtaatctaaatttctgaactttttcatatatgtacaaccacataaatttgtgttggtttcgaatttcaatgcagtgttttcatagtgaaacagccaaacatgtgaaaatatgggggtcggagtccaattctccaaaccccacaaactctcctgctcaacaacaccaacaaattagtaatccaatttggatgggtcgtattagtaatctgaatttctaaactttttcgtatatgttttttttttttgagaaaaggcccaaacaacattaacgaatccaagtccaatttagatgggctgtattagtaatatgaatttatgaatcttctagtttatttaaaaccacataaagttgtgtttggctttgatttcaatacggtgtttccaaggttaatcaaccaagcaagtgaaaatacgaattaattttgaaagtatattgtgttttttcttttctcaaaaatattgatgtagttttatcgacacaaatatacagttggtattgcggtcccgcgcgagactgctcggtgtcagtcttgcatgaccaacaagcgagaccagccagcatgctgttcttggacgctaatcaatgattaattaatcactaatcatttcatttccaacactctcgcaggctgataatgcgagactgctcggtttcgcaccctctccgcgcaagaccaacaccacgtggtctcgtgtcctcaccgtgcgagaccacccacgtcgtcactccaccatcactttcagcgatatcgaagatatatttgtgacaaaaaaaccgcatcaagaatatttcagagagaaaaaagaacgaagaatatattttcaaatttaattcgtgaaaatacaggggctcggagtctaattcaaagtactcaacgacctcccaaattaggagtccaaatccatttaaatgggtcgtaatggctacccggcatctctgcctgtgtattctgggctttccagcactggttttgcgttgtagtgggccgtccttgctgacaaatggatggtgacaaatccaatggaactgatgaaatgctttactcgtcgctaatgaaattccattcaacatctactcgaatagggaaaagtctattttacacccttgaactcttatgcgtgtctaaaatacacctccgaactacaaaaccgggtataatacaccctcgaactgtcaataccggacacttaacccccccccccgggctgtttttaccgtggtttttgccacgtcagccctcaccatgtcaacacacaaggtaatatgggccaagcccatactctgttcattcttctctccctcccctgttcgttcctcttcctcacgtccgctagcggcagcagcgcggagctgctgcgagggcggtgacggctgtgaggacggagctgcggcggcggctccccgttccacacgtggccactaccagctcgcgaccggctacggtgttgagtctcctccgcgcgaggggccagtgcgggtccctcctccacccgcgccgcctttgcttctctattgcgccagtagcagccgcaaagcccgaggccgtcggtaagcctccaggccccgctcctccttcccctcgcgtgcatggtgctgaaccgttgatatgtgcgatgatatttgtagggacgaccggggaggcagctgcggcgccggtggaagagctcgcgaaatctctgcagggggtgcagggggtggaggtgttcgatctgagaggaaaggcggtgcccgctgttgatctgtggaaggacaggaattttttatcgtgctttgtaagattgattgtgtttgagacgattgatgatggttgtttgcatgtgtgtgctgtgccataagagggccgatcttcttgtggctaagcaggatagtttagtggccgattcctctctgcaaatttcgaggaacaaaggaatacatcaaatgcttaaagtgatgcattcttctactctcttttttttttcaatctatcaggttccatttacaaaaacataaaatgttttcatattcaaccttcgcagcaccgccgccctcgcaacagctccgcaccgccgccgcagccatcgccggcctcgcagatccgtgccgctgccgccagtggtcgtgaggaagagaagaacgaacagggagggagagaagaacgaacagagtatgggcttggcccatattaccttgtgtcctgacgtggcgagggctgacgtggcaaaaaccacggtaaaaacagcccggggggttaagtgtccgatattgacaattcaagagtgtattatacccggttttgtagttcgggggtgtattttaaacaagcataagagttcgagggtgtaaaatggacttttcccactcgaataaataataagttttcagttttgctcttcagatctacaaacctaaactttttatgcgtttctggaaaattagattgttcatgcacaaaatgtttcacggccactttagctatggaaacgttgtattacaagcagaagttcttttttaaggcccgtttattcgtataaatatttagaagcaaagtacatgggtgagagatttcactccctagatggtgggtacatttcactccttcataattcaccagccataggctgtaaacgtgtgcttcgatcaggatctcatctaaaactctgctgtaaacgaggttggaagccttaaaagagaaaaataccacctatatatgtaataagaaaaccccactctcaaaatttttgaaccgtgcacgaagcaacctatcattttactccacttctcccatatgcatgtgagcgagcgcaaggtcgcttggttgcctcctccactgcctggccttgcccgcatcaaaagacatcaccaatgaggcccactcaatcaacctcttccctcctcctcctccccaagctaaaggcggcgagtgtcccaccccaccatcttcccatattgttggagaaacacagccaccgtccttatattataactagtcaattgcaatccctactgttaccgttacatcattagctcaccgccggttaccaaccccacagcttcgaaggtggcgccgcccgcccgttctaacgcctcccatgaccaactggccaaccctcctctccgcaccctcccactccgctaccgatcgccatggtcatcaaagctaaaggaaaagggtcatcagcgctggaggagaggacgtaggctcatcagagcactaatagtgaaacagatcttgaagttgaaagtctgtaaattttttggctcaaaatgtatgtcagatgtgatttagcaattaaaaaaaaaggtctcatccagttccgtgaacgttcagaaaacgttttcaccacgagaaccagtttgggagcgacgtatatattcctcattcgcgagtcgcaacagcgcgattgttgggcgctgcacgcaaagaccaaaagcgggcagtatacacgcacggtccaggctagttctacatctactaccgttccatcgccttcgccaccgaacgatccgtggacgcgagcgtgatcaggtggccgagaccacgtgctcctcctcctcctccatctcgtgtattgtggctctcgtgcagcgcgcgccccgaacagtagaaaggggcggatcgatcgactcaccagctgccccagctgggcctgatccctcttcgtccactcgttgctgtcatcgcgttgtgccttgacatcgtcaccatcctcctaacttggggattccgatctgcaccggccgcccggcatttggtgctgtcccgtctttcaggacggatcacaaatgcgatatggtttactgtacggtttactgtgacctctgttttgtgtactagtttcccttttttttcaaagactatgcacgtgaagtgtaaccggttgatggatgctgtcaaatgtttccttaaaaacatcaaaatgtctcggaacgtatntcttaaaaaaaaaaagatatttncccatatgtatggttcttttttttttggggtggtactaaacggctataaaagaactctacttgtgatgacaatggaagatcccgtagatctctanaacctgctattattaacaattgttgtgaactttgctagcagtgttaaagacttttaattatttgtccatatagatattattcatatgttacttagcccactgggttacccatacacgcgggacatgggtatatgtattggtttctgcccgctagtgttttggggcatcaaggatgttgttaccgtccccgtcacggccaagggccgcgtcagccactttgtcgaggcccagatccccaaggatctgccatcggtgaggctcgacaagtagtgacgacttccgcaaactcaggagcgacgaatcttgggagttgcttgccctaccaccaccgcaccatgctaagtcgccaagatagaagttgatcgaggtgggagaggacgggaccaatgatgagcttgacgattgtgagctaatgcaggcgagctcttttattgttggtctttgacccatcttcttcacctttttccgtgaatttgttttttttaacgaaccggtaagctgccaattttattaaatagataattttctgtgaatttgtggtggaaatgtgtgttgctatggaacattgtgatagagacatgtaatttttgtgtgttgtttgatctgatttacagtgtgtgtccaagttcaaacccttgattatttttttttggacgaagggagtatttgatatgttccacagacaactactaagttataaggtggtggctcaactgcttatataaaccgaggttgtgtttagttcgtgtgccaaatttattttttaagtatacggatatacatttgaattattaaacatagactaataacaaaacaaattatagattccgcctgtaaactgcgagacaaatctattaagcccaattaatccatcattagcaaatatttaatgcagcagcacattatcaaatcatggcgtaattaggtttaaaagattcatctcgcgatttacatgtaaactgtgccattggttttttttctccacatctaatgcactatgcatgtgtccaaatatttgatgtgacggaaaaattgaaagtttgaagaaaaaattttgaatctaaacacggtccgaatttagcagcatgtgaaaatcactttcgtagcattgacacgtccaacaggcaacacagagttgcatgggaaaaagagtttgtgttttctggtttatagatttgtctatttacatattgtgaatgaatgaatgaacaaggagggaatacaaatatgcagagtaaatgtgcagtacccggtgaccgaaatgttacagcaaatttactcatcaccaataaacattgtagtacttgcaagcagtgaatgattttttttttcttggaaaggcagtaattaaggtagtagtattgcattgtatgcctcgacaatgtacatcgagccctgtggtcccactgggccagtggcccatgctcgaggcttaactccatgttaccttcgggcccaccgtgtaccgtgcgctgcactctaaatttcccctgttttcttctcgtcagtgaaagcgattgtagcctgctactactgcagctagtccagtactcctactagtactatgcaaacaagaacaaaataaggattttattacaaatggagaagtgttaattactctaagataatgtaaactttttactacagtccatgtcacaagatatggacttttgttagccagagctaacctttgtttaatctccaagttttccagagggtgacacacacttgggtcactgattctctgcatattttatgccatgatgggcacatgcggcttgcaagcctacatactactaccctacaaacaaacatgcctcaatccatggaatggaatttgcagtgtgtgtatgtgcagagaaaagaaaaaaaatgtgcatgcttgatgcttccatggttaaataatttcattaatcttgctcatcgagtcattgtttgattacttgtttactcaattgtttaggtggtgtaagtttagaatttggatgctagtaagaccaggttggcagcgagcttagaaggtccatatgattggtgctgcgtagttgtcttctcttggtctacttcacagtttaatatactgcctaattggttaccaaacaagttagtagtaaatttattgtgctactggggactacttaaattgcggtgatgcagatggctggttaaagaaggaactccccatcaggtggattagtgaaactgcaacattttttggatgattttgcagagcttgaccaagccagtgatccctaccatgtactcccatgtgtacatgattcatcagtattttctgttctgctaattaacatcaagacacatacacaaagtgatcagctttccatgtctgcatgctgtcctgtactcctgtacagatgttctagagttcagagttctccatgtggggtggaaacccaataggatccaatgcattatatggtgcatttttgctcactctgtccccccatggcaacaattcactgcaacacttcacagttcacacgcacacaatcacacagaatgtgagatgatgataatagaggcacatatgacaaatcttgattggcaaattggcatcatggcgtgttgcatgcccacatataatcaggtactgtcactatgtgcattgcaatgtagtgttcttggcattatggccagggacagaaaggctgggggagtcttggcgttgggatgactcgccaacaaccatgttctctgcactgtcctgatgccgattgctgatatctccatcccacatgtatgcttgcactggaatccactccaaaatgttacagatggtttggtagaaaatacattgccctttttgtttttggcaatatcattgtgatttgggggatctttcagatgatgtgttcatggtttgttctgttgttttgtgccgttttggggtcaattcagagttcagacacctgaaactgtgctactgtagaattcacggatacatcttgatctgaagaattgtttcatttttacatcgattttaaatctgaaaagttggtttaagttctcgactggccaatttaaaacattcatgacagtgatctgtgtagtactagtacaatgtgttgggccattctttttgggtacgtcacctacccctgcagggtcatgctcttcctgtggagacaaaagcacataaattgtgtactcactatatcatgcgaattaatatgacctttaggtcagggaattaaaagtatggtggacaagtgtttatttcactccgatgcttatgaactaataacataaaagcattttcacaacatatggcaagagggtaactgaaggccaaacatttggagctgacccttcacagtttttttttttaaaaaaaaacagtttggatgatgcgctagattcacgtaataaacaaaaaaacaatcttaaggtatgggtataaactatgttataaacttcaaaattgaggactccatgggaatgcgaatctcacaggaactagttaaattcctatgaaaatcaggctatgacttgtacaagctacaactcttttttttaaaaaaaaatgcagtacaaacgtgagcgtttactcacattatgaacacaccctacccttataagcacatttaaaaaactagcccaacatattttgagattaacgaagtcatcacagacaatttgctatttacgagtaccactgaatgaataattagtataaatgcgagcacctatatcaaatttagagcttaaccaactctttttataggcacttcaagggtttttgtctcgctttgaaatcttcatatgatatgatttaattctttggttgtgtacatttgttatgtgggggttattatcttcttcatctaaaaccttcccctcatcttgccatattatgagatccaacaaataagtactccctccgtattttaatgtatgacgccgttgactttttaacaaacgtttgacctttcgtcttattcaaaaaaattatgtaattataatttattttattgtgacttgatttattatcgaatgttatttaagcatgacataagtatttttgtatttgcataaaaaaattgaataagacgaatggtcaaacgttggttaaaaagttaacggcgtcatatattaaaataatatggagggagtattttgttactcgttagtaagggcagtcccaacccataacaatagacatggtttccataaactccacatcatcaagaaactagtactagacactactcttccaatgcaaacaccactattccatacttcaatttaatgctacttctttcacatgatgtcttggatgttgtgtaaaaaccatgtctcatacaagacatgatttttttt

SEQ ID NO: 64238 - DNA, 725 bp, Oryza sativa
caatgactacaagcactggaaattggaaaacgcctgagacacgataaagttatttcctcacaaaaagcttgcgctgtaacaattcgtcaggtcccattccaatagcctgctgaagccgagcgtgcgtttgtccagatcgaacaccatcagatgttctccaactgcatcccgccgagcaccaccgccggctcgccgtccaccggcatgccttccggccccatctccacgaccccaacgcacgtctcgcgtaccaggtagttgccgttcagtatcgtccagttacccgtggctccggcgtccagctccagggtgatcgccggcgcgtcgaagcccgtccgcttcatcatagggaatgacaacatggtgtcgcctgcgccgccgtaacaaagctcgaactgcttctgcctggccaccctcgccattctgctttccgttcctctgccgtgtgtggcgaagtaatcagctagagatcaaacattggttatggcgtaagtttgtctcgtgtcggatgctgtacctggtcacgactgtgtcgaacgccttgccgaaggcgcggaacacgtcggtgcgcatgatcgcgtacggcgtcgtggtgctgagcacgacgccgccgcggcccgtgcgggcgttgaggtcgagcgcgccggcgggcagggacaccgggacgtcgcgggcccgcgccacgacacggagatgcgttttacggggaggtagtaaccgccgtt

SEQ ID NO: 64239 - DNA, 1112 bp, Oryza sativa
ggggtaaagatagaggaggataagaggaatatttcccctcaactaattttagaaaaacacaaggggaaaggtcagatttggaggagaaaaaccgagccaatcggtctcagttcggctgctagaggtagaagataaacagtgtcgagggaggcaaattagactcttcgtcttgggctggctgaaaactaagcaaagaaagaaagagaagggggaaactcggctgggccgactagggctgcacggccgtgcacacaaaagagggagatgggccggaaagggcccaagactaggaagaggattattattacttttccaattaaattaatcaatgaaatgatctttgaattgttaaaaatacttcctatgctcaaataattccaagaaaaatcttgaacatacttggacacccaaagtatttaacaatattaagaccagaccatttaatgattaatttaatatgtgggtaattactgaaatgctctttgtatgattaaaaattaggaattgagctccaaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacaacccccggggggacctaaggatcgaatctcatagccaacacaacgaccacagcctatgaagccggaaactacaggagccaagtcgctgggtgatctagtcgaatcaactcgactacaatctcgtcggtaccatcgagttctattattccctttgtaatctgtggttctctccatataatcccatatcaactggattagggctattacctattaaggggcctgacctagtataatctttgtctcttgtttccttgatgtcgtatacgtagatcctcgtaccagcgtaccccaataccctctatatccggtctacgggtaccaccgtcgacaagacttattttagctatacatatgtaatagcccaaagagaagggacgaaaaatagacttattttaaaaa

SEQ ID NO: 64240 - DNA, 13519 bp, Oryza sativa
aatggtccgaaaattggcaaattggcgtcgaatggtctgcaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaggatatgcgaaaatcaatctagggtttgcctcctactctgtactgcgccgtcgctcgtagactaatccatcccgctcgccggcatgcaccagcgatcgggagagcaggtcttcggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtatgtgttcaatatgttgcgcatatttaatctgttcatgttattctgcgtagtttacatgtgtagatctaatgatgcgttcatactagttttcatctgtaatatcatgatttatttatggaataaattaaatcattatatgcccataatctcaacacttttcgtgccgttcactgtgggagatatgatgatctatgcatgatacgatggggatcgaagacgttatcattcttaatatgctaatgtatttagggtcttaaaatggcattatcgtttaggcttactgtatcttaatttgaacgttgaatcttagagagggacatcctgttaaattttgaacgggaaagagtacgtgcaatgcgtggtgcatgtgagcaaatcatttatagtttagcgagtcgtagctctagcaatatgtagtaataattaataatgtccgtgaaataaccatcgtcagtttttgctatttttctgtctttccaggaaaccggtaagattttcttgtccttctgaaagcagttcatgattttttttttcatcgcaacgtgacatttgtagatagagcaatcgaaacagtagcagacaagctcacaagtcacaaggcagagggatcttgacaaagccgtcgtccatatcgagcttttgagcaagccacctgtactatccgcgtatatgcactcttgtctaaaaaacccactccttgatatgactctgggcaccagattcatacacaggagaaatgaggttttctatactgtgcttttggatggaatcaaatttggtgtatgattcaatggctcggattaattcactactgcttcctccatgtcatattataagactttctagcattgctaatatttatatagatatcaataaatttagacatatatagaaattttgaatgacaatgctagaaaatcttataatatgaaacggatggaatccgtattttctatttaaatatataagtatgtttattttatttggtcacttttataaaacttagactatgaatatatttcaaaatattcagtttgagaatatgtaaatcttatgggtcgttgtatttgttagatattatcggtatattttgatagaaaataatggtcaaagtaacatattaaaacccgaataaaggtactaccgtagtaacgatcggttgagacaaaaattaaccaaaacaataacatgttttctaaagaaatacttagttcatcgaaagccaaacaacttgctttcatgagaatgacggtgagcatgggccacggaatggaaccaagcgcatgcccaaaccactcctaacagaagtttcattctcattgaatagagtgttatgtcaatatttttatgatgtgacaaggaattaataaagagagatggacggatttcatttaggtgaaatcatgtatgcattatttccaatataacttgtgtttgcatgtacggtctacgaagaggttttttactctctttgaggttgtgcagtatcaaatcctgactgttgatctggcatcattcaacggttataaatcgtccgtacctcatcgtactgcaccttctcattaaagcggtaccgtgggtggaaggatatttctgtactttcgcgtgggcatctctttctttcgcgttcgcttccttcccttttcacgagaggaaaacattgctggggaagagcagcgagagatggcggcaagaggcaggggcagcgagagattgcaggacggcgaggacctcgatgtgcgacggcagcggcgcggcgggctcgacgggcgacggcctcgatgtgcgacggcggcggcgcggcggcctggatgcgcctcgatgtgcgacggcagcggcatggcggcctcgatgcgcgacggcagcggcagcggcggcctctcttttcctcctttctgctatgaattttgttgacggcggtggcaacgacggcctgtctcttcctcctttctgctgtgaattttgttgttggatttgctgaaccaaatgtaaatggctaaatggttgattaccagcttactcttgaattgcaagtttcgtattgatgaataaaaaaacaaggttcagaaattggatctgctgtaaataatatcgattcatgagaaagtctcgtgtactttgagttacgcattgtttttcctcctaaatccttcctctacagattaaagttgcaaactcaaattgagcatctcctcctggtatttctctgttcagattaaagcagcaaactcaaattggttgcctccgagcaaggcaggctcgatgcacgacggtagcggcgcgacggcctcgatgcacggcagcggcgtgacggcctcgatgcgcgacagcagcggcaagctcgatgcgcgacggcggcggcgcgggaggctcgatgcacaacggcggcaacagcctcgatgcgcgacggccttgatgagcgacggcggctcgacagcctcgatgtgacggcggcagatggaagagagagacctcatttttgttagcctgatcatacccagctaaaccaacggttagattagattagattggtacctcgtgatatcttcttaaggatgggaaaaatgctcgtctacgaaacaaaaaaaacaaaagaatgtattctatgaactattttaaccatcaattaaatattttgttgtttctgtagcactattgttggaagcataaaaaagaaaccacccactaggtggatggcctaaccagaaattcagaacaacgaagtactctttcttttcaaattacttgccaatttagcttttttactaagttaaacgcttatgtctttgatcataaatatctaataagttatatgctttcattacataaatcataaatatttatgtttttatattatattacaataaaaatactttcataatatataattcgtatgttattaaactatataaatccccttcttccatatgtatacatgcatttcctagaaacaggccaagtttggattgggctatggaagccacggatgccatttgctggccctgtccttgggccaagtttgcgctgaggtttgcgttactaaacactaacgcattatggaagtccttacatgtgaactgatcagcagatgtgtagcaaatccttttattaaaaaattaaaaaaaataaaaccataagaatagcatgtatgtaccacaaattaatatctttttgaaacactcagcatagatagtgcgatatttctattgatatagcagaaaaaaaaatacaagtctatagtcctcataagctatagtcatagagaaaaaaaggacaaacaaaccattcgtctacgttttatcatgctaaaaaaacaaaacaaacacacaacatcctcacaaatagatcttctaaacgatgtctctaaatagaaaacgatgttaagattgttgtcgccgtccgtcctatagaacacgggttcgctcctggatcgtccgcgcggacgcggaggaatgacactggggctgttcggctgccatttttcctagccgcacggcaacacagctgtagccgcacaacgcaaggttgcagccatatgacagctgaacaagcccactctaagtactttaccacaaaattaatattgcacccttgctaatgtcacgtgcctttgctttaggaacaagattagcaattcgtcactgcatcacgttttttaggctgcgttagttacctcctgttccaacttccctctcttatttttacgcgcacgtcaaactgctaaatggtgtgttttttttttaaaaaaattctatacaaaagttgctttaaaaatcatattaatctatttttttaaaaaagatagcaaatacttaattaatcatccgctaatcgctactctgtttttcatatcaggctcccgaacgcagccttaattagtttcaccacaatagtcagtagaagtaaatattagcctcccctgtatgattgtgtgcaataaaacgagtagattgagaaaacaagaaaaatagttctaatttggtagcagctcaactactaactatttctggccgtcaaaccataccgaacatgtactgtactcctttctaatacgaatagattgagtatgttttttttttggatgacgcttaattaatgcttgtcattataactcctttataataaattgatgcaactcacatgaagacaaaaaaaacaaaggaaaaatgttgtcagttattcactagattaattaacgattaggactagctattatgcattttcattataactggaaatgtgtttgttggggaaggcttttgcattgtatagtcttgaagttgttgcatttcccgatcggttcactgtgcgtgactgattgcgtgcagtgcgcggctggggtgttgaaacaattaagcacaaatttggagatggcaatgaataagttgggttttgctcgccgatgggttaactggattatgaagtgtgttacctcggtgagatacatggtaaaattcaatggaaccctacttcaatcattcgctccaactagaggtttaaggcaaggagatcctctctcgcccttcctatttttgttcgtggcagatggactgtcattgctgctgaaggaaaaggtggcccagaattctttgaccccttttaaagtctgcagagctgcacctggaatttcccacttactctttgctgatgataccctcttattctttaaagcacaccaaagagaggcggaagtggtaaaagaagtgctctcatcctatgccatgggcactggacaattaattaacccagccaaatgttctatcctcatgggaggagcctcgaccccggctgtcagtgaggctatatcagaaattttacaagtggaaagagacaggtttgaagatagatatctggaatttcctaccccggagggacggatgcacaaaggacgttttcagagtctgcaagctaagatttggaaaagagtgatccaatggggtgagaaccatctctccacgggtggaaaagaagtgttgatcaaggctgtgattcaagccatcccagtatatgtgatggggatttttaaattacctgaatctgttattgatgatctaacgaaactaacaaagaacttttggtgggattccatgaacggccagagaaaaacgcattggaaagcctgggattcgttaacgaaaccaaaaagcttgggtggccttggtttcagagactattggcttttcaaccaggcacttctggcccggcaagcatggaggttgataacatacccagatagcctgtgtgctagagttcttaaagcaaaatatttcccccatggttccctgattgacacttcctttgggagtaactcgtccccagcatggagaagcattgagtatggcctagatttgttaaaaaagggcattatttggagagtgggtaatggaaattcaattcggatctggcgggatccatggctgccaagagatcactcaagaagaccaatcactgggaaagcaaactgcagactaaagtgggtgtctgacctaattacagaagatggatcctgggatgtgccgaaaatccatcagtatttccataatttggatgcagaggttatactgaacatctgcatttcttcaagatcggaggaagacttcattgcctggcaccctgataagaacggtatgttctcagttcgaagcgcttacagattggcagctcagttagtgaatatagaagaaagttctagctctgggacaaataatattaacaaagcatgggagatgatttggaaatgcaaggttcctcaaaaggtcaaaatctttgcttggagggtggcctccaactgcctggcgaccatggtaaataaaaagaagagaaaattggaacaatctgatatgtgccaaatctgcgacagggaaaatgaagacgatgctcatgctctctgcaggtgcattcaagctagccagctttggtcatgtatgcataaatcgggaagtgtttcagtagatataaaggcctctgttttaggaaggttttggctgtttgattgccttgaaaaaattccagaatatgaacaggccatgttcttgatgactctgtggcgcaactggtacgtgaggaatgagctaatacatggcaagtcagccccgccgacggagacgtcacagagatttatacagagctatgtcgatttactgttccagatccgacaagctcctcaggctgacctggtaaaaggaaagcatgtggtgaggactgtacctctgaaaggagggcctaaatatcgagtgcttaacaatcaccaaccatgctgggagagaccaaaagatggctggatgaaattaaatgtggatggatcctttgacgctagctccggtaaggggggtcttggaatgatcctcaggaatagcgctggtgatatcatcttcacttcttgcaaaccccttgaaagatgcaacaacccgctagaatcagagctgcgtgcctgtgttgaagggcttaagctggcgatccattggactttgcttccgattcaggtggaaacagattgtgcctcagtggtccagcttctgcagggtaccggtagagatttttctgttctagccaacatcattcatgaagcgaggcatctgctggtgggtgaaagggtgatttctattaagaaaatatgtcgtagccagaattgcattagccatcatcttgcaaatacggctagagctgattttcttgctggattttggttgggagagagttgtaatcttatctcacatttattaagcgagaactttatgagtgagtaatatatttctttccccccgcaaaaaaaaaattaagcacaaatttggctgctcaaccactcaatttccaacccacgcggatgccgcgttggccgccatcccttttaaacccattgacggatgtacactgatcaattaatcgatattatgccaaaaaatgatacaaatactccagttataaaataacaacggaatatgtataacccattctgaaaaaactctcaattataaacttgacctatgcaatcggaaataaaaggacgtgtttttaattcaactggttatctatgaagtgggtgcaacttaattggttttgactcctagagatgtaatatgtccactatgcactggtggagaaatgactttgctgggtcgacccaaaaccacaataatcccggttccaaaaagaaccagaattaagaatgatctttagtcccggttgaaaaccccagaggcattctaaccaagactaaaaatcatctttagtcctggttcatcccctatcaaattgatgtccgggggccgaggatctttagtccggttggtgttggttgggaactaaagatcggtttgatctttagtcccggttgggaacaccaaccggaactaaaattcgaagcgtagtatataatccctatcccttatcctctcctacacatatcgaatctctccccttctttcccttcctcctccgcttcctacatcctcatcccgatccatcccctccacctcctccccttcctcatccgatcccctcccctctcctccacctcctcctctcccctttcctgcccatcctccccttcctatccggcaaccggcggccggcggggccatgcccggtggcgggccggcggccgtggcaggcggcggcgggccggcggccatggcgggcggtagcaacggagttgttttctcttttttttaatttgtgattcacatgtataattttgtgatttattggatggatctgagatgacctgtgatgtatttgatctgtgtgtaattttttagaatttgtgatgtatttgatttatgtgtatatgtaactttatgatttgtgatgttactttatttgtgatgtgggtttgggatgttactttgatttggggatatgcttcccacttgatttgggagaaaataaaaaaaaagaaacggtaccatctggaactgccgtattctctctttactcccctaaaaagagggattttgtagcgcccgttccgccgtggcgcctagcgggaaattatctcttaaaaaccctaattgcgaaatttgtttcttcgcttgtcgtctagggtccatgccatctcaagatctcagtccccgatctatcgtcaagttcaaatccgaatccaaatctttccaaatcaaattcctccgcaaaagtctattttgcctcccttggggtcgatgggccgaatttctctcggcccatcttcccctctcccccggccctctcctctcccccggcgagctcccgctctccctctctctctctctctctctctcgccccctcccctcccccggcgcgctccctctccccctctcgctccgctccgctccgccccgcccgcgcgccgcgcgcgcgagtgcgcgagcgccgcgccgagcgccccctccctttcccctcgctctgcccgcgcgtgcgcaagcgccgcgccgagcgccccttcccctcgctctccttctcctctccctagcaagctccccgctcgcgaagacggcccccgcgcgcgtcgttcgcgcgcgcgcgccgcgtggttccccgcccgagccgcgtcgtctgcgccgtccacgtcgcccggccccgctgctctgccgcgcctgcagccgctcggccccgcgagccagcgcgcgtgcccagccgcgccgcccgttgtttcccgcgcgcgcgtgctgagtggccgaccgcctggtcgccgccgccgtcaccctctgccgcgccagcccgcgcctgtcgcccgtgtcgtcgcgccgctccaaaccgccccgccgtcatcgccgtcgtcatcgcctcggccccgccactcccgcgctagcctccaagggacggaggcagagcctccctcctccctctgccgcgacgcccccgctccctcctccttttcccgaagaggcaaggggacaagcccccttttctctccctcttttcccccttttccctcccgccggcgtcatcctcctccctcctccctgtcgccgctttggccgcgaccgccgagcgctagccctctcctttgaccgccctaagtcggttcccaaaccgacattgccatcctataaacccgagctcccccctttttcctttcctctcccattcacctccgcgccattgccgcccctctgtttcgccgtcgccgttcgtgtcggaagagccgacacgagcaaggacgcggaaggggacttcggccgcgccctctccttcctcttccccggcccgaggccggagagattactcccgcgccgtcggcctctcgtcacagcgccccgacccgcacggtagtgcctctctccattcttcctcctcgctccatctcccccccttagttttcggtggtagcacgagtagcctccccgtagctagccggcgccgccccgaccgttgccgtcgctcgccgtgtgctcgccgccgtcgccgctcgagctccgtagcacccgctcgtcgccagcctcgctcggcgtagctccgcccaatccgacgctaacatcggattcccgtagccgcgtagatgctctcaccgtcgggaatcggcccctcgtgacctcgtcgccgtttccctcttccctccccgccggttgccgccgccgcgattcgccgctgtcaagcttcctccggcgaatccgagccgttggctcgtctcccctcgtctcgtgcaaccacccggtgtgctcgttttcgccggtatcgccgtggttcgctccgccgctcgccgctgttgtccgccgtccgttctggccggcgtcgtcgtctacctcctgccagcccacgtggcagccacgtaggcgccacgtcggcgccagctcagccgaggtcgggacgggccgaccccggtcagcccctcccgtgcgcgcgttccaccgcgagccgtgaggctgcgcgtgggcccaccgcatccgttcctccgcagaccgtgcgcgtgcaccgcgtccctcccccgcccgcgcgcgtgcaccgcatactccctccgcacggtgagacgagccgctgacaagcgggtcccacccgggaccgcgcgcggtgagcccggtccaccggctctctctcctccctcccgcgcgcgcgaccgacttgggccggccggcccacccatttagctcggccggaccgccccaattctcttgggccgcgccctagccgcccgataaaagtctattttccctccctcttttcttttcttttcttttcttttccaaaaaggatttaattaaatccttttcctttagaccaaaaatccaataatcttagaaattcaatatcttcccaaccgtaaatccgtttgactccgtttaacttccaaaattcctcaaatctcgagatctatctaatggcatgcttagaggtcattaatagggctttatttttcgccgtttgttgagttgtcccgtttcacgtgtagttccggagcccgaagacccgcagtgcgaggatttcgaggatcaagctccagatctcgagcaaggcaagccacctttgaacatcttgagcctatatttgaaatttaattatgttgcttgaaaatattatgcactgataggatcgcacttaatctgttgtcccgtctgcaaggcagtttggcggacctacctaatttgttgcattgatcctccctttgttaattgttatatcatgtccccttgtaaccatctagatgcgtctcgatattcgtgcaccctgtgcgagtatcgacggacgccttcgaacttaaaatctgaaaaacaatttgggtaaaacttgggttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctagcacaatatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaaaatcagcagctgacgggatcagctaggcccgggtggccgtttgaaagttgttgtcccgggtggccgtttgaaagttgttggccgggtgccaatcttgatcaattctaaagactgatacattgcacaaactccgaccggacgagacgcactgtcttaaccgtgtcgtttgagaagcactcacttagttattttcagaaaggtgtacaaataaaatcaattataaaaacaacagcctttccttgaagcctgcattaaacacttaattctcatggcttgctgagtactcccgtactcacccttgctctatataaatatccccccctcagttgctgaagaagatgaagcggatcctgttgatgaggagttcttccaggagcaagccagctacgatgagttttagggtttcggcctagttcccaagtcgcgcctgtgttgattggtccaagtcctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcgattaacaggttaatttggagcgtcacgggctagtttcggtcgggactagttcggggcgtgacagatttttagtcccggttggtaacaccaaccgggactaaagatccatctttaatcccggttatttgaaccgggactaaagatagcgatctttagtcccagattcgtagtcccggttggaaaaccgggactatagggggttacgaaccgggagtaaaaatcacttctccaccagtgatgtttcaactctagatttgacataagtgttctcatttatagctaattattttttcaatgataaactatgtaaaggtggacacttcataatctcaagatatgccgtttaatcttttgaggtgcttataaaggtggggtgtatgtataaggcatgcatacgtatgttcatatggatagcgcgtgcgcatatgggcgtctatgtttatattatgtttcgaaaaaaaagctagctatcttttcttgaggacttcttggcatcacttggtattctttttcccaacaacagaacttattatgtatttattggcatatgaaggcgatgtaaaccatgtctactataccttaaactagaatgcactatttacagccaaattatccattttttttctactgcgtatattgagttttgtaattgaatttcagtatacatagtggtttggtatactcctataacaatatactccattatacatgaatatattgtgtttggtgagtaaaagcgcacaaggtggtgatgtcttctctcaagagactaaaaattcgtccgcaatattttgtttgattttattcatgcagaaattaatcgtgattacatatatatgcagacccgatcataaaccgaaaaaacaaaacaaaagaagaaaagatacatgcacgtaaccactcacgacttcttgcgcgtcacaactcgattacaattctcaaagcaccatgatcggtcgtcatcgatcactcgttggccgtgacggcggtggctgtggcggcggcttctttctcggcggcggcggcggcggcgtctgcttccttga

SEQ ID NO: 64241 - DNA, 746 bp, Oryza sativa
  unsure (1)..(746): unsure at all n locations
aattttttcatggttatatgaagactaggtaaaaaaaactagggtgcctagaactactcttaaaaatcaaattaaaattcgcccccaaaaggagagggaaacttagaaggtattgtcatgaagaaaatattctttccattctactagtctgaatgtaggatcttaattggcattatagcatatgactgaataaaaaaaactgacgtatgtatgcattggttacaaaacaggagctctgaatttaaaataattaatatgaacgttacatccttggcataagaaaaaactcgtccattcgcattaacaaagaacatagtaccacatggttttaattagcatctccctctggaaataagttcattaacttgatggtacaccctgtgattctgcctgttcaacccaacacaactctactccttctgaaacacagtcaaattaacttcgaaaacctgaaacaatctatgttaatttgctatactgatcttcccctttgatatattccacaggagaagcttcgtgttgcactcttcgttcagaaagctgcacttcagttcatcgatggtacgtacagataaccgtcctcaaaaaaacaaaacaaaaaaaaaaaacgtttgctttcaattttgctcgaaatttatcactccgatttgattttgtaacaatggcgatgctncgatcctcctcagccgtcgcaagacggagcacccgttgccgagctcgcccggcaatgcggcttctccgtcagc

SEQ ID NO: 64242 - DNA, 781 bp, Oryza sativa
tgtggtgccaaaatcagaagaagacaaaaaaaaatgaagaatgaacagaaagatttgagtatgggaaggcgggtttaccatcctcaaggtgacaatgatcgaagaaaatgctagagaatcaaatggtatgtcatccaaggcaaaaagtgcacattctagcgattcaggtccaggtgagaagttgggggtcttcaatcttgctcggaaaataatgtaactctactgcatgtcatcataacaaacaagatcaacttagtagagtattgagctatcatggagactctgacaatgctaatttcactcacttggccaatcagtggaatatccaactgagcaaaaggtgaaagtatctctacatctgcacaagcttcctccaatgtttcccgggaggctccttccgctgcagactctccaacctccaaataaccagcaggaagagtcctgttgatgcaaccttgattaggattatggaccaaacaacaagcaccaaaattgactgggaatgactgcctatgctttacaaatgactgggaagagacaaaagcaatctcaacattgttgcattagaaaaataggaaaaaggaacaccgttttacatactagaatcatatcagtcaccagtcgatgtgctaaacataaaaaagaagtgtatttaaactggattggcaagagtgaaacaaaaactaacactataatgtaaagaactgtacagttttaaactgaattggatacagcgtgcatgtactaaattgattttgattattatattcatactcaaaat

SEQ ID NO: 64243 - DNA, 508 bp, Oryza sativa
cctgcggccctggttgctgaaatttttgaatgtcaaaggcccaaaaacaatattacagagaaaatgtttcacagctgcattaagaattagtacactgtaatacttgaaataggaagcacctttgttgcacactcttgcaatactgggaagtttacaggagtaatgccagcatacttgagttccttcatagcctcttcaccagtccaactgaggatacaaaaacaaaatgttagaaacttagaatcgattgaatgtaacagaaatgtttattttcatgcttcattgcaaacatgtagcaaatttctgcaaatcatgaagataaaggtaaacagaattttttttaactcagtatttaagtttattgaaaacatttgaatgatttttggagataatatatttacgattatgcatgcccaatagcaatccaatattgtctaagccaggttgcataaacaagtaatgccttattgaggtattcgttttttttcacaagtatatagtaaaaata

SEQ ID NO: 64244 - DNA, 74715 bp, Oryza sativa
  unsure (1)..(74715): unsure at all n locations
tcaaacttatgaaataatctgctagatggttgatggattgttgttattactgtcttcccatcctgcaacatgtcaaaaggttaaagatgaattgaactagttgccagctaatgtgtaatactctcatgtcacctcagctatatcatgtagaagttgaattatcctgagagctgtagttgaatccaatccagatgttggttcatcgagaaagagtaaagatggatttattatgatctcatttccaatgcaaactcttttcctttcaccccctgaaaccccacggacgaaagatccaccaatcatcgtgtcctggcaccttcaaacatcatcagataattaattaagctaatttctaagaataggtgcatgctaccatacaggaagtggagcgtttttcaaactacctttcaaggccaagttcatatatgatgtctattgttcgttcttccttttcttgcctcgtcattgttcttgggagacgaagcagtgctgcataagtcaatgtctcctttacagtaagatgagtaaaaagaacatcatcttgagtcacaaatccaatcctgaaaaacgagtataaaaccaatcattcactatactcttggacaaactttgaattagtttgtccatacaggctcaagctcaactttggtgctctgacgatccaaaccattggtacaagcagatgttttgcatataaaaccttgtagaatgttgagggtagttagtctagtcagacagtgcgaaaattgctaacaataaggaaccaggatatctctcagttcgaattgtttgccgaattggaagcggaaaaaggagaatactacatggtttttaattggcgattctactaaagtggtgttatgtttgagtgtctaaccaacttagtagctaggttacaccaacacaatttaaaggactaagcagaagaacaggtggaggtagaggcagaagcagaggcaatcctggtgacaaagacaagcatccaaaggaattgcgggacagagaccctggtgcagtggtgttcaagacgaagtggacctctaaacaccggagacctgtaagctcagactactgtaggcctcaggtgatgcaagtgttcactgacgtgaaacgtgtgcttactaatactacctccagcatcggtcaggagatacatcgaacagcttatcggcaggaagggcatgactggaacctcacctcaccagagcacgctacgacatggcgcagacatgcgatcgagaacaacgggcaggcgactccctgaacgtcccgaccgtgctccgccgcacaagccgccggagtttccatgagacgacgacgacgacgaggcgtcgccgcgcggcgcgcccaagcagacgagaccgtgagagacacaggtgaccaggcgacagccatagccgcgggcaagagccgaccaaaggcatcacggcccatgcgccgggacgcacgattgggccacccaattcggcccaaaaagaacatgtcggctgctcggcgtcggcaaggcccaattctggcgccgcccattagacagaataataatgacaggtgcgcggtacgtgccagaatcggcacgtcagatgtgcagttcccctgcggccaaggcagagggaagctggaagaagaagacagtagacagtacaactgtagcagcgatgaacaggtagccagatttagcgagataaccgtgagccttgccttgctaatctctcctttattatagccagccacacagcctatgcatgcagtatggtactatgctgtgctctgtagctgcaagcaacagctgatcgatctcatctcattcttatcactttcgttccccagctagtgacccatcgaccaatgagaaatttacaattagtggctccatcagttgggctaataacccaaagaaaaaaaccaaaatttaaattttaaaaattaattttgaagttaattttaagatattttcaacatattttctttttcagcattagcttttaaatcactaagaatatatataaaaaaattatctacaaattaacttttattttctaataaaccgttttaacttattgggaatatgagcaaacggtgaggttttagggctcgcaaataactaattgtaaataatttagttaattgattaattaataatcctggccccggaggaattaattggtgatgccacatcgtgtacgaacaagtgcatgctacggagtaactaattaataattaattaagacgctgcatgcatctattgcacgcgatcagagaggtcagaggatgaaccttcctttgtgttgtgttacctgcggttgagggacttgcagtatggctcgtcgttgtaggagacgcagccttcgacgtcgccggggccggcgaccctcccgccgaggatgctgagcagcgtcgtcttgccgctccccgacgggcccatcagcgccagcacctcgccgggcgccgccgacccggatatcccgctcaggatctccctcggcgtacccttcaccgccaccttgtacttcacctccgcaaactgcacgaacgaaacgagtctcatctcatgtagcattagctcactgaacctctcgcatgccggcggcgtacgtccatggagcttgggataatcgatgcgtttggtcgatttaccttgagatatatcggcaacgtcggctcggtcatcagcttcttgcgcggcgtcccggcctcgatgtccatcgctgcatacgcacagcggcacagagaatgagaatatatatattagggaagtgatttcatctctcaaggagatcggatatccctcgtttcgtctatattatctaaatatctataaaaaaattaaaaaaattagtaacataaattaatataaaatatatcactccacgaaaatacaaatttaaattcaatttttataagttgtaataaaaatgacaaatataactacgaaaggtacgataaccatatgtgcatgcagttaggatcagtaggagtgattggatgcatactgttgtcgtcgtcgctgaagggatggagctcggcggaggacatggtgtcctggggaggaggggtgaagccggtgaaggtgaaggagaagccgaggctggcgctggaggcgcggctgagggcggcgccgctggagacgaggtcctccatttcgagcttcagctgcgcgctgcgggacttgcggatgtggctgttgttgttgttgctgctgctgtagccgtggctgttcccaccggcgccggcgccgccggacgccgagcgcttcccgaagctggacttgcgcgacaggctcgtcgtcgtcgtcacgtcggccgtgctcagcaccgtctccgccgacgccgtcctgctcagcgactgcgccgacgacggcggcggcggcggcgccagctggtccgacttggtccgctcaatcatcccccctcccgtgtccatcatcggcttctccattatcgactccatgaacgaacacgaacaaactacctagctaacaccgtcacgttcctagcaagcacatttagagcagtagcttttacacgagacgagccgttatatacacagacacagagtgatgggaaggcaacacacgcagctaaggcatttggcaagcgagcgatggaggtcacgcgtgtgaggtggattgtggcgagggcgacgtgggggggaggcagcggaggggcagggggcgcgccagcgaagcgcgatgcgggacgcggggcattaatggagcgggaaagcgcgggtgtggctgggcgcgctcaggcagccagcttccacacatgccggcctcacgacgacgtatcgcgcagggcacccgcgcgagcccccgcctgcggctagcttagcccgcgacagggacgtccccggccacctcgccttcctcgctctctcgctcgcggaggcctcaggcgcgcgcgcgtcccttgcagatcgatccagcgcgcgtgcgtgtgcgttcggtttaggcgtacgtgcgcgcgggcggcagcggcggcaccgatccttttaagtcagcttattggcttatataatttataagccggtggatttaatgtcctaagtttagtggtttagttatacatctaccttacataagccaaaaaaaacttctccaacctagcttttggcttaatagtgttagagtggcttatggcttccaaaaagccaaacggaaaagctgcttgtttgtttaggtttagacttttcgacttataagttggcttataagcctaaacaaagagggccttagcccctccgcacaaattgaggcgctgggtgtgaaacacaaaatgatgacctatttagcaaatgctaacgtaaaataagtgtttagttcacgccaaaattgaaagtttggttgaaattggaacgatgtgacagaaaagttgaaagtttatgtgtgtaggaaagttttaatgtgatggaaaagtgaaaaaaaaagtttggaactaaactcgtcctaagtaaagttcctttaggcgatacatccatatctttacttgatgccatattatttactccatccgtcccaaaataagcacaactatgagtttccgtgtccaactttgatcgttcatcttaattaatttttttttaaaaaaaaataaaaaacataatttacacataaagtactattcatgttttataatcttacaacaacaaaaatactaataaaaaaattaaataagatgtacgatcaaaattggatactgaaactaatggctgtacttattttggaactgggaagtacaattcattgcagggttgctctatctcccgatcgatgctttaatttttctcgatccaaatcactgtcggactgccggtggtcgtttatccacattccatgttagcataaccacgatcaagcatggtcggatggtcctgttcatcggtttacctatgccttctatcaaacaagcagtaattttgcgcgaccaataacagctaactcatcaccacctaattaaaaacagtatagtggccatatgcctagataggatctaggaagaagacttgtgtgcgtcatgatgtagtgatttaatttttcttactaatgttgtgtttagttccacgttaaaattggaagtttgactaaaattagaagaaaaaatattgaaaatttatgtatgtagaaaaaatttgatgtgatggaaaagttgaaagtttgaagaaatagttaggaactaaataaggtctaagcaagatcttcaatatttggaacgcacattcacatcatgatcatgaactatctttgaggtggccattattgtttccaaacacttgtgagggctgagaaaaacaagcatctaattaaattaatgaaggataaagagattttttattaaaataataatatgaacgcgaaaacatgcttagaatgtactaacggcttaggagtgaaatataaaattttcgagccctaggcaatgtacagcccctatatacgatcttctagccataacacaggaaaattcggagcaggcaaaagtcgtcgatcgcagctgcgcaggagtcaggatggacatgcttggcatgatgcctctttctgttttccgtgctcacactgtcgtcacacagtgcaacgattaccatatatcattcgtgaagagaaacacgagtacacgagcggtcgagcatcctaatctcctttttaattttttttttatttttgaaaacaagcatcctaatcttgacgaggatgaaagtatcagcaacggccccaatgctattgttgacaagagatgtgatgtggctgtggnnnnnnnnnnnnnnnnnnnnctgcatgtagatgtactccactccagtaggcagtacgcctgcacagtcttttcctgactgttacggacgcggaaatgtttgtccggagaggagaatggtctctgctaaccggaagaccggaaccaccgaccaatcgggaaacggcgtggcgttgccagtactgattggtactactgggtagtatctttgacctcttggttaatgcactctaatgctccatttattacgaaatattgacgagatatttaaaaaaaacatactctcttcattctaaaatataactacacctataattatttcaaaatataacaatttatataccaacattttcttttcaaccaatcacaacccttcactattaatttttctcgccaaccaccacttcttaatcaataataatatatttatatttaattttatctatttttttaaataattatgtgcaactctaaaacttttatattctaacggatatagtaattaacgaaagttagctcgaaccttaagcgataaacatgcagccttcccattttatccgtgaggatttctttccggttcattcttgtttcctacccgcagtttagattggccttttatctcctgttacggttatttttttgggatacatggcgtcataattctagcaatccccttcctttttatcctcgtgttgcctgcgcgttaactttcatgaaatttgtttccaatttaaatttgtagcctgagattgcaatcttacaacataacaatttttaaaattcacattgcatcttttgaaatttatcgtgtaaatatggaacatataatgtcaaatacatattaaaaaattaaatattttttatgaaaaatatgacactaaacatattttttttttattttccaattggcgagcccgctcgtgtatttattactttgtcttgttcttgcatgctaccgcaatgcaatgcttgctttctccgtgtgttcttgcatgtataaacagttcggtctgtctatgcctattgtcaatggttaatatggatatactgtttatctttcatttcaatttaaatacatgcaacgggcaggtatgtagagttctagcgtgaggtcaatcacacgtgggtgcggtgcgtctcctcctcgcttcttagggcacctacatgggtttcaaacgaattaagaaatataagtttgaaaaactattttaaaaaactaaccaaaggaaaacaaattctaatcaaagtatttgtgtgtataatattcgtgcgtataaaccttttatatataaatgtatacattgaaatatataaatgtatatatatacattgaaactttatagcacatataaactttgtatgcaaaaacttttaatatagcaacattatgtataaaacatttgatccaaatctgaatcaagcaaataaactttcaatgtataaaattttttatatacaaaaggaaaaaaagtgtggtgtgaaaaaggaaggaggtggtgcacaggtgcatgatcatccacgcgaaagccgtttcgggtagacattaaccaaaagcgagtgaacagtgagtttttatatcactttgagtacagctttttcagaaaaaaaaactattaggagatgcctaactttgaattaaggtgtggccaaaatacccacgacgaaacactacatgcctttaccttcaaattgatattgccatagtcaagcattacatataggaaaaggaaataataaaattcaacaggttacattcgtataagtgcacggaagaaatagtaggttctttctttcgccacgtataagctttttcacgaaacatatcgtttagtagtttaaaaaatatgctcgcaataagttatcagcaagtagctgaaaagaattgaacctaagagttgtttctgtacgcaaatgattaggtcatacataccagctccaagaagtcaagaagaggcataggcgaaggacacacaagatattttggagcaggcaaagtcgcatgaattatctgaaaaagcaaaatcggacaacagctgcgaacacagctcttatctgttttctctactccacacggtgcaaacaattactgataactcgtgcaaaatcatcaacacatgcatatcctaattatcttgactaggaccatcatctctaaaaatataagaccccggccccgtgcgaaatgtaaaataggtctctagctagattcatgccaccaaacatactttcactgtttcctcaagcctcatcgaatcttgcatgtcttctgggcttagcgagattaaaaaaaaagaaaataaagcaagattgaagtgaaaccttgaattgagtaagacaactgatattgaattgaggagggaaaaaaatcaccagtttgtgttctgcattcactagacgaaccgaagaaagagtgggctaaattgtgctttctattggttaacatatgggctattttttttttctctctgaagcatggtacttaagcaagtgcattagaattcagggcctcaatttgtagggtgtcctatacagctgatcacctgcccttgctaagctgatcgaaagtattagcagctgagatgggtgttaggtggtgtttacatccagggacataactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattagactcattagattcgtctcgcaaattagtccaagattatggatgggttttattaatagtctacgtttaatatttataattaattttcaaacatccgatgtgatagggacttgaaagttttagtcccatctaaacatggccttactgttaacaagagggccctcactgctgttgagtgttgacaagatgtggagtggctggtgcatgtacgtcttcagagtctctttcgaaaattactgacaaggaaatgtttgtctcagaggagaatggtctctctgtgaaccaaagacgggaagcaccgaccaatcgggaaacggcattagccattgacccccttggtttaacgcactctgctgcaccatgtatgacgagacgtacacgtaagggaacgtgcggtaggtagtagtagcaggcaagaaaatatcaggaaaaattcttccttgtgcagtcttgcatgcttgcagggggggtgtgcccgttccctgaagggagtagcactatcgataaatttttcctcagacgtataaatataatataattacagtgttattaaattatatcataatataatttatattaattttttaaaaatctcatggtacacgctatttttcacgaggtaaagttcacaagacgtaatctcctcccgagcacgtgctatgatttttttctaacaatttaaaattatgtgaaagttgcatacaagtttagttttttttaagtagttatatacaagttatatcataactacatagaagttataatataattacattttaattataatgtatttatattaatcgagaaatacttttatagcaaataaatctttcgtggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaaggcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagtcgccgccggagtcctcctcctcctccccggtcctcctcaacatcggttcgctccccttctccctttcgcaaaaactcgctccccatccccaccgctcgcgtgaatttagaggctgatggtgatggtggtggctatggcgcagggggcaagaggtacgcgaccaccgtcgagacgctcacgcagcgggagcccagctccatgctcgccgccatgttcagcgggaggcacacgctcccccggcacccggacacggtacgccgcgtactcaccagtggagctctcttctcgggagctgtagcctcagaggatgaatggtgggtgcagggcatggtgttcgtggacagggacgggaagcacttcaggcatgtcctcaactggctcagggacggcgccgtcccagacatgtcggagtctgagtaccagcagctcctgcgagaagcggagtactaccagttgctcgtaattggaattctcgatcgtttcttcgattcatcaggttgcagcttcccaattaaccagccgttgtgaaaacatgatggtttgttttccagggcttggctgattgcataaatgatagattgggttggaaaaatgatgagaatttctcggaggccgaattgacacgcaaagatgtgatcaagtgcatccaagctccgagagtcagatttcgtggtgtaaatctatctggccttgatctatccaaacttgtaaggtctttattgttgttctctattggagttgctcattttttgttatggttattaccactccattctagttgctcttagcaactctgatttcgtgtgtgttcaacagaaatcaataaagcattttattttttttctttagtttcttgtaattttgtgacttttacggtctacaggatttatcagaggtggacttcagctatgcatgcataaagaatgccaatttttcctctgcttatcttcgtaaagcaaagttcagggtatgccattcacacctaagttcttcgttgtttaactgcttttgatgaagtagtagcccttaggaactatgctagttatcataatattttaaggcattttagttctgtcacaaaaaaatatctaagtctttgttttttgtatgactgtcaaatgttgtatcagtaataccttaccttgtatgttcatgacagctgacagaagctacttgttcttcattccaaagtgcaaatttacatgagtaagatggtccaaccagtttcttttagcttatagataggctctaagatgaaacacggtctctccttttttacttttgtgttttttttttgtgttggatgcataagcaagcagctaaccatctatttcctcctttttgtgttatttttgtttcgctgtgttattgtaattgcttgatttggaataacaggtgtgagcttattggagcaaatcttgaaggatctgttctagataaagcaaaccttcaaagtgcaaacctacagggtatgtaatccctttctttacctgtcttccgttttatgttatatgtttccaaaaaatactattatgctcaggattatcctgtttcttcattttcttggcttttgacatccttttcaccagggaagatcatcgtccctgtagtattagacaatgtagctatgcctattttgctttcactctctcctattcagggtgtgcttatattcttgtaaaaactaagtaggaaatgattgagttgctaggcttattttgcagatgcatgcttaaagcaatgttgcttcattgaaacggatcttcgttctgctcatctacaggtttgaaagtttattgtacatggtgtgtttcatgaatgttcccagattctcgcgctgctattctgctaacatattgcattcctggtcagtatacaagaaaaagtgaaaatcatgatgaacattagcataaagcaaagcatttctgtttttttttagaagttagttttctgctgctagaggtgatcgaatatctagtttccatccttgcaatattttgtatcatccaaacttccaaagtttggctgcaaaattttgtccttgcccaaagtattatctgcaacacatagacatatattttgtccgtacaggcttgtatcgtctcttcctgaacatttgaatataaggcataaaggctccctattccaaatggttttcagtaacttaaaatacgttgatatttgggttcttattactcatttcctcagtgtcttattgtcagtccaactggattttcagggtgctaatcttatgggcgccaacttgagtggagctaatcttgaaggggccaatctcaaggtaacaaaaatggccccattcaacctgcactttcatcctgcctgtcatatgtaacttaaggaaagctacttgagggggttaaccacagagctcttacacaaagacagaaaaaatgattctaatgtatccaactcttcttttactgccaagcttgaaataaagtgtctgaagtttgcactaggaaataactctagaagaaaatcaccaggagatgttccaaaggcatgaactgatgctgagatgtgcatgtcatgttttgcttacaaaatattaacaaatagggatttgcgaaagagatggtaatcatcttaattgatgataatgcttgcatataaggttttcttttttgtaaacatgtgatgtttgacatgagtgaaaaggtttcgacctgtagtaagtgtgataacagtgcaaacccgttatacttagaaccatgaaaccatgactgtttgatatgaaatcatggttaatcgtgtactgaagtgtacattaacgaaaggtcattggcattaacaccaatccctcttttcttgtgccttaactgacaacccagttccttgtcctcgctttgttattcaaacttctttatccgtactctaagctagtctgatttgcagggagctaagttggccggtacaaacttggaatgtgcaaatcttcagcgagcctacttgcgagaagttgatttgcgcgaaactgtatgttgtcctgcttgctgcttgcttcttcttttttttcctctctctcttttcagtctaactaaatagtgaacagtgaaagaatctaaacttacttcttaaactatgttttactttgacttacagcatttaactggtgctaagcttggaggtgcaaatctgcttggagctatcagataataccaagggaagaagcttatatcttctacatttacaattaaactgaaactggtgctttggtacctcgaacattatcttgcctgcaccaacggtttgttcatgagtaaatagtttcttgctaccgattctgcagatagtcatacagctttagtcggcggttgtacatatacccttgtcacattcctctgattcgaaaattcggtgatgaactgttggatacagctagttgcttagtatcatcatggatagaagctgttctagtaggaaaatttcctgcatactttgggatattgttgtgaacaatgactgaaaattttagtgggaaatatatcttcgttaatgtgcatacaattttcttttcatcatatttactcttcctttaagctttcagtaaaaccgggctcaaaagcgaggaaaatcatattttactcttgttcatgaacctatggaacttttgatgatgtagaaattaccacttgtataggctgcagagatcgatcatagatacaattaactgcaaatcaaatttgtttcggttataatttgcgtgcacagaacacttgcgtttccacacgtattccgaaaggaaacgttggcaataggtagcaatatgtacaaggtgaaggtatcgaacgtgtaagctacgtgcaggcttccgaaacttgcacgtcgtcgttcaggggggctcacgcatgcaggatcacttcagtgtgtcagacgcgcatggcgatcaatggtcggagaagccgatgagaccatgtccgccgtccgccgccgacggatccatcatcagcctgtacttggcgtagaagccggcggcggccaccaacgccagcacgacggcgaggaccaccctccacggcgtcttcctccggccggtcaccaaggcggtgccacccgccgccgccccgtcgttggccgcgccatcgtcatcttcttcttccttgtcctccttctcttgatctgctggtgcagcggtttgctgcgcctgcgcggcgccatgatcggcgggtgcggcggcggcggcggccttgggctcctcttccgccggcgacagcttgggcatggtgatgtggaggacgcggtccctggagtcgaacctggcgcggacgtcgccggcgttgcagtcatcggggacctggaaatccttgtggaagcggctccaccggttgccggagacctgccgctcgccgcttatccgcagcttcccgtggttgtcgatctgcactctcagctgctccttcttgaaccctgcaattgcacccgccatccaaaatgacacatatcaaaccttgcattgcatgaactgagcaataaaaaacaatttgtattcggtctaaaagttggtgttgaaaaacagaatgcgacgaaaaacctctaaaatcaaactgcagttcccaaaattgaaatttaattttgttgcggctcataagcgaagaggtgggaaggaataatgctcttgcctgcggcagataggttgatttgaaggaccttcttgccggcctcctcgaccagctggtgcggcggaacgaagtcggtgtagttgcgcggcgaggtggcggcagcagcggcggcggccatggctgcaggtggtcgatcactgaccggtgatcaggtgctcaggctatgatcactatcaggtgtcgattgatcagttgcaggtgtggtcgagttgatttgagaggaagccggtgttcgtgcacatatatagtgtgtggattcagggttgtttggagtgcgatgcaggaggaaggattgcttcattggacggcgtctgcagggggccggccgcgggaatgaagctaccttgcttaattaatttggttgcgctccctcggtgatataccttgtctagccttcgccaacgcatacagatttcccccacaaggaatctgaaccgtgctgttgttacttgttcttgttctcacagtataagtatttcctgcgattttctgtggtttgttctgggcggcactgtcgggatgtcggcagtcggcacggtaaaagaaaaaaagaaagaagaaaaaaatgtgcgtgaaacaccgccttgtcaagccatctcccgttctccattgggccgggcccggcccactggccgagtgaaactgtacagtagacttgcagttccaggttattgaggtcagacgggtcgttgaaccggcgaggacctcaatgaatgaaccaacggtccaaacggtcaaaccaattaactatcgaaccgagggccgccggttcaacgactggtccgatctcaataactatattctgagctgctacagactcacatgcacctgtccagcggttcggtgccgatttttttatcggtcttaagcggttttctcaaaatctatgtgtctagccggtttttaccggttcacttgcgtagacggtcttttaactggatcagaccgacgaaagctttggttccgatccaaccgctgctccggtccggtcctatggttccagccgagccgagccgagccgacgagaagctctagaagagtggcgttggggacgtggacggcgagagcaggtgacgcgttcccgcgcgacgcgggccgaggtggcgagctgcatgcgcctcatgcacgcacaccaacgcaccaaccagcgagttcactctcccatactactagtaccactctactagactccgttcgctgacacgccccgtccactcttgtccacgctgcgccgcgcagtgtcgcgcacaccccaaaaccccaaccaaccaaacaacccgacccgcggccatggatgcggcggcgggcggcggcggcgagccttcgccggcgccgggagtgggcggccggaagcacctctcctccatcgccaaccacgtgctccgccaatgctccctgtgcgtactttctctaatcctaaatcctaatcaaaccctgttgatggttgatttctccatcgtgtagaaactgtgttgttgttgttgttgttgttgttgttgttgttgtgtgtgtagaaactgttgctatcaattcgaaagaaactggcagtgttttccttgtagcagactcatgtgctttgatcttgtacgaacagaacatattggtatgaagcttcactacttgaaatgaagccggattacatgtttgggcattttatttgaccgcacaaactgcttccaaattaaacctctagcgcgtcagttattcattagtaactataccctgtatttgctaaacgtctctagttctctgatccatatgtccaaaacaatctgaatactataatttctaaccatgtcactgtaaccatgtcctgataccattagtaatatattatagcaattattctattcggtgcatgattcatacgtaatccttatagctcgtcgggagtcaggactcaggactagaaatggcaagagtaactaatacggggtcatggcttaattacaggacattggacagaagtgttgatgaattagttgcagactttgagctcggtttgaagactgctgcggtggataactattcaagaagacttgtcgagttctgtatccttcaggcgctgcaagttgttacatctgttgatctaggagacaagatccatgatggatcgcttagtcggttcacatttgatatgatgctggcttgggagacacccactccttcagatcaacaagttaccatggtttgtgatttttttatatttgtgtgaaattgtgtgtttgtgttcttctgaaatctgatctaaactgaccaatatggtgacattacaggagagcatagctaaagaaagagaggataagaaggagccgctcggagcaaatgaagctgtcatgggcgatgagacctcactgttctattcagatatcatgcctcttctcgtatgttaacacatagctgattaaattcctttccgtaaaatttcttcaagctattcatcggtaatgatgtttcaggtgaatgaagaaccaacagttggagaagatgcatatgtgtggtttggatctgtatttcctttggcgtgcgatgttatcaatgctcgattcacctttgaagccctgactgctacaaccgctaataggcttcattatcctgcttacgacaaattcctgaaagaaatggacaagtatgcaaccacttcacagttagatcttttttgcaaacataagcaacattgcatttcctctgttttttaatggataactccattgacttttgatgtgatatttgactattcgtcttattcaaaacagtagtgcaaatatgcaaaaaaatttaagtcaaccttaaaagtttttaatgataaaacaaatcataacaaaataaacgatactgatataatatttttgaataagacaaatagtcaaatggaatgccaaaagtcaacactttcatacctccctgctagatgtcgttcttcttctttttttttaacaaactggtagaactgcaaattatactgataaagcatgagaaaatgatacaaaatatagaacactgaccaccagtccaccacatcctgatggatgccatgtgaaattgacttttttttaggtcttccgaattcttgcagaaggtgtcaactccaaccggaactgaacttgctgaagatgaattcatcttgcacatcgagggaacagcaggaacacaaagggtggtgcggcacattggaaccactagttggccaggtcatcaatctgatcaagagttatattatttctggtttcttcaggtcttagcattttacgttgatgctttggtaacattttcttatgaatgctacattggttgtatactatacaggcaggctgactctgacaaacaaggcattgtattttgaggcttctgggaaaatttcatacgaacctgctttcaaagtcgaacttacaggcagtgaaataggaaaacaagttaaaactacttcaactggtccttttggtgcaccattgtttgacaaaggcatcgaatttgaactgtgagttccctcttgcatttcttatttttgtgttcatatggacaacctacacggatcaattctttttgttattaaaattatcactttgccccttttgcaaagaatatcgacagtaaccattcatctatgcagaccagaacctttggttttggagtttcctgagatgaccagctcaacaaggcgcaatatgtggcttaccctgataagggaagtaatattccttcaccgattcatatcaatgtacagcatagactcccccattcacaaatgggaggtgcattcgagaatcatattgggggtgataaggcttcatgctgcaagagagatgctaaggatgtcgccaccgcctccttctagcttcctagtattctcgctttacgatgagcttcctaaaggtgattttgtgcttgaacaactagcaaataatctgaaagagacgtcaacgataactccgctcagtgcatcccatgtgttcaagggtttgagcaagtcgcatcgggtagctttaagtgcggagatagcaaaagagcatgacaaggactcaaatagccatgaacagcccttggcatcacttgaaaacactatcggtcaagtaagagacgaggctcgggaagtcaccgtcgctaacgttgctatcgaaggaatgaaggaggaaggtatcactgatagccttcttgtactggtggtatgtacatttcttttatattctctttggtattttatctgctcaaatcatttttatttaagccggattgatttaatcaaacttccattcaacggttctaagttctaactgttttttatgcaggggttagtaagccccatgagcaaattgtttccagtgatccaaaagataatctcatgggagaaaccacttgtgactatcagtgtccttgccatgatggtgttaaccatatacaggttagatttatacaccgcatttaatttcaacatacattttactcttggaaacgatcagggaacatgagatgcaaggtccctttttttttcaacatgatgcagagagtgggtcggttttgcgttagcggcatccttgatactggcagcaggattcatggtttgggctagacaaagaaaaatcggtgcactatgctcagaggtgatcatcgacacttcatcggacaagacgacgatggaaagcctagtggaagcacagcaaagcctgaaaagagtgcacgagtacatcaagacagcaaatgtcgtgatcctccgagtatcgtcgatcgcgttagcgaggtcaccaaaggtatcaatatcatcagagttcatcacacacgttctccgatcaccgaatcgttccaccgttgcgattcatttccatgtcatgttaacgcgttccttcatcatcatggtgtggaactctggataattttctgagtttgcagcatacagaaacggtgatatggatgctgacagggttggcgctggcgctggccgtgatcccgttcaaatacgtcctgatcggggtgatggccggcggcttcatgtcgaacacgaggatcgcgagagccatgtcgaacccgcagggaagccggcggtggagggagtggtgggagagcatacctgccgtcccagttcgggcggttgacgggggtggtctgtgaagtgttcgacgaaatgccggcagaaaaatcctcggtattgttcagctataagcttaagtgttcatgtatgttttttgctcagagatgtgccatactgccatcatctttatcacctgtcagctggtgtataccagaaaagaaaaatggcagagcacttaacacggaacactttgttggatgtactaacggttaaataactgtcaatgtgtgttgataaataaaggaatacgtcatatattcaatattcaatattgtggtgccgagtttttgtcagtgacatatggatttagaagaacgtattggcagcggaaatactgctactaatgaaatagataaagtttctgtgtttgttccgaactttcactctgaaacttccgaaccaaaatcaccatctgaattgtcaacttcccagcacgcgattaggccatctgtaatctgttatctccagaacaacatgagagtgaatgggtgatcatgcttatatctgaaattcagaggcaaattgaaaaaactaaaatattgaaacatggataaatgtggttttcgagtgctattattagccccgtcgattagggaacatatttgatataacaaaccttttggtgcacacattatgcacaccaactattttttttaaaaaaaatcttcgcgtatatatcatacacactaactaatatattttttaaaaaatatataaaaaaggtgtacgatagtattacacttatatataaagtcgtaactacaattcatttcattgtattttagctgtaacaaaataaataaaaaaataactatttcaagagtataaatgtattaatttttgtttttttatatatagagtgagtttgaagataagatttacacatagatgtaatactagttgtataaaatatcttagaaatttttagtgatagtttttagttaatgtgcacggtggatacacgaaaagattttgtgcgtacgatattccagtcagattaacagctcaacactagcattgcaattgggacacagtgctaggagcctccgcgcctttccgaagccgaccgccgctccatccgccgagctccttacattcccgggcgcttgtttcgtagcgagtcttgacccagacagacgacgccgggaatgcgccggccattgagagcgccgccgtggataccagccgtttgacgtgagatgaagacgtggggctttgccgtcgccgtgttgccggcttttgccgccatgccgtggcgctgtgcttttgctgttcgttcaacgtgttaaagcgcggccattgttgcagggcgaggtgccgacgttttcttcaaggactgacttagcaattctcttcattctttgggtttaattattccatagttcatcactagaacagcttgacaaatgtgtactgtatgtagcaaccaaaatcttcatgtttgtcgtcttcagagttcagacaaaatggcgtccggtttttgttttgcaatcgattcaaccaaaccttgtcgaaacgatgaaacgatcttaccatgtcaaggaagacaaggaaaaaaccagcaaaaacgtttgctatctgccattaagaacttgacagctagatgagtcctcagatgaatcatgatggcattatcagcggtatcgagtcgtttggctgaacacacaccgtgccaacttggttaacccttttgtttggtagcgcaaacaacagttaaaaaaaaagtactacttcaatttacagattttttttcccagtctatccatccaattaaccaacttaacgaccattgcatgtagtcatgttcagattcggacaacgcacatcgagaaaacgtttgctttgcatcagatatgctaaaattgcccccacacacgcctaacttgttggagatatttacccgtcgagctgtcccaatccaaacgaactctcatagtatatgatggatgagatggatgcatagatggattggggaaaaaagttgagttgcgcatgaacaatccatgaacttggcgaaggaaaaggccacatccatccactaatcccctcatccaccattccacccacacgccgagcgcgaggcggaggcggccgcgtctataaaaccagaggcgcgcctcgccgcgccgcgccgcgttctcttcctccccggagtagaaaccgcccgccatttggatccccccaattcccctcctcgcccaaaaccctagccgcacccccgccgcgcgccctccgcctccgcctccgccgcggcgtgcgggctccgtcgtccgtcggctcctcgccactggcgtcgcgaggcgtcgtcaccggaggtagcgggagctcaggggacacgatctcgaaggcgcgcgccaggacgaacagctcgagcgcgccgcggggggccttcggttctgagataaatcaccccgtccgcatcatcgacgcctccctccccgcgcttggcgccagctcgttctagggggggaagatctcggcgacgagcagcttgggcgcgttcgcctcgatggacgagttcaaaggcccaggggagaaggagaaggaggaggaggccggggacaaggccgcggcggaggaggcgggggacggattccaggtggtgcgcggtaagaagaagaagcggcccaatggtggttcggcttcgggtgctgggtcggggacgatgatggccaaggacaaggcggcggcggcggcggccgcggagccgtggacgaaggcgaaggtgtctttccacgatcccaacattccgcggccgcaggatgtgtacgcaatcagagtgaacaactacaacgtgccgttcgaccatgtctggctagagcgcaccgaagatggcagccgccctatccaccctctggttagtgttctatttcgtcttttagtacctagtttttgcttttgagtcttttcctttttctgttgcttggtgtgtttagaatgaggagctaggaagcccttgatcaaatttcaagccatgacatgaccaaacattgttttacctttttttttgtggtgtttttatttgtcaatcaaatattgatgtttcttggctaaagatcgagccttgtatgggtaagaaatgttttggggatggcctacatctactttggagtatgatcttaagacaagaatgcttgggtattgttgaaaaactataagatggcatgtgcagagagaagcggggaaagacaaagatttcttgaatttttttttcggataatcaatgtgttatttttattattatgttgaaactatcaaaaagtaagcatttacatgttgactcaggcctaattggttaacagaattagtaggaatgctgtattttgtttttcgtaatcatatagagttattcaagatttgttggttttcttatgtccttattaatcaatagtggaaggattgacttttttgcatattcaattatccatgcatgggatctgatgtaatatactctcgccttgcaggaaaaactgccaatggagcagtttattgacagaaatgttcctgaaagtgaacctgtaaagccagctgatttggaggataccccatttacgctagttgaagataagaatggtttagcagacttagctaaaaagttgaagagtgtaaatgaatttgctgtaagcatttgtaattaagttttatttaactttcaaatgaatatatatcatactttgtttccacttgcattgtattatttattaactttcaactgctagagtattttgtcttatgtagatatccccctgaaaaaaattgtaagcatgcttccctggcatgagttcctaatactggattttaaaatatgcaaacaaatcttgtcagtaattatctataaaatgtagtgaaacatagctgtagttgttgggaagtagcttttctttattgggtgggcagtaccttttatgatctggtacattgattttgacacatattgtgtactgagtttattttggttagagcagtaggactctactatttctagaactgttagaccattagctccttaaatgttttcattttacctatcatcataaggctccagtcattaacccaattagcgctgataccctgtaaggattaaaccattttatgtccaatatattgtagccttttgacttaggattcaaatgaaattgatatatgctttattctgaatgacatactgttgcctgtattgtttccctttctttgccttgtctgacaacaccattcactttctgcactaacggcattgcataactttactggattcttgaaaaagaacatattccatactttctttctgttgccttctcggtcttttacatttcattcatgttatgggcatctgttatggaataaaacaacttctgaggccttgcagtgttaggaacttaagctttatttcggttcgtctgttgttttcaggttgacttggagcacaatcaatataggtcatttcagggtttgacctgcttgatgcagatttcaacaagaacagaggattttgttgtagacacccttaaacttcgcatatacattggtctctacttgaaagaacattttaaagatccaaccaagagaaaggtttcttctgcgttctccaattgtttatcattttattgaggggaaattgtttatcattgtgaactcaaatttctgtttacttggtttcttcttgtgcaaaaaggtaatgcatggggctgatcgtgatattatgtggctccaacgggatttccacatatatgtttgcaatctttttgacacaggacaggtattttgattaataggctaataatactaaatactaaaactgtgattcttgattgcacctttaatttacctctttcttcattctccttcaaaatcctcattttcatgtcttataaactgaaccttggattttcctttctaactccaaacaggcttcaagggttttacagatggagcgaaacagcctagagcacctattgcgtcacttttgtggagtcacagcaaataaagagtactgctcatttacaccaacacaattttcaagtatccatggtgacctacctaattatctacaatgagtatttatgaccaaaacataccccttttgtagatatcaaaacgctgattggaggtcaaggccactttctgatgaaatgataaagtgtttaacctatagaccctatctttcatttattttggtttagtcttgcctcgtttttgtcctacatgttttactatttcatccagttttacccacttgcaaataactcctgtacaggtatgctagagaagatacacactatctgttgtatatgtatgacttgatgaggttgagactgcaaaaggagtcgacatctgacaatgatcttcttctagaggtaaaaccttagttcactagtttttccttttgttctgatctgatttttaagtctgtatgagtgaacattattttggtatatcctttttttccccttgaatgaagtatcgctttagaacaaactgcatgtagatcttacaaagtaaccattgtgcgatcctgttcacataaatttacaatctgtttgttagtcatgattcctgaatatatgtgattttcattagtactgacaaagagtatcaaaatagacattctgatcaccagttttcggttatttcaggtgcaaaagcgcagtaatgaaatttgtttacagttgtatgaaaaggaactgctgacagatacatcttatctccacatatacgggtctgtagctctgtatgatgttctctcaattagttcatttcattctatcattcagaaatgcacttttgctaacctcgaagttattttgttcacatttataatttgcgtgaatcccattaacacgtgtattattacaggttgcaagaacatgacctggatgcaaaacagctggctgttgtatatgtaagagaacatcttgttatttgtttacttcattatgatcattctgtctcgaactcgaatagagctaacatgtgtaacatggcattgttcctagaaatgtatttgtagttgctattactattggctgttggcgacagtttctcattttggctatgttcataactttattgacttaaagtttctgaaagcccatatgtccatgccatgtttccaaataacaacttatattttttctaccaattcgggttatttaatttatgtgtgtaataaatatctcacatatctttttgcaggctctacatcaatggagagattatatagctcgtgaagtagatgagagcactggttatgtgttaccaaataaggctttaattgagataggtactgctgatttatttttgtttttacggcacaggacttgatgtattagtttggctaactaactctttcatttccaccccctattgaattcaaaagcaaagaagatgcctacagatactgcagagttaaaaagaatggtgaaatcaaaatatccatttgttgatgaaaatctggaccaagtcgtaggcatcatatggaatgcaactgaatcttcttatgcctttgaaagcagagctgaacaactaaagaaggaacgtctggagcaggtatgtttaggttgatcttctgtgtatttcatatcttatttgtttgcttttgaggatggtggggagaggatcacagaatgcgatttcttatgtgccaattattagcattgacgtttaagcacctttggttgtatccagctaacggacagggttcagactatatcatcacctgagatgaagacatctatgaacttatcaggccagattagatcaatggataaggaaatactgagcgataacatacatcagcaggtaagagataatttcagtgtctgtagtttttgttcgcccctgtatttatgtagttgcattttgcaggtggcacaggctacttttcaagaactgaagagacctatggctttgggagcagtagggaattcaacatccgggggacagagagatttctttggagggttttcaaataaggtataagcgagtgcttgatctgaacaatgaaaacatttaagtgttcatttaaatgcatgcatgtcattttccttttgaattgttgatgagttattggtatagtacattcttggtcatatactgtaaaatgtttaaataatccttttggtttagttctgaatgttttgtctttacaatagttttttgaaaggaaaatgtttgaagaaccttcaatttttgcaatagttatgtcatatgccaccattttacctttttccttcatgatttaagctatgctttcctggaaatgtttttagatttcccagttagcttcatgtaggaattgtagacttatgtttgttatcatgcaattgcaacttatcaataatttacggaattgcagtctgagaagatggagaaggctaaatcctatccagccttttactacccccagcttccacaatatagccctgaagttgggtacggctttcaatcaataaaccgaactatggcgggaacagcacagtctcctactggcaataaggagagggatctccagaaccctagaagacgtcaatctttcccaccttccggtaacataagtgatacacaccagtaattgctctgatgtatgccttcaaattcatccttctgtgcagaaaatagctgtagagaaatggaaactgggctgtttttatccgtgccccctaatatgagaaactatgcctccctcagatttttttggctagactaacagaaatatgagaatagcccatatcattgacattagatgcagagcatgggaaatgccaatgtggattggcttgtgtgtaacaactgacaaacatgtgctgtgcaattgtgaatactggagttgtacaagtggtatactgtaatactgttatagcatagcatcagaatacaaagacagaaatgaacacatagcatcgatgtctcttttctttatttttttctttggacagcatgccttgaattatttgccataatgtctccgtcccgctggcttcatcacaccttctttgctgggtttagtttcagttcatcgtttggattagctgtttatgaatagagatgctgtttctgtctatgttcactctcagggatgaacatagggcctgcactgtctatgttcaaactcagagaggaacattgggcctgcactgcagcggtgaaatggatccgtgtgttcgcgccaccagaatgagcttggggcgcaatggaacatgtgatgtcagttaaagttgcaggtaaggcagtcaccggtcaaatcacggcactcgccaaccaggccggagcatatcggctctgccgtttgtttgctcctatctgtacgtagcacgagctgttttccattggcaacgcctgatcgatcaaggcgttctactcccctcagcacatgacgccaacgggttgcatctgctgacgacaaatcgctacgcagactccagattttacagctgtgttctgcatcaaccatggggaattggcgacccaaagtgccaaaccatcacacgcaagttgccatgatcgatgcgtgaaccggaaattgatcctctaacttgtccccataatttatgagcctacgtatgagtaacccatagcatagtatcagagaacagtaagtcagataagccttttcgatctgcgaccatcaaaatcgaacaaacggcagcacattttagccgaaacgaatcagagatctgccccagatttgcaacctacacacttgacaatctcaacttggctgcctgcaatctgccattccccttccactgcaacatggagatagccccacccaccaacgcagccaccctacggaaaagcacaccgtaacgccgcccaccaacccccctccgaatctcctccgatcccgacgcctatagatgaataaatctcctccctcttctcactagacaaagcccaaaccaaggccaaaaccctcctcccctcctctcctctccattccgccgccatggccgccgccgccgccgccgccaccacccccaactccctcctcctccgccgcccggcggcacccaagccggcctccgcggcggcctcgccgctccgtctccccacgcgggcagccaggatctcctgcgcggccgtggccacgcccgcgcagtcctcctcctcccccgccgccgccgccgccgaccgcggggtctacaacttcgccgcgggcccggccacgctgccgctctccgtgctccagagggcgcaggcggagctcgtcgactaccgcggctccggcatgagcatcatggagatgagccaccgcgggaaggagttcgacgccgcgatcaagaaggcggaggccgacctccgcgcgctcctcgccgtgcccgacacccacgaggtgctcttcctccagggcggcgccacctcccagttcgccgccgcgccgctcaacctctgcgcctccccctccgaccccgccgacttcgtcgtctccgggtcgtggagcgacaaggcgttcaaggaggccaagaagttctccgccgcgtccgtcgcctggtccggcaaggacggcaagtacacctccctcccgcccttcgacgccatcgagcagaaccccgaggcaaggttcctccacatctgctccaacgagaccatccatggcgtcgagttcaaggactacccggagcccaagaacaagtcgggcatcctcgtcgccgacatgtcctccaacttctgctccaagcccgtcgacgtctcccgcttcggcctcatctacgccggcgcgcagaagaacgtcggcccctccggcgtcaccatcgccatcgtccgcaaggacctcgtcggcagcgcgcagcccatcaccccggtgatgctcgactacaagacgcacgcggacaacgcctccctgtacaacaccccgccgtgcttcgccatctacatctgcggcctcgtgttcgaggacctgctcgcgcagggcggcctcgccgaggtcgagaagaagaacgcccacaaggccggcatcctctacgacgccattgatgccagcggcggatactacatctgccccgtggagaaatccgtgcgatcgctgatgaatgtgccgttcaccctcgccaagggtggggattttgagaagcagttcatcgccgaggcggccaaggagggaatggtgcagctcaaggggcacaggtcggtcggcggcgtgcgcgcctccatctacaacgccatgccgctcgccggtgtggagaagctcgtcgcgttcatgaaggatttccaagccaggaacccttaatttgactcatggtggttatggtattttgatgctgtcttcagtaggaatggtctctgttcttcatcatagcataattaggctccttgcaagagctgctttgcgcgtaagagattttcgatccatctgttgtatcggtaccagtaactatttcgcgatgctgctgctactgcttttcatgtgttcatgggatctcattcccattttgtgccattgaatgttagtatgggaataaaggtagattcttagctatctgagaggagtatatgctgatgctgatgcataataacaaggttgcttggtcttcttgtgtgatcatttctgcttagtttttcttgtgtaatcattttctcctttgagaaatatttgccgatgactgttcattcggatcatgtaagattgttctaccagaaaatctttagattgggggtgaaatgttaaattaccggtaactttcgtgatgctgcttctgttcctgtttgatctcattcccgtgtcgttcatgctgtctcttgattcagtgcttatgtaacaatgtacaatttttagctcggttacagttctgtcaaaacaaacaagtttggttggttctgatgttttatcatttccttatagagacttatcgacaatcattcattcggtttatgtaagattcttccagcagaaaattcttcagattgggatgcaatatccaggttgttgttagtattcatggtctggaggttggtgagcaagttcttgagtttggtggcgaagagtatttttacttgttgctgtgtctcagtctggagtggactggactcactcagagatgagtgcgacagcttcttgttgcaagccaacaaattctaaacaaaaatgtcatttaacttcgaaatttcaaaccgcacgtttggtaaatctgccttaaagccaggagtaccaaaggtgactacgatcaaatcacaaagaaagtgtatttgactttgttctgtcaatacttaagcagagcagcaacaatcctttttgaatacctcgatatgtcaaacttgtactgtactagtttgtcatccttgttcatttgattatgttttctagttgtgtttctacaataaagctgtaagctgtttagttccagtcccatgttgatcggttgatgcatctttctttatagagacgtgaggaatcccaaatgcattggttgcctttctgaatcttcggcgttttcaagtgagaggatcactggggtatactagtaccacttggtaatcatatgacgtcatcgatgattaatcccccgtttggactcttcgtttggtattgctaatctattcggccgagtggatatttctgtggcacctttctgaatttctaatataattttggatcttttgttaattcttttacgtgttttgagccagaataagttcaggaattttgtgagtcaccaattacccctggaatagctgccatcagaaagcaaatgctctgcttgcttagtatcactgtcagaagtatgtagtatttagatggatattaggataggattaatctgtattgggtccttttaacaagagaaggttatactccaataataagaagcaaaaggtctaagaaatacttactatcgaaatatagtaatctagtattcaattagacaatgttcagattcataaaataattagacaatgttcagatttataaaattgtttagattcgtaatactatatataatgcctaggaccgcagaagtaagaagagcacctgctagctagctgttcatgctgatttctgaatcttcagaaatcaattaatccagtcgtgatagaaaatttttaattcggcccaaaatgaatggcacattgaatcgtaggcccaaatatcaaaggaataagttcacctgaggtcccttaacttgttaacgaatccaattttcgtccttcaaccggaaaaccagatacgacaggtccctcaactatcaaaaccggtgcagatgaggtccctcagcggttttgatggcggttttagctgacgtggcgcctatgtggctaatttgactcggtattcgtcccacgtggcattgacgtggcgcttacatggcaattctatccccgaaaaataataaaaactatgggcccacatgtcagttaaaaaaagtgggcccccacaagtcagtgctctctctctctctctcacactcttctcatctggacccttgccgtcgacttcacttcgaggcgttcgggctgccgccgctcgtcccgtccctcgacccggccgtcaacatgagcagccttgccgctggcgcatgcttcgcctccgccggcgccggctacgacaatgccacctctgatctttttgttagccttccattagagcaaaacgatagctagcttagctacattttcatggtgttcttaggtgacatcacacatgacatccatggagtaattttgtgaggtcgcgtcgtgcatcggtgctgccgatgtggaaggagctggactacttcaaggagtacgcggcgaggcttcaaagcttccggggggacgacgacgcggcggcggcggcaacgctgtcggaggcgctctacatcgtcagcatgggcaccaacgacttcctcgagaactactacgccatggcgcgcgcccaagcggcggagtactccacggcggcggcgtacggcgactacctcctcggcatcggcgcatcgccgagtcgtactcgttcgtccgcgagctgcacgcgctcggtgcccgcaaggtcgaccttaacggcctcccgcccatgggctgcctcccgctggagcgcgccacggggagcggcggcgcgtgtaccgacgagaaaaacaccgtcgtcgagcgcttcaacgtcggcctccaggacatgatcgcgaggctcaacgacgagctcggcgacggcgagatgatcgtgtacggcgacgtgtacaggccggtggccgccggcggcgtacggggtggagaacgtaggcaacagcaccgtgcccacgcgggtcaaccggcggcggctcacctgtgccatctgcttcgacatgttcgcccccggtaggatgaggtcggcggggtgctcccacagtcccactacaactgcatcgcttcggtgcccggacccgtcctgctcagtcgccggcggaggcgagcgcggcgaccgttcctgaggagggcgcgggggcggaagacggtgctggagaacggccaccggaggccgaggcaagggggaagcggcggcggcggcgggaacatgcggaggcggcggaggcaggcacggcaggtgacgaggagagggcagcggcagccggcggtaggcccatgggggcgggagtggaggaggccgcgcctcgacgctgtccgcatctccgccggtgagaggagagaggaaaggggagagatgtgaagataggtgagatggggagagaggaggaggaagaggaggggattgagataagaagagtgagtgagagagagctgacatgtgggacccacttggggcccaccagttttttttaactgacatgtgggcccatggttttttattattttcagtgatagaattgccacataagcgccacgtcaaatgccatgtaggtgccacgtcagccaaaaccaccatcaaaccgcggagggatctcatctgcaccggttttaatagttgagggacccgttgtatctggtttttcggttgaaggatgaaaatcagattcgttgacaagttaagggacctcagataagcttatgccaatatcaaaagataaggcccaaagtaccctaccctctaggcccaaatcttccgccataatgctccggcccactaaacgagacgcgggcttaccgcgacgcggtgtgcgtacatcgtaagcagcgggctcctccgcttaaaagctaagctccccaatataaaccgcagtcagggcgaaaaaaagaaagaaagaaaaaaaacaaacgcgaaccgactgcgagtagtaagtaaggctaagcatccgtctccccccttctcgattgttctcgatctgcggcggcggcggcggcgatggccgacggcgggaagcccccgacgccggagaagaagtcgtgggccgacgtagaggaggaggaggaggccaaggcgaaggcggccgcggcggcggaggcggcctcctcgtcttcgtcgaacgagccggcggtggacgcgcaggcgaagcagattgaggcgctgtctctctccgtgccggaggagcatggcggcagcggcggcggcggggacgaccagggcccgcctctcctcgacgactcggatgagtcccaaatccaagccgtaagttccgcgtcggcgctagtgctgggtggccaatctcggtggagtcgggagctgctttctagggtagtttggttgaccggccgattgatttcgaggtgttcctgctcaggtgacctcgggcggcacggtgtacgagtcggcggcggccttcgaggatctgaagctgacgccggagctgctcaaggggctccacgacgagatggggttcagccggccgagtaagatccaggcggtgaccctccccatgatcctcacgccgccatacaaggacctgatcgcgcaggcgcacaacggctccgggaagaccacctgcttcgtcctcggcatgctcagccgcgtcgaccctaaccggaaggtcacgcaggccatctgcatctgccccaccagggagcttgcccagcaggttgattgagcacacatacttctattatgtgctagtatgtggatttttttcttttcttgttatggatgtgcacactgtaatgtactctgtttgttttattgtgatttgcagaataaatcggtgcttatgagaatggggaagtttactggcattacctgtgcatgtgcgatcccaccggctcagaaagattatgtgccgatcgctaaaatgccaaagattactgaccaggtggtgatcggcacttctgggacacttatgaagtggattaatcataagaagatcttgacaaatgatatcaagatacttgtgtttgatgaggcagaccatatgcttgccgaggtatggatgagttctattgctgttcctctatccaaaacttgtgtatgcccattgcccaatgttgttttctattatttattttgttattattaggagaacgcctcgtgtttagttattagggacatttgggttagatattaatcttatggaaagagataattgattattgcaatttctaagctgtataggaattgggaacaatgaagcaaaaactgccataagctcgatttgttgtaagatttttttttttgacttaacaagaataatggtggcttcatgatgattgattttcttactcgaagtggcataccaaagattatctatggcctgtatacacagtacgtggtgtttccattgatattacagatcgggtctggttgggatgtaaaaaggcttaatgtttttttcaactactatatttgccactggtttgtgcagcattgcattatattcattattaagaaaaatgaaaaaaataataatgtattggtccattgttgctacagtatggttctgattcgaacggaaaattgcttcatgtttttcagtagatcaaatgatattagcctttcctaatagaaaaatattttggtatttgcatatgtattatctagattagaagagattcattcatatggttatgttttacatttggtaagacataatccctcacatgactaaacatttgtttaaaattgatgttgctcgtatgtttcatacttcatatctgcttatgcactcgatgagtttatgtattatgagttgaatagctttattttcacgcaatctaacttcacattataaatttcataaagtccaattccttataatggtgaatgcattctcgcaggatggcttcaggagtgattctgaaaggattatgagggatatacaaagaagcgctggtggctgtcaggtaacatttttctggtcacttttaacttcctttgcttgagtaggtccgtcacatgaaacagcttgaatgctccttatagaaggcgatctggatacagtttgaaatcagatatgaggttaatatgtccattctgtgttaagaggatgttttaggagaagcattttcctatagtctgcaagtatacatgtaaatatgcaattgcttattcaagaactccaaccaatgcttatgatgtaattggagaactcctttgcttgcttgcaagtagtggaaagagggtctaattttaaattttttggccattgatgatttttttttttgaccaagggcagccattgatgattttatctggtttgttcagcaattttgcaagatcattcagatgatcccaaatataccttttgagttttaaactagtcttttccatgtcatgtgatcatgtgtggagttgattgtccaatgtgtggagttgttatttattatttgaactgatggctgtcaggtgcttctcttttctgcgacattcaatgagagagttaaagattttgttacaagggtcattaaggatgggaatcaaatatttgtgaagaaggaagagcttactttggaaaaagtcaagcaatataaagttcaagtccctgatgaaagggcaaaaatagcagtcataaaggacaagatttttgagtttggacaaaaagttggacaggttatcatttttgttagaacaaagcaaagtactaaggatgtccacaatgctttgacattagaggactatgtatgctcctcgattcaaggatcccttgaccaatcagagagggaaaagataatacaggaattcaaaaatgggtacaccaaggttcttatatcaactgatgttcttgctcgaggtttcgaccaagcacaggtactatttgtgtttgttgactttatacttgagcaagtgtaaatcttttctaacattcttcctttgaaaggttaacctcgtcatcaattatgacatgccaatcaagtttggcacaagagatgaacctgattatgaagtgtacctgcacagaattggcagagctggtcgctttggccgaaaaggtgaaattatttctttggttctcttttgtccaaaaaggaaaaaaaaatgtcgtggttataattcaatgtttagtaagtcttcgattaataaataatgagaaatagtcaatatcagaggtggcctttataaggtatgttgaattgctgatcaacaatttcggctgatggatccaagttctaagaggtcttagctgagcaaacctgtcttgtggtgctgacaaatcttgcctatgtctagtcgaatacttaacataatgtatgtgtcttagactgtaagttgagcctgagcttttcagctgttttctgtggataagatagaatgtaagtggcttggtcaattataccaggtcatctttctatgatgggcaatgatgtgtcttctggtgcttataatcaaatttttctggacttatttcatggtttatgtgtttaacattgatagggcttgtagaccaagtgatgctaggccaaccaaacacctattcaaattcagcccttctatattttagtacatattctgtagcttatattcttaactttgtcattgctggtgcaggagctgttttcaacttgctatgcggcgaaacagataacactgtgatgagaaagattgagacctacttccagcacaatgttcctgaggtgtgtaactgcaagatgcatatgccagtatcttgtgctcctaagcattagcttattgtgttctgttcatttgtaggttcgtaattggcaaagcgaggaagattttgaaagagctctgaaggatgccggcttggttgagtaacaccattggaaatatggcatcagatgcgctcttcacttgtgacgaacaggcgcgtgatatttaccagctgaaacagcttctaaagcaaagcaatcgagcttcttgagctcatccttggttattatgtcgagagctgtgaattctgttaaagggactcatccaaacaattttgatgctatgagcttatatgaagcaaaggtgttccttcgctatttcgtgggaacttgttgccaggactagatctacacttgcattatactctgttacttcgtgtacttaactgggaacctgttttggtttttatggctttgtcgtcgagatgcggtcaccggtgtacgttacgcccttgtgaaaaaactggaaacctctttctgggtcagtgtacttgtacacttgcgccattgtttagttgcatgtacgatgtttctttctgcgtcagctgtaagtgtacacttgatttattgtttagttccatgtaccatgttctttttcctgttctctgtacacttggccacgctgatacatgagatgcaccactatctcttcctgcatgctatcgctttcagcgtgtttcttgtttcaaagaacaattcgtgtataaattggtcgcctttttcactgtcgtaataatgaaaaaaaaatagagaagaagttacaggttgtcgtgctcgatgacctgcgccgccctccactcctcgccggggttgacgaccaccggcaccagcatggacgccgtcccggtgcacaggaagtagtccttgccgaacttcctgtacatctcccccgggctgcacaggtacatgtcctcgtaccccatcctcaccaccctgaaccccagcccgctattctgcaaacgcatcaacaaattcaaagatcaaattcagttcaatttcaaccaagcctttgatgatctttttttcaattctcagaagaaacaaagttcttgacgatccatgaagatttcttggtgctatgatttttcttcaaaaaggaaaaaggctttgtctttttatgatactctccatttcaaaaattaacaactaatgcctccttcaaatgtttgacgtttgaaccaaccaacatcgaacaaaaaaagaatagagggaatatgttatgtcaaatacggattgagatcctctgactttacgtcagaggaacgtggtgactggtatgtggaccccaccgctctcgggcctacctactagtgaccacatcagggataactttacgtcagaagatccctcaacatcaaatacaatactagtctgttatattttgggaaagaagaattatacgaacatatgaacatttcttggtggtgattttggttgtttacctgatcaatggtggtgaatttggagggcgccgtgctgtagatgcgcttcttcctctcctccggcggggccgcgtacaccctgctcaccttcttcttgaggatggtgtagaggttgtcctccacggtccacaccccctgccggggctcctcgccgccgccgccgccgaaccatccgccgtcctcccgcttcatggcctccgccggggtgaggagcgcgaagccggcggccggcggcgggtgggagcagtaggggcatccccggagcccctccaccgccgtgccccgccgcttgtcgaacttgatgtggctcagcatcgcgctcgtcagcgacaccggcttcttgccgttgttcttcaccatcaccgccgtcgccatgctcagcgggtacagcgtcaccacgtacgtcacctccagcgtcccgctccccttggtgcaccccagctcaacctgcaaatcttagacaaattttaccccagatttgaagtggatttgtttgcctcggaacgcaaacaagattcttcaggtttgcaaacatttgcaatgccaacatgtaacatattaaggtacatagatttttttttttacctacatgtaatcgcaccatgtttggcacagctttggattaagatttcttagagctggatatttctagctccacaaatccattaaccaatatatgtttatgttgatataatattattttttttgactgaaaaaggtagagagactctaccttataaccattgtattaatggtagtcaaggtgatatataaagaggtacaaaagaaccggataaagagggaggaagaagagaaaataagaaggagaaaagaagaagaagaagaagaagaagaagaagaagaaatacagaaaacaggagaaagcatggaagaactagaaaagctagctacgctagtaagtctatccatctgcatattggaggtcgacattgtggcttaatgtgattttcccataattgtagacattctctgatttgatgtgtcacatttgccgtggtaagatctcgctgctggaatgttctatggttgcgtgctttccataagttgtgtgtgcaggcgccaaagcatattggccatccagatttgagatgtgagggcgtaattgtcaggacctgatcaacgaagtggagaacgtctgtgctttgagttgcctgttcatagatgttgagtttcttccaaaccttagaagctagtcggcagcgcaatatgatatggtctgctgtctcaatggtagggcagacagcacaatgtggatcagatgcccagcatttctgtaccctattgtcatttgtgttcagtcttcctcgaaaggccagccaaagaaaaattttacatgtgttcggtattgctttgatccatatgaaaggagctgggcgccatagaatgccatgatatgttataagcctgtagtatgctgctgttgttaatccaaccgggcttagtgtacagcttcttacgtcttgttcagtatgctgtagttgctgagaagctagaatcgtcatgagcgaatccagctcagtttgggcttggcgagagagcacagggtgaagatccagtacccaattatcattaaccagctgagaggaggcggtgcagttgatgtcgcgggcaaacgaggccagggttggaaaggtgaagcaatgatgaattatattgtttatattttagataaaatataaaattttaactactataaagtttaacttacaaacttgagttatgtcaaacaggacctaagctaaattggttttgcatgtacattcattcttgcgtgttcttgttttgaattttgtaaatttcccaaaattcgttcacaaagaaattcgcatttgcaaacatttgggaatcgcgatgtgaaccagcaacataggaaattgaatattcaagactcgaatgcagtcgtttccttctcattcctcaaatatcaatcgaatatgatcttgcacgttcatgttttgaatttttttttattgtagagtccgtaaaattcgttcaaaaatcattatgaaacgattttagaatgggaagtgtacctgcactgcatcgtaggagtcggagtcggcgtccacgacggaccactcggagccgacgaggagcgactcggcggcgccggaggaggacacctcgctgagcgcgagcccgacgccgcccttgacctcgccgccggcgccggcgccggcgacggtgtggagcacctccctgcacccgtcgtccttccagtacaccttgggccggtacgaggtgaccagcccgtcggcgagccggagctgcagcgagctgccgttccgcacgctgagctcggcggtgggcgcgccggtggccgggtcggcggcgaaccggaggcccttccgtccgaacgactcctccagcgactgcggcgtcggggccgccgccgccgtcgcggcggcggaggccttgacggcggacggcctcgtggggaggtggagggggagcagcgaggaggtggccatgggtgggttggagtggagtggagaggcgggggcttgggctttcactgcagcctcatatccgcgaggcttcaggatagatagttttttttctcattgtctgcttgtttgcgttgctcccgcgcgttttttggcgctttttttgcacaggagatattggaggggtggtgcgcacgcgtacctgcagtctgcagtgctgcggggaagtatccaactatgcaactcctataaatggacgtccgagattcattcacgtcaccatgagttaaaaaatttaactcccagtaaattttaactcatgagtgaatctgcgagttaaattttaactctcggacgtccatttctcgatccaacggtgtaagatgagagttgcatagttgcactgaattagatgactacacctgatacttccccgcagtactgcagggtttagccagcgatttcattttcataaaacaaagtttactatctcgattagtctaattgtaaatgtaaatacgagcattcgtattaaatctagaacttgattacttgaatgtgtttaggtgaactagtgaatgagttcaagtaaactagttacaccgtaatgaatctaaccaattgaactacggatcacttcgtgattgaccaacaaatttcaattgtttttgtggtcgatttacaactagacattcgagctggacatgctcgaaactcgccgagattgtgaacacactgcagcgacgaagtaggctggtggtcatgaacggtaagaattcacaagtactatttgctgggtggttcaaaataaaaaagcttagaaaatgatggtgaatcatatcgggaagattagacttaaaataatatgttagtaacattttagcacaaaggtcaggatggccgagtggtctaaggcgccagactcaagttctggtcctctaacgagggcgtgggttcaaatcccacttctgacaatattttcgatcatttttttgaaacttttgctttaactttattatagcctggacactaatctttttcaaacagcacgatatatcgtgtctttcacaaacaaaaatagtttctcagttttttttttaaacttttgctttaactttactatagcctgaacacttatcttttccgaagagcacgatgtatcgtgtttttcacaaagaaaaacagttttaatttgttatagcctggccaccaatcttccccgaacagcatgatgtacagtatcaagttttcagtaagacagcttgcgaatgttaaagcatccgaaacctgtgcgtcctgcagccagttaaatgcaacgctatggacgacgtgtttgtttacttgcacagcatggttagcgcgcgtcggtgcacaagcaaagtctggttcgcacgcgcgagcgcataggcgaatggtgtttggttgccaacacgactactacattcatcccataaaaaaataaaataatatcagatgtgacacattccagtattacaactctgtacatatctatattcagattcgtttgtactaaaaaaaatgtcacattcagttctagattcatttttttaggaggagggtatatctcactacgttggatctagtcatttgtgacggatccaaatcctcatctttaacaggtatactcttcgttattgataagtggtcagtgatgactaaacttattaggatctcacttgtgacagacctaaatcttcatctgaaataggcatacttctcgtcattgatgattcaaccttaacaggaccttacttgtgaccggcctaaatcttcgtctgtaacatactaacatgtatacttttcatcactgataagtaaagcaaacgcaaaacagccgtccgagttaggtaagagggaaacgcgagaaactactctatgtaccaaaatataagaacctattcgatgtttcttatatcttggcaaacatcttatatttaggcatggagagagtagctgtagctccgatcctcgaccagactgacaccatgcaacacttgagcgggaggcgagaccggcacgcactgcaaccatgcaacatctcagaaaaacggtctcacgaatcacgatccctctcaccttccaaccctgaccgcacttgagcagcatatcgtctactcctagttggcccatgggcaccacatgccgatgaaaccacagttcctttctcatcgtaccaagtagcaacaatcacagtggtcaccgtattatactagtactcctttttcagcaacaggtagtagtagtagtactgcagtctgtacctacacttgatcggttcatcaagcagaagcgatagcagcactgcactgcagtctgcagttaaagtgcttggtagtaccatccatccgcttagctatagttaacaaataaagggccctgaaatgataatactactagcactactcatcaagcaaccaaatggaatgatgcaagcaatgccccagctttagaacagccgcgaaaagcagtgagtcagcttcgcaatagctgcttagtggagcacttagaggcgagaccctgcatcatcagatgtatataaagcaagattcttttaagtaaaataaatagcaccaatctaacccacttccagaaccactcaacaacgggattatagtactccaccccccactgaataagcgcgaaacgcaacgcaccaaagccagacatggtctttgcaacttgttgtctttgccgctaggtttttttctggcattttcgacgatactataaacggagtcttagagcgagctaaaaaaaagcaaaccgaaaacgggaatacggcaaaagaaaactaggcaaaactaactagccaactgctccccagtagcagccaagcagcaggatcttgggcccgtgctgccagtttcacagataagagttttccagaccatcagttccttgggaccacatgcctgttgagttcttcaggaccgtcttgttcttcatggctagctagggaacatggggtatgtgatccagttaactagctttgacggtgccgttggcaagggcaggcttctcagtcgctgctgtttgggcgaccttcgctgcataggtaacgactggagctgtgccgttctctgcaggaaccttcagttctccattgacgccatttggtagctttggcttcgcagtagcagcatcctgctgcttctctccagtgacagaacttggagccctactgtcccagacctaaaatgatagaaccgaccattagagttaccaaagaggcataagagaaaccaaggtgcacagattgacaaaagacaaggctcaggcttatatatacctgcttttggatctgctgttgtttcaccctcttttcctgcatcaacttctgacggttctcatagaaagcaaagtcatccaagatggaggtcttactgacatgctccttgaatatcttaagcatttgaatgccttggtcaaggtttacctgaaatttaaacaagcaggtcaaataagataaccgcatggtgtggctttttggaagtcaagaactaatttggacaaatataaggtacctcttgtgtgtcacggctatttgtcactggcttgttctcattgttctctaggatgatgtgcttgagaatattgttgggcacatctttgacaatgtgccacttgagagataaggaaccattccacttatcttgttgccagtactccaaggtcttctcaaaatcaacagcgccagtcatttcagcaacaccaacaaactgcccactagtattaaccttaagttcacagcaacaaagacaaaattaggaaaaagaaaccatgattaacattcacaaatgaatacaagacacaaataacttaccgagaaaaacaagaatattgggcatttggagctcttagcctgagcttcctgataagcagcatcaagcttcttgtttccattagtggtacttgcccacacattgtactttatgctcttatggatatcatcctcactgtatgatttaatgacaaagaactttgcatcatcatattggacagggaagtcatctcggttgaactgtgttctatcaggtacatcagtagcattcatgctgtcacttgtaggaaggctctgccctttcacagcaatagtgacagtatggccaaacaatttctggttcttgaaacggcctgatctaggacctctgttcaactcaattgttccatcctgactctcattgccaaaaccatagtacccgttaccacggcctcttggcttgtacctgttatccatactaagaccccaccgaccatatagcctggaatcataaccattactaccatagccattacttccataaccatttgtgctgtacgaaagaccagttttgtatgagtttccatactggctgtaagaccgggtgctcgggtacatcctattcggatatgtaggagcagctgatcctgttgtagttgtaggtcttctgttattcatgccctgcattacagagaagccaaataattcagttcacaatcaaagccgtagcggatcaggacagtgcattcatacggagaaaaaaagaacatgttttcgtaagactcaccatctgctgaggtgtggagcccttgttttgagtccttgcagaagagccattactgaatgttgaagacgacatgtgattggttgtagttgttctctgctgtccatttgtataagcagaaccatcataccatgcaaagtgtgctcctgtgctgtcatacccatatgtagagtccaggtaaccagcagaaggaactccacctagcaagggtgccctataagttccatcaggggtcagtgatgaattttgctggcttgatccaaggggtacagttccactgttactgtgaacagtaccattaggagcaccatttgtggttgttttagctggatctgccttagctgttggcttgtcaggattggcagaaggctgcaggtcgccttgagtggtagaaggaactggtgtaggaggctgataatacgaagttggatactgatagtgctggccaaacatttggccatcaaccgttggaactggggaactagcaggggagtatgcaccataaggagcatacccatatccataaatatctccatatactgcctgtgaaattccaaaggccaatcagaatagttgatagcacagcacgcaagattctcatgacaggatatttagtggcagacaaataacagtgaacacaaaagattcacagagaagcaatagtgcacagagcataagcaataagaagaagaaccacagataaccaaaccatagccaaataagtgagtgcatagcattccacttattacatccaacaagatttgacaggacagctcccaacagacaataatagcaaatatttggaccatttctacattaagtatatgacacatggtgcaatttatggtcagcaatatcacatggaaaggaaaaggtaatattatctaagattaacttactggggtaatctccactccatctggatttacatatctaggataatcatcccactcgctcacagatccgtcgtaacctggtaattttgcaaaccagcacaattctgtaagcataggagaaaccatgaaagaagctaatgtcctataaatagccacagggcttatcacagcgctaacaaataggaatgaacaagaaaaaaaaagacatgtcagccattcaaaatagctgtactcaatgatcaccataagaatttttccatggttcctcacctccatagtagtatgctggcaggtagaacatgttgggatccataaaatcctgaagcactggcgtgatggaccgctcaggaggaatcgccacgctaagaggctggctggctgcaggcccctgctggattaacagtcaaaaatcaccagaaccacacgtattagaatcacatatcaccgacagaaaaccaagagcatacacgcaaacatcaaggatccatcatttccactgttttatccaataccttcttagcgccggcgggctcggtggccgcatccaccgccttgggctgcgaatccaaagacaacttctgcagcagatccgtggtttcttccaacagcaaaacaatgaattaaggagaaaacagattcattcagatcccaaaatccaatccttcgaactaagccctactaaacatcatgataattatttgtgtatgaataaataaataaacaattattcgatttcacaatcaacagaaggctaaaaacagtaaacacagcccgatctggagaagtcaaccctagcacgaccacgctgagacccccgggcggtagacggccgccgtacagcctcaaagcaacacccagcccaaccaaccctcaagccaaaaccaaatccccaaacccaaaccccaaaaacctagaaataaaataatcaaaagtcacaacccaaaggatacgatccgcgacgggggcagcggtggcggcggcggcaggagccggggcaggaggagcagcagcagcagcgggcgccggcgcgacgaccgggacctgaggcggcgcgacggcggccatggctttggctcacgagatagatcccaagcagagaacacccggaggcggcggcggcggctgtagatccggcgagacgagcgagcgagcgagcgcgcgcgcacccggccccttctcctcccttcctagagatagctaggcgcggcggcgcgggtagagaggaggatgaggcggcggcggcggcggtggcggcgggatgggtggagaggcggagccggagcagcgaggcggctagcaaaccggcagtacggtgtgaaaggggaaaagaggagggttttgggtgagggtcgggggctcatataggataggggaggggggagaaatggagcggaccactggaccacgtctcactggacgccacccgcattggattccactcctctccagtttccccctgattttttttctccctttttagtgataccgattaaaaacttttttttcttgggttttttttcttttttttttaacgtggatggagaatgggtggttagttatttggcttatggcctaatggcttgtcatatgcattctgttcacttcgtaggtttgcatttgctcttaaaaaagaataagactacgaagcaagtaagcgtatctcaactggttagctagatttcttgtggtggaaatagctcgctcagattcaaatgttcgtgataacttcgtcaaattcaagttatgtcggttcagttttcgggagatgctaattagtcttttagtggtgacttcttgaatctcaagatatgctacgtgtatgcgtttagaatagtgagtgtgtgtacgttgtgagtgtctgtgttttgtactgtgtttcataaaaagttttgtatttgcttactggctaagtaaaatggtttgacatgttataatcacgttaattgcatggcttaatgcccttgataaattttgaaatgtttaagttgttttaaaattattctatatatttttatcattttttcaatcttggtttatcacttaaagtagaaacataaaaccctgactcaaattattttatattatcttatttatgtctctacggtttatcaactgaagccaaccagcttgaatatatgatttttttatccaataaactcatagtgcatactgcacaaggagatggcgatttacttgtcatcaattttttagatagggaagaaatcaatacatggatgttttagagaggggaaaagtcaatacatgcctatgtagtaaactgctaagcaccgtgcctaacaacaaccgcgtgagtccaatgactccaccccaccaccgattgcttgtctccatttgcacccgctccagaaacccctacccctttccaagcccctatacaacacacacaaaaagaaaaaggaaagaaaaacaaaacaaaacaaaaaaaattataaaaaaaaacgcgttcagcttggaggaggaaccacggcgcactggacgcgtccagtgatcccacgcggccacgctatgcacgcgacgcccacatccaccacactaccacagccacagccgcagccttcctttctttttcttctcttttttttctttccttcgcggcggccacagccagcagcgaacagctttttttttcctttttccttttttttcttctcccctcgcatataaaacaaaccaggataagatctcgcacgtgccgtgcctgctcctccctcctcctgtgcagccatcaaacgcggggtcgtacgaactgagatgcgaaaaaacgcgaggaaatcacgccaaaaaccgtagcaaatcccgtccccgaaatggatccgtgtgccgtgagattctcccacacaaattccatacttcccctccacggccgcacccccaagtccgtgagatctataccctgaaatcccactgtttcttcgcaaagatcgcgtaattttgttgttgttgttgttgtagatgccgcgtgtgtatcgtcctgatctgggcgtgctacggccgtgcaaccctatactggcttgtggcctcgtcgccggggaagtagggcggtggacgtcgtcgtcgtcgtcggagaggacgacgtggaggaagccggaggtggggtggatgaagctcaacttcgacgggtcgcgcaacgacgcgaccggggcggcgagcatcggcggcgcgttccgcgaccacgagggcgcgttcgtggccggctacgcggagcggatgatcgtcggcggcgcgtcgagcttcaccgcggagctcgccgcgctgcggcgagggctcgagctggcggcgaggtacgggtggcggcgcgtctgggcggagggggactcgagggcggtggtcgacgtggtgcacgggcgcgccggggtgcggtcggaggaggaccggaggcagtgcggggagatcgccgcgctgctcccggcgctcgacggcgtcgccgtgtcgcacctgtgccgcgacgagaacaaggtggcgcacgggttcgccaagctcggccacaaggcgcggcgccgccgggtgtggcacgtcgtgccacccaacgaggtactcgtgttcctgcaacgtgatgctgatagagggtaaaagtacaaggaccgaacaacacaacgttagtcgttgatcgatgtgatctttctctgtaaaaaagaaagttaactgagaattaaacaccatctaaccgaatctgaacacgaggttatcggtaacattagtcattaatcgatatgatctctatctattgattgataatgatctctctctgaaaaaaaaaattaacctaaatgagattttaacataatataaaataacaaatctgaaacatgaggttgtcctaggtggtaatgttagttgttgatcgatgtgacctctctaacattgctactctattaaaaaaagcctatctaaatgaaaatttaacaccacctaggacaataaatatgaacatgagatttcttagagtggtatcaaattctcatttagattggtttattgtgatatggaagaattacttcagctttgggggatttataatgagatacaattccttgtcattacttcgctctgataaaatcacttttatataaatgcggtagctcatattttgttgatttgcgctggacagcttaaaataatgaatgacgaagaatttgtaggcacagtacagtagtgcgtgcgtagtcggattcagtgtcatcttgcccttttttttcttgggtaatgggatattatctgacgtaacgatggattatgcagcataatttcgttttctaattacgcacggctgaggcctggatgcacacgtgtcacacctagcgaggaggagtctgcgtcagatgtcatcctggacaaggaccttatgatagatttatggatcatgtgcatgattggtttaactgtttccatcgtaccctacgtataagattcttgaaattgcccaatttgtgtacccctacagattttttcatagggtcaaccagagttgttggtcaagtactactggagtagtagccggcaacggcagtgaaaatgacgtgccaagaatgaggccaggatgggacatgcagctcactcactaatgcaagggcattcagagtgcatctagctaggagtcaaaacgaatcgggttcgatctgatctcactattttataatcggaattgggtcgaacacggatagcgccgaatacggatacaaactcgaatagtatcgggtaaaaatacggaacgaatacgtaccaaagtagatacgtatattatcggttacgaatatttatttggatatcaagtcgaaataacaatcttatatatcatataaacaataaccatttaataattacatatatccataatacgattatattagaccattaggaccttaggtaataaatatggtacaatatatcatagtaaaatcaatacatagtaccagaaagtacctcacaaaaacataatacggataatatccgtataattatccaggtaacacccagattttttaacggataattcatttccgtcgggtactacgttcccgaacatctcatatccgtaaaaaaaagacccgtatttgaacccgatatatgtgaaaagtcccgggtacccgaatttgtctcgaaataatatgtccgagcgggcggacgagaaatacccgctctgttttcacccctacatatagttgtcattcagtccaagccttccacatcatggatatcacgccatgcctgcttcaaggtgccaaatgaagaatgcggaaccaaataaagacccgcacagagcagggcaatctttgcgcgttgttgctgccgtcgaagcttcacacgtggcagatgaggagaagggaggaagaggagatggcggcgatcgagctgttgccaccgagacgttgtctatgagcttccgctgcctgaggtcgatccaaagctggccaaccgcctccctcggtccgtaacggccaaggttgacccagagcagacgagcccgatcagctccgtcgaggttgatccagagccgccttcctcgatccgcgccaccgatgccatttcaccgatgagagctcaacagcggccggagggatgggggaggggaggggaccaagggaggtgaggatgtcgctggcttcgttaggctcaccgctgtagaatcaaggaggccgactagagggggggtgaataggcggttttaaaacttaatggcacttaaacaaaactaacctaagttgctaggcaaggtaaggtgcaaggttaactaagcaactaagttaagttttgcaaacctaggtgtcggtgacatgggaccgggggtatcttgactagaggtttggggcagccgcggtcacccacgtggcctgaccccctcgggggggtcgggcccgagggtgatgtggccgcccctccctttgtctccccgaggggtcgggccgctcccgtttcggctccgagggctagggcgccccgaccccctgtgggtttggcgccacgtgtgtgggttaggtgagcacagcggcgctcacctaaccgcgtttattgcgggttggacgagcgtcccacaccgcatttaatgcagcgcagcacactcgttcggtccgtgacaggtcacagtgtgtgaccggtcacagaccggtcagatcgcgggttaggtggcaacaggcggccttttgcacgcctcgccccgtcccgtcggaatgatgagagcctctaggcactcgtccctagacggagccggcgtgctaactcctggagttagcacgtcagtcccggctagattcataccaggcttcatcgcaaccattacaaggaagtcattttatgaagaagggctgacgcgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtagcagggaaatccccggtgtcaggcgagtgatgacgctaggcctcactcaaagacaagctgtgatttagcttccaggcgaaggcgcaagccagttttttttgggagatagggtgagtccccacccaaaagaagagtaggtagaagtggtgtatgtgggatccccttgagatataaaaggaggaccttgcccacttaagaaaaaagggaaaaaaaggaggaaggagggaggagggagctggtaaaaggaagagcggagctcgtagaggagaggaggagtgagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccccggccgaaccggcaaaggggggcccgcgcggtctcccggtgaggagccccacgctccgtcatctggcgcgccaggtagggggcgcgtgtgtttttctaagctctcgtcctctttcgtgtgcgccaagcttctcccgctcagcccaatggccgaacgggcagtggcgcacaacctctctccgagcgctagcggtgacgacggggagcagaacccacgccgtcgagctcgtactccaccgcccccctctcgccgaagtcttaggcgggaggaggcgctcgagggggtcgaaagatccgcgacttcgccgcccacgagcgatgaagaaggacggcgagacggggagcgtcgcctcctcgtctacggcgatggcagcacgccccagggcgcgctccaagctgcgggcgcgctcttgcgtcacccgcccgtcgtccccgatccagagactccagcccgatgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcggccgttacctgccgttcgtcagccattccctcgtcaacgcctccgacccaagaagatgtgcgtagggggtcggatgcccgcctcagtatcgagcgccggcgcaatggtcgtcgtgctgcccacgcaacggaaggcgtttcctcgtccggagcgccacttcggttcgggcgcgggggccagccccccgtgcccccggttggtggtgtcggctgtcgagcctttgtggcgagtcttcggaacgtccgttggcccccaaggttccggcccaccatcaccgaaaaatatgacggaagcgtcaaccccgccgagtttctccaggtctacacgaccgggatcgaggccgccgggggtgacgacagggtcatggcgaacttcttccccatggccctgaagggacaggcgcggggttggctaatgaacttgccgcccgcgtcggtccactcttgggaggatttgtgctagcagttcaccatgaacttccaaggcacatatccgcgcccaggtgaagaagcggacttgcatgcggtacagcgaagggacgatgagtctcttcgctcgtacattcagcggttctgtcaagtccgcaacaccataccatgcatccccgcacacgcggtaatctacgcgttcaggggggcgtgcggcacaaccgcatgctcgaaaagatcgcctccaaggagccccagaccactgcggagctttttcagctcgcggaccgtgtggctcgcaaggaggaggcctggacctggaactccaccggttccggtgtggcagcttcggccgcccccggatccgccgctcggtcagggcggcgggacaggaggaggaagaagaggtcggcccattccgacgacgagggacacgtcctcgccatcgagggcgcttcgcgggccacccaaaagaggaggcctgcgagcgacaaaaaaaaggaggccggcggtcccagcagggagcgcccgaccggcaagtggtgcaccgtgcacaacacctccctccacgacctcgcggactgccacgcggtcaaaagtttggctgagcggacaaggaagtgggaggaggagaggaggcaggagcgccgtgagggcaaggccccggcggctccctccggcaaccggcgaagtgaggccaagcagaaggcccccgccgaggacatcgacgatggcgacgatgacctagagttccaggagcctggggccaccatcgccaccgtcgatgggggagcatgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacggggctgcagccctcaacatcctttcccccgcagcctttgacgccatcaaggccccggggatggtgcttcggccgtcccagccgattataggtgtgacgccggggcacacttggccgctaggtcatatcgacctcccggtcaccttcggtggatccgccaacttccgcacggagcgggtgaacttcgatgtggcagacctcagtctgccctacaacgcggtcctggggaggcccgcgttggtgaagttcatggcggcggtccactacgcctacctccagatgaagatgccgggcccctgtggccccatctctgtccatggcgacctcaaagtcgcgcttgcttgtatggagcagcgcgcggaccacctcgccgccgcgtccaagcccgagggtggcaacgagaggctcagcacctccgtcccagccgccccgaggcagcggatgatcatgtgcgacgaggtcccggtcaaggaggttgccctgggcgacggctcgtccaagaccacacgaatcggtggtcttctggacggcaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcgacggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatattctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccaaataggacgtaatgttgaggcctatgttgatgacttggttgttaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatgcgtcaccggctgcatggccgccctaagtcggttcatatcgaggctgggagagaaggcgctacccctatttaagctcctcaaatgctccgggccgtttatctggacggaggaggctgagcgggccttcactcagttgaaggcgtacctcagttctcccccagtcctggtcgccccggagccagatgagccgttgctactctacctggcggcaaccccgcaagtggtcagcgcggcgttggttgtggagcgcgacgaggacaaccctcaccccgcgcatccccaccctgtgtcgactcgacccgggagagagcagggaggagaggcccccgagccgaacggcggccaaaggcccccgacggccggagctggccctccgcctgcttgtccgacggcgctaggcgcccccgacccccaggatggccccggggccactgcgggaaggccgctcctgtcgccctccgaccccgaggtcgtcggcacagaagccgagtgcgccccgtgcggcctctcggacgaagagcgccctggagatgcggcccctagcgaagaggatcggccccgccgaaaggtgtagcggcccgtctacttcgttagcgaggccctccgggacgctaagaccagataccctcaggcccagaagatgctttacactattctgatggcttcgaggaagttgcgccattattttcaggcgcatcgggtcacggtggttacgtcttaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggaccccggcccctgagcccgtctccgcccccgaggccagctcgggcccctcgcagctgcctcacaccgtcaactgggtgatgcagttcgacggctccttgtctcttcaaggcgccggtgcgggggtcacgttgacctcgccgagcggagacgtcctcagatacctggtccgcctcgattttcgggcgaccaacaacatggcggagtacgagggactccttgcgggactcagggtggcagctggactggggatccgccgcctcctggtgttaggcgactcccagctggtcgttaaccaggtctataaggagtaccggtgctctgacccgcagatggacgcttacgtgcgccaagtgcggcatatggagcgccattttgacgggatagagcttcggcacgtgcccaggcgggataacgcggtcgccgacgagctctcaaggatcgcttcctcgcgagcccagaccccaccgggcgcctttgaagaaaggcttgcccagccgtcggcgcgacccgacccgctaggggagacggacacgcctgaacggcccccgaggcccgtcggagtccaggcctcgggacccgaggggagcgttcccggctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaaatgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaatccatcagccggcccaggccctgcagaccatacctctttcatggccgtttgctgtctgggggctcgatatcctgggtccgtttaggcgagccccgggcgggttcgagtatctgtatgtcgctgttgacaagttcactaagtggcccgaggcttacccggtcatcaagatcgataagcactccgcgcttaaattcatcaggggcattactgctcggtttggggtgcctaatcgtatcattacggataaaggcacccagttcactagtgaactcttcggtgactactgcgaagatatgggcatcaagctctgcttcgcctctcccgcccaccccagaagcaatggccaagtggagcgcgctaacacagaaatcctcaagggcctcaaaaccaaaaccttcaacatcctcaagaagcacggcgactcgtggatcgaggagttgccagcggtgctctgggcgaaccgaaccacgccaagccgagcaaccggggaaacgcctttcttcctcgtctacggcgcgtaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccatcagcgccacgtccgggcccgatcactctgcgtcgacgacctcgtcctacgccgcatccaaacgcgtgctgaacttagcaagctctcaccaatgtgggagggtccgtatcgagtgatcggtgtcccccggccgggctccgttcggctggccacgggcgacggcgcagagctgcctaacccgtggaacatcgaacaccttcatcgcttctacccctagtgggggtcgggtgtcaggtctcgggctcgggccaaccccgcgccccccaggcgtgcagggttggccgggggctaccacatgcataagcttatattttttctcttccgtatttcaataaaggcattttcgatttcctaaggactgtgtctgagccatcgtttccttttgaagaatcttggcttgaattagcatgctcgtgcccgaccccgccctcggtggcccgggccggctaaaatcgccaaacggggcccagaaccgagccgtgccccggggcgttgtgaactccgggggggaatcggcaaaggcccacaatcgggtcatccataaccctcggtcaccacgttcccggccaggccagtctcgacacgcggatctccccaggcactagccccgacccgcgccgcttgaggttgggacctgggcacgagccctcgttcaagccaagacacagaaggaccgcgacacaaaccatcctcgtctcatacacacaacaaacagagttgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcaccgccctcctcgtcagagtcgagggcaaacgcgagccgaggggctgtaccctcgaagctgtggacgatgtggtcggcggcgtcccggacctgtgcgcgcgcgccatcctcggttccaggagggaactcgtccagcgctgcccacggggagaagtcagggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcgtatttcgcggtccgcccgccccagaggcccgcctgccgcccggcacggtctagacgggagacggcgtcccgaagcatgccgggccctacctcgcccatcaagcggagggcttcgacctccccggcggacgagtccagcgcgccctgcagctcggcgatggtgtgttcggcggttgcgaggcgggcggctaggtcgccgtcgcccgtggccgccccgccgctgcgcgctcttgcgtccagctccttcgcccgcgcctcgaattcagcggcccgctgatccagtgcggccctctcggcgcgggcgccttccagattgaggcgcgccttctcctcccgcagctgcgccgcggcctcggcctcctcgagagctcgctcccgctcagtgagctcgtcctcgcggaggcggagtgcggactcctcttcggcgcaggcggcctcgtgcgccgccagcgttgcctcccggatggcgacggcggcctcgcgacccgccagttccctctccttcgtgtccagggcgcaggcgcgcttctccagcaccgtggcgcgagcctcaagggcctcttcgcgctgccgggacgcgtcgagcttcttctctagctccactgcccggctcccgtattggaggcagaggtcgtcccgcgccgcgttgaacacggcggtggcaatgagggcagtctcccgctcctcctccacctccctggcgatctccgccaggaccctacgacgggcctcgagctctgaggcgtgccggcggtgtgccttgcggcccgcctccaccatggcttccaccgagcgccgcccctcttcgacgcgcgcccacgccgcatcgacctccgcccgctctgcctgcaggacctccatctgggcgcttaacccgtccaacaccgtggtgttcgcagcggccaaggcctgcaggaggggctctgcgctcagtgaagcagcggaaggcagaggggagagccgcctcggtgtgggcgccgcgcggctcggcccgccgatcgacgtgccgaactcgggggcgtcccccgaagcgggctcgtcccgaacgtcgcccgaggggtcgggcccgagcggcgcgcccgcggcctcgtcgtgggtggcctcggaagtcgttgtcgcctcgggtggagtcgggtcgggggcttggcaggccgcccggcgtgcgtgcgccgcctccgtctcccggacggactcctcggcccggcggagtctggcctcttcccaaacggcttcctcagcctggcgagcccggacggcctcctaggcagcttcttcggcttcccggaggcggtctgcggcttctcgccggtcagcttcccgcctccgggcctccgcggtcgccgtctcctcggcctcagaccggccggacttggaatggcgagaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccctatcttgcggagccgcttcttttttcgctccccctcgggccgcgacgtcggcacagcaccctccgggcgcctgctgctggcacggaccgccctgccccctcggggaggagatggggagggggtatcctcctgtttcctcttcccccgggcgtcggcagggcggctgccccccgggcccccgacacggggcccagaagcacgaccccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccaccttgatgtcttcagggacccagtcccatttgaccccctggtgggtcctcatgtagtcctcggacccggtgtactcccaagcgccccgggcgcgccgctggagcggcgcgatccggcgacgaaggtaatcgccgtacaccatggcccccgtgagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacactggctgtacggtgaagaaccaccggaacagccggagagatgggcgcaccccgatgaacatctcgcacaggtgcacgaagatggccaacgtcattaccgcgttgggggtgaggtgcgccatctggagatcataaagctccagaacatccatgaagaaagaagagaatggcgggaccagccctgccattgcaaaggaaaggaagaagacggaccgccccgggtagtgtggcgccgggcgtccctcgcccagcgcgaccacctcccggccggtggcagattccggcataaatcggcgcggtagcccggcctgcctctcgctcacgatgcgggaaggcggcagcacgctaccctcgagcggtgcggagccccgtgccatgacgccggcggaggaggagcttgagagcgagcgagtatggcaagggtagggcgcaggaaacggagagtcagagcacaagtggcgaaggcaagggggagagtggcgagaggaaggaaacaaatcccgtccttggcgtctttgtacccttgccaacgctatgcccggctcctcgcttcccgcgcccactacctcgccccctcgtctctcgcgcccgcgcctccactaaccacactcgcccgtttgcggcgcacgcggtagatgtgcggccgtggcgttttagatggggcagatcgtgcgcgcattaaccgcgctcgccaaccgcgaaaaacgccatcatcatgtccccaggcgaaacaaaccggctcgtcccgattcgcgcgctgctcgagtagtgtagcggtcttgaagaggccgctcattattgtcgatcggtttcacccttgccgatgcgcgcgatttgcaaccgttgggtttctgcccgcctgtagggaccatccccacctgtcaccaggcctaaggagtggcgtcacgcccgagcactttcctcgaggagggcaatcgccctggcataacgccgggggctactgtcggtgacatgggaccgggggtatcttgactagaggtttggggcagccgcggtcacccacttggcctgaccccctcgggggggtcgggcccgagggtgatgtggccgcccctccctttgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgtcccacgccgcatttaatgcagcgcagcacactcgttcggtccgtgacaggtcacagtgtgtgaccggtcacagaccggtcagatcgcgggttaggtggcaacaggcggccttttgcacgcctcgccccgtcccgtcggaatgatgagagcctctaggcactcgtccctagacggagccggcgtgctaactcctggagttagcacgtcagtcccggctagattcataccaggcttcatcgcaaccattacaaggaagtcattttatgaagaagggctgacgcgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtagcagggaaatccccggtgtcaggcgagtgatgacgctaggcctcactcaaagacaagctgtgatttagcttccaggcgaaggcgcaagccagttttttttgggagatagggtgagtccccacccaaaagaagagtaggtagaagtggtgtatgtgggatccccttgagatataaaaggaggaccttgcccacttaagaaaaaaggggaaaaaaaggaggaaggagggaggagggagctggtaaaaggaagagcggagctcgtagaggagaggaggagtgagagggtctctagagtttgaactctcttgctctccagctctttgtaactccttcatacacagatccaccagaacataggagtagggtattacgcttctcagcggcccgaacctgtctacatcgcccgtgtcttgcgcatttgctctctcgcgaaacatttcacagatcgagggcttagaacctcacctagcgcccccggtcgaaccggcaaaggggggcccgcgcggtctcccggtgaggagccccacgctccgtcactaggtgatatgggctcaaatatgtctctatgaatgtaaatagcacaaatgtaaatgcaacaaataaatgagacaagagacaaggaatttttcatcgaggttcggaaactcgccggtttcctaatccccgttgaggtgagcccaactccacccgcccaaccacgaagccaccgcacgcccccttcgtcaaggggtgggcaaggcgggagccggcccacggagaggactacccaagcctcgatcactcggggtagttcttccttcactccaaaggtggtgaactccaaaccactcacaaacggtgccgggcctcctccacaatctcctcggagaggtcaccgggcaacacctacacaagccgtttaagaggcggcaacctccaagagtaacaagtctaggatgcttgccgaggatgatcaagtgccacactaactataacaatgaagcaatgcacttggattggcttaactcactctctatcacctcactagataaactaagtgcacaagggtgtgagagctcttgcaagggttcaagataatgtaatggagtgccaaaaccttacccttgctgctggggagtgggtatatatacccccaaccaccaaaactagccattggaaccgaaatccccaactttgtgctctgccggtcagaccgccattgtgaggccggtcagaccggactactttgtaacggctagaaaactagccgttacagggcaatcatggagcccactcaacctggccggtctgaccgcagtgtagtggccggtcagaccgtccacggctcggtcagaccgccgtcggctcggtctgaccggttgcggctctggcggctctgtatcgccaccaaaaaccagaccagtgcaacagaccagtggggccggtcagaccggccttaccacgccggtcagaccggcctaaggcccacggtcagaccgcaggtcacttttcagctcaaccgaccgttagtaaaacggcgatatctcttgactcgggtctcggaatttggcgtttttggactctatggaaagcttattcaaagggccatccaacccatgaaaaatccatccaagaaacacaacttaatcaaggataaagggctcacactccaaaggatatccaccggacatacccacaagatgtcactcactcctattggacatgcccacttctctcttggtttaggacttgagaaaactcatcacacttggttagacaagcccaaaaaatgcacctacatgcatatgaactaatatggcacaagattatccacaagctcgcttcatagacccctcttgatagtacggcgcctatctagcaaatccggtctacaccaaacacaaagaccgggaaaagactaagaaaacactcttagctacattatatctttgccttgcgccatccatcttgggggtcaagcttgagtcgagatcaacacttgtgaccatccggttgaaccatgtttatgctgaggtcttgtccatcctttgtcaagactttattctcatcacaagcttgacttcattcttgccaacatgacgatgtccttggctcggtgaccactaacccatggtgtcattcattagcctcatcgtagtgggacctattccttttcacacctcaaaggagaacattagtctcaacaaatcggttgtcatccttcacttgatgactaaccggttgcatatgaaagatatggatatatttgttgagtattcattaacatcacaagtgtcatatactcgtatgcaagctcaagtgcaaagattcgatataaataataggtgaacaatatggatctagaacatgcacaataaatgtataggatttgctccccctaaatatatgcatacaaataaatatacaagagatacaagtgtatgcataattagagaatgaccaatgggggtttatcctatacatatagagaaggcatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatctcatccttgtcattattaaggtccatcacaaaagaatgcatgtcttccacatctcattatcgggaaataacctagtagacaacttatgcaaaagagaggttaatcccataaacatcggtttatcatctatcaccaaagcaacaattacacaaattgtttaatccaagatctttcaatcttttctctctttggtgatggataataacccgatataaacaatatagagagatgagatgaaaaatgatttcaaatcaagatagaaatcttataataaacaaaatatagaataagctccccctcaagatgtgcatacatatggatatgaaggaacgcatatgcacataatcaataaagatcaaatagaaagctcacactatattttggatccacaagagagaccaagttagaatatgtgaagtttaatacatacctctcatcattttttacttttatatccaaatgagactagtcaaagaaaggctcataaaaatgattagtctcatatagttagatttgtcattaatcaccaaaaccaaattaaggcacttgaacttacaaccgccagatccagatcccccgaggttggcagccatgagggagttgagtccgagccagatccaccctaagctcgctatcacatccggcggcgaggacatgagctcgtcgacagttgggtgcggcagcgatttggtgcggaggtggtgacgcaacagcaccccgaccctgacggctggatctggctgccccgctgctgctccacccggtgtcattgccgcttgggccgccccgtcggtcgtcaccgtttaggccgctccacccagcgccttggcttcgtccgccggtgaggaaaggagtagaggaaagagagatggggtgggagatgaaaaatggaagaaatggtacttgtggaacctactacaagcaacttacaccgttgagtatgtagctttaacacattcttggtttaggtggcatgtgaggttcgacaaatctagaggacactactattgtcctaagacttcccacttgatttacttgaattctaaaatatttagttataaaatcgaaaaattaaattaaaaatcagaagtattcaagattctcgtcagccgattactcaccaattgcattttagaatctcgagcttggctacagcagtactactccctatcaggacacccgtaatggttatctatagactctctacaagagatacatgtcagcatattttcctacttggaagagattaaatgaagagagagaacaaatatatctactaatctgaagatagtctatagagaaaaacgaggcaatagattaatggtttactattaatctagtctattactgagatgtacatgttttatagatagcacattactttactattactggtgctctcagtagccagttgcttgtcttggcttggcttgccgtgccttgctgaaattccccagctcgcttccccaagtcgaagctgaattgcacacatctcaatcaataatgctcccccagatctaggtgaatcatcaaatttttaattactcacatcatcatacatataaataattcttgcatcattagccgccatagaaatgacagtaatagtagcatccagaaatttgctcatttagtagtacttgaccagtgacacactgacacctagtggctacttgtccgaagaaattttaactccaagctcgagaaatccacacccaaaaagatctcaatttttgtagtctgatgatttgatgaccagatgaaaccaggtttctgaacaagctgagctaggaatcctgcagctgggtggcagtagccgtgtccatggcgcgcgcggcggcgacgtcgacgtcgacgccggtgtcggtgtcgggcatggtggtgaccctgacgacgagcggcgtgcggacgcggtggtagccgtcggaccagacgatctcgccgaagtcgtaccggccgcgcgacagcttcgccggcgcgacggtcacgtagtaggaggccgtgtcgcggtacggggagaaggacagcgccggcggccacacggcggcgcgcgcgccgtgcgggctgacgacggcggcgcggtacacggcgtccctccggggccccatgttcgtcaccgtccgcttcacggtcaccgtcgcgttgagccgcgggagcacgatggccgggtagttgaggtcgtactccggcggcgccgcgccgccgccctcgccgccgcagctcgtgtcgagcgacggcgaggggagcaccatctggcgtatctggtacctggtgtagccgaggccgcagaggaagaggacgtggtcgcgcacgccggcgtcgtagacgaggcccgggtccagcgcgcgcagcgggtcgacgtggccggcgccgacgtcgaacgcgtccgccgccttcagcgtcccgccggccagcatcacgtcggacgtgtcgtcgtacatgtatgccgtggtcatcagcgccgacttgatggctgccggcgaccacgtcgggtgcacggccctgacgacggcgacgatgccggagacgtgcgggcacgacatggacgtgcccgagtcgaagttccacgtcacggagcgcttgtccagcgggatcaccgtcggcgacgacatgggtggccacgccgccaggatgttcacgccgggagcggtgacatcaggctgcacccgacgaatcacaaaccaaaacacacgaataaatggttttgcaatatatccgattttctcctaaatatttatcaaatgcaaatatagtttagttatattgtaacttatatgtaattacaatataatttatatgtaatttttacatagttttgaaaaataaaatcatagtgtgcgtatggatgaggacatttgtcatgaaacgtctgcttcacgaaaatagcatgtttccgtattaatgtttttaaaagttatatataatttgtattatagttacatgtaagtataatagagttacactgtaatttgtactctctccgttttaggttataagtcgttttgactttagtcaaagttaaattgcttcaagtttttccctaaaaaaaattgcttcaagtttatctaaatttatagaaaaaattagtaacattttcaacccataaaaaattttattatgaaaataaatttaattattgatttaatgaaactaatttaatattataaatattaatatatttgtctttaaacttagttaaatttaaaacagtttaactttgatagtcaaaatgacttataacaagggagcaggaaatttatcgacaaatgtataaataatccccgcaataaaatcatgccattttcaccatttaatccacgctctcgagaatgaaaaatgtggtggcgtaccttaaggatgtgaggggagatggagctggggcccctggaggagaagtaggcgacggccggcgccggcgacttgccgacgagcgtcgtgctcggggagaagcgcgcggtcggcgggcggctgctgccgcggatgtagtcgaggatccgggtgccctggcggaggtcgacgtggacggtggggaggaagttgtcctgcgtcgacctgcgggagatggtctcggcgaagatcaggccggcgccgccggcggcgtacaccgccagcgccgcgacgccgctggacgccgtcgtggtggagaagcacagaacgatcctgccggacgccgccgcccggctcccgttggttagctggtcgaatgagcaagaccttggcatacagcaattggaaccgtgtgattcaaggatgcagatttgcagaaactacacctatgtatttgctagctttacttagtacttataagacgttttgactttagtcaaagtcaaattattttaagtttgactaagtttttagacaaatatgataatttttataatactaaattagtttcatcaaatcaataattgaatatattttcataataaatttgtcttgggttaaaaatattactatttttttacaaacttagtcaatcttaaagcattttagctttgaccaaagtcaaaacgtcttataacttgaaacggaggaagtatttgatttgtgtttttttttgttattactattgataagtgttcgtaatgggtgttaaacttgcacattttgtttcagaatatttatgtatttctgttcgaatagagcagttttcttgcaaatggttagattctactcaaatatagtaaagttcagttagtggtgatcacaattaagaacaacatggcagctacaaaaccactaaccagttattaaccttgcggatcatagttctcatgtctcacaagttcctctaacagagttctaaaattccatgcatattttgcgaaccatataaaggagtagtcatcactaatatagttttccaataatttttattattattttactatctaacaacgttttcaagataattcaggcttattcatattgatcatgacctgggtataaaatctcagtctcaagcctagaaaagccatattatctctcactgttctgccaattacaataatcattacttaatccaattaaactgcacgtgtgtgagagagagattacccatcggagaagacactgccgctttctactaatctcatcttcatgtcattcacattgaagctctctccctatgcaaaaaaccagtcatttcatacattattacttgatttcacacaaagcaaaccacgttatatataaaagtactaaaacacataatgtaagatacaattctgtgcagattacagataactagtagcttgctagcttatgtttatacacacacataattatattttgtatacaactgtaccaaacatctcgactgttataatctagacccaccacgatttctcaatacatttatctttttctctgatttaatttatgaggaaatttataaccccaaagtaaacgtggtgttttttccgagctatcttaatactccctctgtttataatataaatcactataaatttttcttagtcaaacttatctaggtttaactaattttataaaaaatataacaatattttcaacacaaaacggacacactatcaaaatatatttaatgctacaatcgatggtacaaatttaatattatagatgttgctattttcttataaactaaatcaaatataaaaaaattgactacgaaaaaaatatgaaactgagggagtagcttaaatataatagagagataagattatcaaaaaaaaaatagagggataagactgataacatcatggctgctgcactcgaagataaatatttccataccaccataaaacacatgacagtgaactaccgtagacgtgcaccattaagagccgtgatgtcatatcgtgcgtccactacaaacagtagacgccatattagagaagcagcgagagcgaggttaattaccacgagggagacattgttgccgagcgtgatcaccgtcgggaacctcctgtcgatggtgctggcggcgacggtgatcacccacggcgacacgttctgcaccatggcggcgtcgggcccgtcgttcccggccgagaacaccgccggcacgccgagctgcatcgcgtggaacgccccgatctcggtgctcgtcatgaacagcggcatgagcggcggcgtcgagccgagggacgccgagatcacgtggacgccgtcgcgcagcgcgtcgtcgaacgccgccaggatgtcggcgtcgctgcaccggcccgtcaggtccttgaaccagcacaccttgtacacggcgagccgcgaccacggcgcgcccccgcgcgccacgccgcggcccaggccgccgacgtagctggcgtcgggcgacacggcgcccaccgccgtcgacgccgtgtgcgtgccgtgcccgacgcggtcccgcggcgaccggtactcggcgccgccgctggtgttgagcggaccgacctcgctctcgaagccggcgaggtagtagcgcgcgccgatgagcttccggttgcacgccgtggccgggtcgaacttctcgccctccacacacgtgccgcgccatgacgacgggatgtcgcctaggtggccatcatccctgaagctctgggattcaggccacacacctgaaaaaacacatgaaaaagaacagattcatcgtgtaagggcatgttcaatcaaagccaatcctagaggacactcatgtctcaatggatcataccctagatgagcttctcaaaatctgaaacaacttaagagcaagtttaatagtatagcccactattagctccaatttatctatagtcaattcatacaatagttgcttactatattattaatatatggtcccacatgtcatacacacattgtacattgtgtcttagagtccgtgctgcagctggctacagatctgtagcccgctgctctgctctctcatcttttatctcactaaaatatatttacagccgactaatagtctgctattgtatctcagccgacaaagtcccatgtttacttttacttacctaccctagtttctctttcccgccccctcttctctttttcttcgcactcgcctctccctccttttattttcgccgccgcactcgcctatcccgtcgccggcggccgcgagaacgacgaggagggccgcctccctgcctctctctcgtcgccgctcgtccaccgctgcctctctctctccctctcgccgccgccgctcgcctctccctctcgccaccgccgccgcgaggacgacgaggagggccgcctctcccgtcgccggcgtccactgccgccactatctctccctttctcccgtcgccgcccgtcgccgtcctccccggcatcctccgcctcacgccgtcgccggtcggcgcgcgccgtgcgagcatgcgtccgtacatccccaagcaaaccttcgctttctgccactccctcctctcctcgcgtctcctcctcccgtccgccgccgccgcccccacggcgccggccctacccgtgcaggcgctactcaccaccggcggcctcctgccgcgccaccccgacctttacctggtcgcgctcaactcgctcctccgcgt

SEQ ID NO: 64245 - DNA, 4032 bp, Oryza sativa
  unsure (1)..(4032): unsure at all n locations
cgtatgcttttttttacaaacgatggaaatattttttttctcttaggactacgaaaaccttttttttctagcgcattttcttttgcgctttttcctgacattttttcctcactcgttctttttaaaccgtttttattttctcgcacattttttgtttttaatatacgatggaaacttctctttttaaatagttagattagattagattagagatagagaagagatatacacacactactaaaacaacgaatagaaattagactttttttgccgcgcttttttctgccctttttttctcgtgcgtttttctacgaacgctttttcgccactttcttatagagtcggacctttctttttggattttttttgttttcgctttataggaatcggattttttttccattgtgggaatcggatctacgtttctttttcttttttttgccagaaaacggatttttttttgttttttcccgttttaggtgggaatcgtatttttttaatctacgtttcttttttgttttttcgccaggtatcggatttttttttgtattttcccgttttaggtgggaatcggatcttttttttttgccagggaatcggattttttaggttgttttttcgctgtttttttttaattttgacgaacgacggaaacgtgttaaattttttaagtaaatagagaagagatatggtttagttaagatgaaatttactatgtgagttcatttggatatacatatatttttagaaaatcatgagctatagttaggagtctgattgtctcaagttagcatacgagtttttttaaacagatttcttatatgattccttctatattaccaaaagtgaacgatcttaaaaaccgcctcaaatacggatatgtatttcgaaaagcaatcgaatttaaaaactgactcatacacagataacgtaccaaaataccggcaaaaacatcttattatttttataataatagagatagagatgagtaaattcatggtaaaatttttatagtaaggcagtgtttagttccctgcaaacttccaaaaattccgtcacattaaatgtttggacacatgcatggaacattaaatatggacgaaaaaacaattgcacagtttacatgtaaattgcgagataaatattttgagcctaattacgctatgatttaataatgtgatgttacagtaaacatttgctaatgatggattaattaggcttaataaatttatatcacagtttataggtgaaatctgtaatttgttttattattagcatatgtttaatacttcaaatgtgcgtccgtatacttttaaaaaaaattgacacacatctaaacacggccctagatactagtatggctaggcccaaaaatctttccgtcactgcctggaatccacgcacaggatagcatacaggcgcctccaacttagcataacgaagtcaaaacgaggggtgggttgtcaaggttgggtgaaaacttaggctgtgtttagatctaaactttggatccaaagttttaactttttccatcacatcaacctgtcatacacacaaattttcagtcacatagtaccaatttcaacccaaacttccaactttaaaagaaactaaacacagccttaatagagagatggttgtgtgggggaaatagctgcaactagttgtactgatcaggccaagcccaatactatagacgtgcttatatttactataaacaaaatttaaacactattgagtactgtagttggtgaatcttgcagcaaacaatatatgaaccgtacggggggtgtgagagtgactgtgactgtgtgtgaacaggacgaggaatcgggctgaatggcctccccattactgaccggttggtgccaccggtggcgacgtactgcccacttttactacccccatttccaccggcgcagaggaccgtcgtcatctcgcctccacaccacattgatctccgtgcaggcggccgcagcgtccctccgtccgtccccgtgtacatgtggccggtgacgacgagtcatcccaatttatgggcgcgcaggtggtggcatttgcatagtctccgtctataataaggtgtgtttagttcacgttaaaattagaagttttattgaacttgaaacaatgtgacggaaaagttgaaagtttatgtgtgtaggaaagttttgatgtgatgaaaaagttggaagtttgaagaaaaattttagaactaaactcggccatagttgtcagtttgattttttttcttataatgtttgaccattcattttatttaaaaaattagtgcaaatataaaaaatataattcgtacttaaagtaattttgataataaagcaaatcataaataaaataaataataatttaaatattttataaataagacaaatgatcaaacattacaaataaaaactcaaagcgacaagtaatatgagagggaggtagtatatctgagggggtttagacctaggagtgtaaaattttagcgtatcatatcggatattatataggtgtcggatgggttgttcggacactaataaaaaaaactaattacagaatgtccgtaaaccgtgagatgaatttattaagcctaattaattcattattaacaaatgtttactgtatcaccatattgtcaaacatagagcaattagttttaaaagattcgtctagcaaattagtcgcaatctatgcaattagttatttttaaatatatatttaatacttcatgcaggtgtttaaacgtttgatgtgatatggtgtaaagttttacgatgggatctaaatagagcctgagtaaaaatttccatagcatttgcagtttcgcatagtcgaatctgggcagtaaaaaattactaaaaaattccacacacacgcaccacggctgctcgcggtcgcggggggaggcacggatctcgcggtgaaaagtcgtctccgggaaggacgactagtcgctggcagatgctgctgctgctgctgctgctggtgcgtcgtgcgcgcgcgcgtctcgggctcggaaaccccgcgtcgtttccgcgttaacaccgcgcgccgattgcccgaatcatttcgcaatcgattggccctgacctgacaacgatccgacgccgtaataatctcctcattctgttcacagaaacttgaacaatgctactcctatcctcctactactgcatcgtgagtgtactactgcaccgcacaggggggtaaaattaaagacgcagattaattgtaattagcctgaagaataaggaataatgcatgagtcatttcctttcttttcctgagtagaaacgtgcatgttgctcggagtngtcaatgtcaactcatctccgagagaaatggaaaaccagaaaccaagcggccggcgagactgtatctctccgaccgaacttgcaatcatgcattgcacgttatagatgcatactcctactacttcttagatagggataagtgacagagtcacagagagagaaaattttgaacccatacaaacttcactatagctatcatttgctatagaaatttcatcatcagatcattcaaaaatattaaaatttaacggagttttcaccggctggcctacgtgtctgtccgggctaaccggttagtggctctactcctaattggatgtgaacatttctactgtaacaaatctggataatcttttattcaaattcattgtattttttaggatgaagggagtagatgtaagatctctatgcttagcagctatgactacgagtaataaaaacaagggaaattttgctacaggacacttgttatgtgtgatttagccctaggacactgcctaaacttacttttggggaaaacactccataaacgtggttatttgccagtgggcaccgctccgattaaaataatactttccggttggggaggagagagaaatagcgtgaaatgtcaaaaatgctcttgggcccacatgtcagctctatctcctatctctcctcatctctctcttttctctctcagagagcgctcgcacggggtggcgtcggtcacggc

SEQ ID NO: 64246 - DNA, 19590 bp, Oryza sativa
agcccccgcagcggcatcatcccctccgggaaacccagcgccctcatcagctccatcgactgcttgaagcactccaccgccccgctcaccacctccgccccctccctctccttcccaacctccgccgccgccgccgccgccatcgtgcccgtcgtcaccgtcgtcgtcacggacgccatcgatcgatcgatcgccgcgcgctgcaggtgactgctcgctcgcgcggttgtgatgagatgagagttgggttgtgtgttgcgtgatgcggtggtgtgcgagtgaggggttttataggggggagtgatcagtaggtgagtggtcgttgagctaacggtaaatggagcaaaattttgagggatttggtcacattagctcaccaagcgacctgggaggagggaggaacataatgttgggttcggtcacgttagctcaccagcatgcggcaaatggatcagcactcccttcccgatcccgggatcagaacagcttcacctggcagattggtggttgcaggcaagactctgttttcagaagggctacagggacaatttcgacagcgcttgcatgctcatctgttggcaaatttggaaagatcgcaatgctagagtattcgatcagcgagtcagcagaccagaccagcttgcagaggctattaaggaagagattatgatctggaaagaagccagctatttcgcgagtagtagctcataaaaacttctcttccattttttttcgttctgtagctgttcctagcttatgggtgcttgtggctaggccatagcatcatttcgacagcttcctgtcgctgtaaaaaatgttgggttcggtcgtttggtgtgtcgaatgggtttaccaagatgcaatatctaacgtacgtacgcaaggatatcatgctacgccacacaatctcttcacgtgctccttgcctcttgttatgcgtgatgttggtgggagttgaatttaatgggctgttattgtagtgggcctattgaggtggatgtgccattaatgtccctaggtgaaataagttcacttttgctcctttgacatagagtttcagaaacgttcttaaaccgcaataacatatatagcgtgtcctttaacttgcaaaattggtttaactggaaaaaaaatacccgtgagttgcaacgggtgaagtctattttaatcttattattgttatttaatttagttaaaatgaaattcacggtgggagtccacttggatatatatatttttagaaaatcatgagctgtaattaggagtccgatcgtctcaagttagcgtgcgagtttttttaaacagatttcttatatgattccttctgtattaccaaaagtgaacgatcttaaaaactgactcaaatacggatatgtaattccaaaagtaaacaaacttaaaaaccaactcatacacggataatgtaccaaaataccggtaaaatcatcttcaatttctataatagtagagatagggtcccaaggtagcataggtttcgtccgacgtgtcgttttggctcaagcgtcaaacgaaaccaggagctatactggcttagaaccccctttaacctgattttgtaagttaaaggatatggtatgatgtttctgaaattcgacgtcgagaagaggaacctaaaatgaacttattcttttcctaggtagctggtgtgaacagcccgttgtaggtggtgggctattgttgggccgttaatgttgatggtgccctagtggcctggtttgctaggcaccaaaccgacacacgacgtgtgacgtgttacacgcaccccttcctcgaaaccgctcggaaattgtaaaaaaaaaaaaaaggaaaaaggaaatcaggtggccggaatccatccatcgcgagagcagagggagggggatcgcggcggcggcggcagctgcggcgaagggggaagcgccggaacgggagccgtggagcgatccgtcgggcatcggcgcccgatgtgggcgtggggcctcgtcgagcgcgccgccgcgggcctcctcggccccctcggcggagcccatggcggcggccgatggaacaccgccgtcgccgtcggtgtcacggccgccgccggcctcgtgctcgtcgtgatcgttgtctcctcccgcaggttcgtcgcctcccaacccttactccccatcctctaggaggcctggtgtggtgttcccttcctggcttcctttcgctgagttgctagcgggtgctttgattgcagaggtgggctcaaatcgccgtggtggcggcggcggaggaaggccgcgcttaagccccatgaatgggtcagcttgttcacgccggaggggaagcttaaggacggcggagtgaagcttctgaagaaagttcgaagcggagtaagagagttttgctttttcgtttatactccctccatttcacaatgtaagattttctagcattgcctacatatatatagatgttaatgaatctaaacacatacatatgtctagattcattaacatctaaatgaatatggcaatgctagaaagtcttacattgtgaaacggatgaagtattctactattatgtttccatgattcggtgtaggttaaggagttatatgattttgttctatgtgcttctgtgacaggggattgagccaagtatcagagcacaggtctggccattccttctgggagtgtaagtactctggaaaacttaatttcgagacggctatagtcaaggacttacgtgttcagatgaataattatatcggcaacatgctatgatcatcttgtacttaagcaaatgacaattgattttgcctcctggatttgaggaaagacttctaggctagcatctcaacttctgaacataggctaagtgtgcaggagcataacagaacttctgatcataccagttgtacacacatgctgagtagttactaagggtgcgttctaaagagcttatctgattgtctactccctcgtttattgtgagcatgtttcccgaaccgctaaatggtgtgttttttgcaaatattttatatatagaagtttcttataaaaaaacaaataaattcatttttcaagtttgtaatacttaatactcaattaattatgcgctaatggctcgcctccttttgtgtgccaagtacaacttataaagtgtttttttttctttcaatcagcagaatgtgagaagaatgtattgctacagtgaggaatattgtgtggttgcatattgtagcatatatatatgtgtgttagttgtgtcttgaagatagcttccatgtgatctgaatttttcattcttatgcagttacagtcttggtagttcagaatctgaaagagacgcggttaaggcacagaacaggtacattcttctgcatgcacattttgtatgtctctctgttcttcctgctttatcgcatcctcatatacctgcccaaagctgaccaatcaaaccaaatccacttgagaacctttcctgatagagttaacatgttatatctgctactctttattttgaaatttgactagtgcctcttgtgttcttttttctgggttatctgaagttgactttttaatggtggatgaattttgtaggaaaggttatctgttattgaggaaccattgcctgcgaaaatctgtctacatcaatgaagagaacaaacaatcaaatgaagccgctggagccaaacatgtggagtgtgttagttctgaaaaaggcgaagacactgtcaatccagctggatctgaagaagtacctgataaatctagtgtagaagagcatcttgttggcgatgacactgttggtcccgttgtatctgaagaagtggctgaaaaatcttttgtcgaagatcatcttgttagtgaggaggaaaatccatctgccaatccaggagaagaagtgcaggatgacacatctaaaacaagccctgagaagctgacagatggaaatcattcttcatctagttcatctagtgaggaagaaagtgaatcaagtggcctgactcatgtagaaacatctcatatggttgtcgcctcagttcagcaatctttaactgaggatgaacaagaaagtatcccgagatattccaacacaggaggaaacatggaaaatgatagcgagttatctaaggctgctcgtcctgtgaaatctgtacgcacaattgaggattttgagacttggcaacgaattatccgcttggatgcagttcgtgctaatgatgaatgggtttcttactccccatctcaagctgtagtttccagggagaaggcaattgaatctgctaaagctgtttgtctgaaagattacgaacatttggaaccacataggatccgtcatgcagcacgccttgttccaattcttgaggcttatgccatctatgacccagaaattggatattgccagggcatgagcgaccttcttgcacctctacttgccgtactggaagatgacaatgaagccttctggtgctttgctggttttatgaggaaagcccgtcataatttcaggcttgatgaagtgggcattcgcaggcaactgaacatggtagccaggataatcaaatacaaggacttccatctttacagacatttggagatgctccaagctgaggactgcttctttgtttacagaatggtggtggtcatgttccgaagggagctgacctttgagcagaccctctgtctatgggaggttatgtgggccgatcaggcagcaaaccgtgctggaattgcaaaatcatcgttggggaaactgcggttaggagcccctccaactgatgacttgctactatatgcaattgcggccagcgtgctgcagaagaggaaactgataatagagagctatagcagcatggatgagatcataagggagtgtaacagcatggctgggcagctggacatttggaagctcctggacgatgcgcacgatctagtaacgacccttcacggtaggattgagtagtgatatactgatacactctactcattttgtacacggcttgttgtattactttacacattttcatccttacgtcatatttcatctctttttcactaacactccctccatggatatgtgttagtttgggactacagacctacagtaccacaggctcagttgcatggtgtcccagtctagctgcctctcaggattaggccattatcttttcttgatcatagtggtgtaactggaccatctatgcgtgtggatttctttcttgctgtggtcgctgtcagtatcctgcaaatccatgtgatagcatcataccaatgtgcaaggggcaaattctacttcctccgttttaggttataaggctttctaacgttgccttaaacagagcgttttaggttataaggctttctaacattgccttaaacagaggtagtagtggacatgcggttggaaccggtaaaccagtacctaaaatagaaacaaatcaatggctacccccagtgtttcttgtctgtgtacataagcatagatgtttgcttcgtgaggacttcaacaaacagaacacaaatatcagaagttacatcaaagaagaataatttcacttctctttgtgtcgaattctccgaagtgttctacgctacgaaagtcatttgttatgttatttcatatcccagccgttccaaatgaacaatatttgggcacaaatatgtaacacggatgttcgggatacataatactccataatataacaatacaacataccgttcccctcaacaaatatcattatttagttcttttgatccaaatcatttcacctaatatagcttcatggaccatattgattatcaacattgtaataacagatctactcagatttggtgtactgccggatagcaaatgcaagccccaagatcaagatggggacaagaaactgcaagatcttaatgagcatgtcatcgcccttgtctgggttgccgggcgcttgctggggagtgacatgagtacgctttactgggatggttgaagcatcaatctccccaatgagatacttctccatcatctcccttgctgattcactgtggccaatgtcttcaaaatcattggttgcgtctttgcctacgtgcattggagaggaggggtcagctttgatattgagatggcaatggtttaataatgttgacagtcagtttcatcattaattatgaaatgaaagaaaatatatctcaccagttactgctagcaacacttcatcgccaccagggtgctcatccataaaagaagtaacatcatatacctgaaatgttaacaaggatgagatgttatggtcaagtgcataaatctccatattagcacaatttcttatcggcaagcaacatacggcagatgacattaaatatgggccaaacataagttttttatgttttcaccatgttttacttcatactccctccgctccaaaataaacaagtctagaatgagatgggacattacctagtaccatgaatctagacactaggtaatgtttcatcctaggtttatttattttgggacaaggagagtacaatcctaatcttatggaagagatgaatatgcatgtctataccaaccataattacttaacccaaggaactagacaatttaatggtacatctctttttcactgcagagaaaacctactgttatgcataggctgtagtagcacatggttcgttgtacacaggccatactaatccatacactttccaaatatcataattgtgaaggggagagacaaccaaaactattgaccacacggagtacaaatgcataatgttttagagggtcgtatgaatcaaatgcactaataactcctttaattccaccatgcacgactactctctctctctaattcaagtgggttgaatgtaagccatatcattatttgaggtgcatgcagtacctaagcacactgaacactaaatgaaagtcactcgacctgcaatggacatacccgctgatagaattatgcctgctttccatctctttttttttttacgtaaaaaggtagagagattctaccttgtaaccattagattaatggtgggtactttccatcttaaaaacacatatttgttcgagactccacagataccttgcagacataccaatcatgagtccacaaaagaatctgatcgaggaactttgcaaatacaagttacacaaccaccacatactgtaatatgttgatagccatatgtaatgcaagcccaaatgaattaattctacccttcaagtaaacaatctatcgtgtattgtcctctggcttcaagtatctaaccatctggcagatagcgcatttatttatcctaaatgatagaggggaaacgagtcgattagtcaccaacaagaacattctgcacagtgcccacaagctttgtcatggtcagcattttattttgctgtgttttcttatgtttgcttgctcttacactgaagcagattctttattccagggatgtagtaacccaacatccaaaacgaggtttgctggtgtggaacctatgcccagagcaggataatgatgtgagcttggtgtttgcttaggggttgggaggactactaccttttattttttcctaaaaaaaggttatatcccagctaggggttagggggtcatgtcaagtctgaagtcatgtcatctcagatgctgataatttggactcattcctatgaatagtatgggttgcgagtgatttattataccttcttggtgagaattggtgaccacgaaacaaacactaatcgcagagaaagaggataaagaaagaaaaaaaaaaccttcccggcgatgatgagccagcaatccttggtgacgttgtggccggccacctcctcgaacccgaacaccttcttctcgccggccatgtccgccgcccacgcccacgccctgcaacgctgcaaagagaaattcccccccccaaaacaccagagaaacaaacaatcagccccccttcttcgcgcacccgagaagaaaggagagaactccgccacgcaaagaggcgcgcggctggctcacctgcgaggtggtgggaggaagcggaagccgacgaggagcgcgtggccgcggggggagcggagcggagtgtgggggagtcacgcgatctggacacgctccgctctctcggcggcgccggaaaccccgcggtatttgagacgctgcgcaccccgacccgagtccaccgtttacttgcttgcccatgtggttttaccgaaatacccttcgttccctgcctactacgcaacgcacggctgctttgggtaattgggtccggcccattatcatgcctcgtggtctcttcctcgctctgcaccagtgtaccgtactactcgacaagtggttttacccaaatacccttcccttcctcagcatggctgcttcttatgtgggccttccgttgggcccggcccatcggctcgcctcgtggtgacgtaaccgttgacacgtaggcggcggcttcccctacctcggagtcagtcgtctcctccgctttttgcttcgccatttgatttttttgccaagtccaacgtcgcgcgaggcgaggcgaggcgaggcgagaggaggagtggagaccaccgccgccgcggcgcgcgcgcgctcggagatctcgccgcggtagcgcagcgcgggtgccgtgccctgatccgtccgtgcgatgaaagagcccgcgcaggtgaggacggcgcggggcggcgcggcggatggggtggaggtgggggtggaggaggaggaggagccgccgcgatcggcgacggtgaagcaggaggaggcgaacgcggtgctcggggcggaggggtcccgcccgttcgccatgcgggagctcaaggaggaccacgaggtcgcggccgggagcggcgtgaaggcggcgtctggggagaggaacgggatcggatcggcggatgcccagggttcgtcgtacaggttcgtggagatgcagtccattcagatctcacgacatgtaccgtatcagttcgatttagtcgtgtttgcgttgagtgttaattgctctgttgcctgcagagttttattcgatgtttaactattgctttagttagaattccaccaccatagttgagttaatctcatcaatgtgaattgtgatgctgatacttatgatagttgttgtattggaatgattagctgcaacatgcaagcctgcaaccataattctttgttttgatgagaattgtttgtcaagtatcagtggtcatagttgagcaaagcaaaattaccgccctagcaaatctagcagacctctcacctagtcgaccttcttttaggttagttttactgctagataaggatatataaaagccacttttcgtgccactgtacattgctttgcaatatcatgggtaattcttaaacattgtggaatgtttaattccattcttaaacatcatgggtaaaatattgtgttatgtacaacatatagtgcatgtctatcccattctccgtacacattgatgagactgtctcgaatttatttcagccaagagagtatgcagcagttttcatcccatcatgatgttgcaatggacttaataaatagtgtcactggagttgacgaggaaggccgttctcgccagaggattctttcttttgctgccaaaaggttgtgttatctttcctgaatatcctttctcttgctattatcttacactttaaatgtccttcatctgtaattacttgttctgtcaagtcttataaaatctttcatgcagatacataagcgcaatagaaagaaatcatgatgaccctgatgcatattataattgggcccttgttctccaggtacatctgcattcttcttaagttatgtgatgtgccagttattgtgttgtactgttgttaatacttaactgtgaccaatgtatgattgataatattctctcaaaatattgattcaggagagtgcagacaatgtagatccaaattctagttcgtccaaagatgcattgcttgaggaggcttgcaaaaagtatgctgaagctacccgtctttgcccaactctttatgatgtaagtttttgttcctcacatttgtttgatttgaagaatttgaattgataagagaattttctgagttggtcttgtccaagaaaagatgagaagagacatggccattttttaccaccaatactctatcaaaagcatttagaattgtagatcatcccgcagaatgtaatctatggttctggtggataaaaagtgctctcatttgctgtatattagatgtccatatttgactattttgtacttatttcaagcacccatttccccttttaggcatattataactgggctattgctattgctgatcgggctaaaatgcgaggtcgtactaaagaagctgaagagctctggaagcaggtttacttacaagcctcacacatgtacatgctttgttaaaatgtttatgctatatatcttgttgctccctgttatcagtataatgtttattcatctagtgaaattccattgattgcaatttgcattatttaaatgatcaacattgtgcaattttcctttcagttatcaagttaaaattctatatgataatattttttagttatactaataagttggttgcttccttcatatatctcgatggcagtgtaagccacaactttctcaatagccaattgggtagtaagcggcataaaactcataatggcacttcgtgatgacattaattcttgcggtttactgtaagctatgctgacacaatgtgatcatcatatttgaggcttatttttatctgtctttttctatactaaacttagccagtttgcctttgatatttggggcaaaatcaacctagcatattcttaaaaaaagttctgtgtatctcttaataccgctgtttggtttcgaacatattctaacgaaacaaactgtattggtggaaataggaattgattcctactgcaaattttgatggtgattttccaaatctaccttgtccagatagtcttggaatgggttgttctaatgatccatcactttattgaagcatatatgctgccctgagacttgtttttttttcggttatgtgcttgtaaatggaaaccggaatcacacttctagttttgcatagactaacttttgtcatcactcatctataacaaatgatacctatttttttctactaggttttactgagtcataaggtgatctttttctttacaaggaatacactgtcatactgtttaaagtttataatgaagtttgatgccacgtgttatgtatggttccattccattgcaggcaatactgaattatgagaaggctgtccagctaaattggaatagtccgcaggtcagaacctagatcctttttccttatcttcaggactttacaacataagaaaaaaaaagagaagatatgaaatgtttgcctttttgtgaagaagaaacattcttatttgatttaagtggaagaaattcacgtcaatgcaattaatgaaatgggaaggttcaaaaaaatatggagttgtgccataccataaaaatgctatcatatgggttgtagaatgtagagaaccgtttgtagaggccttacctttacatttagaatacatttttttaatctaaatcctaatatgccctttaaggaaaaaaggcctcactgaatgttcattcttccatcaaatggtccaaaagaagaaattttaaaattacatccactgagaaaccaaaacttgatatacctcaatcgtaatactgtacaattcatgtcacttccttttaaccattctcttcattcttcattttgggcaaagctatgagttgaacattgacagatcatatcaacttggattttctttccacacactccccctattttcagttctcacttgagaacccatgccattgttgcttatattagttatatctttgattacaggctcttaataattggggtcttggactacaggtaatcccacatttgacttcttgttattgtagccttctcaatctgggatattccttagctctctgctcttgagctatatttgctatgctgtattttttttcagctaggagtatgaatttgtattgcaggaactgagtgcaattgttccggctcgtgagaagcaaaccatcataaaaacagctataagtaaggtagatgcaatttctattactgtgcgagaatcatttttgatgattgtatcttctataaactattgggctgttgacgccccccttctgatgtcttggcagtttcgagctgcaattcaactgcaatttgatttccatcgggcaatatacaatcttgggacagtcttggtatgattcctgacttccattactcacctagcaataatctattgttttaatgtagctgcagtgacttgtgaaaaccttagctgattaagttttatgataataacaagaatctgtcttcttgtcttattaaatgtctcagtatggtttagctgaggatacaatgaggtctgggaagccaggtgtgtccgctagcgagttttacagtcagtctgctatctatgttgcagctgcccatgcactgaagccaaattactcggtatttctttttgtcttttaattttctaatttatgtatgggacttcttcataaaaactttatagctgacaatgtccctttttgtataattcaggtctaccgcagtgctttgcgattagtccgttcaatggtaagacactaattttatttcttgacaaactcttaatttattgtttatttttatcagttgttagccagcagtagttaagatatggctagaatatgtttatttcttaatttattatcttagaattcacttatctttttttttgttaagtcgtttttatgtggaagataaaagatgaatagacataggactttgaacctgtcaaatttttactctgctgttctttagttttgagtatacattgttatttcagtacatggcttcttatcttatttcttgatatggcagaagtaaccttgttcttgctgtcattctatgtcatgcagctgcctttgccatatctcaaagtgggatatttgattgctcctccagaaaatagtgccattgcaccacacaaagaatgggagaggtcacagtttgttttgaaccatgaagaactccagcaggtagttctgccactgttctttgtgcacttgctttagatgataatattgtccattttgaagttactgctgtctgtaattgttctttgtcattatcgtgcctgctcaaactgctatgtgttgtaaattgtaggtcaatgcctctgaccagcctccatcacaatcacctgggcatgtggacagcggcagaaagcttttcaggatagttgttgcagacattgtttctgtgtcagcatgcgctgatctaaccctgccacccggtgctggccttcgcatcgatactattcatggccctagattcttggtatgcatttcaatttgcaattgttcatttgttctatcgaaatggattacagatgttttcctttatctacaaatggactattttctctgctttccttgtaaaatggataactacaactctatgcctataatgtcctcagctatcattatcaagttagtgacaaacaactgagtatatagtttcgagtgcataacaaatgttttgttgtgcttgtggcaggttgctgataactgggagaccattgacagttggctagacgctatacgcctagtctacaccatatttgcaagagggaggagtgatgtccttgctgggattattactggctgatggctcgctgctagtgaaaaactgccaacaagtataggccaagagactgtaggagtatgtcccggaatcagatagaagtatcatagaactcatggttttagtaggcgtaagagcagatgttatttgtaacccatttatggactggtaggtcataggccaattttcctttgtactgtggcgttgtgtcgtcatggtacatatgatgtgatataagaaataaaaaccgtaatatcctctctagcctgtgaataaagatgcaacggcttgtggcaggcgagtaggttgtgtgaactgctgtcctatctccctctcaaagaaggaataaaatgtttcccctatctgtttttcagccttcaaatctctgtttctcggaaaggaaaaccacatattatttacaatgttacacgtacacagttcggcttagcgaacatttgttttcagacataatttggacatgcatgtcagtacttgatatcaaaggctcaaagcgtgtatgcaatttgctccttgaagtttcataatctaagcgtgtatacaatctcgagccgcaggatccagccgcaggaatccagtgctgttcagattgaggtcatttcaaaccatactaatttttaggtaaagttgtcaaagatgtgcatatatttagtttcttatcaatctttggtaaatacataataaatcctgccaaaatttaataaggtttattttggttacaatctgaagagcccctcagtcacttgatgctggacaagagatgaatctctgaattgacatctccaagtattccaccacttactgtaaagctgaagggaaaaaaactgaaaaagagaaatattcccccgcctgagatttctcagagacatttcgaaatttctcctcctcccagatcgccaactcaagaaagaacaccgcctcctcctcctcctcctccactcctactccaccgcatccgcctcaacctccatcaatggaactctcctccaagcgcgagcgccccaaggactccagctagagtgagctccctgatcgggccatggcgacgatagcagcagcccgtggaatctccaccaacgacatcgcccacatggcgttcgtgtgcaagcgctaggcgggcgctctgtgagttcactgctccaccttcggagaagtcttcagctctgatgcgtccgtctccattgatgaagcgcttctccaagggtcctatggattcgggctggggtgagctccctgcttgcgcagtcgtgaggatcacagcagcaagtggacttgcggacaaggacgtcaaccacatggtgttcctgtgccatcactgggcgaacgttctcctcgaggagctcacgatggcatcgggtgagtccccctctttccctcccttagagagttctgcagcggccacagggtggagaggggggatgcattcagctgctatgtcatcatcgcgatggagcaccattctatacgatttgttgttcgcaattgctcttcgcctgaaggatttggccgtgctgaggcttgtgtgcaagccatggtgggatgcattcccaggtccaccgtttctggtatgctccacacacttgctggaagaaccactggttggggaatcacaagttttgggtcattttctcccatgcaagttgcaaaaaattttcccccaaattcagtctgttggggtggatctcttgatgtacttgggatagtcgattcggacggccaccatgattgcaggattttttgtctgctctgtgagggagaggagagattaccaccattgccagattcacctaatggactcttcgtgttctagatctgtaacattcttatgagagcagttcatgttgtggcatcgtcattactttatcatttccatgagagaaaatttgtgctagtgaatgagggtttacaacgatttgtcgagtaggtccaaattaagattccaaggaactataccattggtccaaattcggtcgtggagacaaacattaatggtattgttatccaacagccaaaggtagcagaatttgcccaaggaagtcattattcgagaccaaaaagacaacacctctttatatgtaatgaggagatgtacttatgtatcatcttgcatggagctgaaagggatgatatcatagttaagctattcagagcaattgagctaacactaccaccatcaattttgttcttgcgaatagtattggtacttactcactttaccttggtgccaatcaaccttggttcgccacttgaataatgtttctacatgcagaaggatcaacactgcctatttcgagaattgggacgacaatatgtggattgcgtgttttaagcattaatttcagtagcatcacatctttaactagacaggtgaaataatggcacaggagaacattaggcccctgcagtgtgggtgtgtaaaaatctccatagagatacaagtaccgcatgtcatttatgctattagagtagggcaatacgatggtcgaccagaaggattgatgatggcacatcatgggtgcaatgtgcacaatgtaatttgttgtattaatatcgactaaggaaaaaatctcgcttgtaaaggattatggttttctatcaataaaattgggtttgaaatttttaaccaagaggttacaatacatgcttgcataattggctgtagttttttttctataataataaatgcttatataatgaaacataagctatgaattggttacaacaaaatcaggatcacaagactataaattcaccctatggtgataccttttaaatgactataaagatgttccacaatgattacggctatattaatagtatggtggaaaatataacttattttttatggatgaacttaataactgggtgtgtggcagttaacttaagttagttaagaaatacataatgtttagaagtagcttttatcaacccatcttactattcttattcgtattgtctatctcctcctgcagtagaaggcccttttgaaaactgagtttagtcactattgaaaactgagtttagtcactatgccaataggttgtcaaccgtttaagacatgctaaagttagagtgtgttgattttagtttagttagagtgttttattttagtttagctcttgtgagatgttttgtaaatattgttattttagctttggtctatttgatggctgtctttgagattgtcgtatacaaatgttgaatttataatagaacgtcatggatagttggtgtccccaacaagactccttctatctatctactgtattgatgttttcttcagaattttaattacttaactgatgtttgctggtaagtttgtcatatgcattattaatattttccttctattatggtgatgcttcttatttagttttaaaaaaaaagttttcggttccgcttaaaattcagtcaaatatggttgggatgttagatgttttgttagaaccataatgaagaatttaacatcaaaaaggtttgtttcatattcatatcaagtttttattatgttattttgtttacaacttattcaagtaattttttatttgtagttgcttaagattagttgtgaaactttataacaaaaaatatgccaagagctaagcccttataagtattttcatcacttattttttattttgtttattttatgatactatggtacatagtgagtatattaagtatcttatattcatttatgtgtataaagtgattatgggagggaaggtactgattgaaggataaaaccattttgttttttatgttacttgagttttatcctgctattttttgtttgtccctttacgtaattcactatataaacaagtagattatttccatttatttaatcttttcaacattatgaattatgcagctattttgaatttgtacatatgtgtagttaaaaaactatcaaaaataataagtgttaaacatactgcaaaatatgaatacgtatccaccgtaaaaaaagtaaaaaaaagctttaaattataagatactatacatgtgtacagatttttgccttagacattgataattacgcacagatttttgccctttaccctgagattgctaacataaatagattatttttatttttactgtttatttttcttgttaagccttgtctagcattagattaagttaatatcacggtgttacaacattttttctgttaaaaatatagttctgaagttccacaaacttcaacatagtaaataaatgtataattgtttcagtttttgaaggttaagtagtttaatagatacatccttttatttatttgagtaaattttgaaacttggtgttgtgtaagaactcaggatcctattgtgcatgtggggaggggtgggaagatgaaagttatcgtgtgcttattagaatagttttctaccgttggaaattaatttgcattaatcctagttagacagaaatatgtattgataatatgaataaataattgtaccattatgagtatgtatgcatacaagttctaattattacatcttggaaatatttttttggtaccaaaatattagaattaccaatgaagtaaaactcatcctagtaatgtatgattgtatgttttctgaatttgaatttagattaacaaaattagttctttaacgtagctaagtaatccacattgcacttgaatctctagataaatcagcagagtataagcctcacaagcctcatgtgagtgcatggagtgttgaaataagcataaagtatttggtgttcaaattattcagcattatcaccaaaaaaaacaacgtgagtaaacaactgcaacaatccacaatgattatttttttatatttttcttataactaccaaatatcccctctattaggcccattttaaaaacatcagcattaactgctcatttttgtttgagcttgttactgtctacctacaaaatcttacactatgatattgttagtctgattgataaatcgtcctctcttctctaacatttcaaggctaagtagatttgttaacggttgccgtaccgccgaagggcgggcttcactagttaagcggaaaatgaaatggtgaaattgtatttatttcttaaaaattggatcctctattacatccccttggggtctatttataggcttacagccctggattctcagttctagggttttgatattacatgaatgcccctatgtcagggatatttacgggggtaatgataatattttaattgcactatgcaactcatgggtccaattatccctttttcatggtgtcagtgggcctccatggttgaatcgaagaggctattcagcaatcagccactcaccgcgcgcggcgcgcgtaggggggcggcggcaggacgcgtgtaggggagggagcacgtgtctcaatttggtttttttctttggtttttgcagctttctggtttctttccttcggttttctttgggtttcttttttatacgtacggatacgttcccggttcagtttttctatattttttcctttggttttttgcggttttctggtttctttccttcggttcttttggtttataaagtttgtatacgtgaatgcaaagtttgtatacgtacgtatgcaaactttatatttatatatgtgtatacatacatacatacataaattttgcatacttgtatatattttttatacatataaaaatataagttttatagtagtggtatcagtgtagcagtaagtactagttatagaggtagtaaatagtactagtactatagtagtagcacgtactggcacgccgcgcgggaggctgggcgcgcgcccagcagcgcattagcagcgaatgttgattagcgaactgtcgtgtgcctctcctcccgtgcggcgcagccgtggcacgcgcgg

SEQ ID NO: 64247 - DNA, 18484 bp, Oryza sativa
cagtggcagtggcccgccggtggttgctgctcatgtgtgccgcccctctccctccctcctcactccatgatttctatgatatgaattcgtggtttgttggagctgttgtaggacatgaatattagtggtttgtaggatatgaatttgctgttggagctctcaaatctatcaaagctatgtcaaatttgttataaatgttttaaaaagattcaaattaaaaaactttgatataaacatagtcaaatgagcaagggaaaaaggacatctggcccgtaagttaacaccgttagttggacttcacggaataaggtcaactctgatcttcatttttgaaaaaggatcaaataaacaaacctagaaaaatagggtcaaattgatagttacgtttcgagatagggtcaaataagcaattatccctacttttatagcaaagcaaatttcgatccgtatcaccaaaatgtataactgaccttaggctagcaagctgacactgatctagacgcgtatggttatttgtacataataaaaggttagttgtacacttgtacaaagtcaataggagtctatacgggacagcatcatatgggtccaaccaaattaacaacgcttaccagcaaattgtgggcattctattgtttcttctaattttcgaaattctgtaaatagcatgtgcataatcctgtcaaccattttttaaaaaaaaacaagacaaattactacataagttcatggttttaactatagtacaccgtaaaaagtaaagttacactctctaaatgtgataattacctagtggacaccactcccattatttcagtgtgttcgggctgatgacacatgagagggcccactttttgacacggcgcgatcaagttacccctattgtatatttagactaactggatccgtcaaccctttagagccctatgtcgccaccccaaccatatatatgctctattttgacattgccaccatgacccgttcatcatccctgacccactaggaatagggatgcaagggtgatctcgtgctaggagtggaattggcttgcagcaatggctacactgttgtcagagcagggcgtggaatctgttacgaagctggtgaatctaaaatgggtgtccaaagggtaggctcgatttttctttgttttgattcgattgggatgcatggtttgttgatttcgttgagttgagttcttttcttgatgtacttgcaatggggtagaaggctagatttgcctggccagcgtcagttgtcgagattggtttggcttaggacattgtcggagatatgggccgagggtatgcaaagtgaggggaagttaccttcacatccagccgcgtggctctacagcctggccctacccccgcacctcgcgagtcacagaggcggccggggggcctcggggtgccacgtcatgcccctcaggccctcgcgctgcccctccccgaggccctcgcccaactaccatgtggtggggggagcaagcggggaggagacccaggctgaacggccatcaatgcgcggcgccccaactgtccctcaccgcgtttaatgcggtaagggcggacgtgcggtgccactagactgacccacgtcaatcgggtgtgaccagtctgtgaccggcctgttgccggccacgtccgattggacgggcggccgtgcccccacgtcgcctctgtattcggcggagtggaggtaggtatgtcccgtcccatcggggcgtcatctggggttccctccacgcgaggaccgccacaagtcttcactcatttaagaggaaattatagggctgtcccccgtggcaggcggggggcggcgccggatcccactaaaggacgaactgccgcttagcttccgggcgaaggcacggatcgtggtccggtcaaggtaaagtgggtccctctcccataaaagagtaggtaggagcggcgcatgtggtatccccttgaactataaaaggaggaccttgcccgctgaaaaagggggacgactcccagcaggcctgagctttagagggagcagaccaatagcactctccagagttggggaacccttgtaacactcaatcataaatcccacacacaggagtaggatattacgctctatagcggcccgaacctgtataatcttggcgcccatacgcgatctggaaaccctgagggtggatacacgatctcgagaggcgaacccttttccccggctgaactcaaaaagggggatctcacgatctcccgctagagaggatcactcctcgacagacatgtttgagccagaccatctcaatttgagccggatacgcttacacaatttttacaatttgaccctttgaaaaaactatttttacaaatgaacctccgccaaaacttatttcaaaaataacccttttttcagcgccaaatcatgtggcgctgaacttagacatctcagcgccaaatagtgtggcgctgaatgtgcgttggcacgctgacttagcctcccatccgcgatggcacggcattcagcgccagtagacgtggcgctaaggtgtcaagttcagcgccagatgatgtggcgctgaaaaaaatgttatttttaaaataagtttggcggcggttcatttgtaaaaatagtttttttaaagggtcaaattgtcaaaatgtgtgatacacttagggccaacttggtcaccctatgtcaaaaaataggccctctcacacgttgttagcacaaatacagtaaaataataggcacaatgttcattagctaattaccacattaatagtgttttcccctataatgttactcttgcgatgtcctaaaggtaaaactagaaagcctcaagattctaaatgaaacattgactatgtatataattaactagactccggtcctcaaaaagcgcataactccataaatatatattctagaggtacatatctcatccttgaaaacaagtagaacatcaataattacactactggtaccacacacgtctcacataagttcataatctggcaaaatatatattgcaaaccatatatatagtggaaacatgtaaactacatattgttgaatcaaaatgcaaaatttgctacatgacacttaaaaacttattatctttgctggtagacgtcgtaagaatgtgattttttcctaatgacacttcgaaagcgtggtaatttgccataggacaccgagcgcataaaaatacaatatccacccaattgatgagagaaaaactatgtaaaatgtttgttttgccctcatcttcttctcccttctcatcttcttctcccttctcctggtcttcttccgacaataggcatcggcggtggagctatcatggacctctgccttacttccctcgcaggacatgatggttattgccgagatctacatgagatgcgcggtgaggttcttggtgtcgatcagagcggccgcctccacgcgggtgctggcgaaccgtctgggccaatcgaggaatctctcaacgacgagcgacatgttggggaaaggcggtgaggtagaccggcgaggcggcactgcgggcaaagctacacaggtggaatccaccagtggcgcgacggaagtattggcgaagcaggcagggtccggcggcggtgagaacatgagcgtgcagtggtagctcaggaagtgcagcgcgacaagcagcaggagtataacgagcaggaggactatagcggtggccgctggggtgatgaggaaaaggtagtgggagtggttgttagcgggaggagagggggcggtgccgctactggtggtggcgggggcaaggaggagtccacaagggcaaacttgtttcttatgaattttctctttttgtttccatcaaatataataaaataatacgttgagtatacgactaattaccatatttctatggtatccacgaactaacatactttctttagataatgtcacgtagcaaagaccatgatattttatatcatgcagcaaattttaccgaatcaaactagatgcctactccctccgttttaaaaaaagacaaaccctggtttccgtgcccaacgtttgaccatccgtcttatttgaaaaaattatgaaaaaaattaaaaagacaagtcacgcataaaatattaatcatgttttattatctagcaacaatgaaaatatgaattataaaaaaaattcatataaaacggacagttaaaattggacacggaaatccatagtttgcctttttttagacggagggagtaatatttatccacttcaccttagcacacacatgagtagtcggtgccagggaaagagacgatgggagatgccttctgccgataacgatgcttttttttttccgaaaatgaggtgcgcctggtttgcgtgtcagccggtccgtcactgatgtgtacttaccttccgtttttgtgttaaacagacaagatggcagccatccttgctgcccatggactcagcctgcctgatacacactcagagtgcacagctccttttgccttggtgttgcgttggtcggcccacgttttccttttacaagaagcgaaaataaaagaaaaaaatgagcacctctcctgcagcaagcgaaaatagagaaagaagaaaacgagcaatttcccggaagctagagagagagaaatgaagcagaaagaataaaaacacaatcccctgattagaagtcacttcattaggccatgggcgtttctaggccttcaaatatatcagcgccatctcgtttcacttacgtttttttttaaaattacgcagtacaacgcagtcactcacaacacgcaaaccctacccctatgagcatcttcgaagactgggccggcaagtcaccacaggcacctcgctgtcgacgggtacgtcgcctaccactgaaagcataacgcgcaaaccctacccctatgagcatcttcgaagactgggccggcaagtcaccacaggcacctcgctgtcgacgggtacgtcgcctaccactgaaagcataacgccgttaaatcctggaaaattcgctcctatggggagtcgaacccaggacctcaggtgctactgaggctcttgtaaccactaggttacaggcactttccctcgtttcacttacgtttatatatacatgcatcaaattttgtattttaaaacttaagatttaagttgatttttttcttttttccatcgtagattttttttatagtatctgcttttacatcatatgcctatataaaatttctgaaatcttggaccaaattaatcacatagtccttgccaagaaagagtgcatgtcgtttgctgcttgaactgttcatctgttacttaacatgttatatgtccgcaagctggtgttaaagtgcctatatttgtggctctttgcatgtgcctatgtcctagtaatatggttgctaaaactaatgagaatatttctttttatgataaaagagttagttacatctatccattgttttgggaccacaactagagaggttttcatgcttttcaaaattattcgtaaacgaataattggttcatattcgatctatgtgtgcgtccatatgttacaaattaagcgatttttcttttcaatatggcttgacaggatttgattttttttttcttttcaatatgcaatgtgtcaatttttacgtggaaacaccggttcttttaggtaggaggttttttcttaactaagacatgtggcttttttacatgagagaaatacagtggttgagaaagaactggaatgaaggggttctatttttttttattagtagagaactctgagatacacaaccggatactagtattcatattcatgttcgcatatctgaaaaacgaaaacgtgaaccatttcaattctcactgccatgtttggctcgaatctctcgacttgatctgcacgttcatgctcattcaggatgcaggaggaggaagcaaagcatcctgtgcaacacggcaacgccggatccgtgcaaaaccaaacaaaaagcatccatccatccatccatccatggcagatttggcaggcctgcacagagcagagcagtaaaaaagaaaggagagtgcagtcaaaagctctcctctcctttcctgaacgggaaggcacagaaggcgtaggacagtcggaaggccaccacatctgcatgccattctcgtcattctcattctccctccaccgtggggcccacccatcacccctaacctaaccgccgtcgattcagggaggtggacggccaggatggaggcggcgcctcccacgacgcgcgtggtgcaggttcagagcagcagcagcagcaggtgtggcctccacattattaattcctcctctcctctcctctccttcctataagagagaggaggtggaagaaagcaaagcttagagagggagagagagacgacgtgctcatcgatctggttttggttggaaggaggcgcttcaggtcgttgctctccatctctctctgtgtgtgtatcctcttgttgttgttgttgttggtttcttggatcttgcaggagaatcttgcttcgtttttgctttcgcgcggatggtggtggataatctcctccctcgtcgtcgtcgtttttttctttctgggtgaatttgtttctgcgttgcacgcgtatgatatagctatagggtgggttttgatcgatcgatctctacgtgcgtactccatagtagatggaaacacacatccaagtactaggaggatatgggtttctagttgctttatatataccatgtgttcctctgctcgcttccttgctttttctccattttgcttcgattgattgaatgatttccacttggtttggttggtcgatctccatggaatctctcacccatccatacggaaatgccaagtctgcgtacgtctgcgtgctccttttcttgttgttgttgtaggttcatctcgcttctttgcctgctcataacacatttctgcacctgcatccaagccaagcagaagcagagctctcggcatggcggcgccggcggtcttcaccatctccggccgccgtcgcccgctctgccgacgagagagagatgctgccttgatgctttgatgcttgctgggctgtgtagtcactcactagtcaggcccatggcccgttaggagcctttcactggcccacgagagagagagagagagagaggggagaggggagagcaaccgcttgagcaacggagggaggcggcgccggatttttggtcgatttgagaattgagattgagaagatggattaaaaaggaaaaaagaagggggaagggaaaggcataaacatctcagttgcttgagagcactggttgtccatgggagagggacatttaattatttgcaacttttaagatgtgtcaattaagaatttatcactcgctgtatttgacatgtgggtccttatgtgtctatgacatgtgagtttaatggcaaatcctttagaactactcggaagagtggcaaatagttattattcccatgggggaagttatcatgggctgcggtgcgactaagtccgactgaactgatctttgatagttagtgagggtgcctaaaaggtttcttgattatacatttatacttggactgtgtagatatttcgagtttcgcttctatagggctgtttctgatgcaattgcaatagattgcatcacctctgttcattggcagtagttttgtttgctggaactttactggattgttgcttaggctagttcaggggtgcaaatggggatggcattgcctatcaggtcttctcaggttatatacttttcctgtacttgttctgagtgtagtggttcctgaaatgttctgtgctggtttctttaatggaaatgggaggggatctgcccttcttgctaaaaaaaagaagtagattgcaaaatgaacacacatcagtgagttatttcaaaactgtaggattttgtgttgcttgtttcataattattttgctgctgacttatttcaattcttctactgaagcacatttagtgttagagaatctgtaacactgtctaatgttgtgtcatgcaaatgcaaattgaaatgcaatcgtaattcctattctaatcatgaatgaccattgccctgttgttctgtgtggtcctctgatgttctgaacaatgccatatgcacacttactacatccttgcttgatttttttttaactgtggttgtaacaaaggtgcatccagtgctgttttcgagctcaatgcaatgttctcacctgaatatttccgtgtcactcaggtctgccatggatttcacctccgacgagtcagagctaagtgatgcagatattgatgactatgctgacaagtgctacatggacctcaagtctgggaagccggtggtgagtctaggcaatgaaaagttcagatgcccattctgtctggggaagaagaagcaggactaccgttacaacgagctacttcagcatgccattggggttggcgcatccaatcgcgctccaaaggtgaaggcaaaccacatggccttggccaatcttctcaagaacgactatgctgatgcagcaggctcattgccatcacgacaggccattggaccaagtaatcctccaaggccattgcaagatcaggaagcgtatgtttggccatggatgggcatccttgcaaatgttccagctgagaaaacaaaggaggatggagctagtctgatgcagcagctagctaatttcaatcccttgcagtttactgctgtgctctgctccgagggtaggtatactggttatgcagttgtcggtttcagcaaagattggattgggttcacgaacgccttggcattccacaactacttcaaatcacaacgtctgggtaaaaaggattgggcagcacttggacaagagaagtacatctgtggatggatggcaaaagaagaggactacaaatctagtgacccagttggtaggtttttgtcagcaaatggtgatctgaagaccgtgtctggtctggaaaatgacctgtctcgcaagactgagactctcatagctaacttgtcacaccagattacagctaagagcaagtatttggtggaactggaatgcagatgcaatcaaatgaatctctctgttaaaagggcaatggaagaaactgacttgctgcacaaaagttacaatgaaggtacatactacaaactgttcatatgaataattctcatgccatgggcatatgattgctatgttgttgtctacttttattgccaatttgccagaataataatatctattgtgttgtttcattttattgctgttacagaaatgcgaaatatgcaatctgctgctcgtgaacattcacagaaaatatttgaagagactgatcagctgaggaaacagttggatgataaagagaatgccatcgagaggagatccaagcaactaagcaagtttgttgctcaaactgacatagaaagaagaaaattggagagtgagatgaaaaaggtatgaatgtaaccacagctttgctctctttgctttatgttactgtttagcatttgcatttcctcttcagagttctatcttcaggaacagctatgacaatctttctaggggtgacaggatttctgtatacttgtcatgtatctatattacacttcctgttagctccgcatttacagtctggttacgatgatctttgttagaatatcttatctgactgtttgtcttactgatttcccctacagaactctgagcaaaacgactccatccacatggctagaatcgagcaacagaagtctgataaaaatgtgctaaagcttgttgagaaacacaaggtctgcactcttgtttccaattattaatcttatgcaagattcttttaatttctcatgctctggaatttactctggcttgtaaaaatctcacagaaagagaaggagattgctctgaacaaaatcctgcagttagaaaagcaattggatgaaaagcaaaagctggaactggaaatacaacaacttagaggaagactgctggtggtccaacacatggagggagagggtgttgatgtgaagaaacgtactgacgagctgactgaggaactaaatgagaagattgaggagatatattataggtttgaatcaaatcaaactctcattatcaaagaaaggaagacaaatgatgaactgcaagatgccaagaaagcgctgatttctgtaatgtgatgatatgctgatctttcctttctactgcttgacagagtctgaagatattttcatttgtgtttatttggactcatttcagattcaatcttattatactatgattgtggctgagacctgagtttgtgcgtatgttttgtagggcttatcagaattgttaggccctcgtagcaccatcggactcaagagaatgggcgagctggatgagaaacccttccttgcagcttgcaagaaaaggtatggtactgctgacggtgaagctgaaataaaagctgctgaattttgctccgagtggcaagaaaatctgaaggatgccaattggcatccgttcaagattgttaccagaggaggaaagactgaggtatgctcaacagaatgaaatcttctggcacagtttttcgcattcgatctcccgacaaatatatgatctacacttccatcactgacatgacaacgatatccgttttcttttctgtagcaaatcatcaatgaagatgatgagaagctagtgggcttgaaggagcagctcggtgacgaggtctacaaggccgtgaccacggcgctgctggagatcaacgagtacaatgccagcggcagctacgtggtgtcagagctgtggaacaacaaggaggacaggaaggccagcatgcaggaggccttgcagcacgtcctggagcagtggaagcttcggaggcgaaggagatgaagcacgcctttcactcacactggattgaactaaggctttttgttcatgcttcgtagtgctcagttattttttggatgggattatcttggcttagctgaaactggaagattatgcattgtgtgatcctggtttctcgctctgattgaaatcgctgggataaacacattaaggtcatgaactacattctgatagaattaactttctgatattcactacattctgatagaattgtgctgtcagagcataaatctttttgggacagtattataagaatctgtttactatttctgagacaattcctttccccgaactgtttgagttgttgttgatgatgatgatgatgatttcttttcgtacccttgaaaaaatacagttagaaagagttgcatatttggaagcaacgcagcacaatggtagcttcataggcctagatgtgatgtacattatgcaatgctggacgcctggaacttttgaattcagtaacagcagttgatgagattactctagctgtaaattaaatttctgaagacttcagattagtgaaggctaacattcagcatcatcgcagagtacacaagggtatcaacatcatacaagatccaggagggtgcagaataccgtaattaaatgttaaatgttatctcttttaattgttcaagagtaacatatatttgctgcatggtaattaggtgtatttagtcactttctcgtctcactaagagtatatatctagagctttctgaacatgatgggtttgcaattccctttcatttttttttctgagaaaggaacatgtgcatattatcttataaacgacattaagtaattgaatttttaacattttacagtttcaccatttcgtcatggatggatacttaacacccgaatacccaatcaagcatagatgaaaacatacaaacccagaaaatgctctgatcaatggttgcaaattacaagcaagaaagagcataatggcctcccatctcaaaatggggcacaagggcaaaagaaacaaatcgagaaatttcttatcatgtgatcaatcagaacccacaaagctcaagccgtatttttttttcatggtcctcacacgtcagccctaactaatttagggcaggccacaacggctacgtggaagaaaagtggaagcaacacaaacaaattacagaagcgggcacaggtgcaccacacgcatcacccaatatacacctaaaccgaatccgaatccgaatccttctctcttgttatttcagttcagctgaataggtttggaatgcaggctcccgagtcaggattctgctgttccttccagattcggccggtgacccgcaatttcaactctttcctctctccgcctgagaagaacagagccatgttccgctgaattatgaggccgtcatggctgtccctaaccttccggtggctgtcccttatgctgcggggagtgccctcccatatcatcttccggccattcgcgccaacctcaaggctataactatagttcctggcatcattttcgtcgcccataaaacggaggaaggccatgtaaaccggagccactccaagttggaaggcctcgaaatgcaagcagaagtactgcccaaagcagtgaaagacctaaaaggataataaataagtatcaaatatcaccttaaacatggataaaaaaaactcttgcagttaaattgtaccacccacaccaatatatatgttaatgagactgcaagtgatagaaggcaataaaggtaaacacttacagtcaacatccaagtagcattttcgacctctctggggtttgacttaacatagcgatggttgaatgtgcaccctgagtgcatgtcaactttatggtcatccctcagatgagcaactaggaaaggaatatccccgacaactgagcattcagagccagcataagggcagttgtatggcctgaaattgcactgtgattcatgcttgagtttgctgtagtacggaaagatttctggacaacctagtgagtaatatttgcagggtagctcaagcgattcagccactttctccaatgctagacatctaatatcaccaagctcctgtcgacaggttgggcagcggttgtgcacacgggttttgcaggttgaacacagagtatgaccattttggcactgtaatatggcaaaaaatattagtcaattattaattacttatattgaattctgacttgtaaatgctgaacctagaaagattcaagcttcatgctagcaatagctagatagtacatattttcactcagacaaatttctaccaggagtattactatgagcaagggccactgagcaatagttaatgtctacaaacaagaatgtactgcatcaacacaagatgaaagatacagtgaaaataccacaaaaaaagagagggagagggagaaaacatgtactatgtccatgtatttgtgatggaataccacagacgcaaaactcacatacaaatggtacaacatggacttttgtttaaaagcttcctgattcatgagatattatgaaatcctaacaagaaggattaaaatatggtttttattgtggtttgtaactgcttttggaaaagttcagctctttctggcataataacatcattgtccgcattaattgcctgcttagtagctaatcagaaatattttacagcctgggcaagcttcactatagctaatatttactaccgaaattctatctcaaattttctaattacatggaattttaatggattatccatcgacgagcccagatggatgtctggggtcaccgggcggtagatccgcccctgcctgctctatatgttgtgacgactcattgagatcattcatcaaacacagtttcctcacttgaatctgatcgctgtgccaaatgttgcgataaaactacatgtccgtgcacaggttattaataatggtacgtctttatgtttgatgttaggaaagacttctatagtagaaagatacttaacctacacctctaacaggatcacagaaagcatgcttggtaattcttcaggctcccagtgacctaactagcaacacaaattcacaatagacaaaaaaataataatctccaagccactccagatatgaaattttggtattataataatctccaagccactccagatatgaaattttggtattataacaaactataatgtgacaacatatccctgatataaaaaagtgtaacctttaggtcagttaacaggtcatcacttcgttttaaaaatgtgacacatcatacgacaccatatgaccataatagtccatcaagcagtaatacagtccaaagtgcatgcaggaaaagattttgatacattgggcaatacttcttaacaaacagttaatacagctgcttccaagtaaattttaataaaaaggtaataagttgcaacagaacgataaagaaaacgaaataacaggtaacaaaaagaataaccgatcatcttaaactacatgacatcttccatgtcccaacttaagccttaccttccacttgtgtaagggcatacaagcatgcatacaacacatcccctagactacaaaaagaaatgcactaaaaaaggctagaaatgaactgttctatacaacccaacacttcactagcatttgttgtagtgatcatccttgcatcccagtgatattttccactaccaagcatctaataccatgaaagagggcgtcaaagtaaagactcatgggattcgcgaagtgacgtaacaaggcaaagataggccgatcctcatctccaaatgttctgccgcacatgctgctgattccagacataagaatatattcacaacaggagatactcgattcctctcccaaaaagaaaaaagaaagacgaaagaagagatactagctaggtgttgatatttggtttcaatttgccgtaaacctgtaacctaaatggggtcaattataccgattgcattaactaaacgtgaagagcagtggtgtcactagacaataatcagaacaataattttatctcctgaaatgagaaattgctggatcctctcagtccgtaattgattatcgttgtttaaacagcattgcaagttgaaatcaacacgccgcggcaaccatcctatcccctgaaatgcagcaagcacgccatgttttcccgtggcagggaaaggcagtatccaagaagccccaggatcaagaacccccaaacagacacgcaacgaagatccagccctctcacagcaccggatcacgcgattccaccccaccgacgacgactcccttgcggtgagaggagatcctagtagtagaaagaaaccgcaagaaccccaagaatggcggacctggtggatgggcgggtacatggagttggtgcagacggggcactcgagcagctcgtggacgctcgtcgccggggggacggcgggggccccggccacgaccccgacccctcctcctcctccccccgcgccccctccgctgcccgcggagacgacgaccacgttgacggcggcggcggcggaggagggcttgacgaggatggggcgtggcaggtgggagacgccgccgacgccgacgccatcgtcgtcgtcgtcatccatgctgtcggagtaggagacgcactcgatgctcgccatgtccatggccacagatcgaacccgaattcagctctcagctcagccccccgcccgccgcccgcgagcccgccggggcagggggagtcgatcgggtcgaaccctcgtcggaggcggagggtgatccgccgcgattccgattagcggcggcggatggggatttggaattggatttggagaggaggggattgttgcgttagcgtttgggttgcggggtggtgtggtttggtggtgggggcggtcgattgacgggtgtaatggtggtgtggtggtgcgggaggattgggtgggggtggcttgtaattacgtttttcttttgcttgtgcgcttttttagcgacgaggggaggggattcgattttatataaccaaccaaacaccaaaaaagcgtggtgatgatgcggggggagtgcggataaggtgggggtgcggcgaatgttcaaattttaaactgacgagggaggggagcggtggcgttggcgtggtggcaaggctggccggctccgtatgctgctttgctgctggctgcaaatgcgatgctactacttctggtacatgtggcattcattcaaagcctgcagcagcattcgattctcgtgctactttgacagtctctgagtactagtacggcactactagtaaaaaagaaggaaatatatactgtcacggtccttcaacaatcgaactattcgtcctaaaagggatcaatttgtactaggaccggccttcttcaacccattttacgtttgaccactcgtcttatttaaatttttttttacaaatataaaaaacgaaaagttacgcttaaagtactgtagataataaagtaagttacaaataaaataaataataattttaaaaaaaattgaataagacgagtggtcaaatgttacaagtaaaaactcaaaatccattatattatgggacagagggagtagcaatcaaacattcaaacctcttctctgctctttgcactgaggtaagcattcaaatttttgtttagttccaaaataattcttcaaccttcctaactttttcagcacaatttttttacacacacaaactttcaactttttgtcgtatcattccaatttcaaccaaacttttaaaattttgatgtgaactaaacacagcctaggaatgaaaagggatcaatttgtattaggaataaatatgaatgaaggagtacgtgccgagagatggagtgcagatgataccaggattctacgagtatatgcggagaacatgaacaagcgaaggtctctcttctcttcttttctggtctgtcaccggcacattgctcacccacgagagccgtggtcgggtgagcgtgcctacacgtttaccagaataacaggcgggcgtggaccaaccatactgtacaagagattacccctagaaaaaaaaatatggttattatcaactttacaaagagaccaagaaaccggtaccgtcgtcattaccagaccaggtatggcggccagtttctttcaatgattttcctttttccaaatgatcaggactttttcgacataaaatgatgagaactttgaacacatgcttgctgcttaacctcccctgccaaagatgcaataacactagtaactgcacctgatcagtgtcccgacaatatattgccagtaatcataatgcatcgctcgacaggttccttccaggaaatgaacaggaggcttggaacttcatcatggccatgagaatctattcccctttaccttttctttttaaaaaaatgtcacagaaagggaaggttttgatcgccaagagaaattgcacccccgacatggaccttatacatgaatgtatgaggaggatgactttacatttgaattggctacagttacatggccgataacaagttatatacataattactgttgtcaggaatccctacatgctggccactctagaaggggcttctgtatcaatgtcaggttctccatccaccttctccgaccgtcgtagctgaaacgtaaatcttttaggagcgtacaaataagtgaagatggagaccaaccagaaatacaaaggctggtcttactaattaaacaatacgacactaccatgataagtgatgcaactgtttgcttgttctcccaaaaaatatactatatacatatcaatcgttgtctctactgaaaaatcaggagtgatgaagaaaactgataaacatgatgtattaaatattacttgaataagttcatcaccactagcatgtaaggctcaaggggaatgtaacgactgattggttctttaacattttcaacgtatatttctaccagtaactagaagtcatctttaggtattctgaggtgaacaggccagcaggggaattcacaaaataaactagccaataaaaactgctgaattagcatgcctctaatgtctgcaaccccatgtctagccactgaaatataacaggagcaacattaaatgctgcatcccatatctaaataatagtgctaaacggtcaagtgcacataagaaagacttttgaggtaacatcgtgtatggaaaaatgatgatgatgctcaccgttgattctttattatgttcatccaagtaaaggtccaatgctccttctccacaaagaatcttggctccagaaccatgctgatttgtagatccaacagagtcttcgtcaacaacaaccgcgtctattttgtcttttccagttcgtatttctggaatctgtaaaaaaaataatgttcattacaatggtttaagtaacaacaggacttttgacatagtaaaactgaaaaaaaaaacctactcaaacaatgtaatggaaccaacggacaaccaaaagtgtaaggccccgtttggtagggctccaactcccaactctcaactctaaactccaactctagtgagagctggctcctataggagttaaagtggatatgaaaagtgtttggctatattggctagctccactcgaccacgcccttgttggaatttcgtcgaacaccttggtggcgtcgctggcg

SEQ ID NO: 64248 - DNA, 28133 bp, Oryza sativa
  unsure (1)..(28133): unsure at all n locations
gggaagagaagccgggggtgcgtaggaaatatctgtggatttttgggggaggtcgccgtccgccctggagagtagcggagtgtttcttgcttgtgggggcgggttggtacggtacctatccttttccgcggctgcttcggcgaacgccaacgagatgcctagagagagaagaaggaaaacgtattgtagctttgctatgtgatgatcatactcctcgctccttatcatcaccattgaccaaatcacaaaatgatactccctccgtcccataatataagagattttgagtttttgtttatagtgtttgaccacttatcttattaaaaaaaaattgaaattattatttacttttttgtgacttactttattatccaaagtactttacacacaatttttcattttttatatttatataaattttttgaataagacgattggtcaaacactgcaagcacaaattcaaaatctcttatactgtgggacggagggagtaactattagtttgaactagctcagtgtaaagattaagtgatggatacgtaaaatgaaaaagtcactggtgtatagatatttgagttttagttattttaatcttagaaaataaatgtatttgatattttacggcaactactatatagaaagtttttatgcgaaacacaccgtttatcggtttgaaaacatgctaacagaaattgaggtaaaattgtattttaattagaaaagaaaagggcagtgcgctaatggtagtactagattattattatttttttacggggagtagtactagattattgattaggagggaatcgaagtaccctacaacccgccgttcttttcaatctactccttgcaatttaatttgctgcaaaagactagtcacaagtttatttcatcttttaattatccacctctatctatttttagccatttctcatatcccatgagcctccatagtagtgaacgatgttgctagttgccaccaaaggtgtgtaactcaacctccttgcatactttaattctaccaacgttgtagcagtaaacacacgacaattatcacatactatgaaaaaaggtgcatcaaatctcatgctcaatagaagacataaggagtaacgtcactcaccatactgggatctatatgatgcgagaaatcactgagtgtgatgaaaaaaattagcgaaaactgagttagaagaaaaaaatagacatgtaaagagtgtttatgaaattaagttgcaggggaagattaaaaagaccagtaggcagttatttggatttcccttattgattattagtagggtgtactccccccgtcccattttaagtgtagtcatggttttccgcgtccaactttgatcgttcgtcttatttaaaaaaaataattaaaagcataagtcacgagtaaagtactattcatgttttattatctcataacaacaaatactaattataaaaaaaatttaaataagacggacgatcaaagtttaacgtgaaaactcatggttgcacttaaaatgggacggatggagtatataatagtgggttacgatgaaacttggtgtattaaaaatgaatcacacccgtcttgcctttgaacttggtaggagtattgccctgataatttatagaatgattagatttatgactcattttgaaatgaaggattgaaaaaaatagaggaatggaaaaaaaatacaagatttgatagaaatgtatgagtgcaaaacaaagcagcgcaaaacataaggaaatatacatgaattgtcgtttgaatagacagtaagaaaaacacataaattcgattagagatatagcctcaaatgaaatatttttaaggggttaaaactctcgctaacttttctctaaaatatttataggattatctatttcatagaaatttcaaaagaagggataagatcctatgtttcaaaggcatttctagatttgtttcttataatattaaagtcatccaagtttcctatattttttctacaaattaaacggggctttagaggagaaaagaagagtttgtatggggtcttatccttagctccaaaatagtcagtatattgtttgtaagcacacgattaaaaaggaccaacgctaagttcgaattcttgatcttattaaattaatcaaaagttatcagttagatctttacctgcaaactaaatttgagtataactctaaataaccacggataaatctaactacagttttctttcataaagcaacgacatgtgtgattgtgttgaaagtttctttatctgaaaatagtgaaagcttccatttctacatcatagatggcccacatgaattcttctagactttaatctgtttgttataggactacacctttgaggcacacatcaaatgaaatcatccgtggcagagaagtccactccatttttttctcattcgctcgaaactacttcctccctccttaaaaaaaataaaaaaaaagacaaaccctgatttccgtgttcaacgtttgaccgtccgtcttatttgaaaaaattatgaaaaaaattaaaaagataagtcacgcataaagtattaatcatgttttatcatctaacaacaatgaaaatactaattataaaaaaaattcatataagacggacagtcaaacgttgatacgagacccacaatttgtctttttagagggagggagtattttagccagtagcatcacatcgtaacccggctttcctctttactggcttgtcacattctctagcttttgccaagttgagaatccttgtatgtaccgtacatagaaggatattagccatccgttttgaggaggtaagcaattggtgggatagagtatttaatttgcctgtgtccatggtactacatggcactatctatgacgtggtaatctctttttctaaagtagagttaggtaagtttgcaatggtaaaatattgttaaatttgttacctaactaaatttgcaattactaaatttcgataagatctaatttagcaataaagtgaacgccccaaatattactttctattacctagaacacaccaacagatacactcgcacgtataaaaatgtgtccctgattttgtggttgttgcactaggctacggtgtgtttgagagaagagaagaaagcagaaaaatgagaagataccactaacatatgattaattaagtattaattattttaaacttaaaaaatatatctatatgatttttaaaacattttctatggaaatattttggaaaaaaacacatacttttgtgtttttcctgccgaatgcaggctacacctagcataagtcgatgtactgttcctatattttattctttaaaataaccaacatcgatcacttcatcacgagataaaaggttaaagagcagggcttacgtatacttagaaaaattattacaaaacagttgctaataaagttgatctcaaacctttaattaattagttaatacttccgttctcatatttaactttgatcattcgtcttctttcaaataaaattggaatacttaaatagatatcatagtatcaaaaagtattacatactaataaacattaagaattaaaccacttattgtaatcaaattatttttaagagttataagtggtcaaagttgaaacaatatcgatcaataaacatatgatagaacttataaaaatcatattcatccacatcaatatttatgaaaagtttgtagctattttactttacatgtaagagtattagctttttctgacggtgagaaattggcttgtgggaatctgccaacttctgagttctaattaattttctatatttttctcagaatttaactgataatttaaactatgtagggaaacttgagattttaggagaacctccagtgtatggttaaaatcaaaccgtgcataaaaaaaatcgaacagaccatgctgtgaaagtcggctggtaagtgtccggaggaaaacatgttctttaaagagaagccgaacacaaccagttaaaaaaatatttgttgcgcacggctatcagactgtgattcttttttcgcatgggtcccacaatcgatttttacactgtgatggttaaagagaacttttgttcggctttcatggaagtgctagtcgaactaaacactataggtgccctaacagaaggtgaagctgttagagccgatataataggatgttttagcggcgatactgtatgtatcctaccaaatatgctgagttggctgagaattagcagagagagaaagagagtgtgtgtgagccggcgactaatttgtcgctgactacacacacgctccaagacaatggatgcagcaccatgactgcttctactggaacacgcaagcaagcacatgggcgatttcgatgttcgacggcaaaaggggcggagcgacgggcgaaatgatgcagcgggaggaaagctcgatggcgacgcgattgagagctaacagagaagtgagttcgttggcggcaatgccgacggaagccgggaggtcgaggatagggacagctttgttggcgatgacgccgacgaaagccgcgagcccgagtacggcaacaacgttggtgacgcgagtggcgacgggagctatgagcttgagggcgatgaccagagggacgatagttctacgttctccatgctccatggagcaagcggctcaatgcagctgcctgttgtcccaccccgcccgcactccacgcttttgctacgattcgctcgctggcagtcatctagccatggcaccagctctatgtccatccatctttgctagctgcttgcaacctgcatatctccataacaatagatagatcaaataagaggtggaaactagaaagggagttgtagcaagctagaagatggattggacatgaagatcgatgggaactgtgtacggttagggcagtagcagtgcgtcccacaaaagtgaggagcccatatgtccacataggagaaaaccccggaaaaaggagtcgaagcacctctcttcacagtgcgggcacgcgtagtgtagctttaggtggaccccatcaatttattttcctgaggccgaccccaccacgacgtttctcttcatcttcccggatcaatctctcctgcaccaaaccaacctccgctccttcccctctctctcttcctctccctccctgaactggcacatgacatcaactcccctccccctactctcctcgtcagggtggaatttgtggacgtgggtgcctccctccccctaccgtgacggacacttggcgacgacgaacttggcgctccgggtggctcaaatcgagagccggcgtgggcggcgaggtccgggtggctcggatcaaggggcggcgcggccaacgagctccaggcggctcagatcaagaggcgcggccaacgagctctccggccccacgccgcttttcctccgccgcaccatttctccctcctccccatccgacggcgcatcgatgcagacagagctggacgggagcaatgattctagcgcgggaacaaagatgcagagcgagggagcagaggattgaagctacgacctccacagcgcagacgcgaggtgattccctgtgtcacgcgtcctcctttcgacgagaaaactcattgcccagatagggggtgggcgactaaacagagtaccatgcttcgtcaccacatatgcgcgggtccgacgtggtgtgcgagataacgctccagctcaccacactgtaaaaggccttagaagaatactccatccgtttcagattataagacattttgactttgttcaaagttaaactattttaagtttgacgaagtttatagacaaatacagtaatatttaaaataccaaattagtttcattaaatcaataattgaatatgttttcataataatttgtcttaggttgaaaatgttatttttttctacaaatttaatttaatttaaagcaatttgactttagttaaagtcaaaatgtcttataaatgtaacagagggagtatatgcttactatatgaactagcaaaatgtccgtgcttcgctacggtattaaccaaagttattttcacactgttttggtactttttcttgctagaaaaagtctcaaatgatatagagaaatatagtagctcataataaattattgaatgtttgcttgctataaaaaatctcaaatgatacatagaaatatagtagctcataataaattattattcaatagtgcgttgcaacgggaaaaaactaatgttattaagttagtaaatttatagaaaaaagagcatccacgttagctcttatggtctagaaattctcatattaattggagtaaaatataaaaaataaggagaacttattgtagacaaggactctttcattttttttaaaaaaaatcgcgttgtccaatcataaataatattggatgaggagtctagaatattctccaaaagcgcctagagtgcatataggaatacaatttagaaaaaaaaaattaaaattcaaaataaaaaatattgaaagaagagtttaaagtccatatagaaaactaattagaacaataaaaaataggaatattggaagaagaatagagttcatatagaattaaaaataattgaaattatttaattttagtctaaatttaaattctatatcatgagaaataaataattgcatttttagttgaaaaataaatagaaaaatctagccaaatttttagtttattgaatttagttggaattaaattaataagcagtcataaacaattaaaatggtattaatgctatttcttaaaatagaaagatgcttaaaattactgagagagaaaacattgattttaattgtgggctatttggaggcccaataatgcggaggcccaatagtccggtggtccgatgcgggagaagccggagtcgttctatcgaatggactgtccagattgaaccaatataaatatatgcagcaaaaccctaaccctaaaattcttcccccctccccacttccaatctcctttctctctctctatctctctctctctcttgatcgaaaacttacggcaacagcggtgacctccgccaccgaacagcgacggcggcgccctcctcccccccacccacgagcggctgcggtgcgctcttccctccttcccacgagcggcggaggcggcggctccctctgtcccgtctcgcctccctcgccggcagccgctccctccgccctgtctcgcctccctcgcccctcctcctctccatctcgcctccctcctgtggtggatacggcggtgatggcggcgggttggcagtggccgcgagcggattcgagggtggtggcggcggatccctccaccccctctagcctccctcccgtggcatatccgccggcgatggccgcgggcggatccagcggtggcggctccctccccctacccgccttcctcctgcggcagatccggtgtcggtggcgtccgtggtcggataaggagcggcggctccctccgccgcaactcttctccctccggcgacggtagcggggttggcggcggccgaagatggatccggcggcggtggcaacggccgagggcggatccggcggcaggcgagtgaagttttgtgatgtatattgttgttcttctttttgatgtatatttttgtgaagttttgtgatgtattttgtgatgagtgtggttgattttttttttgcaaagagtggttgagttttggttgtgccgattttgggaagtgtttccatgtttctgattctaagagcgattgggattcgggggctacgaaggcgcaccgccgacggacgaagacaccttcgtccgtcttgtgatgaacggaaaattacgaatattttaattagttaagatatactccctccgtttctaaatatttaacaccgttgactttttagcacatatttgaccgttcgtcttattaaaaacttttgtaaaatatgtaaaactataagtatacatataaatatatttaaaaatgaatcaaatgatagaaaaaaatgcgtcagatatttagaaatggagggactatatacacagcaagcagactgcagaagcagaggagacgtgtgtagatccctctccctgatggcttcatcaaagtccgtgtgtaggccgccctggacaaaacggagtccgcgacgtgcgtggcccacgcgacgttccacctgggcctcgatctgtatgtgtgggccttcatatgttgagcccattaatttgtttttgcttgggctcagttgcctgaagaacactcggatgaatcggagagcgcacgaggaaaaattagcgcgattaatgacggacgaaagcacgcaatcacagatgtgacgaaaggaattatatgaatcatttaatttaattagttaaaattggtagtttttaacgctacctataataagctgatgtgccaatcttggagccagttgcactatctcgctcttaaaaccgagcggccgagcgtaaactagcctcaaacaaaccgacctggacacgtcgacacgatcacatggtccatcatcctgggcccacaagtcatagagccaacgaacttcaattcagccatccccaacaaatcgcatcgttactcctcttcctctgcctgccgcccccaatcgccggcgatgccgcgccccgccgcctcctcctccagccgccctccgccggaaggcgagccggcctcgagccgcgcgacctcctctgcggagtcctccatcgcgtccctcatagaccgcgccacctccaccacctccccctccgtcgacccggccctcctccgcgccatcaagtccgccgcccgcgcctccgacggcgccatccgcgacgccttccggatcctcctctccctcatgtccaagccccacgcccacgtgagtaagctcctccctgctggtttgattcccttgccgaattcgcccaaaccctaactcgcccaatcttcaggtgcggctgctcgcgttcatcatcgccgacgagctcttcatgcgctcgaagctcttccgctccctgctgaccgacgtgctggacggcttcctcccgctcgccgtcggcttccgccgcgcccacccgctcccgccgcccgctgcctccgcgaccctgctccgcaaggccgccgtccaggcgctcgagcgctggcaccacctgttcggcgcgcactaccgccagctccgcctcgccgtcgagtacctcaaggagtccgcccgggtccagttccccggcctccgtgccgccgtcgaggctcgtgccgcgcgggaggctcgcacgcaggagatcttaactgcaaaggtcgagcagttgcgccgaaacctggcagcgattaaggctgaaatccgctccgcgattgatgagatccgcaatgggttggatatcattcgcatcgagagtgaaaaatttaacaattatgcaaatgatgaggatgaggagcaggagattgcctctttggcgatgcggagtattaggatggcttctttgatggctggggagtgggttcctgagactcaggagaatgaagcagttttcgacgcgttgagggagtcatatcggctccttgtgtcaaagcatttggtcacagttcaggaatggatatctgtgctggttagggtcaatctcgcagataatcgtttcagagattctgctttgaaggaattcattgatgttaagaatgaaatacgagcggtgagaaatcggtgtagtgagcttggtcttaatcttgacaatgtccataggcggaagggtgttcaggaggaagaggatgatgacttttgggttgaggggaatattgaggttcctagccctggtagagtaggtaccagtgcagatgttgcaagtagcagcaaggacactagaaagggaaagaagccagtaggtggcacggatactgatgatggcaaggcacctaatgctggcaatagtcctcaagagctggatccagagagggcaaagctgcatgcagaagcccctgtgctgccatggagctctgttttggatcgttggggttctaacagggatgcacttgtaaaccaaaggggacttgagctcgagagccattggggaagggtggataatgatgctgttatacctgctgcaaagattgcagaattaaatgttcatagttcaatatatagagaagatccagttgagattctaccatgccttgcacctctgaagaaaggaggcctttgccagagaagagatctcaagatatgcccgtttcatgggcctattgttccacgagatgccgaaggaaatccaattcatcagagtgatggccattgtgatgcagaaggaaatccagttgggcagactgatggccattatgatgcagcagtaagtcctattgatccgaatgaagacagttctgatgtaagagaaaatatgattatgccagatggaagcagtgatggtgaatgtatttatgagtcctctccttcaagaacggcaaacataaataatgacattagcgacagcgatgtaggtcatgacctcggtaaaattacagtggagcagttggcgagacaggcagtgcagaatgtccggaaaagagacagggatgacaaaaaagctctggaaaaagcccaacgagcgagaattcgtcagcataatcaagatgttttgcgggaagcggctcttgcttcaacctcgcgctcagcggcagactatgacctcccttcgccagcagtgtctcgacggggacgccgaggtaagacaaagggaccaacactggcatcgatgctgaagaagaaagttacttccaaagatagaattgcagagaggcttctgaatgctcgagctagggatgcgacaataagagaagtttcacatactgaagatatgagctacagagaagcattcccaaatcaatggtagtataagaagcctaatttttgctgaataggttggtgaatcgtcatgataagagtgaatcaataattctttctgtgcgcagttttcagttaaccacatgtcttcttgagttgcccagatacaagtaaaattgtaggttttcattgtgaagtttagtttttgtacagtacagtagattgaataagtttcttttatttcttttgcatgttcattttccctttgtaaacatgtatatgtaccactccatacttgctggattaataactatatacgctgaggctgcagttcaaattgtgttattttatctgagtaatattgtggattaattaatattgcggttttatatggttcaagacttcaagttgctggtgcaactcgtgacctcaggttttacagaaaaaacaaggaacgaccgttgttgcataatagatgtaacatgttattttcacccatacatgttagcatatattcgctacttcctctcatagaaatacgatttgttgtactagattgtgttatattcttacttaaattgtttttttttttggacggaggaagaacagaaaaccgtttggaaagattagaaagcgctcttctgatcaatcagcacacctatctctaaaagcatacagagagtaattccactccacagtgcacttatgcctcgaatggaacagcgcaaagcaacgatgaacctctgcacatactcactccgcttcataatgtaaaactttctagcattgcccatgttcttatttgacacatatatataacatagttgctaacacattgcacaatgttattatttttcacacattactaacctaattagtacatagttatatacacattcacttacagaaatacacatatacacagttgctaagtacatcacatggttcagatcgataaacagaaattacctgtgttcagaacgattagaaacgctcttatctgaaccaggcacacgtaaccaaagctaagaacttgcagagatttccattccagagagccgcttatgcctcgaatggaatttaacaaacacaaatctagcaaaagcaatatacacctgcacatcatcatcacatacacaaattaacctaccaaactggacacacacacacacacacacacacacacacacacacacacacacacacacacacatatatatatatatatatatatatatatatatatatatatatatatatatatatatatatatatatctatctatgtaaccccagattcaaatccaacgtctcgttcgagccgccgtcttggaggttcttacgcgccaatggaggcggcaggttcaggttgaggtccagcgcggtggcggcggtcgccggcgccggcggaggtgatgccgacgtggtagtggtactactgctgccggcggtggagacggcgagcatcgatatcgcctgatcggcacaggaacgatccggccagtggcaccgcttgtggccgccgagcgcctggccggtggcgaacccgcggtggcagacggcgcacttgtggtcggcgcaggttgccggggaatgatgaggagcagcggcggcggcgggggcgagaaggcgcttcttgcccttgcccttgccggcgccggagcgggcggggtgagcgccggacagcatgaggaggctggcggcgacctcgcgctccctgagcgtgaactggctggcggcggtagacgacgccgcgcctgcgccgccaccgccagggggcgtgatcccgcgccagtggcgctcggggtggcagcgcatgtggccgaacagcgccttccacgagaggaactgcctgccgcactcggtgcacggcggcgcgtccccggtcggcgacgagcacttggcccgcgccaccatggcctgcagcgggcgagcggcggcgggcggcgcgagcgacagcgtgagcgtggtgtcgtcatggcgcggcggcggcggcatcggatcacacggcagcgcgggcggaggtgacggcggggcaggaggtgaaggcggcgagtgctgctgcgccatggtgggctgggagcgcgagaggagaggagaggaggtttgggtttgggagtggaagttttgaaggtggtggtgggaagggaggaacagtgcgtgtgctcgtggaggttaatgcgggcggggagagcgggaggaaggaaggagaaaccgctacttgccctcagcctctggcctctgctgctgtgtaactgtgttgtgactcacatgctcgtttagatcaggctgtgtttatttcacactaaaattggagtagaagtttggttgaaattggaacgatgtgatgaaaaagttagaagtttgtgtgtgtaggaaagttttgaagtgatgaaaaagttgaaagtttgaagaaaaattttgcaactaaacacggccttagtactccctccctttattcgttttgattttgattaaaatcaaattgctttaaatttaattaagtttgtattaaaaaaataaatgttttcatcccaaaatatatttaattactagaaaaaatacccgtgcgttgcaacgggtgaatgctattttagtcttattattgttatacggtttagctatgatgaaatttaatgtgggaatttgcttgtatattcttttttaagaaaatcatgagctacaattagaagtccgactttcatctcaagttttatgtaagtttttttaaaagaatatttccaaaagcaaatgaagttaaaatccaactcatacacgaatcttaaaccgtatgaaccgttggatctgcatttccaaaagcaaacgaacttaaaaaatcaactcaaatacggatgacataccaaaaagtaaaacctcttcaatttttataatagtagagatagctttaataaaacaaaaagtaaattgcatcgtcggtacacaaacttgtcaggtgggtgcaatctagtacacaaacttgtaaaattctcgtctttgtgcatgaacttgtctattgcgtgcggaggaaggcgaaaaagacactatatggataatcttattgatttagggcatatatttgagaaggttgctattagagatgtacctcttcaataaaaaaaatagaataggatatagtgatagcagaaaaagattaaaagacgagcaatgatataaatgttagaaatatatgaaattcatcatttccatgatgaaggatacaatatagaccaaatttataaatattgaatgtcttatgcatactcactacacgtatgcacgtcacatcctaatcaacgtcaacttcgtaaaattaacattgccaacatattttggtcctcattcgcacaaactagacaagtttatatactgaaacgagcattttacaagtttatgtactgaattgcacccaccaaaatagtttgtgtaccaccaatacaatttactcaaatttagatcaaaatcaaaacgactttgtaatccgaaacagatggttgtaatctgaaacggattgagtaatacctaatcagcctaaaaggctggggggccggcccttcagattcttctctcgtgatgggccgtagtaggcctgatgggacacatgcccaatcttttcggataggcccaatctgatttgtatctttttggttaatttttttcagtttatcacttgatgaattcataaatcagaaggttaaattggatccgtgaaaagaagaaaacaaaagtgaaagcgaatgtatttttgtagtcgaaaatcgtttctatatttgcatatcaaatttgggttgcgtgttcatggagggacaccggacacgcgatgaaatcatctgcgcatcctgtactttcaatttttcctgtgtcatccaataaaaaaaactaattcaaacaaggaaaaccaagtgttgaaacatggtaaatgatttaccgttggatcgaccgatcccgttctctcacttcaacagccatatatattatattaggcccatccacgaacaaatcgaaccgtcgaagtgactctgtagccccgtaactggaaatgaattcatattcagatttgctagtcctcacggccgcacgctctcgcatcctcgcgtttcatcctcctgtccgtgctgtggatggactcaatgtttttgttcattgtttctcggtaaaatttctgcaattttgtttgagaattcaaattttgtttgaaaattttcgtgatttcgctgacccccgaaatttttcccatttccgataggttgaaccattttgatcttcaagactccaactcgtactcggtttgtagcccatctccgactcggattacacgtaggcgcgcgcctatttatagctgctgccctgcccgtctccttactccattagcttgctagcgcgcggcacaagagcagtaagcgaggcgcgcatggcggcgcgcgccggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggcgctgaggtcgccgcgccgccgccgccgccgtgtacggcagcctcccgagatcgtctcggcggcgccggcggttgactgctggcatgagcccgatcagatcgaggaggaagaagaagatgacgatgatgcccgggaggagcgcagagcgaggataagggagagggcgctgctcctgaggcagcatgaggaggagcagcttcttcttcatcatcatcaccagcggcatcaggaggatgaggcggcgtctgagtccgacgagacggcggcggaatcggactcggacgacgagcagatggccgtcgtctacatggccgcgcccctgttcgtccccaagtcacagcgcgacaccatccggctcagggaggaagaacagcatcggcagcgccggcggcttgagctggagctggacaagaagaggctcgaggacaggaaggctcagacgaggcggatcctgctccaagagatcatcaaagaagagctcctcgccgccaccacagcttcggccgaagccgaagccgccatcgacggcgtggacaccgacgacgaggtggaccaagccgaggagcacgagtcgtggcggcgccgggaggcggcgagggtcaagaggagcagggaggagagcggcatcgacgagaacccggtcgctgatgatcgtcccaagaagatgacgatcaagaagcagatgaggttcatgcggaggtactaccacaagggttgcttcttccaagacgacgccgacggcgcggcgcagacggccgccggagcatgcgaaatctaccggcgagatttctccgggccgactgggttggacaagatggacgtgagcgtcttgcccaaggtgatgcaggttaagcactttgggcggcgtgggggaagaaagtggacgcatctagttaacgaggacaccacgtacaggaactatagctagcctagagtagactgattttaaggttccttagaagatgggtactccctccgtttcacatctattcattaacatcaatacgaaagtgggaaatgttaaaataacttacattgtgaaacggagtaagtagtatttatccccacaattttgtgaagatgtgagcagtggcaagtttgttttttttctttgctccttgcagtgtaaattgttttggcttgtctatgctttgtattgcatttgcattcataaatcaaacatgaaaagttggtatatctaagcaatgttcagaataataagaactactccagtagtaaaaaatttctagttaacctagatatctcacttgaacttatcactaagtttactaccttaattaaattggtcacaatggtcagatttaaattaaattaaattaaacagcagctgcacataattttcagtgttaaaccttttatagtagtgcataaattgcagtacccaccaaagaaaaaaacataggattgaacaacattggttcaaagggagtgttcacctaagatagttgcgctatctctagcgagttttcctaaccgtagttgctacaaaccaatccttcacttcaaacaatccgttgattgcctcattttactcgtagtattatcatcagaggcacaagtcctcccaggtgtgtatattgggaattgaagcaaacttgacagtaaattgtaaaacacgaacgaattctatggcaagaaaaaaaatatcattcagaatttcatatgagccctaaaacacgtgtagcaggtttgcagagtgacagaacagaagggtaaaatttccagtactaatttcccgttaagagaagcttgattgcttcatctgtgcctccccacttttgcacgcaggttgaaacacgtgtggcctgcaaatggcagaatgaagatgagcgaggtttagatttaggtgcccacgaaaactaggcaggtcgaaacaaattagtaacagagtatggtattgaccattcacttacaaaactgaaaaaagttcgatgacaaagtaatttacatttaatttataaccatagtataaatgctttgcaatgtaatacctggtggcagtgacatgattttgcagtgtcctagataaaagtcacgaaactagagtgctcggttgcaattttttttggcctaaaagtatctatgtacgaggatcctgagacattttgatttaatgactaactaaaagcaaaggtattatgacagtgtttcacttccaggactaactgagctatctgttttatttccatatccgagttatctgtttttcatttttgtatccaaagaaaaataaaaattgaaattgtgacaaaaaaaaaaactaagcaatctgttttatttccatatccaagctatctgcttttctatgtgtaagtgcagactataccaggattcacaattttcgaatgccaaaagaaaaaaaatcagggcactgaaattcagaaatttcaggggggaaatgtaactttgcaaactgaaaattttaaattttggatagattttcactgaatttgaatttataaattcaaacaaattcaatttttttgggcagaggcacctcctgtcaagtgtcaagatccacctgtagactagaatctttgagctgaaaatgtaaacattagatttacctgacaccacaggctgcacactgttgagcaccatggtcaaaccaagaagccctgcaatcttggcaacggcctgccacagcttcacatcgctggtgagtagtgaatatgatggagaagtgatctccgagaatcaacacgacagccatgcaaagcagccaatcatcagcgactcaatgacggcaacaatgacatcgaacatgacagctcttggacaaccggaacctaagctcattggagactcgggtactgaaacaaatggcaattatcaaggttaaatgaaaagctttggtattataagttcatcaagtcttttgtttcaaagaaaataaattacaccgattcttgaagacactttctagttaagaacattgaatcatcaagtagaaacaaattatagtatatgtagataagagcaagagtctgcagccaaggaagacgtagcaaaaaacgttcatagctcaaataatgcagcagtataatcaagaaccttaaaaataatagaaggttaaagagtcaaacctgcgggcagcctggcaccaaatactgttagatttccttcaaatattatattgtcaacatgtaaccttaaaaatacttaggtaatattaattctgttagtatgtaaccatatattataaacataaaaaagaaatgccacataacaaggtagtattgaatatcgcaaaatggtaacctttttaaatgaaaaattactttaaatcctgtaatcagtaatatggtattataaaagccataatccaagaacaagactagaatccactttactccagactgaatcaagatataagataaatttaagctgcaggtgtcaacactcaatagttaatcaatgcatacacataagaatcaccaaatggtccctcaatttcatgagatcgaaattgcctcctcaaatatgaaagcggaaaaacgttagcctctagagcatcaattaacaggttcatttcagcccgtatactgagctgctctgacaccatagtgctgaccctgtacagtgagttttcttgctcagcactgttagaagtccaattgccatccaagcaatttactcgatggatagtgatcatctatagaaattttggaataatcagtgttgatgattgtgattaaattgcttggagtagcaattcagtcttcttgctatgtgtgattcaggaaaacagtgaccacactaactcagagtgccatggtgccctgtcaaatcagtaatggataaaacgagccaaatttggaactttgaggactactttggacattttagtagttggtggaccaatttgagtctagtgcgaatgttcagggatccttttcgtgcaataagcataaatacaaattgattgataaacatgacaattgcatgtgctttacgtgaactctttgttgccaattcttaactttatttacaaatagtatatggaatttaggaaataacatagcactgtggcgcctgtgccttggccttggtgcacgcatcctcagggctcctcttagaacttggaaaattttaaactattaagtatgtggttgtgaattggttttgcacaatgtcttaaattctttagtaattcaggcatattacattctgaatactctgataacttccaagatttaggagcaaactgaaactcaacttattatggaacacttctattaaataataagagttcaaaggtgatgaatgccattgccatagactgagtgcaaatcacctcatctagaaaaaatgtttatgtcattcctttttaaggagatattcatgttgtaatagtacagaattctagtgcagtcctatggagacctgtaccaaggaaacatgcttggaatcctagcattaaattgtgcaaccacacctgatgttacagaaagtgcaaatgacagtaacttgcacagatacacagaaacaaaaaagtaaaaatgataataaaaaaggtatgttttggtggcaaaatcagtgttctaaaagtaggtgataggtgaccattaggcactaggcaccgggtagcatgattaggcattagatggtgcattaggcagctgaactactttgggtggtgtttggttgctattttagtgttacatagtatacttttatgtaatatgcttgctaatttcttggatttgactagttgatgacctaggcaccgcctaggcgtcaattagacattaggcgccacccagccgctgagccgcctgactaaagcccaccaccttcttgagccatggggaaatgtttactgtccagatttatttctgaacaaagagattctcataacagttcaccggttccaatctattcagataaaacaatgcatcgtgcgtataccaaaaatatgcatttatcctattgacttctcacaataatcaggtaagagatgtcttgaaatacagatatgtacaagctgttatctagttctccagcagccctgctccagttaatttattgtatctccaccaagcatgagagttttttttcccttgtaacaaagtcatgacaatgatgactaacaaaaatgcgagtgagtttctctagtgatttagatatgctgatgccaaaatattttttgttgtggtgattgtaacagacagtaaagcatcaaaatctgacaaattaactatcatttctagctaaagtccctcaagaatggacatttatataggtgaaccatattagtgcattgttccctactagctacataaatgggattttaacttcacatcgattgttccactagtgcttgagggtgggatgcaaattttgcctatcatcattgaaacagtagcataggctgggattacgtatttttagaaaagacatgcgacttatgattatggcattgaaaagaagacctttggtttaaacagtatgggcaatcatgaggtaaatcaacttggatatcaaacttttcatcaattttattttgtacaattacctcactacagaagtagcagaatcatcatatatcatcacttgattatgcaaatcatctcgagggaaaccttgtcgaatcactctggttcatgtgttttgatcaatgctgggaagattggtggccaaaccatcatgaaggggtatatctcaaatagaaaatcatccttcattgccatctcatacaccttctccactgtcctgctgataatatccatgcaaaagacctcaccatccacctccaagaacacaaactcagcgttgtccccagacccaggcagactaatgcgtgaatcccctgactcccaactaggcttcacaagatgaccaaacacctcgcgcaaacaaatagtatttactagattccaatcggcagagctgtttccatctgttccgtgaagccaaacatggatcttaaacccctccacatggatcagataaagcccagatttctccgcttgcgacagcttaacgctcagctgaaagctttcagggcagtcatctcgcacggcatcggggacctcgatgaagaacaagctcatggacaccaattccaatccaagaatgtaccctgttgtgcccaacatatacagcttgccattgacaagaaaaccccggctcaatgatctcctccagtgcgccggtagctcaatgggcgccgaggtttgcgcgacgtcccagaccccagctcgcaagatcttctccaccttggcgaagacctcccgctcgctgctcaccagggtcaccacggtgcacgccacggcatcgccatcgccatcgccaccgtcctcggggaggaggatataccgcgtgtggcgctggttgggcgggagagggcgaggcggcgtgcggaaggtggagatgaccgccccgtcgctcgccggatggagcgggcggcggagctggagcgtggactcgccgccgcccctgtggcacacgaggaggcggccgttccggcagcagtagatccccgtgccgaggtggaagtggaggtcggcggcggtgcccaggtcgaagctgccgcggcggacgacggcggcgagctcgggcgggtgggggaggggcaccaagcgcgggcgcgggaggctggcgctgtcgacgtaaaaacccaagaaggcggggcgggtggaggacggccaagcggcggaggaaggcccggtcggaggcgtggcggagccagcgcctgcagacgagcgcggcgcggacgaggaaggtggggtgggcgagtcgaagaaggatctcgcggaggaggtccccgtcgtcgagcaccgaggaggaggaggaggaggcggcggaggaggccaccggcggcggcggcgacggctggggagggcgcgggcgcttgcgatccatgtggacgcggttttgggtggatcgtggggtaattaccaacaaatggagacttgggagacctcccgttcatttggggatgtaaatcgaaatcttgatttgtcctttcgatggaaaatccatcatcatttaccccatccagagtgctaaggttagtctattcggagcattgcggtaccaaataaaagtattttactttgttctaaaataaaaaaaaagaagtaaaataattatttttccttagagattgctattatatgatatctcatcccaggtcggtatggtaccatctgggtactgaagttatgtatgttatggtatagtgtcattaccagacctgatttgaaagagggagagatcgactctccaactcggtggctaccctcctatccgacgacagcgtctccctacctacctgtagccaccatcgtcaaatccagccaagcctagatcatcgaagtcgagtctaggctaagacagacaacgacgagatctggcatccttgagtttgggacgtaccaaattcggtggctagaaagtttgggttgtagatccatcacggattggcaacagagagggcgtgatgttaggggcttcggccaccttcgggatgtgcaggggcccaggtggagtggagctttgagacggcaacgcagttcactgatcggctaagaagccatggcacacacaggtctagtcaagtttaccttcccacaacacacacgcagcactaaggttcctgtggcaactgaactaggattcaaagccaggatgagtggatctaccactccaagccctttcctattcttatactaatatatgtaagttccttgcatttagaactagaacgtgaggcatagtaatggcgcatgtgtgatattttattgatcatatttaggctgctttaggaaagcagtcaagcgggaatggaaaaaatgtcttctactgctatcttatgtgctaaaatggaaaaaatcttctcttcttctctatgtcactcatcacagtcggagagacccatgagactttcttttctcccggtaggctctagcgctacaatgcttatggctgcaatccaaatagcaatggtcctcgcggatttatgtgcacccaatccattaaggattcctggtagtgagattcctctagtcaagtctaaggattaaatatgagggatttcatccagtccattgcggaatgtatggttacaaaatagactcatccccctgcttatagtatgtagcttggaaggccttggattcacacgtctggtgctgccctgtcttctccacatcaaagagtaaagtatgttgttgaggtggtaaaaagtcgactttgtttgtcactaaacctgcagcattctcgtatattgaagccgctgaagactagggcctaagtattgcttttatccgaggcgctacctgcgactctgcatgggagaagagggctgaattgcaaacttttgtgttctggcttctattattgaatcaggcttctattattcaatgtttagttaccatgggaaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgcccttgcggctgctgacgcagctattgtatatccattctttcttccatccatccctttccttcattcgggtcggtcacttttccgggctgggatcgagaagtggaagtcataaaaaacatttatttatgctatttgtaccggtcaccgttttatggatgagtgctattggcgtagtcggcctgactctgaacctacatgcctatgacttcgtttcccaggaaatcagtttatcaattctcgagtcgtcaatgattggtgaaccagcacattcgtttgcaactcctatgggagtctgggttgattctcggatatgaagatatcaaatagaatacatcaaactcgcatgttccgtgactcatgtgtggtatttgaaaggtctttctagttatatcacgcatattttagataaaccccatnnnnnnnnnnnnnnnnnnnnnnnnnnnnnnnnnnnnnnnnnnnnnnnnnnnnnnnnnnnnnnnnnnnnnnnnnnnnnnnnnnnnnttatgagtttggaaccctgaacagaccgccggtgttaagccggaggaaggagaggatgagagcttttcctagaattgttggcactacctggtagatgctttcaacacttcgagttggtctgccataatatacaggaaatgttgggagctctgtgtgataaatagaacattgttgaattggaaatgctatttgtgccggtgaatcgacgaaactatgtcctatgcagttttttgcgcaatgtcatgtcgtaaaaaaatgttggacataatattttaaatcttttctataagatatatttctctcaaaatggtgacatgataacatttttggtatctatagttttcggctcatacatttttgtattttttggtaacatttttgtatttttggtatctagagtcctagcctcacaaatccaccaaaaggcaaaatcgcattctcacatatctgtcatacatgtgttctacttagtgttcttagattaaacacgttgaatatgtagaaaccctaataatctgtcgtatgttgcattgactcttaaggggtatatataaagtacataggaaatagagatttgaagtacaagacaaagttagagtagattatctctaggattttatctctctagtttgtattcgattcttatctttaatcatatatgtacttctaacaaccttattgtcttacattaattatatgtgaactaaaccattgttttagtttgaaaaccatgggcatagtgaattctccaaccaacacacaacgccaaaggaaagttattaaaggatagcttgtcgatttatataactgaagtgtggatttgtgctcataaaaagcttgttagaaaaagccatctatttgtttgggcttagactttgtcataaaagctaatagctaatagtatatttgcggctatgaaatttccaaagcatgattaaaaagccaatagcttatttatttagcctctacatttttaccaaaaaaataaaaaatctaaggacacccctaaacaaataaggctaagttcgaatgtgagttttggggcgagctttttctggcatgggaaacgaggcaagcaattagtgtacgattaattaagtattaattattaaaaatttgaaaaaatatatttatttaaaatttgaaaacttatagattaaaagtactttttttagaaaaaaaatacatagtttagccatttaggaagtgtgctaatagaaaacgaggatgttactgaaagtgcatctaggcccctaatttgtttttatgattaatgacaatacaattagagaggactaacaagttttactaagtgaatgcgaaggattgttagtccgtgatgatttgtagcgcaatgcatatctcaacgaatgtgacaaaactatgagttgtggcaatgatcaaaggttatattgtatattttcatttctttgggtcattaggaaaaccgcactattaagattgatgatgcattgacatatgaggtgtgatgaatgtgctcaaaatcattttttataagtgtatctcagtttctgtattctggaaattttcggagttgtccgaaagtgatgacattccacttccctccatcacatattaacacatatccacctgatacctcatactctgccctggtgtcaagtggtaactggtaaccatgcatgtatcaccacagaaatatgtattctaatacacaacaaagattttgaaattaagaattgacaatttaaagttgttaggacgacaatgtggaaaagcaccctttcacagttttggttaatgaatgatgagtcgcatcatacagctcacattatttcccttaagattttaatcatgacatttgtgtggtgcaaataatatccatattgcgacaccaaacacttggttagtgacagaggtgagcatacttctattttgaacacaaggttatgccaatgcacacctcaatctggtttacatgaaaagaaaagtagcatggttaatataattagaacccatggttgttagcactaagtaatattacaaggactggcatgaacaaaagctttagtcgaaccaaaatttatagcagaaaacaaggagtggttggattggcaccaaggtaaagctaaatgtaaaatgtttacaaacattgattttgatatggtttgggatgcttggcaaaattacagacaaaattaagttttttggaaccaaataaatggccaaatgacacaaaaaaaagttgtttcgaacctaataaatggccaaattaaacgttggagattttttgctatatgatcttttttttaaatagggaagtatctgtgcgatcttttcccatcatatttacatgatatactcatatttatacaacatgtataatatttatctatttggttgtcaacaatatttggataattaataatttaatcatatatatatacataacatgtataaaagaattatataagtagtattaagatgtattttacattgttacatccttctcatttgtccattttagaaacacaatataaacgcagacgctcgtaacatgcgcacactcacccttataaacatacaccctacccctttaataagtacccctccgtactcgtaaaggaagtcattttggacagcgacatggtctccaaaacacaactttggctccttgtttctataaaaatatttattgaaaagtgatatatgtatactttcatgaaagtatttttcaagaaaaatctatttatataatttttacattttcaaactcaacaacttttaaaaatacggaaggagtcgtataagaaatctctttttaaaaaaaacttgtgaactaacttaaggcaatcggactcctaaattcttaattgaagctcataattttctaaaaaaataaatatccaaatgaatttccagaataaattttaccttaaataaaccgtataacaataacaagattaaagtagctttcacctgttgcattgcacaagcattttttgctagctgtaaaaaaaacaaacgtggcattatcaacctttacatgtcttaggctttgttcgttctagggagatagaggagattgtgtctcgttttccgcgcgcacgcttttcaaactactaaacgtgcattttttgcaaaaaaaatttatatgaaagttgctttaaaaaatcatattaatctatttttgaaatttaaaatagttaatactcaattaatcatgagctaatggctcacctcgttttgcgtatctttccaatctcctcaatcctcttcttctcagacacatgattttacttcattcaacacaggccattttaaggcccatttcgagtttgctaaccaatagttccttcctggtccaatagagtaaggatagaagtagggttccctagaagtttttcttttctttttttatttcattttctatattcttttctctcttcttctaggagtatctctctctctctctctctagcgaactacccaagccaagccactgccctcctccctttgccttgcgcccttctctttcctccttcctcctgcgtttgcgtgacgaggaacgaaagcatcatctccgccccccgccgccgcctcccgccgccggcgaccgcacccaacgcccccttcgtcctcccgtgcgcccgcccctctccgcatcgaatcgatcgcgccctccaaagtcggtgcagagttcgttgggc

SEQ ID NO: 64249 - DNA, 22710 bp, Oryza sativa
cgctgcgtgccgtgcggcttcgacgtgcacccgctctgcaccatgttcccggcgaaggtgcggagcccgctgcacccggagcacgagctcgccatggtgccggcacccgcggccgcggcggcgacgctggggcggcagtgccgcacctgctccggctgcggcgaggtctgtggcggctggttctaccggtgcgacgcttgcggagtgtgcctccacgccgagtgcctcaatggcgcccgcgccaagcagagtgccggggtgggaagccagggcaccggcgtcggtggcgcaggcagcagccagagcggcggcggcggcggccagagcaccggcgtgaagcggagccggagttcccttgttgggaagttgcttctcaaggctgcggttcgcgtcgccgtcgatgcggcgacgaacggactggcatcggcggtgctcgatagcggcagcgccgacgacacgtcttccttcgatcaataatgtggttgtgcgtcctattgatcaatcgatatcagtacattatgtatgagtatcacctatctcccttgttttctcaagttcatcagaggtcccttacttgtcaacgtatccgattttcgtccttcaaccggaaaaccagatacaacaggtccttcaactatcaaaaccggtgcagatgaggtctctcggcggttttggctgatgtggcacatatgtggctagtttgattcggtattcatctgacgtgccattgatgtggtgcttacttggcaattcgatctgaaaaaataataaaacccgtgagacccacatgtcagtttcacacacacagtaataaaaatggtgggaattgtgggaatttgttgctatatttactttctccttatttcaatatctcatgcttagaatgatgatgttaagtttctatgcattttgcgataatttcattcatatcttgtatacacatgcttataaagtgtcttgctggggtaaataagtactcactccttcataatttgacatatacaagaatcgtgttatcaagaagccccagaaggtagtgaggtctacaacagcgacgagtttttctagtctagtctagacttgagcttttgcctgtgtcatttagtaggttggttttctccttgaatttcaaataaggatattttagtttggatcttttaatctttaagagttgtaatagctagtcttttgtaaaacatgtttgcaataatcgaaagctgttatgtatatcaatctgtgcgtgatcgaaatcctggacgatcatgagtggatatttgggacaccaagaatcaattgggtgttatcataattaccaataacatgaaaaattatatgagaattatcagggttacgggttaggtataccctttacccttcgatatacgccgcatatcagtatggcatacccacgcgcatacggatattctctgcatacattaaggaaatccttcatggaatttacggatggaaagagttctactcggacaagactgggtcgtcaatgtatcgtgtaaggtctgatgtctccgagttctacttggaaaccgcttgacctgcgatataaaagggaccccccggggaggacctgaggcatcgaatctcagagccaacacaaccctcacagcctacgaagtcggagcctgcaggagccaaatcgccggggatctagtcaaaccaactcgactacgatctcgctggatccatcgagttccattgttccctttgtaacctgtgttttccatcatataatcccacatcaactggattagggctattatctatcaaggggcatgaaccagtataatcttcgtcttttgtctgcttgatgtcgtattacgtagatccttataccaacgtaccccaataccctctatatccggtctacgggtatcacccgtcgacagtggcacgccaggtaggggggcttggtgctcaaggttctactactatgtcatccagcttcgtcgacaacaacgtcaacaccaacctcaactaagtattccctgcttcaacaatgctggtgtggactcaagtcggcaaaatcgtcttcccggtttacaccacaatgccgatctcagcctgtccatcaatgaccggaaacgagaacgcagtggctacaaaccaagacgactccatgtcgaaagatcctcccgccgaggcggagaacggaacatcgacgacatccgagctcgagaaggattctaatgcggccaaaccttgtcgttccgacaagaaccgcgagcctacgaagatgacttccgaagcgacaaggtcctggtgtcctatccacaaaaccaggaaacacaccttgcaagcctgctgggttttcctcaacgtccgcgctgaaattcgcgcttgcaaagagcgtggaattcagcgtatttctccaactcgtgatgtctattgtcctattcacaagacaaagaatcacaacctctcaagctgcaaggtctttctcagcgccatgaaagcgccatctcctaaggttcaacagtcacacattcccatcagggataaagacaaggaacaaggagcgacgtcaacttcagatcgatttgttggggtaatcgatatcgatcctcacgaaccatcagtcttgcaccttctcgaagactatggatcatcgacaacgagcgcgccgcgggaggtattggctatcgatgatatcggcacgtcaacgcgcaccaatgcagaagcggagaatcaattggccactccggcccagcacatcagagctgtcaacgctatactgagggaaaccccctacgatcctattctgaacgacgatctcgcgcgttggacagaacgactacgggaatcagtgaccaacctcagcaacgcgttcgaagaggccgctgccgcagcgcacccggagtagccaccaactggcgatgccaatggtgaagaccctgaacggagggaatcgcctcatcgagccacccctccacctcgcggcactggcgatctccgagatcacctcaacggccgccgggaggcacgacgcacacgagacaatgagaatcgttataagggctatggccgattcaattccaaccccgaccacaacccctgcacaatttatcgaataattattttatatgtacttttcagcaatgttttctactttaccctagtctcatccatctttgttgatttgcatcataagttgttcatcttcgctgcaagagtgtgatatccttcgtaggttgtcccgtaaaccttccgattcgcccacgagacgggtggttatctataaatagatctaaatcaacctagaggctggtgtaatatctaaattggttgcgctagccggtttaatcttttctaaacccatattagtttggatttttctagatcgaggtgtttggtgactctgttaacaccacaaatcattaggtgagtccgtgttgaccgaaaaaggcgtcaacaaagtcggtttgactttttctaagtcaaacttggttagctttgaccgagtttatagaaaaatatagctatattttaaacataaaacaaataaactatgaaaatatattcaatgttagatttaataaaactaatttggtgctattaacgttactatattttttttaaaattggtcaaactttcaagaaatttaacttaaaaaggccaaaacaacttataatatgaaacaaagggagtatatatgaatctcgcgtgtggcaccgcggtgagacccgggcgatgctattcctataaaatcaagggcgttgctctggcgaggtggcgacgctattccagtgagttagtgagcactaggggtggaaagagagtgaatagtttccatccgcttgagagaaaaattgaatacgaataaagttcggaatggataatccggatatggatactaatatagatattttctttggatatgaatacaaaaatggtactatagttttcgacgaatatgtaattccggtgaatagtgttattcggatatccactaaaagcatgaaaatttcttcttatctatagaccttcaacctacctctttagactttaatggtagcccatctcaacttttaaatatttcacaaactatagtacaatattatgttataatttcaattatacatgcatttttatataaaatgagctaattatgtgtgatggtatttgtttctattagaaattgaagtggttatcttgtttcgagaaataaatatttgtgttcgtattcgtgtcagatcatattcggataaattgtatttattttcatatcgtccaagctattcgtattcgtatcaggctgaaaatacgataatgattagagtcttttacccctatgccattaagaaagttggaggttacgtgtgtgtcacaaaaaagttttgagttacctgtatgccatgaagacaaactttcttttacatgtgcgccactttggatggaatcagtactaacggagacaaacggaggtttgaaagatctattttgcccttgctaatggaaggaatcagcggcggaggcggcgtgccggcaacggcgacgaccagcggcggcggcggcggcggctagaggtgtgccgccggagccggatagacgaggcgaggcgatggcggcagatagacgaggcgcgccgccggatagacgaggcgaggcggcgggggcggcgtgccggcgacggcgacgaccggcggcggcaacgaccggcggcggcggctaggctagggcacgggagagtagtagtagagatgaaaatgcttcaggggcaatttagtcattttcatacatgggtcccacatgtcagagctcattctctaacataaggtggatggaatggcacacgggtaaacggaagtttgtgtcatggcatacaggtgactcaaaactttttcgtggcacacacgtaacctccaactttcttaatggcataggggtaaaagactctaatgattattgtatgagcactattgcctgtatccgctcggttttcatccctaactagcgcaagagctcaacccaccatgtgtccatgttgttgccgtcaccagattcatgcgttgagaatcgagagttccctttgaggctatgaaagggacgggctagaacagcttattggttttaacccatttctcacccaaaccgtataaaattccatgggctgtgatcgaaccgtgaagtcctagatgtaatatgtataagcagttacacgaaataagattattacattaatccacttcaatgcaagtgtaaattatagcatataacattgttttcttcctaaggtctacctccgtttctttgtttgacgatggttagtaaccgacgtcaaatattaatggatggagggagtacattctaaccaatttgttcgaaagataaaaggatatttgctcacacatgctgtttaagaagtggcatattcactcatcctcaaagtgctgtttatcactgtccttattgggatcaaataccacctcctcctattcgttgtcgtcgtcgtcttcttcttcttcttcttcttcttcactgtcgtcgtcgtcttcacattcctcttcttcctcttcctcttcctcgtattcctcttcttcctcctcttcatcatattcctcctccgttagtttttctttgttgtccttcccatggattgttcctggccctcctgtaaccgtcgatcctaacttcaatttttgcagtattgatgacttcctgcttcctgctttctgtcctgctcctcttataactgctgttgttgcgccaagcaatttatgcgaaattgtagcaaattgatttgcagctgctgtttttgatattctagtcttttttgttggaactgcaactgcctctgttccttgtattccaaccccttctgaagctgcaagttcaacattagttcctccttgaaattgttggggtactcccatttccacattgctcgtgttgccttgctcccatttgtggctattgtaaatttctacatgtgcttcttcatgtaatcttggattatcttctcccgttacttgagaacaactctcgtggatgctgaagttgcagagcttgcaacggtagcaaatgagagaacctgactgacgacatatgtcgcaaatgaatggacgtctgagcttggtctttattaatgggtgagcttggtgtgacgcgtctataatcggcatcctagtttggacacgcaaaagatgtaaaacttgggaattctctccatcgagaaatatacaatatccataaattctgatattcaaaatctgaactttggtcaacaattcattgaacaatgtatatggttagtgcaattcatatatataagtggtgccatttgatttatatgctaagagtacttctggcgttgattaatttcgtggttagaaaatttactctaatagaaattctgtcataattcagtgtttgagatcctgggaaatcaaaccacaccttataatttaaaatttataggaacaatagttctttatcacaaaacgtaaaatattttttttaaaaaaagagtaaaacaagacagatctatatgttcagataaaaaaggggaaagatttatacgcacggagagaaagttaagaattttatagtggagtatacattctacggttttgctttggaggacatgtcctgtacacacaaacttttcatatacaccatgtgcaccaactaacaaattttataagaagttctataaaagattgtacatatactttaaatagtattacatttatatgtaaaaatctcaatctcaaattcattatattttagtcgtaacaaaaaaaaaacttaaaaatctgtcagaattttgtctttctttttctccatatatataataatttgaagatcggactttgaggacgtatccgatgaaaacgagctaagtgttgaaaaatcgtgaaaatcatacctaaagttttgtaaattcatgaaaatttattagagctagatgtagatatgaaatacattctcactaaatctcaaatcaaaactcaacttcgttagaaacaaaaaagacaaatttcgggtgaacagtgtcttgttactatttacctaaaatttgtatttttttgttacttctaaatgaaattgagtttgaacttgagatttgttgataatatatttcatatgtatacatatatctagtattttttttcatgagtttttggtacgatttttacgagtttccaacacttagctcgttttgactggatatgtccctaacataaatataatactactaatagtacatatataatttttttaagaattttttatgatattttttagttgatgtgtacacgagaggtcttgtatgcatataagttcacgttccaggtatctgtgtacacataactaaaaggctagttaaagaggaggacgatgtggacggttttattatacggttttaaataatgatatggttactttaattcggtagtacgtttatactctctccatttaaaactatatggtatattaggtttctacgcagtctccgacatacactttaaccactaagtttctaaatagagtattaacatctataaatttaatatcatatgaaaatattttcaaatataaatctggtgatactacatataacacactaaacacatactccctcggtttcataattcttaacattttgaataatgacacggtcttcagatatatgtttgactatatttttatattataatatataataaatattttttattttattatagtactttgtaagataaatctatatgttgttctagtgcctttgaactaaatatttttaaagtcagtgacagttaaagctaaaaaaaattaacctaattttatataaacgtcaggaattataggcccagaggagtctaatttttgtttgttggttataaaaaaattaatataaactttgcggaagaaaaagacacctcatatattcaaatggagctgggatcctctcctgtaatgcatgtgtaataagtatgtgcagtaagtgccactgatacgagggcctggaataggtgggacccacatatcagtgacacgtaatgcagtgcagtacagcagtggatttgcatcattcaaatggagtgggtgccagctaggaggattaattagacagccgaacggaattaagtgaaagttgtagttttgtcattggtctccatatctcactgcacgtgcgtaggtgtcttgaatataataaaagagaccgctcaaaaaaagaatataataaaagaaggtaaaatctaaatcaagaaataaaagaaatagcaccctgatgaatgcttctgtgagcagccgttagagtagtttatagtattttcttaaataaatgaaatggaccatatttgcaaattaaacatagaaaatgtttacctttccttcccaaattaagacgaatccgaccaagatcctctccggactctagttcaatctcggaactgaagagcacacgatgcgtcgatgtgtacggtgtacctcgctatgaggagccttttatagatgtagtatttcgcgaaaagaaaatttttagatgtcacatcggacgtttgacgacatgttaaaagagatttttggacacgaatgaaaaaactaatttcataactcgtttggaaaccgcgagacgaatcttttgagcctaattaatccgttattagcaaatacgggttactctagcacttatggctaatcatggactaattagactcaaaagattcgtctcacgattttcccctaactctgcaattagtttttttaatttatctatatttaatactacatgtatgtgtccaaaaatttaatgtgatatttttggaaaaaagttttgggaactaaatagagccgtatatgtatattccgttgagcaagtctgattttatattcagttgaacaagtctgattttttttttctttcttgcgttggataagtctgcgatgtacagtcaagaaaacaattggagaaacccatcgctctccaatatgcaaatagctaaagaagtttgaaaataaaataaaatctatcactaccatagaaacgtactccagcttgcttcagatatactatacggaacaactcatcatagatatgtaagttaattgaggttatatgtgatggatcgtaactattatcatcacaattaccatcaccgatggcctcacattcagtagtattgtatgaaccatggcaagggtcccattttcacctgttatggaggtgtgatcatccgatttggttcctgtgctgtgcagtgtgactgcaacaactagggctgtctgtcattggcctgggcctcgagattgggcggctcgttgtgtttggccggactgtatccgatgtcggactcaccgcatccgtccaccatgttactgtaattttcctcttcgtattgatctcaaatgttactgtaatattcctcttcgtattgatctcaaatgttactgtaatgagataatcgtgccatatcaatttcggaaatttcccaaaaaaacactttcagaagtttctgaaaatcatttttggaaaaaatctgaaaatcacagtactttcaaatccaagaatgagaaacacttcaaaaaagattttgatcactaaactcatccctaaatattaaggcaacatccccttaatagtacgactttactaccaactcaagagcaaatagaaaagctataccaatacaaatacctttacgccatcttctctctttgccttgatcaatactaatatggatttgaaaacgaatcacatccccttgaactttgacatttcatcttgtgcttcttcttcatcaagggttgatcctcacactactacaaaaacgattttcctgtacgagacccttgtgaggttacagacggatcataactgaccgcatatgcaaaaatcgacctccattttcgcatacggctccttaaaagacccgcacacaaaaatcaattttcgcaggcgggccacttaaaaggtccgcacaaaaaaataatctattttctcaggcgagccacttaagaggcccgtctgcaagtctaatccctctcaacccattcaaaacttatctcttcttctcctccccctctctctcccttatcttctcctcacttcatctcctcctctcattttcccttatccgttctcttctcctcacagcaacgcgatggcgggcgcgacggcgacgtgctcggggagcggtggcggcggcggtggcgggctcaggagcggtggcggtgggttcgggagaagcgatgggcagcgggtgacgcggtctactgtgaaggccgtggctccctcgccctcccccacgaagcttcggcggcggcctcgagggatgacgacgacaaggaggcggccgggagtggcgccgccggccccacgcgcacaccgactggatccgcaccgccccagccgacaatgacgacgaggagacggcggccaggagcggtgccgtcagccctgcgtgcacacgcgttagtcggatccacgccgccccgctgacgacgacaaggaggcgacgacggccgctatctccgcgcgcacgcgccgccaccgccggattctaggatttccttttttgaatttttattttttttggaatattatttttctgtgcgggcgacataatccgaccgcacgtgaaaatctaattatcccgtgcggtccacttaacccgaccacacgggaagatggatttttctgtgcggttgggccgcccgcacgtgaaaatatttattttcacagacacctcggtgcagacgggcaagacctccgcatggaaaaatccttttcgtagtagtgtcaacaacttgtgacatcatatggccttgattgattcgtcggtattcaacaaagcacttgctccttcaccactgcatcatgtccttcggcgccaagcctccacttgcccttctcccatgcatggtccatcgtgtatccaagtgttgccaacccttcattgcatcttgccatcttccgtcatttgtagctttgcatcacaatgaaaccacaatgtattacatctttctctacatcatcttcattggactaatcccttgcttatacactcaataaaagcattagacccttaatcatttgccatcaattaaccaaaactcactaagggcatagatgctcattaaatctcccactttttggtaattgataacaacacgattaaagcttacaaaagattgataataatgcttttgaaccaaaagttagtttgagctcccccaaaatgtgtgcatacaaatatatggagtgaatttctgtgatgagtgataccgaaaggaaaacaagacacataactcaaattcttgccaccgattcaaaatgtatcaaatgaaattcttaatgccaattgcaaaaacttgattttatgccaattgattctggtaccgattgagaaatcacgagtaaccaaatttttgaatcaaattcaaataccaataaataatgtcaattgcatctggcctagcaatcaaataataagcatgaaatctatcacaccatgcacactccaattgacaaacattttcaaatatactctccccctttctcatttactctttggcatgtccaaagcatgtctttcgataatttctcacaattatctcaccctttgatcaatcttttcttcacccccttccttcagtatactccccccccttgaaatctaagcaacaaaaagggcatacgcagggaaagaaaagcagagggatcctcgtcgattacctttctctcaattttatatttcatcacttgtgattacgaattaaacactaatttgacacaagtgaatcaataagcattgagatacaaattttgcacataaaaagctcacattcgaagggtttaaagcataaaccaaaaagtatccctttgaatgtgacattcttcttttcttctaatttaatgtatccctcccccttagtcctctcccactttgtcatttaagcatggcaaggagagggcatgatatataatgaaggggatcattgagatttgaacatgccaaaccacttcttcacaaactagagtgagaattaagagttaaaaataaaaacaaccgtcccaaaattattcacaaagcatttcgtaaatgagtttagaatatatgaattccatagtttgtactaaggcaaaaaaatccatatagaatgaagtctttgagcactttgattcacttagaatactaactttatgactactactcacgtattgagtaaacaagcattttttttcataacattatgcaaactaggctaattagcaagaagtgaaagttggcctagatgcacaaagactaggcaagtgatccaatcattccaattgaaatagcaagctatggatcatccggttaccttccttgttaatttttgacacgcccatcgaaagaaatacattacaaatgttcttcttggtgtttgtgaccttgtcaaaagattgacttagcactaaaagcaaatatccacagggataaaccagagaccaaatagggtgaaaaagtgaagagaagaaattttggtaagcacttatggttatttaatgggcttgagaagcagtcaacatggagttttttttagaagaaaaataacacggagaatacgggtacgaatagcacaataaggggcagccgccaactatagtttggcattaactttcacctcttcatcaatttcatgacattaaaagcatgggagtgaactcttgccaagaaatacaggccatcgcttaatatgtgatggaagaaattgaagaacttgcgattttttttaaaaaaatataaataaagatgtattttggttggagtcttaatttcatatttttttataaatgttacgtcataaatatatagctacttgtttaaattaatattgtgatatctcgtcaaggaacaaaagaatatcaagtgtccctgttaatgggagcaacttttcgaggtttgttattagactctaaagtttatgggaggaaaaacaaagtaattgaaatacgacactattcatgcatttgattcgtaggaataagaaaaggaaaaaatgtaggaaacttttctattcctacgattatagaggaaaaacgtagaaaatttaacatccactataacctcttggaaaacttcccttgagtctatctctttcatctgtttcctgcgtttttcctgcagtacaatcaaacggttatttctgtgtttttcttctgttttgtaattctctattttgcacttgttgcagtccaatcaaacggttattcctgtgttttttttgtgttttgcaattctctattttgcacttgtattcctatcaaaatccggtatttttcatattcctctattttttttaatcctactatttaaagaggccctaaatgtgttcctcttgttcctatctattacctttgcctttctagtgtcaattcctttgaccttggcaggtctcgttcgtactggctctcatgtggaaagatataattcgaagttggaaccactccgcacaattgtcgcaattcaccagtaaacagattgaattaagggccgggtatatgaatgcagaatgcgatttcacgtaagcagctatagactcggtgcccagtctgagtcgtctgcaatattttataggcaaattggcaacatgttccaggagtccttccactgtctccaaacctgctgacttgtttcacttatatcgtcgtattattgcaattcttcgtactactctttaagggacgtatatctaatcccatcttcgatctaagataaaaagttattttaggatttgtgtctatcaagatcctttttgtctttgatgtaacagtgatctcagtctacaaagacttactacagtatatttttaagttttagaattagtgtagagttaattttctactcatcttatcctctcagtattagtactatcttatagagcttttctttgtgtcgtcatgtcgatactgcacgtctttgtttatatttaatctcaccctcgatgtaaggtaaggtagagaattattatttgcatctgtcaaaaattttggagattcagaccgttaagtattactctcgtactaaaatataaattagttacttagacaaaatccatatatattaggacgtgcgttgcacgggttattatattctccctccattcaaatttgattgtcatatttcagtttctgaaatattcagttttgatcgcgctccctccaattttgtctcgggtgtgatgcctggttgatcgttttccatgcatcattagtgcatccatgcaagggattggttcaggttgtgacccgttcattttccatgcatcattactgcacccacgcaaggattggttggcttttcaaatgcaaagcaacagctttgaataagtattattgttgtcatagatattagaatttcaattatatatattcaaacattagttattattttttttcaaacttatatgttcaaaagacagaataagtttatttatgataaaaaaactaattccagattatatacaaatcaatcctaatatttttgtatattagttccgattttcttaattcaaattttcaaatttttaattacagttgtacacatattggagtctcaatttaataatctctgtaatttaatttggaaatttattaataagtgctgagttatactcgatttgaagatacaaatttccatgatttaataattctgaaaatcgagattaatagactctgagacgtactcggtttgaggtcagaattagaaattattttattagcatatgtttagctttacttggtttcaagtttgaattatattcatttcgaagaaaagtttgaattatatcatagattttccatatcgttccaaaatttagaattaatcactgcctatttgttctcgtgtcgaaatattaatgttcagattcattatcttaggaggggacacatcccatcctaggttgagtttttttgacggagggagtacgtggcttagagcaggtacaatagcaaactattagccatctataaatatattttaatgaaataaatgttgagagagaagagcagcgagctatagatctgtagccagctacatcacggacttcaaaacacaatgtgtgtatgataggtgggaccatatattaatagcatagtaaacaactattgtataaattggctattacatacgctgtagatgaattggagctagtagtggactattatcttagcgatgaagagagttgagggacataaagcggactagaagttcacatggtggtctgctgccggcctaaagaaaagcccatgttaccaccagcccagcgtatccggctactgctttgctccccgtcccccccgtctcttcctcgtgagttcgcctgccgcctccatcccgcgcagcagcgccgccgccgccgccggcgacctgcttcttcagacgcatcctcgccggtgagcgcagcaccaccctccttctcgtctttccattacccacgacttctctccttgcatcaaccttaggcttgcttatcctagatctggaagctttttaatttctctttgcaactaacagcgatttgtttccgaaaataatttgggattcagctgaaatcctcaccatgtcccacgtgaggtcggcccctgcgggcaagtccggcgggggcggcggctccacgccggcgaagcgcggccgccccttcgggagcaccaccggcagcggggcggcggccgcggccgcggcggctgcgatcggcgatgcggcggcgccggccgcgctggttgggccgtccctccaagtcctcacggcactctccggtgagtgagcctctttcttcgcctgcaagtccgcaacgagcttgtgatgatgtctagggcacagctttggagacgactttgttgcgggaagggggattagggtttttggtctgctgattatgtgccttggtgttgaaattgaaattgggatgctgaatataccatgcatcgaggatttgctttattggactgctgacctaacagggaaatagaggaacaatgtttttagttttgaataaggcattgcttcgatttttgtcttatgaggagctagatgggactggtcgtcaaattggccgtcaagaacggcgtgatttatgggtagtacactggtaatcctatgacgaacattggaaacaatggggacaaacaatcgtgctgtagttgtcttcataatttcagatgcagaagggatggcttgtatagtttctttacctatattttttccctgttcatattggttcattcaatagagatgctacctcacatgtgtcatgagcttgaaatgcacatgcactccttttttctgcacacttaacatgtactgacgacatggttactaagaaggagagtttatgtttctttgtggacttttcagatcagaacaataaaagaattgttcttgcattgcaaagtgggttgaagagtgagatactatgggcattgaacgcccttacagtactctcatttaaggagaaggatgatctccggcgggatacaacacctcttgctaaagttcctgggctcttggacgctctccttcaagttgtaggtttttaatgttaacttccccccttccaatttgatctatatgttatggaatgatgcatctcttctgaagccaaaaatcatgtttcccaattcctctagcatgcattaattgatcaatttgaatcagagttcattttagaaaatgattagtcaatcaatcatcaccctattcattttttatggtggacctccgtactgttgatgccaccagtggccgcagccacctgttccagaccaggaggatcaggaaatggattgtgagactgatttatctttactttttgttcgcaaatattctttcgtttaatctgcagaagttgttaggcaatcctcctacttaaggatgggactatcgctacttgaaggcaaactagaataggtaccctaccccctgcttctctgcgaacttccgtgtacctcctgtcttcctcctgcacaatggtgcccaagcgccatggtccaggtctccaggatcttggcttcctgcctctcactcctattcccttgccaccagaatcttgcccacaatatccagacactgatgaaaatgtgatgatctcatgcaatatccaggactggcattgttgtccactgtagccatagaaacgtaaataaaggttccgatatttgcacttacacttaattggttggtggccaaagtatcgctttatttaattggactaccgtgcttctttgatatgactaaatttgctaaataactaaattttttaaacaatgcactgatcaattttcatccagaaaagaaatgatatggtgatcatgtacggatacgcttattaggactttatttctgcattctgtttgatgcatttccattttgtacagatagatgactggcgagatattgcaatgcctaaggatcatacaaaaccgccaagagtaagaacattgggtgtcaatacaacactctccggctttggtcatgagaatgttgaaaaagtctactcagacaccatcatgtatgttgttattagtctcatcaacatcttcacctcatttttaatgagttaagcagcaatacttgtatttttctgaaatacggtatctcagtccttcagatgaccaaacaaagacagctgactccactgtcacgaagaagcgatctgcaggatttttgtttgatgaagagggcctatttaatgttgatgacgaaggacgaacagaaaagcagcagtgtgctgttgcagcctccaatataattcgcaatttctctttcatgccagaaaatgagactgttatggttcaacatagacactgcttggagactgtatttcagtgcttagaagaccaaaacactggtaaagttccaaattcaattatattctattttaaaaaccataaattaatatggaaatgaccgactacctcttttggttgtgttgtgccataatttttgcttttgacaggagatggcaggggataatccagctgtaatgtattaaaataagttaaaagagaattttacatagatctaaaggatataaaaaaattaccaacaaggaaaactttatagatagcaagaagtgtgttgcaaattattctatccaattgtctagggcaattcaatttcaagttgatgttaattgtgtgctaaatcaaataagttatttatcctaggaccaagttatgataacatgtaaactaaccttctattcatttttatcatgtaccggaagattatgagctcataacaaactaactttttatgcatttttatcatgtaacagaagatgatgagctcataacaaacatgcttgagacccttgttaatctagcacctgtcctggacctgagaatcttcagctcatcaaagccatcatttattaaaataacgtgagatcaaacttatgacaagttcttttcattttgttttcatagtgatgcctgatgctttactctgctttttcaccaataatacagtgagaaacgtgcagttcaatccataatgggcatgcttgcatcatcgattagggtgtggcattgtgctgctgctgaattaattgggcggctgataatcaatccagacaatgaaccatttcttcttccagccattccacaggtaaatcatttttaacttctagcatattgtttcaattttgttgatatgctatggagatggaccgaataaagctattcggttgtggatgataaaattctgtactttacattgctaaattttcatacagatatacaagagactagttgacctcttgagtgtgccagcagtcgatgcacaggcagctgctattagtgcgctgtacaatgtagcagaagtgaatatggacttccggctgaagcttgctagcgagcgatggtgatatctccttcattctattagatatagcacactgatatgagaacttaaattcaaactcttaaatttcgtattatttgaaccagggctgtcgatagactccttaaggtcgtgaagacgccacatcccgtgcctgaagtttgtaggaaagcatcaatgatagtggagagcctagtctctgagcctcaaaacaggatgcatctccttgtccatgagaatacttttgctgagatactcacgtcggaagggaaatactccgacacatttgcaaggattctatatgagctgactgcaaggccgagcaacaaagtgacagcagggcaagctatctgggggaacataaactgatgcatcattgtattgttaaaatctactagataagatgtactttagtagcttaggtacctgttatgttgaaaatgccttgggtttctgactgtatgtaacaagcttttagctgtatttagttgcagccttgcaagcttacattttaacgccttgatcttccttttctgaagtactacacttgcttccagagtttcagagtactatctatgatattttttgttaggcttggaatggctggtatatattgtagcatgttggtgttatgaatgctgctggaattttctgccaaatcgttttgctgtgcctagaatgagcaatagtctggtgtttcagtgaggttgttttgctcggctttctctgcagcccagcccgtggacaacgtctctggcaacaagaagaggccgttccggtacaatggatgttgccatgttggtatggatgccttcattttattttataccagtactactagctgtgaagtgtttgaagaggtcgtgtgtactcgtactctcgagtgccaagttgaaattttttcttttctgccgccaaggccaaaggggcgcaacttgcaaggaatctgggatcgttggttgacatcttaatttaaatatgttactcatgaacttgggaatctgggattaagataagataagcatacacgctccactaaccaattcaacacgctcactcattagccgcttatattgtttgggtcaagctaactgatacatctcctacggaatttcacatccgtgaaacagttgatatctcaacctggtaaaaaaaaactctatatctcagcgacgcattcataatcactacaactaatcacataaaattgaaaaaaataggtaacaccagagctttgtatagggcctgttcggctgcctgtgctacggctgtggcgcagccagcaccaacagtttcgcacacgcacgacacagcctcagctttagcaaccgcagccagcttgccgaccagacccataatttgctctgtttggcttaccttgctttttcttagaacccaaggtgattttgaattttaactttcaagaatgattttggctgagtttttttactcatcttttagcacctgtaaaagggagatctggacaaagtaggtggtgaagaaaacactctaaaattaatataaaatcaaaacttaaaatttaaaatcaactgtgttgcagctctcccatgatcaaccatcaacattgtcaatactaggaaacagcctggattaaaatggtagtctgaataatcataaaaataaatcctcagcgcttgttccaacctcagcacaagttgagcctaaattaaactgctggttttgttgaacgtgaaatttactatccaataattagcaagtgctccggagtgtgactgatcccacgtataccaagtcatgctcatgcttgctgccggtacatacattttttttttcttttggcacacactgtaccaagccgggttattgtcttgtcaggctagaaaagaaaaattaatcaactaagaccgacgactcgaaacatctatatatacacatccagtacaagcatcgtcaacaccgcatgcacaactactacaaccaaacaaattaaaccaagccatatcgatcgaattatcggtcaagagatggcagcttctgtcacctgcaagctacacccagggcactcgctaacgaggcaccactacggcggcgaggagggccatgcctgtgtctgtgcactgtgcgagcgcatcatcgccggcgccggctacaggtgcggcgagtgcggcggcttcgacgcccacgaggcctgcctctcgctgccgatgcgcgtcgcgttcgtcgggcaccccgcgcacgagctcacgctctccctcctcacggccagccggtggtgcgacgcctgcagggtggcctcccacgccgggcgctgcgtgtaccgctgcgtggcgtgcgacttcgacgtgcacgcgcggtgcacgtcgctgcttgacggcgagcagcagcatggtaggaagcgtggggtggcgaggcgcgtcggcatggcggctctcaggatggggttgttcgggctgcgcgtggcggacgcggtcaccggcgggttcgggtcgccggtgatcgaagtcattgagacggcgcttaatctctagacgatcgaaacagtgcacgcatgtgtgcgactggatttttttttcctcttctttgcgttaactgcaccatctgcactgcaaacttccacctatcacaatgtgctcacgattcgatcacaagtcgattttctttttttttttaaaaaaatgtagccgctggaagatttgtgcatgcaactatgctgtactcccttcatccgacaggtcttcggtgctgtgtgtcacactctcactccagcagctagcagtcgcgttgtcgaggtgattgttacggtctttcgtgttagcctttctaagcccggtagccccgtgcggcccaaaaaaaggcccaaccacctcgtaccctaaaggcctaaacatagccagtcggacgccgcgtcgcctcccccatcgccggctgatgccgtccttttcctcgcgcgccgctggtcctttctccagccgcgacccgcgaccccttccggcaacgttgcctgcggcggggagttttaccacctcgacgtattttccttcttctccgaacggcgtcccgatgccagggaattcaggctattccataattcgtctgttatttaatttaggtcatatttgaatgaacttgaagcgaaaaacgtccgagtgtctttcggctagctcaacaaagtggtggcacaactagaaaaatctttttttttgcatgcggccaaaaatcatttttccaggcagggaaaggtctgcctgtatataaacgcctgcgaaaaacatcgattttcgcaggcagccgaaaatcctcttgatgaacaaaaaaaatcgctaccaccccccacccgtgctgctactcacctccggtcgatctagggttagggttttgggaggtcgagggagaggaaggggaggtgaggggaagcatagccgctgctgaagggctgccaacgctggtggtggggggcgccgccgccgccaccgccctctcccttccttcggctggatctaggatggagggaaccgccgctgctgccctcccccggtctccatccggtcggatctgggaggggagccgcaccgggtgccgccgccgccccgcgccatggtcatccccgcgcctcgccgccgccgccctcccccggcctccctctggccggatctgggaggggaggggagccgcaccgggtgccgccgccgccccgcgctgtggttgtccccgccaccctcccctggcctccctttggccggatctgggaggggagccacgccgggtgccgccgccgccctcccccctcccccctccggctagatcagggagggagggaggggccggaggccgccgcggccgccatgtcgcgagggagccgccgctgcctccggccgg

SEQ ID NO: 64250 - DNA, 11278 bp, Oryza sativa
taacggacgagaacgcgccgcccaaattccgcgcctcgtcgacctcggctccggccaccgatcgatggctctgccggtgaccaccagggcggcgccggcgatgcccttcgcgccgcagccgcgcaccgccggcggcggcctcctccggcgaccgtcgccgcctgccgccgcgctgcgcatcgcgccgcccctcttctggccgtggcagaaggtcccattcgcaacaaacccctcttgatacctgcatgattacactagttaaattagtctagttcaaattctgctgcacttcttggagatttgcacggccagttcgtgtgctgtgaaagcttaactctaccgtgttgtcttcttaattaaggaggcaaactgttttggtgagcttgtagccatgtacagtagaactcaagctgcagttttttttttttcttcttcaagacagtactgctactacattcaaggctggaacagagccacagtagcttttgctcgggaggccctgcagtaggtttactgattttgtgacatgacatgagctaaatgtactacaactttgccattaaacaagaacgcaaagtaaatgaggcaccagtacaagcctcatgttctgtctgaatgtgcacaacttttactgaccgtagatttcgtgcctccttgagcacaaaccacaagaaggatccgatgaccatgctctctctcccctaccatggagctatctctagcaaagaaccaggaatgtgattagattagtagcactgacagtctgctcctttttggtaaccagctatggatcaaacgaaaattatttgttaatgtttatcactgatgctttcgttcctctttatcgaagtcgagcacggaaacccaaaagttccacgctgtgtgatttctgttggaaataacgagctagatgcatggcacaagtttgctgttgttgccatgcatgggctgtgcttattttactcaagatgactggaaagctactgacattgtgttcgtagactagaattagttgatgctatctgacaagaggaaaaatcaagagcaggatattggcccaacaagctttgtattcgcccctaaccaaattctgtcgaacaactgacacattgaaattcagactttctgaaagtttcaagtaggatcggcatgctaagccaaattgtcaaatgtgcatcttgttgtgctcatgtttcagtctgaagtatgaaccataacatgttacagtttctgaagaattagatgttatcactagtacatgaagttttcattcataattgatcagtgaaatcctttgaaggttatatttttgttgataaatataggtgaaagtcggtcccctttctgtttcgcctatgggatttggaacatgggcttgggggaaccagctactttggggatatcaagaaagcatggatactgaacttcaggagtgtttcaatttggctctgaagaatggcataaacctttttgacactgctgactcttatggaactggaaggttgaatggtcagagcgaaaggctcctcggtaaatttatccgcgagtatgaaggttagcctagctagtaattcagaataatttcttaaattatgggatagtgtttctttggggggagtttgtctagttgaaatgacttcattttccctttttgtatgacagggccgatgaagtcccctgatgatgtgatcattgcaaccaagtttgcagcatatccttggcggctaacatcaggccaatttgtcagcgcctgcaagtattcttccaatttgtttgcttaatgtacatgaaccatatttcagcttgttccgtgaaatttttactccatccaccaaccacgaatgtgctgaaaaacatagagctaactgaatattgaacatataactgatacctataggcctctagcgtttaggtgacttacatcagtgccaattttcaggtcttctttggaaagattgcagcttgatcggctcgggataggacagctgcattggtctactgctaactatgcacctctgcaggagcgtgctctttgggatggtctagttgagatgtatgaaaaggtcaccaaacttccgattgtattgtcattgttcaatgttctgaatcccaactgtatattcagctctacaaaccatatatatctcagttaggcaaatcatatctcagttaggtacacggacagattctttggatgaagatattgtcctcctttacgttcttgatttcttagaaatttgactgcaaaatggatttcttgtagggtttggttcgtgctgtcggcgtcagcaattatgggcccaagcagcttctgaagatccacagccatctatcatctagaggtgttccattgagctcagctcaggtaccttcagaatgcccatacatcttgtacagttgtactcattcagtatagctgtaactgaaattgtcatggaatgcaggttcagttctcactactgagcatgggggatgagcagatggagctgaaaactgtgtgtgattctttgggcattcgtctgattgcttatagtccacttggattaggaatgctgacaggaaagtatactacttctaaccttccaagtggaccaaggtaacgactaatgaccaaaggaagcagacaaatatttctctctgaattttatgacaattgatgacggaaattcagttcatttgttctctggtctgcaggtctgtgttgttccggcaaattcttcctgggttggaatctctgctgacttgtctgaaaagaattgcagaaaggaaggggaagaccatgtctcaagtaagtattgctttccaagagcaaaatgacctgcataacaagtgattcatgcatagatcttgccaatctggcttcaaattatcggaacatttcatcgtatgagtgataagtttatttagctcgttgcaatacctgaatgcttcagagatgcaacacatgaagaaaactgacggtgacactgtgatctgaactcaggtggccataaattggtgcatctgcaagggcacaattcctattccaggtgtcaaaacagtcaggcacgtcgaggataacttgggagcactgggctggaggcttagccctgctgaagtttcagagctcgaagctgcagcaatggagtctccgaagagaatggtccagaacatattccaaactgcatgagcacacatatatataaggatcgctccaaccatcagtaattcagtgagagagaattagaagtgtgcatttctcctaattgagaattcatcactgtaaatacatattccagccaagtgtttcagtctgaagaatatatatagactgtgacacgcacgaagtgccataatcttactgagaaagaaggttgctgcagaaacattgtccatataacatttcaccagcttattccaatacactcagtttcccagagaacaagcagcttagctgtgccattcaactatctgaaccagagcgatcagatagtactcagtttaacagcttaaaccttacttataggtagcactagtaattacataataaactatatatacaaaccagcaacacggggcagatacaacaaatcggatcgtcgctaatgcgcaccatcaatggcggggctcgtgacgtcacaccttgcagtacttggcggcggcgtcgcggtcgggatgctgctgctgctgctgctgcatgagcgagagcgcgcgctcgaactgcgcccaccgctgctcgagcgtgccgttgtacccgacggacatgcggacgaggccgggggagatgccggcgcgagcgcggtcctcgggcggcatctcgctgctggtgctgctgccggagcacgacatgagggtctcgtagtagccgaggctgacggccatgaggccgaagcgggtggtgttctggaggtggtgcatgaggcggttggcgcggtcctcggtgcccatgtcgacgcagagcatgccgccggcgccgtagcccgggttggcgatggcgaggaggcgggcgtggtgcgggtggtcggggaggcccgggtaggcgacgcggaggccgaggcggcgcatccgggacgcgtactcggcggcgcgccgcgagtgctcctgcatccggagcgggaggtgcgggaggcgctccgagagctcgaaggccaccttggcgttcatcgtcgggcccagcagcatcagggccccctcctgcaggtccatcatcgcgttcaccaggctcgccggcccacagatcgcccctggaaacaaaatcatccacgtaaattttacatcttgcgtgtgtgatatacttcctccgtcccaaaaaaattgcatttatagctctaagattttatcccacaaaaattgtatttctagccatgtggggcccagcaaattgattcatctagataagtttccttaagttttctcagcttgtaatttaagtatgctaattatatgggttaattctctcaaacttccttttaatcatttgtatatatggaatgtgtgcatgcaatgggtttattaaataaggtcattgtggtcattttccaatcctactgttttgtcctaaattagctagaaatgtaattttcatgggacggagggagtatcattttacacaggcttattaatctcttgcgttgcgttgctttttttttaaaaaaaaaactaggagaaccaagcttgttttgcgtagctcagctgcacgagcaaatgtgttactgtgacagatcttcgtgtctatagcacgtaagcatcatatgcacttgatagtgtagtagtaatagtgtgtgtttttaacaccgaagtctcgtgtttaattctcaacacgtttataatttttcttaaaaaaaatatatttctgtcaacatttcatcgaagtcgaaataaagttacaaatatggagaattcttgatgtatcaaaaccgatttcataaagctaatataataatgctattgtttctaaccattttcatgccgggtcaggcagggtgcaacgaatcgggggtaaatgatatgcgctattgaatcacgggtgacactgtggcgcaaatgagcgccacacatcggcaatgattcatttgatttggctagacgtacgacgcatgcgaaaaaagcaaacaaatccgtcatttagctccggcgatccagggccgtccatggtgatgggtagcttttggcttggcagacatgcaacacatggtgggtgcagtgcaaagccatgccaaatgggcagtaggttccgacctagatgggtcaccaccacgtcaatctgactcactgccttgtccgttccgcctcgcgcgttgtcggcacgtgagacgggtggtaaaattcttactaccaagaatccaagatttaacctagtaggagtagtagtttctttttttcgatggattaaccttatagtaatttttttcctactagtatgatgatgaattcgtgactcgtgctactacatacttcatcatgttttttcttatgtaccattagcacttctgcgagatttaattgccgcacgtgtgctctattaatcctaatctattccgggggaaattaaacgtagagtaacaaataggggtacgttgtccgtatcctagtcgcgatcaccttattaattaattaattaattaattaattgtttatttagcttaatccactagaccccgtgagtatgagtcatgacggcgcaagcctcacccaaggcctggggctggcacgtgtttgggcggctttgagccccagctaccttggaacgacatggtaggtgacagtgcgatacacgagtggcacacgacaaagacgtacacgacgacgacgctgatcgtgcacgcgcgctctgatgctcgcgtacactgccgctaacgtaagagctagcctctttaattgagcgtgtcaagcgtgtgtatgtgcatgcaacacgtcacgatgatatagctaaaaatggagaacggctaaggcgtccggcgtattcgtccttacctgcgatgatgtcggcgccgccgctgatgaacttggagacgctgtggacgacgacgtcggcgccgaggcgggccggcgagacgaccatgggcgtgaacgtgttgtccaccaccagcttggcgccggcgtcgtgcgcgacgcgggccagcatcgggatgtcggccacggccagcgtcgggttcgacatcgtctccacgtacaccacccgcgtctcccccgggcgcaccgcggcgcgcaccgccgcctcgtcgtcagcgtccacgaacgttgcgcgcaccccggacgcgcgcggcaggaaccgggacagcagcgcgtgcgtgccgccgtacaggcaccgcgacgccaccacgtgcccccccgcgccgacgagctgcatcagcacggaggagatggcggacatcccggacgccgtgcagtacgcggcctcggtgccctccagcgccgccatctgccgccccagcgccagcaccgtcgggttgaagtggcggctgtagatgtacaggtcgccgcgctccgggccgagctccccggagaagaggcggcgcatggtgtccggctccatcaccgtgaacgtcgccgacgcctcgatggacatgttcaccccgccgtgctcgccgaactcgtggcgcgccgcggccagcgccgccgccgggtcggcctcccggcgccgcgccttgggcttcccgtcggcgttgccgttgccgttgctgctgttgtcgtcgtcgttctggaaggggcgcttgatggtggcggtgacgagctcggaggcggccatgacgtgggccatttgggatgcgtgtgtgtacgttcgagacaggagagcgggtgcggcgtgtctgtcgaacaggagtcgcgggcaatttatagacgggggttggatcttctgcggccagaaaagaagggagacgcgtcgctgtgacgtggtgtgtgacggttaggtccgcggctcgtggaggaacggacggctgacactgacagcctggggcaatgaaccgggcccatttttacggccaggggggagaagggacaagattagaacagtgtaaacaagcagcatttacgtggaaagataacgtaattcaattactttaattcctagcggatatacaggagtactcctggagtagaatttttcgagtagaaacaagctgttcttaggctcatttctttttctcaactccaaacttcaactttctgctttttcgttagtatattttttaaaatgttactttaattcctagcggatatacaggagtaagttggtactcctggagtagaatttttcgagtagaaacaagctgttcttaggctcatttctttttctcaactccaaacttcaactttctcccttttttgttagtatattttttaaactgttaaatagcacgttttttaaaaaagtttatgtacagaaattgtttaaaaaatttaaataaatatattttcaagtttataattattaatgcttaattaattatgtgataataaggtttctcgttttatgtgccttaaaattctgccttcaaaacggtcgatcgaacgcagccttaaaaagaatctcaaaactcttacaaatactgatgtagcatgctatgttaaatctaaattttctgtaatttttatcttattaaatcaaaagatggataacttgttctaattatctacaagagctttataagatagtttttcaagaaactttatttttttaagtacctatagcagtgttttttcccctgaaatggcaacatgacggatcaatttagccactagagcatgtccactgtataattcctgaaggaatcttaaggtgagacccacttacgtcatactagcaactactccattcattctaaaatataaaaagttttgtttgaatgtggtatattctagtactacgaatctaaacagataacatattcagattcataatattagaatgtatctctttaaccaaaactccatatatttttagcacggatggagtaggagataaaaagtccgccaatgtacgaaacccgcaattgatccttatcgtacggatggatcagcaaatatgtgtatggcaagtgggcctgaagattctccctgctttacaacctggtactgtactatgcatgacgccgactccttcctttggagcagctagcaaaaatagtgcaatatatgggaccggaccggttcgattgtcctctctccttttgagacctctcaaaatccataggaagtcacagggaacgtgcgtacacctataggtccagtgcactttgtcacggtgaaaagacgggcaagttcaatgaaccaagctcgatcactacaggcctcctacccccgtgaggtcgtgactactactggtcaggtttagtctaaattggctaccatgctaactttggcacatcatataagcctgtagaaaaggcagagttctaaacttctatgtcagggcagttctgaaccacagaatcatcatctatcttgttagctcaaatttcaaatgaggccttgaatcgtttccaaatttggatggaaaagacggcatatgaaagccaacatgaatttggatgctgcattgaccaattgtagttatctagtaggtggatggatggcgatcaatccataaacccatcccttggtgccaagcgttttgactaaacctcgcttgtcaacaaggcaaaattgctttgtactactcttttccaaatacatgggtgtgttttatcaaaaaactaataaaaatacacgggtgtgtgcatgatgcgcacaggcattaacaggttcagtgatcagtcagatcagatctccagggctgcctaatcatccagttcttacaaaatttggagccttgcatggattaaacatttactaatatctgtgacaaaaagagcacgtgtaaacggagatgatacttctaaatttagattcaggagtcaggtctaaagtggagttgtgatctgaaattatttatttaagctccaacttcaagagaggtagagctagaggtggagctgtgctaactgccaaataaaccattattaagattttatagctttaaaattttaaagtccaattaacaaagttaaattttgaggaagccaaagattacttcgtccgtttcaaaatgtagttatttttgaggttggcatgagtattaaaaaaagtatgtgagaatgattggaggaagtgtgtaattggttaaaaagataaagtaggtgaagaagaatagttattattggttgagataatcaagtaggtggagaaataatttcattttgacaggacattgagctagaaatagctactgtagtacattttaagactgagttcggtgttaaaatttttttaagtatacggacacacatttgaattattaaacgtagattaataataaaataaattacaaatttggactgtaaactgcaagacgaatcttttgagcctaattaatccgtcattagcaaatatgagttactgtagcacttatagttaatcatggcgtaattaggcttaaaaacttcatcttgaaatttatatgcaaattgtgtaattattttttttctgtcacatttaatgttccatgcatatatccaaatatttgatataatggagaagtttgaagtttttgaaaaaaaatgttggaatctaaactgttcaaattgcagctgtgggcttgggtggtgggcagcttgggtacgacgatgaaactttggaactcaccgcggacgcaaaagccccgaagcatcgcgcggcggaaaacacgtggagccgggcgtggcggccgctttatccgcaaggaatccgagtatccgacccacgcatccggcaatccgcgacattgggatgtggtgcggtgcacagggccacaggcggccagagccccggaggcccggaactccacgggtttaggatatgatttgtcatcgtgtcttatcgcatcatcatcaccagcgttgcatcgactctcttatcttttccatcttctagtagtatttcttttcctaaccttttcattatggcatatgtggtgcactattttatactcctgggccctggctaggcaaagataatcccagtgccggtgtttgtttgcgttaattaggtgtatatgatggacaaaacacgttatcgtacctaaacattctggattctgaaattttgatcttcattctgaattctgaaaggagacagcaaatgaagatctcattgttttcattatgtagagagcaagagaggaacttgtacaatagcagtgaagcaagcggcctgtcaagtgttatgtcaagttgtcgagacccactcaaagtattttgcactgtggagcatgtatctttattggggcttgggcctactccctttataaaaaaaaatctttagaattgaatgtaacatatcctaataaaacgaatttgaacatagtcatgtttaaatttattgtattgtgacgtgttacatccagtactaacttgatttttatgacaagagggtcatcaagtactacccgcactgctatatcgcactaataaaagatatcgagcctgccacttgtatcccgttctgtcggccatttgtcctaatttattcaaacccttttttttcaatggaataaccggtgtatctaaagccagacaacttaacttgctttcatgagaatggcactgaaggatagagtggagtgaattagcacatgcttatcagataggggcacactagtacggacttcctccgtttcacaatgtaagactttctagcattgctcatattcatttagatgttaatgaatctagacatatgtatgtgtttatattcattagcatctatatgtatgtggccaatgctaaaaagtcttacattgtgaaacggaggagtaccacttagaatgacgcgatacacgttggaaattacaaaaatcgaacacaaccaactacttccgttttatattataagtcattaatttaattttttttcttagtattttaaagtttgatcaagtttatagaggtatatactaatattatcaatacaaaacaaacatattatcataatatattcaatgttaaatttaatgaaactaatttgatatagtggatgctgctatttttcctatcaatttgaaaaaatctaaagaattttgactaaaaaagttaaataattaaaaatataaaacagagggagtaataagcattcataattcaagcaggaccattactttggcagattcgattcgatcctgcgctgttactgtcattctcccgtactactactgattaaggcgtgctttttgttggaattaatgaatgggccttagcccactcgaagattaattctttggaaa

SEQ ID NO: 64251 - DNA, 16768 bp, Oryza sativa
  unsure (1)..(16768): unsure at all n locations
cccactttttatacacattttggtatgtgaaattacaatgcaagagagatatcggtagatgaacactgtaaaactatgtctttggatgatacgaaattcatatatgttgagaaaatatagggaagaaaattatttatttactgaagtttgactgctttaccacattatgaaattgacttacattttagaattttacacgtttttataatactctctttgttccagaatatagcttacctttaacttaactatgaaataagctatgaatttgaacaagtatagaaggtgttcagatttataggtaaaagtagctatatatttgagacagagggagtgacacacgctcacatcacattttttggattttttaaaagcatatatttttactatagccttttggaacaaaggatttatgcaggaattttgtaccatcctgtaagaaaatttcctatatggccctttggaagagaagactgtagcttttcaagtaatgtaaaattccaagttaggaataatacatagtgtgaggattttggaaaaaaaatagttaccatgaggtcaatttcttgaaaaatatatttgaagtctatttatttcatctaatttctttgtttttttctatagcctattcaaacggttattcaaatatcccttgttcttctatttgtgtgttttgccatttttgtatttcaaataggcctaagtgttatgcacgttttcattgaattggtgcttgtatcctgctagttttttttcttttttatttattttaaatcacttctaaatttcaaattcacataagtatatagaggcttttggagctattttgtgcagaattaaattccactcttcagttaatatatgaggcacatttcagattctttgaaaaaaaacagaattttagatgatctttcactggaaatacactgtttgtacagtttcaattttcgagagcgattgagcacatatactccctccgtcccatagtataagggattttagtgggatgtgacgcatcctaatactgtgaacttgtctaaatttatagtattaggatatgtcaaatcctactaaactatattcaaaaagatcatctcaagatttattgtcgatgggtttttctcgagtggagtagaaaaacaactcagatttgtttcactgacgtgtgtcccgcttggtagtgagcccatatattactggctcattttagagggaagtagtatacaaatttacgttttgattgagacaaggaaaaaatcgagaaaatacataaaacgagataaataattaagtattaattattttttattagaagaccatttaacggtttaaaaattatgcgcaccgaaactagagactttctcctcgtccccgaatagagattatactatggttaattggcgatgtttttgttggagtggaggagtacaccagcagtacaaagttgatgtcgatttccggtgcgtgagctcagctccctcataatttcagtacctgctacactaattgcgcaaatttctcgaagtcacgtcaaatcttttggggtaccatagcgctgaccataaatcttacaccgcacagcacacgaggctcacactgtgatgaatgcatttgtgtttgccagggtgggtttcaaattcggataaggctttccgttcggtttacagaattgaattgaacatgatgaattgcattgcggtacaagggatcctctggaacgaacgattgttgaagtaataacgttttgaggaagggtgtgtttagtttacgttaaaactagaagtttggttgaaattggaacgatgtaacaaaaaagttagaagtttgtgtgtaggaaagttttgatgtgatggaaaagttgaaaatttgaagaaaaagtttggaactaaactcggcccaaatcctttgaattaaggctgtgtttagttcagcgtaaagtttagattttggttaaaattggagatgatgtgactgaaaagctgtatgtgtatgacatgttgatgtgatggaaaagaagtaaagtttggatccaaactttggatctaaacacagcctaagggttaattcgatccataccattgcaactttatcaatttacaaaaaaaaaaataccattactgttcacgatatcggctgagtgtcactgaaattttgcaaaattaaaaccacgtcatcgccatcacattttctattcccctttcatcttctttcttcttccttctctttgtctcttctcctccccgtgtgccactcgtgcctgcgggtcttcgatgaaccaccgccacgcctgttgctccttcccccacctccccggcatgctcaccggccagtaccaccagcatcttcaactcctcctcgcgcaagctccgacaagactggatccaagcgcatgtgcttctcggccgatgtcaccgccatcttcaccacctcctcctcgcgtgtgctctgaggaggctggatccaagcgcccccgccatattctcttcacctcatcctcctcgcatcagctctagagaagctggatctaggcacgcgtgctccctgggcggtgtcaccgccatcttcaccacctcctcctcacgcgagccctgggaggccagatccaagcgttgcatattcatcacctcctcctcctcctcgcacgagttctgaggaggctagatctaggctccgccgccatcgaccggatcctggcgccactgcaatgttcaccacctactcctcaccgctaatggagaggtgatggtggtcaccactggggtcgctttctactccacctccatgttcttcatgggcatcggctgttgccctcatagcttactgctccgccgtccctgacgttgtcctcaccgcgtgatccctctctgccgttgacctctcccactccctgggctttggcagcggcggccttgcccacttctccggggctcgctggccggcctccgacctctctcactccctaggctttggcgccgctagccttgctcgcttcgccggaacttgctggttggcctccttgcagccgaccctcgacggggagaagaaggaagaagacagaagggatggaaaatgtgacggcgatggcacgatttcaattttgcaaaatttcgatggcactcagccaatatcgcaaatagtaatggtggttttctaaatcggtaaagttgcaatgtgtcggagggtgaactcctcaagcggggggcagagaggccctccttgttagttcgaccaggggcagcgggtgaaaatcaagaacttggtggaatgtgtggtgtagagggcctagggcccctcgtgagcaatgagacaaaagtggtttatacaggttcgggccgctaagaagcgtaataccctactcttatacttgattgatcgaccaaggaatataggcgcttgaatcaatgagaaccaagcgtgagttagccaaagaaacgatctcccccccccccaaaccaggcctggacctccttttatatctcaaggggctgccacataggcctcgaaacctgcctaggggagagggaggataattacattaaatgcacgtcttgttgcttgccttagaagccattcacacaccgaccatggcgtggggcctgtcaattccatccggctgacacgggggacacgcatgtcattcactatttaatggaggaagacttttgggtcctcacttgtgtcgagaaacagaaaccctgctctggttgggttagatgagttgactccggctgtgatgagaggctaaacagcctctcatcatcatgacgtgacaagggatgccaggtggcacaccgcctgacatgcaaccagtgcacaggcgcactaccctggtcacatcggtcattcgaccagtctcagaccggtcacagattggtcaggcacactacacgccgcataaaatgccttaaatgcggttaggtcggtgttgtgggcgtccacctaaccccgtacatgcggcgtcatgcggagggggtaggggcagcccaatcccctggcatggatggggtggccgccgccctacctcgggcctgacccccctcgggggagcgccgcgtgggtactagggacagcctcctccctctgagcttgataccaccggaccgtatcaccgacacaatgtcatggatcaaattaactcttgaattaaaggaatagccataaaagaaatcatatcaaatttctttggatagactcaaaacattgcaatattggaggaattttgatattagatccaacctcttggaaaaaatattttgtttttatatctcttttcttattcgtgcatttttcatgtactctatctatacgatgattcctacattttttttctcaatcgataagatttggagtaaagttccaggatactccgatcctgtatttttcatgttcttatattttgatcatgagttccaaaagactaaactttccatcaacgaaaatccggtagaaacgaaagtgggttgcaattcaatttccctttttggttcacaagcaaattttcttcaaatgaaaattgttacatataaggatggtttggtttgctaccattgtggcaacatacattattgtggaagccaaacatggtctagttggcaaatttgggtagtaaaccaaacatggtctgttcaacttgccaacattttcgctaattgcggaagccctagtgatgataacatacatgaaacaattagacaaactttgatagcatagcttgaagatggaatagtgccacaaacacaaggcagctgcgggctgcggcagccgtaagctgtaggactggctaccgaacaggtccgatgaattctagaatttgatgttaggattttaggggcttcgttgttaggccctgttttgttcattggtgaaaagttgttgcgtgtaacattggatatatggacacatatttgaagtattaaacgcagtctaataacaaaacaaattacaaattccacatgtaaactgcgagacgaatttattaagtctaattaatatgtcttagcaaatgtttactgtatcactatattgttaaattatgacgtaattaggcttaaaagattggtgtcacaatttacgcgcaatctctgtaattagtttttttatctatatttaatactccatacatatggcaaaacatacgatgtgacccagtaaaaactaaaaagtttttgtttcggaactaaattgtctagttctccttagcgactgttaaagaagataaagtaaaaacttatagctaatctattgttaaaactcaaactttaaattcaaattcactttgagtgaaatgccagcgaaagtccattggaaagatcgtgcttgaattcataggcggaccttagttaccctggcttgttgacctaccagtgctaccacagtacaaagtataacacgttgaggccaagtttagatctgaagtttttcttcaaacatccaacttttccatcatataaaaattttcctacacacaaacttctaacttttctatcacatcgtttcaatttcaaccaaacttttaattttaacgtggactaaacacaccctgaatctgatcgtttgagctttattttttcaggggaatcgagctttggttaataggccgtcgagaaaaggaatgataaaactaaagtaatgtatggttatatttgtattatcaatggtttaacatgcaaatctgcagaataaaccacgatgaagaaagtacaaatcaatcaattataaagttttaaaatttaattttaaattttggctgaaatgaagagaggctaatgcgtaattaaggtcaaattcatcttaaatacagaagtaactgaaattactattttccatacaccatcatctattttttttaaacaccacagaaggtattgcaatttgcacatgccaaagtacagaaaacaagctgctactggagtaccgtatttttttttctaaaaaagcatcaagttatatgtaactaaggcctggtttagtccccaacttttccttcaaatttccaacttttccatcacatcaaaattttcctacacacaaactttcaatttttctatcacatcgttttaatttcaatcaaacttccaattttagcgtgaagtaaacacactcactctaagagtgaaccaatcactcttaaaaacttatcctctccatccaaaaactctaatctaattcaagatagaatatatactactacctaatcctatgaatacgtccagattcattagatgaggtaatatctcatttcaactatagattgagtttttttttacggagtatataccccacctgtcagatgccataccgccatgtcagactgcatgcggataagaacgtccacgtcggatgccacgatgccattcctgccacgtcagcgtcccccgctcctatactcctttaaaacccggtcccttctcctcgtcctcttcccccaaaattccacaacaaaaaaacacccccaaaaaagatcaaaaaaccctaacctccgatcgaatcatcgccaccctccgccgccgccgccgcccgccgtctccggccatgtccccgtcaatcgccgcctcccaggatcgcgtctcccggtgattactcccccgcgccctcgtctccattttcttgtgctggtatgagggccgccgccgcccccgatccgtccccggcgccggcgaggtcgatgctgaagcggctgttcgatcgccagctgctgcgcgtctcccccgccgagcggattgtggcggtgggcgggggggagaaggatgaggtggagccgagctccgtgtgcctggatggcatggtgcgcagcttcttggaggacgggagcggcgtgggcgcggctgtcgagcgggctggcggccatggcgcgcggcgctgcaactgcttccatggcggcgggagctccgacgacgacgacgacgaggacgacgccgccgcgtcctccgacgtcgccgagacgatcaaggtaggtggggtgggcgaggaggaggagaacgacttgtggtcttttattttacttttctccggtggccgcgccatggcgtgcaaggacactgacctcgccgcgtgtcgtgcaggggctcgtgcactgcgccacgctccgggagcgcaacctcctcgccgacgtctgcggccacgtggagcggcaccgggcgggcggggcaaggaggcgggagctcctcggcctggtggcggcgtcgctccgcgcggcggggcacgacgccgccgtgtgcgtctcccgctgggacaagtcccccacccaccccgccggcgagcacgcctacgtcgacgtgctcctcccgccggcctccgaccgcggcgcgcgcgagcgcgtcctggtcgacgtcgacttccgctccgccttcgaggtcgcccgccccaccaaggcctaccgcgcgctgctgcagcgcctccccgcggtgttcgtcggcaaggacgaccgcctccgcctcctcgtcgccgcctccgccgacgccgcgcgcgccagcctcaggaagcgcggcctccacctcccgccatggcgcaagcccgagtacatgcgcgccaagtggctgtccccctacgaccgcgagccagcgccgcccgacgaggcctccgcctccgccgccgcggccgaggtcgctggagaggaagcccccgccgccgcgtaaacaagaggtgccgcttggaattttcaaccttcaggagggcctaaatgcaaagttaaatttcttcgattttaacacttttttttggggaatctcgagtattttggggagtgagaagagtatgtattacgcgaaatggagacagcaatatgtagtgtagttttagtattaggagaaaacaagaagtacaaaaaaaaagaagaaatcttttggttaggatcagatcaggttagcatccacttttggtcccaaattaagcctataatatttcataagtagtagtactagctagaagcttgatcatgatagtatggtgagattatggccattaggctcctgtttgttttcatttttgtaagcaaaatgttgcccagcagacaagttgaggcgagagatgagtacatcatacacggagcttttgattttgatttggattttgagttttgatccccacaaattagaattgtgcaatattttgtaggattatatgtttaatatatacatgttttatgaactgtttggaaatgagcacttatattatgtacaaagatttgtatataatgtttggaggaagaccgaattggagggtatgcttcccatttaaaacctcttgagtctgaatcttttcagacaaattcacgccttcgttaaaaaaaggcttgatttttttgtttggcttcctggatataataatctacttaaattgaagtgattcgtgtaaactttacagtagtatggctcgaagtcaagctggtttgtggtctttctctcagtttctagaacagtctctagtcttggtttctttttttaatttaaaaaagagaacagttttagataacgacgaagagcaatagacgcaagataaacacatggatattatcatattactccctccgaaataataatacttgtcgttttagaaaagggtgagattaaattttagaatctttgattataaatcatttttaaaatatttgtctttcaaatatagtgattatatgtatagattcgtcttaaaaagtactttaataaaataatatatttgttaacacttttttacatattataatagaaaataatggtcaaagttgttttttttgaaaccgtgcccttatccaaaatgataagtattatcaacccggagggagtattagttttcatttggtcaaaatatattactaacaagggaagatttcaaactgttgaccatacatatatttatcattcagaaaaggatgtaatagaagttatagccaaaaagaaaaaagaaaaaaaaaactgaatcctctcacgatcaataaattactaacggagtgtttccccccactaataattcaaggtaagtggctgtcttatcacctaaaaggaatatgctttatgtggtgaaaaaaaaggaaaagatattctccatcatctctcttaaaaagttaagaatagagttttaatactactaaaattcaaggtggttgtacagtggaagcaaccaggtgccggttgttgcaagggagacaagggcaagtggcagatataggatttttattttctttagttctttctgttcgttttgtgtgccaaaaacttaaaaccaaatctgcatgaaaagattatctgcagaggttggttgggttggattagaggatggacctgtaggtttgataattaattgccatttgtttatccagtaggacaatcttgttctagaggattctctgtggagtttggactgtgccaattctagggagtcagacagatggataatgccaagctttttagagaaaaattacaatttctacaacataaaattagttttattaaatccatcattaaatatagcatatctgctttgtgtttaaaatgttacatttctctataaactttattaagtacaaactcgaaacgttttataatacgtaatgaagggtgagctcttttttttttccattgaagactgataggggaaaatgatatgaaaagaaagatggaattatagaccctttttgcccaaatcttattttaacattttactcacttcatcccaaaataaattttacacatgacaacctactactcatctcgcatagagtacaagaagatttttagggtgaacaaccgtagtactccctccgttttgaaataaaacgatctaggatgagatgagatatatcgtaatataacgaatctggacaatgtctagattcattatattaggatatatcctatccatattcgttataccatgatatatctcatctcatcatgagttgctttattttggatcgaagtattagaaaggaactgaaaaatgagaaaaaatacagctagtatgaggcggaggggcccttttgattcacggaaatagaaaaaccaatattttaatagaaatgcaagtgcaaaataaatgattgcaaatataacaaacaaaaataaccgtttgattggaacgcacgaataatgatagatagactcaagagaaaatttctaggaggttgaagttcttgctaaatttccttcaaactatctatatgattgtccgttccataggaatttaaagaataagatatgattcaattctttgtttcaaaaaccttcatagaatatttttctactatagagttaaaatccttcaattttttttatcttttcctccaaatcaggcccctttgattcaaaggaaattcatatgaatttttgaggatttcattactatagtaacttttcctatatgtccctttgaattaaagaaatgaatactatagaattctaatatattacctattcccataaaagttttagaaaaaaattaacatgagctaaaagctccttaaaagaattctttgagtttttaccgcttctcaaattccagtgttcttcatagggcctaatcaacatttctatgtttttctgtgttctacggttatctattttacacttacatttctaccaaaataccatgttttttctatttctctatttttcattcatgtgattaattaaagaggtctcaacatctactagtactactctctttgtcccatcaaaaatcaaccagtactgaatctatacatacatctgaccacattcgtcatactgtattttgtcttattcagttccaaaatttatttttttatagaacgaagaaagtagtacgcccttcccggaatcccgggctgtaaatcgctgccgtacaagtacgggagaggcgatgagatgatcacgggcaaggagcgaggagtacgacgcgtggggtacgtgagcggcgggcccgatgtgtcgcgtcgccggtgaccgctcgcctcgccctcgcctgaccactgtttttactcctcactccgccgctccatggcgggccagcagcagcagtgtttattactactgcgctgcaccgtgtactactactgcttctgctgccaaacgctgttgctcccgttttattgcacgccaaaattcacagctcctccgtttactcccgtcctaaccagggtgtgatgtgttgtttcagtaccttatcttcacattcgtgtgtacaaaagttagttttttttttgccgagtttagttccaaactattttttcaaacttctaacttttctattacatcaaaacttttttacacacacttccaactttttcgtcacatcgttacaatttcaactaaacttctaattttgacgtgaactaaacatacccaaatgttttaaagaagaagttaaacaacaatggtattgattttaacacagaaaataatttatcaatattttgtagaaaaagtataatcttaacttatacgacctttacatatttatactaattttttaataagacgaatgttcaaacgttatacgaaaagttaacggtgtcgtacataaatgaagtagtatatagcaatgccatgtaatcctagtaaaagaataaagtaaagaaaacgtagggcatcaatgaatcaattgtttagagttcagacaagtacacaatacaagttatatgtacagcgctgcagctactcggagtcgtcgggccgctgtcaatccttacattgggtccttttctaaataggcattgatcactggattgatcaaagataacacggcagctagattgtgacgtccgatgatggatcgatcggtatgcacggagaaactttcctaagtatacttgtttcaaaaattcaatgggaatgtacaattctcccatatatgttgtaagcttaaactgtagaggctaaacattctcccttctttgtttatttttcatcacgaaaaaattgcaccgcctgtgggttaattttcaaagtgagctttcaaaacaattgaaaacagtttgcgagcataccttaattgggtgtgccagcaagagagttcattctcacgatcgatgagacaattttttgcagacgaatggtttctttcaaatcctacatggaatagttggattctataaattaaattaaatctttataacaaaataaaatgaaccaaggacacgtttcccaagaggtgttgtgtcataggagatcattagctctagattgtctctatgggcacactccctgtaaggatattagaatgatcaactatcgcttgaattaatgagggaaaagaaacgttgcagataatccatatattccaataaagccccacttaatttaaaggcttcgtttcatatgaagtttgcacatttgaaggccaaaggaggggcattctgcagaatttgtggcaaccatgagtaggatcataaaaaccatccaaattaattaaaacgagatgtggggcattcagaactggtggagagaacaggataatgacatcctctcagttggatctatctaccagttacatgcacatggacagaaaaccagggacagaatttttctagaaatcactaaacaaacaaaccttccatgattacaactaattaaacaaatatcaaggattggttagctagcagcatcagttcagtaaacaacagtccactggccttgttgttcagttggttgagtcgatgagctatcacatgcttttgctgatgagactactaatctatgggtttcggatacgattaatcagcaattaggagtagcaccctaggaggaatcatgcatagtttactcctaattatgttgctttagttgagacctccaatcaaccaacttgctatcagtggccaaaggcgttaggggacacacatacacacacaaacaaatatcttaggttatgtccaaactaatgatagtacaggtatgacaacccatggctaagagcacacacatgcacccacaatccaatcaattatttttcaaataaaggaactcttgtgttgattttgttgaatttttataagagatttgttgatttaatcgtactcacgtttccattgcaattatattttaggattattggatttagaattaactttgtcttttctcccccatgaattcgaaataattgttaccgtgcaaagcaaactagccatgtgtgcatctaacaatacttatcacatccttgtctgtaggtcgaatttatataagcatatatattacctgctaataagtccaaatgctcaatcatttggcacaaagaacaaattaaattgtaggggttgcaaattgcaatcaaggagaaagaaggataggtatccgattaagttcctcacgattaggtaaactgaaagttacactagcttgataggagagaatcttagggtggtccttcatttgatgttgcactagcaccaaaagttgccaaagcttctttctttttccaacttttttttttcttttgttgctgttcttcttttttccttttgccatgctcaatttttgagactaccatacatttttgggttataggacttcagtgttgctgttgtcgtctttttcgtctcttgacgccttntcaattcgatccgattccgactgaaaatatggtaggaaaagtatacggaaaaggatatgtagaaaaaaaagaacacttgtcattcggagttggaaatcgacaattcagtttcatggctccttttgttcagtaatcgaaggatggattcttcacggatgaaaatttggaggcggcacacaagaacaatcgtccacaaattatgtgcctcataataataatgggttgtggaatcttgcattagcaccagtactagtgtccgctttacccgtttaatagagaattaagtaatatcaaattatagttaattaatttggaatgctgttcgaaatccaaatttgaaagcgcaaggcatgaattcaaaggctgttattggcttattgcagcatgagactggccaatatcctctgggcccttttcctgagcttgctaggttttgtaaagtcaaacgatgctcgggccatatctgatcgttttggagtggagaaagtccactttacatccctcatataggttgagtttcatttgtgctcgtgaatagcaaaacagagcgttcgtcaatcatcaaaactagtgtaaatctagtccttagcgattttaaatggtggttttgtgtatacatattttatggcccatcgatttttagggtatatgtggtgtgttgacttgttcttcatcccatatgacttctacacacactaatatacaacaagacaaaaaaaaatcaattaagctcgcatgtcagtcataaaaagaaaatggtttacccacatgtcagtcgagcctctttctccatggccctggataaatggtgttgacagcgattttgaccgaaatggctttttgaccctgtttacatttaacgtggcgtttatattgctatgaggatatacatgaaatatatggttttcgttccactatcactaccttctccgccatcgtcaaccctctgcaactacaagcacgagagttaacagaccgtttggttggagggagtttttaggagggattaggagtttagagggatgaggctattaattgttttgtttggttgggagacatgcgaatttaggtgggatgggatggggaattgaggaatgaactctctttttttcaataactgggtaggggtggtaacttggagggacgctcgacatagaattttgcggttgacatcgagacctagaatggactttttcctattgtagtagcccatacctgggccgttcgatgtggcccacaatttgtttctcttttccagcccctttttgttgggcccttgatgggcaacgtaccgcagttcttctgcgtcatgggccgtactcactatgcgtgtggttttgtgtaaaaaaagaatctatacatgggtcatgcgtgtggtccttatttacatttaagagttcttttaaatattatttgttgataggcttctgatgatatttttcgaaaaaaaatttactctaaatacatagccgtgatatagtatttcacagcgtggtaagctaagtatagattttttttgcagtacaattttagtggctctacggaccaagcatccttttcctaaatcctattcctacgtgacaacctacgccgcgacaaatcccacagtgctacgaacgtaccgcagggcacgccctttaaaccgcaggattagaaaaaaaaaaggaagaaataggaaaaatataggattgacagaaatataagtgtaaaacatagcattgcaaaacactgaaaaaacacatgaatacttgtttaattgggctgcaggaaaaaaacgcaggaatcggataagagaggtgaactcaaagaaatttttccaaaaggttggacctctcgctaagtttccttcaaaacctatatgcaatgaattgtataggaattgaaaaactctaattctttgaatcaaaggaccaaatagaaaaatttcctatagaaatataaaattcctccataaatcctttgattcaaaggggccctaatgtcatacatacgtaccatcatttctaagggttctagtttaattcctataaatttttgtcgctcttaacgtgttgtctttcattactaaaagtagtatttttttcatgcgatcaaaacctaattttacatgtggtggttgagccgtccgtctacccggaggtgtatgcaaaatcgttagtttttcatgtgggtggctcatctgcacgcgaaaatcaaattttcgtgggcgggtgcttatgttgtttgcctgtgaaaataaaaaacagaaaaaatatcccaaaaaaaatcgaaacacaaaaccttagctaagcttccatccgccggtgacgttgttgccacagtctgccaccgatcgtggtcaccgtcgccgagtccccgtagctcatcaccaccatcacccctccttgtgcctccatcactgcccctccgtaccccaatgacggtggcggcacatatccaccagatctgcctatcgtagggccgatggcggtggatccacccattatggcaccgtagtcgctgtcgccattgttgttgctgagcccggtaatgcccagtccgttgcggctccgcttgagcccgtcgtctgccactccacatgaggccacctctagacatactcaaccctgctcgcgctcacacaaggtcctcgctactacccgctggccactcctcgggaaaggaagtcgagggagagataagaggttagaaatgagaggggtggaggatagggagtgagacataatatgagtagaagatgtgagggagagaaggtgaggaagataaggatgaacacttaattttttctttttgaagatgttgagtgggagaacaggagtgaggtcagacttgtaggtgggtatttaagaggtccgcttataaaaatgtattttcgcatggggccgcttaagaggcccatttagaaaaataagtctatgttacactgaaaatatttgccgtattcatgtaattacaaccctatctatacatattttattgtcggacccaaaaagttaatatgtattaattcacctttgaatttctctcatgctttgatcacaaccccacatgtcatgtgattttacagtgcagttcttatcactgtaaatatcaacatatatcgagccacattcaccttgaaataatactaaccattggacctttctcatgctcgatcataatcattgatgcctcgttcgatgtggcgttttggagatagatttttgttggacgtaatgagaaacctcattatcatatgattaattaa

SEQ ID NO: 64252 - DNA, 867 bp, Oryza sativa
gtgattagctgagggttgtgaagcatcaagcaaccccatcaaacaattgttggacaagccagcaagatactgctagaagcaatgcaatgggctgcaacatgtttgatgtcttttggtcaggataaggtgacagagcaaagcaggcactcaccaggtgtgccttggcccagacttctgaggtgacttgtagaaagagggtgttcagctgtggccagccacaccacactctctctggccctggtctcactctcaagtctcaactgcatgttttgtggcaagcaatcacttgagtgaaagctttcatcactgattgggcttgccttagaagtggggtagtacttttatgtggctagttgggcatttcacattcgtgtggactccgagagtaataagcttatttttgtaatgcataattacagtccctccgttactttctataagacatagtgtaaatatattatactacctccgttttttaaatagatgacgccattgactttttctcatatgtttaaccattcatcttatttaaaaaatttacataattataatttattttcttatgagttgttttatcactcatagtactttaagtgtgatttatatattatacatttgcataaaattttttaataagacgaatggtcaaacatgtgagaaaaagtcaacggcgtcatctattaaaaaacggaggaagtatgtcttaggatatccaaaatttatcttcacaatatgtatatagtaaattggaactcacatttagaataatggttaggtggaatagagaatgagagagaagagagttttaatatttttaagtgcttgttaccatgtagtataactattgctggatgggctgcaggaatt

SEQ ID NO: 64253 - DNA, 1743 bp, Oryza sativa
gaaaaatagttgaaaataaacttaaaaagttaatacttaggaattatgataatttagctttgtaattattgattatttttatattaatttgttagttaaaagacatgggagaaaggaattgaatgggagaggaaaggaggggtgagctagaggcgatatggcacatgtgaaagagcgtttatgctcctagtgggttttggtttatttatgacaaatgattaagggactaatgcacttattgagtgtataagcaagtgattagtccaatgaaaaagctaggaaatggacttatagatggatgagaattaaagagaagatattgaaaatgcgggtatgaagtgactacctatggcaagacggtgaagcgcaagcgacgctcagctgcgatggaccatgtggtggtgaagggaaagcaaggggcttggcaccgacgaaccgaaaccggtggtgaagggcgagtgaaaattgtgtcgtgatgaaccttgcgaggccatttgaagccatggattatacgcatcaatcatttgagaaatggaagatgaaatgtcaaagatcaagaagatgagatcttcccgatgatcaaatgaccttgacgttggtaaccctccaagtgaagaaataatatggtgtgaaggtactcctattggtataactttgccttttaaatttgagtttaggatactgtactattaagagggataccacatgcatataattggttgaatactagtgctcaaaatgcttcatctttgtgtgagttgaaaaacctaagctaaaatttcaatcctgagttgtttcacttgtcacaacacttacactgggtttctttgcaagtttttcatattctcttgaaggttttggaccatattttatgttgggtttgatagcccacgaaactagctttccatagagtccaagatcttcaaaatcggagttcggagtaaaaagttattgcatttttacttgagcaacatcagactatccgatttgaaatcagactatccgatgtatcggactattcgatttttcacagaactttactctctgtctttgtttgaacaatcctttcgagtgagtttttctaagtgtcggagtatccgatgtttgaggatgaagtttttgcttctaaaatatcatatactccgatttaacataaaatagttcgatgtctcggaaagtccgaaatttcatgtaacttcgttctctgtttctcgttgccttggaggtttaaaatatcggactatccaatcttgtatcggactatccgacgtgggctgaaagattcccctccaacggtcacattttgggggatctatataaacccccaccaacccttttctagggttgcccaaactgatttcattccaatcttgctttgggtagagctttgtgctaagtgctttgaatttttgagctctctccctctctatctcaaatcccccttgttctttgtgactttgatctttgtgtgtggatttggagtttgggagcctagtgtgtgtttcttttgatcttgagcactaggatttgtccaagagttgtgtggtgtttattactcttggaggttaaggactcctagacggctaggtgtcgttcttgggccaccgatctacgtgtggttggccaagagaagtttgtgaaggccggatctcgcctccgcaaggaaagagatacccttagtggaaggaggagtgcatttgtgcaacctcacgagaatagggttgaaaaagggctgcaggaatt

SEQ ID NO: 64254 - DNA, 3777 bp, Oryza sativa
caaccccctcctccgaacacagcctaactcctatagaccttaaaatattactccctttgatcatcatattttcaaaaaacaaaaatccatatttagctgtcatattaggtggggttgtgacagaaatgtttcgtacgctacgttgcatgcatgccttgcagctccattggcagaaatttgatcaaacatttaatgcaatcacaactaaggcactgttctattctttaactttaaaatttaactttctcgtttttcgttagcacactttttaaactgataaatggtgtattattttaaaaatatttctatatagaagttgttttaaaaaataaataaatacatttttcaaagttataatatttaatgcttaattaatcaagtgctaatgatgttgcttgttttgtgtgccataaaaatttgtcttgagttggggagatcgaacggggcttaattgggcagtccattagccatgcaaggatatgaaatgttgatagtgctaattgatgtttatcttggtatcgttgtacaagccaaatatgacgataaaaaatgaacggatgggtattgttttagacattaagagtttatatatttttattactttattgtaagtattattaaatttcttatggcaatgcgtggatattcactattttacattgatataagaggtcatgttcgtttcaatgtttgggtcattaagctgtttgcctaccagagaaaacactaaatattaagtggagtattaactattaaaaagcttgaattttccttttagtttttaagaaacttcttcatagactttttttctaaaattatattagcggcttaaagatcatgctcgtaatgagtggggaaaagatggaattggtgacagatggaggtggaaaagaacaccgcgtggcagttatgggccataactgttctaagattggcgctagcctttttatggaaactagaaaaaagctcgcgcaaatgcgcgggcatcttatttattgttttgtttatagaaataatgctattagaattaagtcatatctcatcaaatagatttaaaaaattatagattttatctcataataacaaaaatctatattgtgaaatagatcataaactttaatataaatgataagaatgtctcttagatttaaaaaatcacttttatccgggttacatgtaaacttgcctattatcaccattatttattatcatttttcttaaaaggtatatatctttttaataaatggaacttaatttgtaccaccaaataaacttaatacgccattaatacataagacatttatttccactacatacctaaatatttatctcaacacttatttctaaacctattaataaatattctaaaactaccgcttttattaacctattggttaataggataacgtcattaagaaataggcatgaatgcccctctaatgggtggaaccatcaaagctttatttatccgctgccttcaagcatgagtcgacatagtcgtgcctctcacagttagtgtggagcataattttaattaatcatagttagttatcggcacccttaaaagaagattgcattgataagtaggaaagttgagcactcttatcaatggtggcctcctctgggcttgcttcaactcaaccatatgtgtgccccctgctatacttgtggtagcatagcaagttctgttattcatgctcggtgcccttcatggaaacaaagagaatatgatgtgatgaaaatagttcttcatttattcccataaaaaatagtttctttatgttttgtatgagacacctttactaattctaaatgtatttattttctcaaaattatttataataattaatttgttgaagtgcagttatagttacatcagtgggctgtttggcgtacatttatcaattatcacttatgctgaacatattataatttctcaagtgtaagaaaatatatcatgagtagttttatggacatgttataagattgttcatttgttaccaaacctatttggcaaaaaaaatgtaaatgaccatattttttgtgatggattaaggagttgtattgtagcatgatcattgcctgtgcatacctatcaaataattctgaaaaatccaaaaaaattaagaatcttaatctcacaaaaattaaaataaagtcagatataattgacaaaacataacgttgtttcattttcatgcatgtagatttcagttagtgttatataattatcaaatgatatttgaccataaaatataatgtgatattatttcaaacattatcatagaattaactattatatgtcacacaaattatttgaaaagtgttttgaattaaattattatatgtcggctccatgtgtggtaatgtatttagcactataatataactatgataagtcatcaacatttgaatacaccttattataagttgactatataattgaaaataatttttaaaaatgggtgtttaaatgcatttagtttgtttttatattaatatagtttaacctgcatatttatctttagagtaataaattttattttatagtatagaaaatcctattctgaagaacatctatatttttttttgaaggttgtaccaacttatatatgtattttttttgggatttatagctttattatcgtatgtacatatgtttctttgtgaatatccggtacacagtttctctcgtatatgcaggggattaagaggaagcgggctaatctaatgatttaaaataatgggtccattatttcaaatgaaagttgacagcaaaattataaagtgccatgtggcggtctaagagtgcttgtagaaacaccacatgatcatatttgtggagtaataaattttgtttttatagtatagaaaatcctagtttaaaaagaccgtctatttttttttctaccgacgtatatatattttttaagggtcttatagcttttcttttcacccctacataagtacgtaccttttttcaagtgaacaatatctaaagtttttttttgtttgatggttttttttatcgtacttacgtactcttatatatgtatttttttgggctttatagatttattatcatatgcacgtatatttctttctttgttttgtttcaatcgaacatcggtaaacaatttctctcgtatacccatgaaactaagactaataatctataaaataggtccatcattttaaataaaaattgacatctaaattataaagtgccatgtggcggtaagagtacatgtaggaacgccacgtgatcatatttgtggaataaattttatttttattgtacagaaaatcatattttaaaaagatcactgtctatttttttctacctatgtacataaatatgtgataataaatgaaaatattattaataggaaaacatcaataaacatattaaaaaaatattcaaaggctcttttctttttttggggtctatatatatatttatatttttttgttattttttcaagtgaacagtttcctttttctgttttatagttttttatcgtacgtaactactaagtacgttcgtttttttaaaggaacagcactaaacgtacctttagtttttttttccaaatacgtaccgacggtaattttttttcccggtataaaaggcatgcatctaagcaaatagatctaatttaatggtctaaaataataggtccaccaatttaaataaaaattaacggtgaaattataaaatgctacgtggcgatctataggagcgccacatggcggcttaggaggggctgcaggaat

SEQ ID NO: 64255 - DNA, 28933 bp, Oryza sativa
ttcttccacctcctctctcttataggaaggagaggagaggagaggaggaattaataatgtggaggccacacctgctgctgctgctgctctgaacctgcaccacgcgcgtcgtgggaggcgccgcctccatcctggccgtccacctccctgaatcgacggcggttaggttaggggtgatgggtgggccccacggtggagggagaatgagaatgacgagaatggcatgcagatgtggtggccttccgactgtcctacgccttctgtgccttcccgttcaggaaaggagaggagagcttttgactgcactctcctttcttttttactgctctgctctgtgcaggcctgccaaatctgccatggatggatggatggatggatgctttttgtttggttttgcacggatccggcgttgccgtgttgcacaggatgctttgcttcctcctcctgcatcctgaatgagcatgaacgtgcagatcaagtcgagagattcgagccaaacatggcagtgagaattgaaatggttcacgttttcgtttttcagatatgcgaacatgaatatgaatactagtatccggttgtgtatctcagagttctctactaataaaaaaaaatagaaccccttcattccagttctttctcaaccactgtatttctctcatgtaaaaaagccacatgtcttagttaagaaaaaacctcctacctaaaagaaccggtgtttccacgtaaaaattgacacattgcatattgaaaagaaaaaaaaaatcaaatcctgtcaagccatattgaaaagaaaaatcgcttaatttgtaacatatggacgcacacatagatcgaatatgaaccaattattcgtttacgaataattttgaaaagcatgaaaacctctctagttgtggtcccaaaacaatggatagatgtaactaactcttttatcataaaaagaaatattctcattagttttagcaaccatattactaggacataggcacatgcaaagagccacaaatataggcactttaacaccagcttgcggacatataacatgttaagtaacagatgaacagttcaagcagcaaacgacatgcactctttcttggcaaggactatgtgattaatttggtccaagatttcagaaattttatataggcatatgatgtaaaagcagatactataaaaaaaatctacgatggaaaaaagaaaaaaatcaacttaaatcttaagttttaaaatacaaaatttgatgcatgtatatataaacgtaagtgaaacgagggaaagtgcctgtaacctagtggttacaagagcctcagtagcacctgaggtcctgggttcgactccccataggagcgaattttccaggatttaacggcgttatgctttcagtggtaggcgacgtacccgtcgacagcgaggtgcctgtggtgacttgccggcccagtcttcgaagatgctcataggggtagggtttgcgcgttatgctttcagtggtagatgacgtacctgtcaacagttaggtgcctgtgcgtgacatgccggcccagtcttagaagatgctcataggggtagggttgcgtgttgtgagtgactgcgttgtactgcgtaattttaaaaaaaaacgtaagtgaaacgagatggcgctgatatatttgaaggcctagaaacgcccatggcctaatgaagtgacttctaatcaggggattgtgtttttattctttctgcttcatttctctctctctagcttccgggaaattgctcgttttcttctttctctattttcgcttgctgcaggagaggtgctcatttttttcttttattttcgcttcttgtaaaaggaaaacgtgggccgaccaacgcaacaccaaggcaaaaggagctgtgcactctgagtgtgtatcaggcaggctgagtccatgggcagcaaggatggctgccatcttgtctgtttaacacaaaaacggaaggtaagtacacatcagtgacggaccggctgacacgcaaaccaggcgcacctcattttcggaaaaaaaaaagcatcgttatcggcagaaggcatctcccatcgtctctttccctggcaccgactactcatgtgtgtgctaaggtgaagtggataaatattactccctccgtctaaaaaaaggcaaactatggatttccgtgtccaattttaactgtccgttttatatgaattttttttataattcatattttcattgttgctagataataaaacatgattaatattttatgcgtgacttgtctttttaatttttttcataattttttcaaataagacggatggtcaaacgttgggcacggaaaccagggtttgtctttttttaaaacggagggagtaggcatctagtttgattcggtaaaatttgctgcatgatataaaatatcatggtctttgctacgtgacattatctaaagaaagtatgttagttcgtggataccatagaaatatggtaattagtcgtatactcaacgtattattttattatatttgatggaaacaaaaagagaaaattcataagaaacaagtttgcccttgtggactcctccttgcccccgccaccaccagtagcggcaccgccccctctcctcccgctaacaaccactcccactaccttttcctcatcaccccagcggccaccgctatagtcctcctgctcgttatactcctgctgcttgtcgcgctgcacttcctgagctaccactgcacgctcatgttctcaccgccgccggaccctgcctgcttcgccaatacttccgtcgcgccactggtggattccacctgtgtagctttgcccgcagtgccgcctcgccggtctacctcaccgcctttccccaacatgtcgctcgtcgttgagagattcctcgattggcccagacggttcgccagcacccgcgtggaggcggccgctctgatcgacaccaagaacctcaccgcgcatctcatgtagatctcggcaataaccatcatgtcctgcgagggaagtaaggcagaggtccatgatagctccaccgccgatgcctattgtcggaagaagaccaggagaagggagaagaagatgagaagggagaagaagatgagggcaaaacaaacattttacatagtttttctctcatcaattgggtggatattgtatttttatgcgctcggtgtcctatggcaaattaccacgctttcgaagtgtcattaggaaaaaatcacattcttacgacgtctaccagcaaagataataagtttttaagtgtcatgtagcaaattttgcattttgattcaacaatatgtagtttacatgtttccactatatatatggtttgcaatatatattttgccagattatgaacttatgtgagacgtgtgtggtaccagtagtgtaattattgatgttctacttgttttcaaggatgagatatgtacctctagaatatatatttatggagttatgcgctttttgaggaccggagtctagttaattatatacatagtcaatgtttcatttagaatcttgaggctttctagttttacctttaggacatcgcaagagtaacattataggggaaaacactattaatgtggtaattagctaatgaacattgtgcctattattttactgtatttgtgctaacaacgtgtgagagggcctattttttgacatagggtgaccaagttggccctaagtgtatcacacattttgacaatttgaccctttaaaaaaactatttttacaaatgaaccgccgccaaacttattttaaaaataacatttttttcagcgccacatcatctggcgctgaacttgacaccttagcgccacgtctactggcgctgaatgccgtgccatcgcggatgggaggctaagtcagcgtgccaacgcacattcagcgccacactatttggcgctgagatgtctaagttcagcgccacatgatttggcgctgaaaaaagggttatttttgaaataagttttggcggaggttcatttgtaaaaatagttttttcaaagggtcaaattgtaaaaattgtgtaagcgtatccggctcaaattgagatggtctggctcaaacatgtctgtcgaggagtgatcctctctagcgggagatcgtgagatccccctttttgagttcagccggggaaaagggttcgcctctcgagatcgtgtatccaccctcagggtttccagatcgcgtatgggcgccaagattatacaggttcgggccgctatagagcgtaatatcctactcctgtgtgtgggatttatgattgagtgttacaagggttccccaactctggagagtgctattggtctgctccctctaaagctcaggcctgctgggagtcgtccccctttttcagcgggcaaggtcctccttttatagttcaaggggataccacatgcgccgctcctacctactcttttatgggagagggacccactttaccttgaccggaccacgatccgtgccttcgcccggaagctaagcggcagttcgtcctttagtgggatccggcgccgccccccgcctgccacgggggacagccctataatttcctcttaaatgagtgaagacttgtggcggtcctcgcgtggagggaaccccagatgacgccccgatgggacgggacatacctacctccactccgccgaatacagaggcgacgtgggggcacggccgcccgtccaatcggacgtggccggcaacaggccggtcacagactggtcacacccgattgacgtgggtcagtctagtggcaccgcacgttcgcccttaccgcattaaacgcggtgagggacagttggggcgccgcgcattgatggtcgttcagcctgggtctcctccccgcttgctccccccgccacatggcagttgggcgagggcctcggggcaaggcagcgcgagggcccgaggggcatgacgtggcaccccgaggccccccggccgcctctgcgactcgcgaggtgtaggggtagggctaggctgtagagccacgcggctggatgtgaaggtaacttcccctcactttgcatacccccgggcccatatctccgatagtagcccccggcaccgcgtcggacattggccccctgagggcagtctgacgtggcgcctcacgacttcccgtgccgaggttgtgggcccggcggggaacccagatggttgccgctgagcggccaggctggcgcattagccataatggcgatttgaccgccattaaccgcgctgatgatgggggcgcctagggcgcgaaaatcagggggtcgacctggccatgcccagaatcgtcacccatgccgcctcgactcccctacctgccaggcatgcgatgggaccgacggcgggcccgcctaatcgcgcccgtgaacatcgcacgccccgcgccgagtgtgccgctgacaggcgcactaaacgcggggcgtgggttcaatgggcgatgtgatgagtggacgcgagaaacgatgaggcaaccgcaggtgtaggaatcgaggaggcaaccgcgagggcgtgaaacgaggaggcgagcgcggtcgaggcggggataaaaggatagggaggcggagatttcgtccccttcctctcgccgactgctcgcccgcacactcgctcctcaagccctaacgcttctctcgctccacgctattccgtacaccaaactcctcgccgtttccccgccggtcatcatggcccaagacgctagtgacgttgtgctcccggtgtcgcgcatcacggcagagaggcaccttagcctcatccgcaagatcatgccggaggacgccgccatgatggtgggggagtcacggccgcggccgcggtacccagagcgatccgtgcacctcctgtccttcgccatggtggggttgatcctgccattctccaggttcttccataaggttttggatttctacgaaattcatgccttgcatctcacacccaacgccgtgatgacactggccatcttcgcgcacttgtgcgagatgttcgtcggggtgcggccgacgatgcggctgttccagtccttcttcgtcccacagctgctgcaaggcgcggtggtgggaggatgctacttccagccctggccaggaacagcggggcagtacattgagagccacctccacaacaagtgggaggattggaagaaggattggttctacaccgcgctgccggatcatccgcgacttcggctcctcgccggccctcccgaacgatccgccgcgtggttagcggtttcggaactaggcgaggagtacgacgctgtgcggtatcgcctcaggggcctgcgaagccagggcctaatgggggcgatggtgttcggcgactacttccgccgtcgcatcgcgcctctccaggagcggtcccacggcgcgtgggagtacattgggcacaacgatcccattcgcacccacgtgggtgagcgttgggactggggcaaggaggaagcgaagacggtgatccggcgggtggtgagcaaacgctgattccggacgggatcctcgccctctgcagcgaccgcgaccgggagagtatcctggttgtgatgtcggccatcggtgctggcaggggtcggtcccgccggggcggcgccggtggtggcggcgatggcgcgggtagctgcggcgcgaccgcaggtctctggcgggggcggcggctccagggcgcccagtccgagccgtggacccgggggggggggcctggccagcaacccgaacgggaagcgaaaggtgtccgaatctcggccgccttctcccctgcgcagagggggcgccgagcgaacggcggaccgaccaccaacgggccacaaacgccccgccacgtccgaggctggatggaagaagaagcggcttcgaaagatagggcaaacggagccgtgccgggggagtttcatcgggcccttgaagtagaccttcaaatgcccccctcgcaggtacgatcgctagcacccgactaggtgctctctatccaccttggcctcttgcttttcccccttcttttctttcttaacgtgatcagggttctccggtagcgggattccttcccagagggtcgcggcgtctgatccctcgcaggggtcaaaattcgagcgaccggatgaccgggacccggccgactcggtgctatggggccttcgcagtaccctggcggggcccacgggccacacgctgggtctggctccgagtccgccacagccgaggtgcagccagccacaggtgatggcagcggcggtggcgcccccccggggggcgatcccgagggcgcgacccacgaggagcgccactcgggagtggaggccaaagcaggtcgtggcccagaggccgaggctgggggcgggcccgaacccgaggccgaggccgagtcagcccgagggctcgaggcgggggggacgggggcaaccgttcccctctgcatctggggcaccctcggggctggccacgtagaagggggccgagagcagcccccagtcccgcgggggtttcaatagcactccgtcatcccgggggcggaccgcgactttttcttctccgactcctgcgagcatggagccactcctgcaggtgctcgctgccgccgactccaccgtccgggaggggctcaatgcccaagttcaagccctggcggacgagcgggcggccctggaggcggagtgggcgcagctcgcggcggaccgcgcgtgggttgacgaggggcgccgcgctgtggacgacatggtggaggtggggcacaaaatgcatcaagcccaactggcggagatccaggcgcgcgaagagacgctggactcagtcatgcgggagatggaggaggagcggcaggcggcgctcatcgcttcgagcgtcctggatgaggtgctgggcgacatccgcctgcagtacgaggcccacgccgaggatctggtgaagagggttgaagacgcccgtggagtcctcgacgcggctgccgcccaagagaggcgggcatcggaggtcgatgccttgttgcgggctcggtcggcggtgctcgaggccgagcgtaaggccttggacgagcgtgcccgctccgcgcaggagttcgaggccacgatccatcgacggatcgaggtcctcgaccgcaaccagcgcgaacaggacgggcgcagctaggaacaggcgcagcgagcccgggggtggaggagcatgctcgggtgctggaggagcgtacccgggcactggaggagtgggcgcccatgctagaccagcgcgagaccactttggccgcccacgagagaacggcggccgaggcggagtcctccctccacctccgtgaggaggccgctgccgagcgcaaccggaccaccctcgccgcagaggcttttggtggctcgttgcgcggaggagctgcggcttcgagaggaggcgtgccgggaacggaacgccgtgcttgccgtacgcgaggctgaggtgaaccgccgcgaggtggcggcacgccggctgggcgagcaactcgcgaagcgcgaggaggccgttgcgggcgcgaagctcggcatctggaaagcgcccgcgctgagcgcgcggcgatggcggcgagggcttccgagctggaggccgcgagaaagagctggtggcaggcgggcagcccagcggcgcggagttggtaagccaactcaccgcggctcaaagcactctcgccgacctggggcgcctggtgcaggaccaagccggggagatcgtggccctccgcctcaccaacgagattagacctggccaactctccgacgccgtcgaacagctggagcgcgcgggatgccgggtaggcatctccgtgcgccaggacaggaagctcccgcctacacagccggcacttgcgttccggctggacgggatggcggcagatttggagaggctggaggaggaggtcggcgaggccgtgaagtcatcgtcggcttctttggcgcgggctacggtggagctggtcctcacgagtcaccaagctcgcgaccccgacttcctcccgtggcacgcgctcgaggactgccccccggggaccaaggcgagggctcaggagcgagtccgggaggcggccgacgcaatcgtctccaacttcgaggggtcggccccttggttcaacctcgtacttgccttgaacgaggagagcgggagaaaggtcgatggtggtgatgacggcggcgaggactgggacgaggtggtcagcggcgccggactcgggggcccgagcactccgtgactatctccgcttttcttcttttattttgttatgtgctcgcggtgaacgcttcaaactttaggccatcgtgccatcctgtttgtaaataaagcttccccttcgctcctttatgttcttgctttctcctttgaatgtctgcggcaaggaaagaagaaaaaccaaagctaacgtattcaattgactttctagtgattaagttgccgctcttacccactttataccccccctcgggctcgttccggtgaaaagggaaattcgcgctcgatccgcgggacctaagtggcgaggggcaaggccgtcgccccgagggagctacccagcgggtctggccagaccgaggctacgacgaccgggggtcggggatggccgtgtgtaggcccttctgagcccccagggttcgccgcggcccgtgtttaggctccctttcggcggttttcaggtcacccaacgccacgtaggttctggagtaagcgcaaatcgtcctttgaaccaggacgagccataggaaagagtaagaaaaggcgtgcaacggcctccgcttaagcggaaaaatttattgatggggaggggaaaagatacaacatatttaacagtggtagcccccggccaagccagcacaagccaaaggatgcgcgggggttggcccgagctctaggaaagcaaaagacgcgcaactctatggatagaaacggcggaggtgttcgatattccaggggttaggcaactccgtgccgtcctccgtggttagccgaacggagcccggccggggaacgccgatcactttgtatggccattcccacatcggtgagagcttgctcagccccaagcgcgactgtaagcggtgcaggacgaggtcgtcgacttgcagtgatcgggcttggacatggcgctgatggtagcgccgcaggctttgctggtagggcgccgctcgcagggctgcacgccttctccgctcttccaaatagtcgagatcgtcgcggcgaagatcatcctggttggcctcatcgtacagcgcgacacgatgcgaacccaaggaaagctcggaaggtaggaccgcctcggcaccatacactaggaaaaagggcatttatcccgtggcgcgactcggagttgtccgattcgcccatagtaccgcgggcagttcctcgagccacgaatccccgtgcttctttaggacgttgtatgtcttggtcttgaggcctttgaggattttggcgttggctcgcttgacttggccgttgctcttggggtgggtgggcgaggcgaagcacagcttgatgcccatgtcgtcgcaatagtcgccaaacagctctctagtgaactgggtgccgttatccgtaatgatacggttgggcactccgaatcgggatgtgatgcccctgagaacttgagggcggaatgcttgtcgatcttgacaactgggtaagcctcgggaaacttggtgaacttgtcgatggcgacgtacaggtgctgatacccgcctcgggccgctttgaagggtcctaggatgtctagcccctagaccgtgaaaggccaagagagcgggatgacctgcaaggcctgggccggctagtgggtttgcttggcgtggaactggcacgccttgcatcgcttgacccattcttgggcatcttgcaaggcgatcggccagtaaaaaccttgtcggaaggctttaccaaccaatgtgcgtgaggccgaatgggccccgcactcaccctgatgaacgtcggcaatgagctcgacgcattgctcccgagaaatatacttcaagagtatcccgttggcgccgcgtcggtagagtcccttctacgagcacataccgcttagagatacgcgcgagcttttcagcttctgcgcgatcctcaggaagagtattatcgtcgagatatgcctggatgtcagtcatccaaacaacctgactaggagggtcgggaccgacccccttgggccccgaggcccatgggtcgtcggggattggggcagagaccgtggcgccgggtccctcgggggggggggggggtccaaccgcaacgacggttgtgcgagcctttcctcgaaggtccccggggagagtggggctcgtgctgatgcgatgtgtgacaactcgtcagcgactgcgttgtcgcgtcgggttacgtgccggagcttgagcccgtcgaagtggcattccatacgtcgcacttcgcggacgtaagcgtccatttgcgggtcggtgcactggtactccttggagacttgatttatgaccagctgggaatcgcctaggaccaggaggcggcggatgcccattccggccgccgccctcaatcccgctaggagtcctttgtattccgccatattgttcgtggctcggaaatcgagccgaacgacgtactggaggacgtccccgcttggcgaggtaagcgtgactccggcccctgcaccttgaaggttgagggagccgtcgaagtgcataacccagtgcccggcgcgaatgttggcgtttgggtctcctccatctccgaggagggggggggcattggatgcaacagggtcgtccaccggggtccactccgtgatgaaatcagccagaacctggctttttatcgcgtgccgtggttcgaagtgaaggtcgaactcagcgagctcgatggcccacttttcgacccgaccagtaccttctcggttgtgcaagatttggctgagagggtaagacatcacgacggaaacccgatgcgcttggaagtagtggcgcagtttccttgaggccattaagactgcgtaaagcatcttctgggcctgtggatatcgtgttttcgcgtttcggagtgcctcgctgacgaagtagacgggccgctgcacctttcggtggggccggtccttgttgttaggagcagccggtccggggtgcccgtgcttaggggcctcgggggtatctcgggccatgtcaggattataggcgtcggggccacccgccagagcctcccttcctcccccgggggcctcggggccctcccggggtttggggggcttcgggcaacgagccgtcgggagacgagggtccatcgccagtcatgggggcccctggtcccttgccatagccgggctcgtgacgcgggtcaccttcgccacgctccactacaagggtggcactcaccgcgtggggggtcgcagccaagtagagtagcaacggttcctctggccctagggccaccaggataggtggggggaagtgaggtaagctttcaactgattgagagcttgctcctcctcctccgtccacacaaatggcctagggcgtttgaggagcttgaataggggcaacgccctctctcccagcgttgatatgaatcgacttagggcgaccatgcatctcgtgacgcactgcacatccctaagtttgctggggggacgcatcctctctatcgtgcgtatttactcgggattagcttctatgcctcaggaggagactagaaaaccgaggagtttgcccgtcggcacaccgaacacacacttttcggggttcagtttcatgcgcgttgacctaaggctgtcgaaagtctcagccaagtcctataataacatctcctggtggcgcgtctttaccaccaggtcatcgacatacgcctctacattgcgccctatttgattactcaaagtaatgcgagtcatgcgctgaaaagtaggacatgcgttcttgagatgaaaaggcatagttgtataacaaaatgtgcctacaggagtaatgaaagcattttttttcctcatcttccctagccatacggatctggtgatacctagagtaggcatccataaaagacaaaaggtcgcaccctgaagtggagtcgactatttgatctatgcgtggtaaagggaagggatccttagggcatgccttgttaaggtccgtgtagtcgatgcacatccggagcttgccgttggccttcgggacaaccaccaggtttgccagccactctaggtggatgacctctcggatgaagccggcctccatgagccgcgtcagctcctctcggatgaaggcttgccgctccggggtttggcgccgtaccttctgccggatgggtcgcgcgtccagccgcacggcgaggtggtgctcgatcacctccctggggaccccgggcatatccgacggcttccacgcgaagacgtcggagtttgcccgcaggaaggagacgagcgcgctttcctatttggcgtccaaggtaccgccaattttggctgtcttggacggatcatcgccaaggggaatctccttgactggcacctcgtcggccgaggtgaggcgcttcttggaggcgcaggacgcggaggcctccgggacctgcggctccatggctgccgccaggttgtcggcgcgctactccgcgcaggcgagagcgaccctgacatcgccgaagacggtgatggggccgctggggcccggcatcttcatctggagttaggcgtagtgggtggcggccatgaacttcaccaaagcaggtctgcccaagaccgcgttgtagggcagattgaggtccgccacatcgaagtcgatccgcttggtgcggaagttagtggagtcgccgaaggttaccgggagctcaacgtgacccagaggccacgtgtgccccgaggttatgccgatgatcggcagtgacggctggagcttcatcccttgggccttgagcgtgtcaaaggcagccggggagatgatgctgaggctagccctcctgtcgaccaggacacgcttcatcttgatgttgtggatggtcggggagaccacgagggccaacttccctccccgagcgagcactgtcggatggtcgctctggtcgaaggtgagcttcacctccaaccagcgcgcctttcgtgttgcctcgtgagtcgggactgcagccagaagctcacgtctcatggccttgaagccacggcgggaggtgtgagcgcaagcacccccgtcgagggtggcgacggtcccctgaggtatctggaattccagatccttgctgtcatcatcgtcatcggcgggggccttcttcttggcctcccctcgccggtcattggcagggctcgcgggggctttgccctcccgttgaccctgccgcttctcctcatcggctttccgaaaccctcggccaagttcttgaccaagcggcagtcggcaaggctgtgccgataagtgttgtgcaccgagcaccacttgtctgccgaccgaccctcgccggatgtagcggtggagctcggcctgtcgccggtggctttttccttgcgcggggcccgtgagggcccatcggccgcaaggacgtggccctcgtcatcagagcggaccggcttccttttccccctcctatctcgccgcttagagtggggagcggactcgggggcagccgcagccgccgcgccggtgccgggggagttccaggcccacacctcctccttccgagccaccttgtctgctagttcgaagagctcggtgatggtcttgggctccttggaggcaattttctccagcatgcggttgtgccgcacgccgttccgaaacgcataaacgaccgcgtgggccggaatgcacgtaatagtgttgcggacctggcagaagcgctgtatatacgagcagagggactcatcgtccttccgctgcacagcatgcaggtccgcctcctctcctgggtgggggtacgtgacctggaagtttgtaatgaactgctggcacaggtcctcccaggagtggatggagtcagggggctgggtcatcagctagccgcgcgcttgacccttaagagccatggggaaataattcgccatgacccggtcgtccccccccccccgatgctgccacgatgattgtggtatagatatggaggaactcggagggattgatgctgccattatacttctccgtgaggttggggcgaaacttcgggggccaccggacattcccaagactcgcaacgaaggccctacaactagtccctccaggggtgaacgtggggggcggaccgcctcgcgaggaggaatgcggcactccgaacaaggaggcgccttctcccatgcgggcagcacggcgctcgtcccggcgtcgcttaagcatcctgctccccgtagaggccatcgtgatgcctccgacttcctgaggcccctgacgacgttggggccgtggaccgcctcgaggccgtggccgaccgacgggccctcctccttgctgacgaggagagggtggtgggggtacgcgacgtactagtggtggtgggccggccacctgcggccagctgccgctaggcagtggtgaccaggttggccacgtcgtccaaccatcgctggacgggggtctctggctccgagttcacgggaggatgccgtagaagggctcctgccgcctgaagcgcgcctcggggcgagccaccgtcaccgtatgtcaggcgacgtcgcgctccgatgcgccatggcttccccccgcccggaggcggggagagggccgagccacccgaccgggtgggatcctccctccgcgaggggtcgcggcggggcggagtccgagagttgcggcggtggtgacgggggccgcggctcccgctagcatcctcactcccggagggagtgggggtgtgcaccaccacttcctcctccaagacctcgaccatgatcgtcgaaggcggaggaaaacttggggcagaagaaaataacttctctttgaagcacgcgaattccccctacctggcgcgccagctgtcgaggaatgatcctctctagcgggagatcgtgagatcctcctttttgagttcagccgggggaaagggttcacctctcgagatcgtgtatccgccctcagggtttctagatcgcgtatgggtgccaagattatacaggttcgggccgctatagagcgtaataccctactcttgtgtgtgggatttatgattgagtgttacaagggttccccaactctggagagtgctcttggtctgctccctctaaagctcaggcctgctgggagttgtccccctttttcggcgggcaaggtcctccttttatagttcaaggggataccacatgcgccgctcctacctactcttttacgggagagggacccactttaccttgaccggaccacgatccgtgccttcgcccggaagctaagcggcagtccgtcctttagtgggacccggcgccgccccccgcctgccacgggggacagccctatcattccctcttaaatgagtgaagacttgtggcagtcctcctcgcgtggagggaaccccggatgacgccccaatgggacgggacatacctacctccactccgccggatacagaggcgacgtgggggcacggccacccgtccaatcggacgtggccgacaacaggccggtcacagactggtcacacccgattgacgtgggtcagtcaggcggcaccgcacgtccgcccttaccgcattaaacgcggtgagggacagttggggcgccgcgcattgatggccgttcagcctgggtctcctccccgcttgctccccccaccacatggtagttgggcgagggcctcggggaggggcagcgcgagggcctgaggggcatgacgtggcaccccgaggccccccggccgcctctgtgactcgcgaggtgcgggggtagggccaggctgtagagccacgcggctggatgtgaaggtaacttcccctcactttgcataccctcgggcccatatctccgacaatgtcctaagccaaaccaatctcgacaactgacgctggccaggcaaatctagccttctaccccattgcaagtacatcaagaaaagaactcaactcaacgaaatcaacaaaccatgcatcccaatcgaatcaaaacaaagaaaaatcgagcctaccctttggacacccattttagattcaccagcttcgtaacagattccacgccctgctctgacaacagtgtagccattgctgcaagccaattccactcctagcacgagatcacccttgcatccctattcctagtgggtcagggatgatgaacgggtcatggtggcaatgtcaaaatagagcatatatatggttggggtggcgacatagggctctaaagggttgacggatccagttagtctaaatatacaataggggtaacttgatcgcgccgtgtcaaaaagtgggccctctcatgtgtcatcagcccgaacacactgaaataatgggagtggtgtccactaggtaattatcacatttagagagtgtaactttactttttacggtgtactatagttaaaaccatgaacttatgtagtaatttgtcttgtttttttttaaaaaatggttgacaggattatgcacatgctatttacagaatttcgaaaattagaagaaacaatagaatgcccacaatttgctggtaagcgttgttaatttggttggacccatatgatgctgtcccgtatagactcctattgactttgtacaagtgtacaactaaccttttattatgtacaaataaccatacgcgtctagatcagtgtcagcttgctagcctaaggtcagttatacattttggtgatacggatcgaaatttgctttgctataaaagtagggataattgcttatttgaccctatctcgaaacgtaactatcaatttgaccctatttttctaggtttgtttatttgatcctttttcaaaaatgaagatcagagttgaccttattccgtgaagtccaactaacggtgttaacttacgggccagatgtcctttttcccttgctcatttgactatgtttatatcaaagttttttaatttgaatctttttaaaacatttataacaaatttgacatagctttgatagatttgagagctccaacagcaaattcatatcctacaaaccactaatattcatgtccctacaacagctccaacaaaccacgaattcatatcatagaaatcatggagtgaggagggagggagaggggcggcacacatgagcagcaaccaccgccgtgccactgccactgctcccaccacgaccaacatcgctcctccttcctctgcacgacaacagcgcccctctgccgtctgcgcagccaccaccgctccttcctctctctctctccgccggcgccatcccaccctccctcctcactccgtgtgcttgcgtcatcgctgttgtccatgaagcaaccaccgccgcgcgccgctacttcctctctctccgcgtcggcgccgcccctccctccctcatcactctgcgcgcttgcgccgccgccactgtccacgcagtagccaccgctactcctcctcgcatcaccgtgcgtcggtgccacccctctgttgatgcaaaaaaaaacccaagtccagtctatgattaaccaaatttagtcgttaacaccctccctcccgcctcaatccgtgcgcctgcaccgccatcgccggccgtgcagtagccaccgccgctccttcctctctctctccgtgtcggcgccacctctccctcctcctcgctctgcatgcctgcaccgccgctgccgtccgcgcaacaacctctgacgctgcccctcctcgcatagtcgccgccgcttctccttcctctgcgctaatgagttgtgttaggatattgttacgtataatcaagggtattttggttagttcgcgatagcaaatttattttctttatttccctaaccgaaaccctagcgcaccagtgaaaacaggtttagacggtggcttcaattttgaaaaactgggtcaaataagcaaaccttaaaaaaaaggtcaaattggtagttgtgcttcaaaacatggtcaaacaaagcaattgccccataaaagtaacatgctttaccattacaacgtctatttccctatgcatttgggtatcctggtctatatatccaaatgaacccatcgttaaatgaaagaggcataataacataagaaaaaattaaaataatttacagccaataatgcgcttgcttgacatctcactgaaaccatacagtccatacttcatccttgtgcatctgtcaattaacatcatcatcagagctaccgtacgagcttacaaaatcttgggccgggccaatatcaaattaactcttctcccattcgggaaagcaaaaatgtccaactcaactccttcaaaatatttgcatatctaaccgtaaaaccgggtatatcgacccatcctactattaaaccatgtaaaatgactcactggctgtttggagagtggttttcgctatgtggcgtccacgtggtagctcagtcatcacatgaattaaaaataaatgtgggtcgaacatttaaatgatatggaaaagaaacaagtactcatttgaccctattcaccaggctctaccaatctgatctcaccttttcaactatacttatttgatcccatttttaaaaattgaagattaaggctaaccttattttgtgaaggaagataaccgtgctagctaagcggcaaattgttatttttgcccttgctcatttggtcttcttatataaaagccctttttttttataaattacacccatagtacaacaacttggcgggtgggtgcgatatagtgtaagaactcgagaattaaacgttcgagtgcaataatttgacaaatgggtgtgttttagtacaagaacttaataatttaatattttgatacataaacttagctaagcatataagcatatgctaggtgagtttttctcatgatatcaatatgccattaaatagcaatcctatggatattaccttataatattgaattcaatctttaagaattatactgcatatctaattacctttaagaattttgttttcttcaccttcccaaatctcaaccaaaatatattaatttctacctccagtttaattgacttttagttattagttattaggataatataaatatgcttatatacaaatccacgctagtatgttgtcaaaataagtacttaaaaataaaatatgtataaaaaagtgctctaaataattaagttaccgcataacttcttaacttattgtatcaaaatcgtacatatcttgcaagttgttgcatttatgcgatcacttataaagttcttgaactaaattgcacctatctgccaagttgttccactagaacgctcatttctcaagttcttgtatgaaattgcacccacctgccaagttgatgcatcgtggatgcaatttactctaagatctttttgacatatttataataaatttaacatagctattcaaaccgtgcaaaaatgactcactcaattgttttgaggatggttttttgctagcgtggcgtccagatggtagctctgtcatcacatgaactaaaaatagatgtggggcctacatgtaagtgattaaaaaaaagataattgctcattttaccctattctgaaggctaactacccatctataatctcactttttcaactttacttgtttgaccccatttttcaagtttgaagatcaaggttgaccctataccatgaagacaagataactgtgctagctatggggcaaattgttattttttcctcgctcatttgaccatgttatataaaaagtcttttgtttattcagacctttttgacatatttatactaaatttggcatagctttcacagatttgagacaagtgaagtacacaaaggtttgagatcattaggacacaatgatataagtggagtacttggactttgcaggtggacactattatgaaattaggatggaccctttattttgtgggtgagcattgcaacggacccaaaaattcatcaacttgtgcttcgatgtcctacttgaaaagtgggggtcaaatgagcaaaattgaaaaactagggttaaattgcttcggtacagagtggcatgagcaattgtccctaaggaaaacataaaaaattatgggcccacatgttcgaaccgactcttcttctcctctatctttcatctttctttcgcagaaacaagcgcaagaatccagaaaaatagtgcagacttgcttgtcgccatctccccacaaggaggccaagtggcggcaatggcggaggaagctgaggaggccaccatcatcacctgggttatgaatggcatggggtggagcagcgtgcaggctgaactttttctgcatgtcggtgttgtcatcggggaagaaggttgtcgagctgagaaggaagtcaacagggttgcggcgcgaagctgccggtggccgcggagtatgacatcatggaggagatgggccgtggagctggatgttgggcgctgctgttgctctctctcctccgccgagcactcaccttgctgagcagaccgccaccgctctcacctccagtgacaagagacgacaaagaaaagaggctagtcctccccaccgtcatcatcttccacctccccacaggggatcccatcctcctcgtggctctccagggatcgttgaccgccaccgcctctcttccctcaggcacgctggtgagctttgacctcgtgtaggtcccttcaaggaggggcatgttgtggtggaggtaagtgagcgccatggggagatatgataggatggtgtgggccgggagtgccatggctagggtgagactggtgacgcttgtgccggacctaagctccttgccaccatcctctctgcctcccccggctgattttcctcacgtggggccatcgcctctcttgtctatgaggaagtagctgccgcctttagctcttttttttgtcgggcactgccttggtcccaccagttgtcaccgtcggcccgaccactgcgagaaaggagaggtggacaaaatgccacattaacaaaaacatctgccaatactgctaagactttgtactggttttaatagttggaggggttgatatacccgattttagggttgagggatacaaatcagatctaacctttatctgagggagttaaattggaccttttccttttctagagtatcctactcggcccggcctggtccgaactccaaagcaaaccagcctccatccctcacgtcatccctcctcgcgcctcgtcatcgtcgtcttccgaaggatgctacgcatcggacgttcgatattttgcaaatatccgatgtctgctagttatggaggtcttactttatgcatgcacctacacctgcctctatacatgtcagtgtgggtctattattctctctttagcagagtatagcaagtacctcccactcatgtacatgcatacaggatttttctcctaaaatatttatccgatcaataatctgattatgctattgtgtttgttgcaattaaatcttcacaacaagatctaacatcattatattttgataaaattatatatgttttttcatcacttggataaatgtttcagcccacttaataagatgtttcataggggtgcaacattataaaattactaactgcaacacccataatcaatgcatgaaacattgagtcgtaacgagtgaaacatcataaaaaaacatatgtggtatacaatatgtaaataattaattctattgaaacattttttatcacatataaaacaccaagatgtaattattgaaccatgataaaatacttattgaaacatctaaataacatgatgtacaacatttgcaaacgaagtacagaaacatcatacaatacttactgaaacatcttaataacgccatatgcagcataaaatttaaaaaaatcatcgtaatttaatcatatgagatgttgttgtaaagatttaattgtaactaataaaacggtgtaattggattttagattcactattggagaatcgctttttagtctcagttgggaaccctcctatagtgactaaagatgttcattttagtcccggttgaaataaccgggactaaaaatagatttttagtgccggtttgtaacaccaaccgagactaagttaccaaccgatacaaaagttattttttttcttttttttctaccgcaaatatctccaaatcaaataaaataataaatcacagattttgttcacacatcccaaatcattcacagcaacaaaccaatatctcaacatcccaaatcatccacaacaacaaatcatacatcattctcaaatcacagataaaatcagcaaacaattattcacattattcacacaacgagaaggaaaaaagaaaaagaaatccatgaatccttccgccgcgcggtcttccgcgccgggccgccgtcgctcagccaccgcctggcggccgtcgccctgccacgcctggccgaaacctccccagcccgccatcgcctggccgccgccgccgccgcccggcacggctcggccccggccgccgccgcggcccctccctggcacggccctagccgccgccgcccttgcccggcacggcccggccgctgcccctccccggcacaggtccggccgccaccgccctcgcccggcatggcccggccgccgccgtggccgcccccgcccagcataggctcggccgccgccgtctctccccgtcacgggcccggccaccaccggccgcttctcctgcagatctgaggaagagaagagaggaaggggagaggaagagatgagagggaaagaggaagagatgaggaagagaagggagagataaagagtggaggggaggaagagataagagggtgacgaggactcagatcgatgcgcgcgcacggagaaatgatgaaagagagagagcgagatgtgggaaactgatttgtagtcccggttggtataaacaaccgggactaaagatctgatctttactcccagttgtttataccaaccgggattaaaaatattagaagacttgccacgtcgtgccaaaaaagattatctttagtcccggttagtgttagatcattgcacttttaaaccgggactaaaaatgctttttagtcccgggttttttaagcaaccgggactattgttgtttttgggcaaccaatcaaagatggtttctcccgtagtgattggacaagtatttttggaaaaaaaaaggctacatcttgcttaaaaagttaaatgcatatgcatatgcaattcaaaaggcaaagaagagagagaatatgagtgggattggctgagagcgtccgaaagtattttcctcgtcttcctcgatccacgcttctcgcaagatccgatcgactcgatcgacaatctcagctgctgttcgttcgtgcgtgcgtgcaaccggatgtgagatcgatctcccgtgcgctgtgagacgcgcgtgcggagatcgatgaggaaggaggagctggactacgtgctgatcccgctggggatggcgctcatggtggggtaccacgcatggctgctcctccgcatccgccgccgcccggcgaccaccgtcatcggcgtcaacgccatcaaccgccgcatctgggtccgccacatcatggaggttcgtccgtacacttgatctggttttggtggcgagcgagatgagaatgagatcgccggagtgacggggttcgggtggatacaggaggcgtcggggaagcacgcggtgctggcggtgcagacgatccggaacaacatcatggcgtcgacgctgctggcgtccacggccatcacgctcagctccctcatcgccatcctcatgtcctccgccggcggcggcggcggcgatgggctcctcccgggcgcgccgctggtggtgggcgccgcgggcgagacggcgctgtcggtgaaattcttcgccatcctggtgtgcttcctggtggcgttcctcctgaacgtgcagtccatccggtactacagccacaccagcaccctcgtgaacgtgccggtgcgcctgatccagcgccgccgccgcccgggcctcgccgtcgactacgtcaccgcgacgctcaaccgcggcagctacttctggtcgctcggcgcgcgcgccttctacttctcctgcccggtcttcctctggctcttcgggcccatccccatgttcgccgcctgcgccgccatggtctgcgcgctctacttcctcgacgtttgcgacgactgggaggaggaacaccaagaccacgacgagcaggatggaagcgggagtgatgagagatcaggagaagcgaaggtctgagcctatgtgtgttaggatgctacgtagataatttttttttaaaaaaaagtacttcctccgtttcaggtaataagacgttaagtcaaaagtcaaactagtttaagtttgactaattttttagaaaaaaataatagtatttttaactcaagactaacatattatgaaaatttatttaattatagatttaataaaagtatgctggtgttgtaaatattactacatttttctatagagttagttaaacttaaagtagttgattttgaccaaagtcaaaacgtattataacctgaaactgaaacagagggagtaatttgaaatggataaccaactcaattttccgcaaaaaataataaaaagttctcttgtatatccacagacactgcacataatcagtcctgtgaaataaccctccctaggatgagcaaaatgcaagaaacaacatatgcaacgatatatcgctgtaacaggcaagcaaatcttacgaatttgtgagtatcaaaatataagtaatctctccatcccagaaaaatataagaatcttcgattagacaagacacttcataaaactacaaatttgaataatctacatgttcagaaatgtcttatccgattctaaactattaaattttagacattttagaccgagggagtactaaataattaaagaaccgcagcatagtaataataatctaggtgtgcaataattaaagtactactagataactagaacagaaccgagtcacattctaccgtaatttacctaatatatcctaatccacaggtataaacagatcagaaaagatgctcatcttgaccccataagtttatcctcgtcgttttcacgctctctccctatttacacaagtagatgcacctgttatcaacatagagatgcataattctctcgatatgtggttgaacgacaaatatgttcactttatttatataatgttagaggaattttataattattaagatgtaccaaaatttagtacaaatttggaaggtcaaatttggtaccttccagtaccggagggagaggtacaaaattttacattgggggctgttcaaattgatgtcatttttaaccatactatttttttttgcaaaactatcaaaaaaaaaatattcacgtttagttttgccaaactttggtaaatacataagaaatcctgttaatgcctaaattttgctattgccaaagtttcataaggtttattttggctacaatctaaacatcccctagaaaatagggaaaagtccattttacaccctccaactctttgttttgtctaaaatacactcccaaactctaaaaccggatatttcacaccctccaactttcaataccgttcactttacaccctcgagtggtttttcagctggttttcgcctatgtggcattgacgtggaagtctagggtggaaataaaaaaaataggaccaaatgtcagtccatagccacggaggcaaccacctcttcttcttcttccctcatctcctcttccctttctctctctatccttcttcctcccagagctatggcagtggcattcttgagctcgtggagtaggagatcggtggtggagactctttgaggcgacggagctcaaacacatccctagcctttccttccgcgccgactgccggcgagcccgagctcaaggtccacctctcctgcagcctccaggagcagctatcttctccatgaaatccaactcgctggtggtgctagagctgcttggggacgtagagttcggcggaggcgatggggcttggggatcaggaactcaagctcgatgaggcggcggcggccggcggatgcagatatggccttgagcttgacctcgtcctcgatcaagcagtggcggcgttccataggaggactcctccccacgcgtgtggctccggcgaggtccgcctcttccgcgcagggcagcaaggtccaccgctgttgccactctcctcgctggcgactgcgtgcagagcctttcgctggcgactgcctccgcgaccatggcagcgccgccgccctcgcagctccacgctgacgccgcagccaccgccctcgcagctccacgccccgccctcacaaccacacgccgacgccacagcctatgccctcgcagctgcacgccgatgccgcagcctctgccctcatagctccacgccgacgccgcaaccgccgcccttcgcagctccacgtcccgccctcgcagctccatgccgatgccgcagccgccgccctcgcaggtccacgccgccgccgccaacgcgaacagggcagggagggagagagagtgaatatgggcttggcccatattatgttgtggactgacgtggcaagggctgatgtggcatccgacgtgtcaaaaaccaccgtaaaaacagcccgggggattaagcgtccggtattgaaagtttgagggtgtattatattcggttttatagtttggggtgtattttggataagcataagagtttgagggtgtaaaatggacttttccctagaaaatatatgatgtctcccaatatcttcttaataactataaaatcactcataattttaaatatataatatgtatatggcatgtttatcaccagcacgtctagaagacctgatggagcaaggaacttacaacaactaatcaagaaaacagtagatcaaaattaagaagaaaaagtgctttcttgatcaaaatcaataaaacaggagttctgggctagctagttgctaccaaccatgatcagccccactgtcttcttcattgtcaaatcttcgtgctgaagccaagggtggagctcggaggacgtaggagatatgctaccggcgtgaaggctgacatcagtatacaaaggtcaaagggggcaagcgctctggatttttcacaatttggtcctttcaaaaaatcatttcgcaaatagatacctgaaaatacttatcccaaaaatggtcctttttgagcgccagagtcgctggcgccgtcctcctaccaccgtggcaggtcggcgctgaggtggcagggggagcgtgccaatgtggctgccccccccggcccccgcattttttttatttttcttttattattttgatattttttcatggttaggaatataccagaaccaaccatagaaaaaatgaactcaaatggacgaaatacgtgacttgtagaatttttcctctctagtgtagatgagagagatgtgcaacttttttatttttattttattgatatttttttcatacttaggaacccacaagaaccaaccgtagaaaagtttaactcaaatggacgaaatatgtgacctgtaaaattttccaaagctctaccgaaaagcttctcgtcttgaaaacacaatcttgaaagctgaatttggaggttttaatctcgctgaactcagcaaagccagggagaattggatgtaactttttctgtagatgtccgtggatatattatttgcctgattctaagtccgtatgagaaagttacgcctgttttaagaaatgacactcgaatatagcagaaaaaaccctaacttattttttttataggatgtaaaagaggttaaaaaaggctaagagtattcaaaatctaatctactttttttggtggggggagaggtggggggctataggaaaaccaaaacaacgaagagcagggatagcgcgggggagggggttggggggggggggggcctc

SEQ ID NO: 64256 - DNA, 17817 bp, Oryza sativa
ccgtttatatatattaagtttgtgcgtaaagagtttctatacgtaaagtttccattcgaaatgtactatcgaatatttaagtactactaaatttctgaattaaattttaaaatatattaaaaaactctaatcaaaatgaccagatagaatggcgcattagccaatcttacagtacgcaacatagtaaaacaagaaaaattgtaaaatcatgctggtctattatagctaggagctaataacgtgcggtgcagcagcagcgcgcacatcgtgcgaaagaatcgtgcttttggagttctagagtttcacgataggctaaccaaatcaggaaagtttggatctgtttctccatgcacgcggtagacaaaactggaaattttgaatccgttcgcgtcttgtatatctcgcgtgcgtccgtgcagtagacctcccccgatgacgacgacaacaatacatcctgttgttgttgtttttaataagatgaacggacaaacatattataaaaagccaacggtgtcaaatattcagtaatgttaggagactgagggagtacattgttcagaaatcagagttgacacatgaaccctttttaagtgcacgaggcctgtgaacgaagggcatacagtatatcaaagctagcataaacaaatcatagcttaccatggcagcagcatccggcaatcacttgaccgagagccggacgcactttgcccatccacagcacccgcttatcaagacacagtacggcggcggcggcgagcggcagccgatcagcagccacgtctgccgcatctgcgggactcgatcgcgtcgtcaccggcgccggctaccgctgcgaccactgcgacttcgacatccacgaggccaaggcctgcgccaacttcttcccggagaaaatgattacacccccgcccaacttcttcgggcatccgtggtcgcacattaatctcacgctcagacagatcacggcggatcatggcgaacgaccctgtgccggggtcccttccagcacggccacctcgcctaccgctgcgcgccgcagcgttgcgggtgaattcgccgcgcaccccgttgcgcacgatgctgccgggagagatccgcagcccgctccaccgggagcacgcactcacccactccgggctcatctcgtcgtcgtcccagagcggcccgtgcacacccgccgagatggcccgggtctgctccgtctgccgccaagattgctccatatgcgcacgcggcactaccgctgcggcggcggctgcatgttcgtgcttcacatcggcggctgtgtttccggcgtcccgccgacgacgacgccggagcagagtagcagtggtcgtgaggacgacgtcggagctgctgctgctccagcccccgccatcgtcgcgaggtttctcgatcgtcgtggtcgcggactcgcggagcagcagctggcggcggatttccagctgccaatggcatggtggacgtctttaacgccctgtaagcttcgctgggctcgggtgattaattactagtagctatataaacgtacatccgagcgatttgtccagttacgtataagtatatacgcgtgtgcttgttgtctgtaataatcgcacaaaacattcttggcgtttgtcgtaacgagttcgatcatgcgaacgtgccagtttgaacacgtgacatatatagctataggcctatagcagccgagctagctagttaaagtatatatgtggaccgtttggtctttagtttcagaagattagtggtgaaaacgagcggtagatatacacggtcggattatgacattatcatatactagctcatatttttctttaaactcgaagccagatacaactagtgtgtcggataagatatcactcatcttatatcttatcttatactagttccttctaatcgaatttgagaacgtatatatatttgtaactctaatttatatgtattaaatataaggaaataattaattgttgaaagagatacatcagagaaaaaaatgtacaatattacattgtaactcgtaacatagtgattaaacaatcttttatcatgtttgtaagtggatttataatatattttcatatatgttttataatatggaacatacgggcgtatacaagtcttttttgtcgtaacacaattttttttacggattcggatttgtactcagatagtactaggtgtcacatttgtttttctcgtatattcttcctgcgagcctcggatcgggtgggtgatcgggaattacccatcccattttcatccctacgaaagatatgcaactatttgtatgtgtggtgaaatgattactccaaaaattctacaagtggtttccttttggtattatctaaaaatatttcacaagtattccaaaaataaagaaaaaaagatataactataggtgtaattacattatatatagttccatcgcaaaatgttgcaacctaggatagacttttgtttatgttcatggtcctaatttacaatattttgtgacggaaaaagtaacttttgtataacttatatgtaacttgtattttacttaagaaaaatgttggggcaggagctcatcgcggcgaggcggccgtggggggaggcgttccgggcgccggccttctccaagtcgcccagcgtcggggaggccatcgccaaggcaaggtggaacacggcctacttccgggcgaactacgcgctcgtcgtcgccgcgtcgtcgctgctctggcacccggggacgctcttcgcgctccacgccctctgcaccgcctagttcttcctctacttcgcgcggcccatgtcggcagcgggacaaccgctgcagctcttcgggatggagttcgaggacggcaccatcctcgccacgctcacaggggtcaccgtcgtcgcgctgctcttcaccaacgtcggctagaacagctgctccggccttgttgctccggcagtcgcggccaccgccaccgttcgccgccgtggcgcaaaaccctaccgccctccccggggcgttttccaacctctagatctcccgcggccccacggcgccgccgggcgagccgcgaggccttcacggatggcgatgccgccgccagccgcacggccctcctttcccggtagcccgcccttccaccagcccgccgttcaagcgtgcgccagttgcttcctcttcgcacacctcgacgccgtttggtgggactcccacggccgcgacggcacagccatgtgggttcggtgaccgagcgaggagccggaggaggaggaggaggaggccccggcgggcacccccgacaccgaggctaccgccgacatctccctggccatagccaccatcagcgagggccccgcggccatcgacgacgaggaggagagtggcgctagtgcccccagcatgtcagcctccccatcaccgtgctcctcgtcgttggccacctctcacccgttgctaacttcattgtcgggcgccgtcgccactgactccttgttgggagcgaagggaggaggagacagagagaagagaagggggaagtgggacccactatattttttaagttttatttgactgatatgtgggtccatatattttgttttaattttttaatctcaagtctaatgccacgtgggacgaggacaagtcacactatccacgtaggcgccacgtcaacccaaaccgtcatgggaccttatttgtacttggttttgggagttgagcgatacgtcatatctggtattatggttcggagatgaatttcgaactcgggacgaattgagagatctcgagtgaacttattcctctcattttgggtatcttgccaacgctggcctttgtagtttagtgggccgatcgagagtatgttagcaactcgggacgacaccgttcacaaaaaacaatccataaattaaactgctgtatattacaggagatcgaaccacacgttacgacgtgtgttgtggttttatcaagcacgcacggggaaactaactggagaagaagaaacttcagaggaaatgaaacgagaacacgcatgtcaagagctgatagagcctgatacgtacacacatgacaacaagcatatatacgtgtgcatatatactgatcaaattatgtgaaaatcactcctgatcatccaaggccgtggcaaggacatcgagcaccgttgttgccagcgcgccggttgctgcgttgatcgcgatgttgagacttgtcctgaggaggaacttggcgatacgagtggcgcggctcgagcccggcgtagcagcagcagcaccagcaccagcgttgtgagaacggctggtgtcaccttggccagcgtttgccgcgccagaggggcacacgacgtgcagcttatagaggcaaaattcacagcggtagtgccacatgttcaggccttgatgacacgctgagcatgtcccccatgaaggggccatgttgagatcatgctgcgggtgaagcgggctacggatcgtctgcagcagcagcgtgcacagtgggtgagcgtcgaaaccgcactgtgcgcagcggtagacgaagcttccccggggacagctttccgtgcagaggttgcacgaccacctgttggtatcgtcgtcggggatggtgctgagcgtgagggtgtgccacgggtgggcgaagaaggagactgtctcctcgaagtaatcggcgcaggcgtcgtggatgtcgatgtcgcaggtgttgcagcggtagccgaccatgccggcgacgttggttcggcagatgtcgcagaaatggctcgaggtggtgctgtagtgcgtccggagaagcaggtgttgcggatgggcgaagtgccttcgctgcctagtcgccatgtttcagttgaaatttttcgctttgtgcttttatatgcttcgtgtatagaaacgctccagacggagagtttcacagtttagggggtgtttgggacaccccgttagtctggctttggcatgcctctgaggagttcattacacatttatactacacgcagaatctacaagcacgatggaccagttcactacccatcatatattcctagtaccagcttgagtgtgacaggccggcctgtcactggctgttcgtctttaagatatatattccctcatttcctaaatgtttgacgccgttaacttttttaaacatatttgaccgttcgttttattcaaaaacttttctgaaatgtgtaaaactatatgtatacgtaaaagtatatttaacaataaatcaaatgataataaaagaattaataattacttaaattttttgaataaaacgaacggtcaataatttaaaaaaaaatcaacggcgtcaaacattttaggatggagggagtatatgcatttgttgttcaagatatatagagacttcacgcctcggaccaagcttggaaagttggaatatggactcggtccatccaatcacagccgaattcaccatctgctactacgtttaattcagtggattctgagattctcattcctcaaacatgttaatttaattacttaaggaagataaaagtacattatctccggccgcgccctggtcgacatgcaaattaacgtattatagcactaatattgtgcaggtctctcgatatactacttaatttaccgactaatttccgaaagggcagataatcaaggcatgttcagggttcaatataactgatgcaaaagctatcacggaatttataaaaagagaaacactgttgctcgtatcgttaggaaacaccagtgttagctgctttgatcagatttgtccacggttttgcaaggcagcattaattttacatgttacattttgtttgaccataattttctaataagtattgaaccaccacaggaagatcatattatacattttatagacattgttaaaatagttgccaagttcagttggacaatgagaaaaaaaaaatactaaatccgtcccaaattagatgttttgactttttttttttgcctgcaacgtttcaccattcgtcttatttaaaaatttgtccaaatataaaaaagataagtcatacttaaaatacatttgataataaaataagtcacaaacaaaataaataataattttataatttttgaataaaacgaatggtcaaatgttaaaaaaaaatcaaaacgacaagtattatgagacacatatctagctagcatattgatttcaacactattgatgacccaattcaaattgctcaattacaataacctcgcaaagtcataactagcagcacgacaaaaaagagttggcctcaagcaaataatttagagagatggagtacattgtttcacaaggaatataaacgatgtgactatcagcaaggtctgagtacataaggcgagcacatacaatttgacatcaaaattaaacaacgagagaatgattcatgcttatataattatcaccaagtaggcagcaaaaactatatcatacatgagctgtaaaacaaaattgtacttcatccgtttcacaacgtaagtcattctagtatttcccatattcatattatattaataaatctagatagatatatatgtctagattcattaatattaatataaatgtggaaaatgatagaataatttatattgtgaaacggagggagtataggctagctcaccatatatatcgatcagttaacaaaggcacactactagaaagtcagcgcgccctttggcgcgccagctagctaacccttacgtgcatgtcaaaaattagatactccattatatattgtaaaaataaaatatccttttttttcttcaaaattagtagtatctctttatttaacttgtgttttctctcatttctacagtctacataaaccaggaacataattatcagtaccctcaaataagcaacatttttttcagccactagttgacgttaccctttgttatattttttttgaatatattaacattaaaagataaaataaagagtaaattttataaaactacagatactttaatcaatctatcctacagatttaataacgtatcacaaaattacagatttaacatcatatttttcgtaaaattatagatttaaggtatggtatcagacaatgatagatttaacatcacttttatcacaaaactacaactttcgtaacaccaatagtgctatgatataaactctaaaatctgtagttctttaataacttcaccactaaatctgtagttttgtgatatgatgtttcaaatctgtagttttgtgatatgtttggtgctaaatttatagttttgtgatacatatgtttaaatatgttgacagtttgatcaaagtatatgtaggtttgtgaaatttactctaaaataaaatatatgattttagttatgcatagacgcctgcatgccggtctataaacttagtgagtatgcttgtttgtcaagtgctgtgaaatactaatattagtagcatttgtctttgttatagtcacatctaccatctgttaaatctgttacgatcacaagtctactcaaggcctctttagatcccctggcaaaattttataccctatcatatcgaatgttaatttggacacatgtatggagtattaaatataaacgaacaaataactaattacacagattgcgtgtaaattgcgagacaaatattttaagcctgattgcatcatgatttgacaatgtggtgctacaataaacatttgctaatgacggattaattaggcctaatgaattcgtctcgcggtttacaggcggattctgtaatttgttttgttattagactacgtgtaatacttcaaatgtgtgtccgtatatccgatgtgacacgccaaaactttacacccctgaatctaaacacaacctcagtatctaatcttttggtccgtagactgatgtgactttcattcatggtctctctcagctgcacccaatgctatcagtatcagaatactaggtagtatcattttgctcaaagtaatatcgtatcatagtatcaggatactataagattttccttttttaagttcaattaatatttgtattaattacatatagccattatacataaaaaaatagtaatgatatatgtcatacaaataaagatatttatcaagagaaaccacattagttttgatatatttaactgattttttataaacttgagtatatttatttacattattttcaaaccatcttattttaaataatattttgttggatcgtaaaggatcgtagaatcggaatactacctaagattttataggatcgtgtagtaataaatagatcgagatagcacgaaaattagaatactagataggatcggtatcgtttgtgcttgacaaccttgactgcacctacttctgatcttaacgcgctcacgtatctcttataccgaatcatgggtcaattctcaatcggttaaccctgacacgtggcacttccagatacacgtatttggggcctgttcactttgatgccaaaaaaagccttaccaaattttagcattgcaatgccaaaattttagcatagttgccaaaattttgatatagttaccaaaatttggtagcaaactaaatgtagccacttttttggtaactttaccaaaatttggtaaggttgaaaatggcatcaaagtgaacagacccttagtttccaccggccaacacgcagaacgtgcgactcacctccacgcgctcatgcttgtgcccgtaaggcagctgggccgctctacatgttgactagggggaaaaagtacaccgaacgtccctcaacttgtcatcaagttacaaaatcgtcctccaacagcaaaaccagatacacaacatccctcaatttacagaaaccgttcactttagatcctctggtggttttgaccccgattttgtcctacgtggcgttgagtcaacgtgaaacccatgtgggccccacatatcagtgtggccacgtcatcaccctctctttccccttctctatctctcacacttttctcctctctccccaccgcgccgcgcctccctcccggtgctcgctctcctcctcctcctccacttccgcgtcctcgccgctaccgcggggtcccacttctcccctggcggtctcccgccttgtaggccgctctcctcctcgttaacatctgacgacgttggcagtggtggagaaggctggcgcggagggcgatgtgacggcctgcgacgtgaagtgttatgtgttattaatgtgttcttagatgtgtcatgtgttctgtgctgtgttcatgacgttcttgacatgttcttgaagttcttgatttgtgttcttgatgtgcttggcttgattcgtgcttgggtcagcttgattcgagccgagccggtatttttttttgggcttgttcatctttctaggtgccggttctaaaccgtcgacacctatttggtttcatatctgtgctgcctgcgaggtgtcggttgccaaatccggcacatatgtggggttggcaaccggcaccaaaagatctttatgtagtagtagaactcgttacgacaaaccccaagaatgttttgtgtgattatattattacagataacacgttgaaacagcactcgcgtgttatacgtacgtactccctctgtacttgtagaggaagtcgttttggacagtgacacggtctctaaaacacaactttgacttcttgtttctacaaaagtatctattgaaaagtgatatatgtatacttctagtaaagtatttttcaaggtaaacctatttatataatttttaaatttttaaactcaataactcaataacttgatttaaacattgtcataaacgaattgtagtatacgtaactgacaaatcgctcggacgaaagttcagctggctagctgtaccagtaattaatcgttcgagctcaacgaagcttgcagggcgttaatgaccgccaccatgccattggcagccgggaaatccgccgccagctgctgctccgcgaccacgacgagaaacctcgcgacggcgggggctggagcagcagcagctccgccgcacgaacccctcgcgccgtcaggaccactgctaccctggtcctcgccggccggcgccggcggcggcgggacgccggaaacgcagccgccgatgtggagcacgaacatgcagctaggcggcgcagcggtagtgccgcgtgcgcacggtggagcagtctcggcggcagacggagcagacccgggccatctcggcgggtgtgcacgggccggacgggatgagcatgagctcggtgtgggtgagcgcgtgcttccggtggagcgggctgcggatctctcccggcagcatcgtgcacagcgggtgcgcggcgaacccgcacctccgcgcgccgcagcggtaggcgaggtggccgtgctggaagggcccccggcacagggtgcacggccacgatccatccgccgccgtgacctgtctgagcgcgaggttgtgcgaccacggatgcccgaagaagttgggaggtggagttatcattttctccgggaagaagtcggcgcaggcctcgtggatgtcgaagtcgcagtggtcgcagcggtagccggcgccggcgacgacgcgagtcccgcagatgcggcagacgtggcggctgctcggctgccgctcgccgccaccgtactgtgtcttgagaagcgggtgctgtggatgggcgaagtgcgtccggctctcggtcagctgattgccggacgctgctgccatgataagctattgatgatttgacgtttgtgctagctttgatatatgtgcttcattcacagggttcctcgtgcacttaaaaagggttcatatgtcaactctgatttctgaacaatgtactattagtagcttacggtttttcgttctgatcgaaattggttttaacttttaagatgtgttgaactatgtatgaaacagctggcgctaatagtgtaatttacaagtaaagtcaattttgagatcgagcctgatatgtaggcagttttaattccctctacgcactgatcgaattgaagcggcccatagtatataggtgcactcactgtattgctacttgctccttgtgctagcttacatgcatacagaaacattcagcgacgactcgaggttactcaatgagttctaaacataaaaaaagaggggtcagcggcaatcgccgtctcgcacacgtacgtacgatcaataccttcttcccgaccgcatatgcacaggcgagccaggaccgcgtgtacactgtgcagcgctactgtgtagaccgacaggagagggccggaacagggtccaatattgtttgaaatttcagaaattttcacattgttgtgtgctactgtattagtgtttttgtgcgaggatcgacttcatcgtctctcatacgtcgccggtgtcatggaggcgcgcagaggataacagagggagagatagggtaaaaagaaatactccggtagcttaggttcaatcgacctaacgaagcatcataaggacgtagctggggtagtccttgtggactcgggactaccccaattttgaccaagaaatcccctacacctcataaaaaattaggcccaaataatcaaatccaatagaccaaactaaaattagcaacccaaacccaagaaaaacgttgagctgtgaactctgcaagagctgcccggaagacactgatcaccttttcctcaactgtcccctggcctcagctttctgggatatgattcaagtagcacccttataacatctatgaatttgcttcactccaacaccctgatggacaacatttcggctcttcagagtaataccttcttcattctctgttgctgacgcctgtggaatcatcgaaacaaagttgtctttcagaaccagccccccttcatttctcggctcaatagaagttgtattcaggatgctcagctctgggcacatcgctttaaaccttcgcttaaagcactcctcccgctctggctatcgctgtttaatgcttctcttgctcttctctagttgctgttctttagctcttttgtagcttttagttttcccccttttattttggcctcgtctttgtatagttcctctgtaattctcttacttcttttaatccaatttaggtggggcctccccccaccccccccctcccttaaaaaaaagaaaaacgttgagggcctattcggaacacaggaaaaggaaaaacacaggataggaaaaacgtaggaatatgaaaggaaatcacgttgaaaacataggattgaaaaacgcaggaatataaaagttgagagcattcggtttacaggaaaggaaataaaaagtaatcgaggagtaatctgtatactgtatttattatctaccgctatcttgcttatcccgtctgtcttgcttattatctagtggctgttttattgcttgattggcttgattctctcaaagggaatgaaacaagagattggagtggatggaattttcctccgtttttcctgtggaatcagcagcaaaggattttttcctacagttttcccataaccactttttacgatccgaacgataggataggaaaaaatcccatgtgaacagtattcctatgaaattcccgggaaaagcctccaatccgaatgagccctgagagtggaggatgaggggatggctaatgcgcgcatacgcgccagctaaatcgctggcgcgcacgccagctatccccttccgccggtccttttctttttttgcgtattcgcacttttttctctgatcttaggcgtgttttcttcgtttcttttttatttttttaatcattcacacacctctttacaaataaatatagaattgaaagaaaccaaaaaggcggaaaaacgaaaaaaaaagagtgtgagaagctacgaactaggaaacgctcgcgatttactaatctggcgcgtttgcgcggattagcaatcctgggtggacgagccgttacaacgctactccctactccctgtcttcctcccttcaacttcgcccgatgcccgtaccacgcgcggttgccgagtcgccgacgaggcgacacccgtgtgtcaagtcgcaccaccgccacccgtgcgccgtgccgccgtggatacaccacccaccgtcctcgtggcgccttctgcaggacgttccacagccatctccgctctggtgctcttggccagccaagcgaccacagcctcccgctcccgctgcagcgctcggcgcctcggccgcttgcccgcagccatgcagcctttgcttcaattccggcggaacggaacggcgccttcccctgcaggtagtgaacaactgcctctactccccttcctttggctgactagctcagtagttatgtctctgtaggtaatggcttcaaaaatagatttctgatttgtgagtctgtgaataagtgaataactgaatatacaatttgtaagttgtgattattgtttagtgaatgtgtcattgtagtttgtaggattggtaaagcatgaagaggagcagggattttagcttgttaagtaagccacttatcgatgttataagacattattattatatttctaacatattttcactaattttgttcttgtatatgatatcttaggtgtagaaaattttagtatatgatgtgaatttgtaaactatgactacccaaggaaaatctcctggctacgccactgtattgatatattatggcggcgaggggcgccctgtccgagtgcatcatcagcagtgccggctaccgatgcgtcgagtgcgcgtgcggcggcttcgacgtccaagatcagcgcagagcagtttgttaagtaaatgtgtcattgcagtttgcaggattggtaaaacatgaagaggagcagggatattgattagtgaatgtgtcattttagcttgttaagtaagccacttatgatgttttaagacattataataatatcatattttcactagttttgtacttgtatatcatattttcggtgtagaaaattgtagtatgtgatgtgcatttgtgaactagtactgcccaaggaaaatctcctggttacaccattgacatatgttacggcggcgaggggcgccctatgcaagcgcatcatccgtagcattggctaccgatgtgtcgagggagtgtgcggcggctcctgttaggaagcgataggcaaataaacgataaaaaataatagatcaatcatagaagacccgagatttaacgtggaaaatcttttcaaagcaggagagaaaaaactatgagcatcagttagcaaaatatcttcactttatcggggtaaggttacaacaccgaacgacggcttacaagaagtatatatgaaggtgaaatcctaaaaggataacgacgggcctccgcttcgctctggcagaagctggtcacaactcaacagtttcaatgtccaagatcagggtagagggctgcctctccctgccgatggcgcgctcattctctctctctctctctctctccccctcatggctagccggccggtggactcgaaaacttcaaatgtggcctcaaatccattaaaaaaagtgaatgttagaaaatgaactaatattataaataaaaggggtgagacttcaaatccagaccagccagcccacactactataaaaatcattttcgccgacgttgggtattcatttttggaggcggacatgaccctcagagccaaatagccgcctacaaaaatgcaaaccgagatgaagctcgctgtccgcctacgaaatccattttcgcaggcggacctcttatgtggtccgcctacgaaagtagacttggaatataaatagagctaacctagggccgattttttctaagtcctcattctccctcactcctctcctgcgtccctcctcactcccctcccctccccttccctcctctcaccggccgccggccggaggcagcggcggctccctcgcgacatggcggccgcggcggcctccggcccctccctccctccctgatctagccggaggggggcggggggagggcggcagcggcacccggcgtggctcccctcccagatccggccggagggaggccgggggagggcggctgcggcgaggcgcggggatgaccatggcgcggggcggcggcggcacccggtgcggctcccctcccagatccgaccggatggagaccgggggagggcggcagcggcggttccctctatcctagatccagccgaaggaagggagagggcggtggcggcggcggcgccccccaccaccagcgtcggcggcccttcagcagcggttatgcttcccctcacctccccttcctctccctcgacctcccaaaaccctaaccctagatcgaccgaaggtgagtagcagcacgggtggggggtggtagtgattttttttgttcatcaagaggattttcggccgcctgcgaaaatcgatgtttttcgcaggcatttatatacaggcggacctttccctgcctggaaaaatgatttttggccgcatgcaaaaaaaaaagatttttctagtagtgccaccactttgttgagctagccgaaaaacactctggacgtttttcgcttcaagttcattcaaatatgacctaaattaaataacagacgaattatggaatagcctgaattccctggcatcgggacgccgttcggagaagaaggaaaatacgtcgaggtggtaaaactccccgccgcaggcaacgttgccggaaggggtcgcgggtcgcggctggagaaaggaccagcggcgcgcgaggaaaaggacggcatcagccggcgatgggggaggcgacgcggcgtccgactggctatgtttaggcctttagggtacgaggtggttgggcctttttttgggccgcacggggctaccgggcttagaaaggctaacacgaaagaccgtaacaatcacctcgacaacgcgactgctagctgctggagtgagagtgtgacacacagcaccgaagacctgtcggatgaagggagtacagcatagttgcatgcacaaatcttccagcggctacatttttttttaaaaaaaaaagaaaatcgacttgtgatcgaatcgtgagcacattgtgataggtggaagtttgcagtgcagatggtgcagttaacgcaaagaagaggaaaaaaaaaatccagttgcacacatgcgtgcactgtttcgatcgtctagagattaagcgccgtctcaatgacttcgatcaccggcgacccgaacccgccggtgaccgcgtccgccacgcgcagcccgaacaaccccatcctgagagccgccatgccgacgcgcctcgccaccccacgcttcctaccatgctgctgctcgccgtcaagcagcgacgtgcaccgcgcgtgcacgtcgaagtcgcacgccacgcagcggtacacgcagcgcccggcgtgggaggccaccctgcaggcgtcgcaccaccggctggccgtgaggagggagagcgtgagctcgtgcgcggggtgcccgacgaacgcgacgcgcatcggcagcgagaggcaggcctcgtgggcgtcgaagccgccgcactcgccgcacctgtagccggagccggcgatgatgcgctcgcacagtgcacagacacaggcatggccctcctcgccgccgtagtggtgcctctttaacgagtgccctgggtgtagcttgcaggtgacagaagctgccatctcttgaccgataattcgatcgatatggcttggtttaatttgtttggttgtagtagttgtgcatgcggtgttgacgatgcttgtactggatgtgtatatatagatgtttcgagtcgtcggtcttagttgattaatttttcttttctagcctgacaagacaataacccggcttggtacagtgtgtgccaaaagaaaaaaaaaatgtatgtaccggcagcaagcatgagcatgacttggtatacgtgggatcagtcacactccggagcacttgctaattattggatagtaaatttcacgttcaacaaaaccagcagtttaatttaggctcaacttgtgctgaggttggaacaagcgctgaggatttatttttatgattattcagactaccattttaatccaggctgtttcgtaatgtctcaagagcataggggctagtcggcgcgctatgggtatcctagtattgacaatgttgatggttgatcatgggagagctgcaacacagttgattttaaattttaagttttgattttatattaattttagggtgttttcttcaccacctactttgtccagatctcccttttacaggtgctaaaagatgagtaaaaaaactcagccaaaatcattcttgaaagttaaaattcaaaatcaccttgggttctaagaaaaagcaaggtaagccaaacagagcaaattatgggtctggtcggcaagctggctgcggttgctaaagctgaggctgcgtcgtgcgtgtgcaacactgttggtgctggctgtgccacagccgtagcacaggcagccgaacaggccctatacaaagctctggtgttacctatttttttcaattttatgtgattagttgtagtgattatgaatgcgtcgctgagatatagagttttttttttaccaggttgagatatctactgtttcacggatgtgaaattccgtagatgtatctgttagcttgacccaaacaatataagcggctaatgagtgagcgtgttgaattggttagtggagcgtgtatgcttatcttatcttaatcccagattcccaagttcatgagtaacatatttaaattaagatgtcaaccaacgatcccagattccttgcaagttgcgcccctttggccttggcggcagaaaagaaaaaatttcaacttggcactcgagagtaggagtacacatgacctcttcaaacacttcacagctagtagtactggtataaaata

SEQ ID NO: 64257 - DNA, 8269 bp, Oryza sativa
tagcctgcctccccatggcatatgttccttctgttcctgcattcgaacgaatttggatggatttgatcaaaaacttcaatggaatccgcatttttaaatttcttgtgtttaaaacgtttccagtgtctcatattatttcgtcagtaatacagtaacctccaagcatgttggatcttggaacgtggcaacctcaagccctcaaagcttaaactgaattgaatattccatctcggtatttttagatgcagtgcacacaaccaagaccaaggtgatctagtagtgtttgaaacagacaagaactattctcaaacgcaattgaataatcaatcaacaaccaccctcccccagttcgaccctactcaatgatgatggagtaaattgctaatctaaaaatcataggattccgcgtgtgcgagtgagttccgctaattcagcagcaaccagtaaccagaaacgtgtctctcgcgccgttaaacatttgggcaggacagtgacgtgcatgttcctggccataggaggcttggggattgggacctgggggtatggcagtgacatttcttcttttttcccctcttgtatgattgcatctttgtatctaaatcatgtgtccatgttcacgctgcaaaacaaaatgtcaccaccacgcttggtagtggataccgatgcaaatcacacaagcctataacaatggtggtaagtgcagccatgacataagcgctttgctgtcaattagtacaaggttagtaccaactaaacacgaacagcacaggagccgttcgccaatgctttgtctgcacaatggatgccaactttggccttgtcagcaacagaacaagtgcaggaactttaaaaggctagacaagatatccgctgtaacaaattggatccacctacggacctaccaaccagcaacaggcaaatttggccgatccggcgatgacctactttgaaacacgctagttttaggcagcgttcgttctgggagattggaggtagaatgcacatcgttttccgcgtgcacgcttcctaaactattaaacggtgtgttttttgtaaaaattttttataggaatgttgctttaaaaaattatattagttcattttttaaatttgaaataattaatactcaattaatcatacactaatagctcacctcgttttgtgtatctcccaaatcttctctatctcccctttctcaaacacagccttaaatgccaatgcttttttaagacatgctttttagatggactcgagacacgtctgaaacactatagtttctaattctgaaatttcacaggacatagggaagattcatgtgttacaaacaaggactttgcatcagagctttctagtcagtaataaaaaaaataaattgcatcaattgcagcagaggttaaaatctgtactagttttgcaaatataactggtagtcatatcacatcttagaagaaaatgtagacgaggttagctattcaccttttgtgcggagtttgagcagaaaccagttgtttctcttgagaaatcacatgattgtccttcaagcacagcatcctggttcaaatttagcctttaagctttggcttcccaaccttgcatgcaaacttgttctgaatcatgctgaacaggaaacacatagcgtcgatttagatgcaaaggactacttcttggacatgtaacaagcaacagaaaattgtctgtcaacttgcattagccaattgtgggaattaaaaaaaaaagcaaaagaaacaagcggcaactgatgacatcataccaaattgaccggtaccataagaatatgcacaacgaaagcagtttgagacatgatggactgattttccagatgcatttgcaggacattagcagcagtgttttgatcggccatacctttttggaactcttacagtaaatttagatcaacagcttttcggagtcatcaagaatatttaggatctcactgacatgccttattaacaacccattttcacgtcagtgtggttggaggccattaaactcagtagagacctgccgcaagtgcagttttgcaaccccacctgcaatacatcccggcacctgagccctgaaaattacattgtcttgcttacttaaagaacaagaaaatgatcgtcattctttgatgcatgtgaactgagaggcatattatcaaggaggttaactttaacctcttgccctaataggttcaagtcctaggatcaacttggatgaccatctcatttttaattgaatgacaatattcacattatccaagccagtttttcttttactctttatcgtttcaataaaagaagattctggaagcacaatattacctcccacagtcccactagagcaatcatgcccatcactcaacatcagaaaatatgtcaaactcaacatatataacagtgtcagcttgataaacagcttgcttcggtaagtggcatattatcctgcatatgacagtatttcatgacatattacgtcatataagttatggccaggctgtactacaaatatccatttatcaagctctaatcagttcaagctagaaggtggcactggccagtagcaatttcatacaaatggtaaatgtaagcttgttagcaaaagattatatatatatatattgtttaataggagcatgagattgatatttaggcatgaactctctctagtctcatttggacaagaatatgattgatgtagatcatgtaaaaccaataaaacagtgattcagaaatcaaatgatggtgaccacgaacctacaactggtcctgtatcaatttgatttatctgaaaattctacaactattctggtgttaagtggatgctgattgctcaagaaattaggtatacgcaaatatctgaaaaatggagggccacaagtctctagtctacagcataattggagtgggcttcacaaatatttaactgtgatatatttccactaaattgcctaaaaaggaaattgtttcattattgccaatttgatgctaataaattttggccaaattaaagtgtcatgtcacaacataactccaatatgcctcaataaatctttgcaactgttagaaaattggctacataatgtatttactcttatccacataagtaggcattctatgtgcgaaccagtaaaaacagagttcacaccacaggtccattgcctaccattttgatgaaggatagagatgtgtacctaaataattactgaatggtttccctgccaactccaactgaatttctttgtacttgagagccaatcatgatccttgactggttctatcattccactccacgatcatgataacatgatgttgaagatggaacatgcatgatgcatcagtaaggttaaaaatctgtgcatttgcggaaataccagaaagggactgatactctaggattctagtttctacaatacaactttgaaacaggtgcttctcatctcaacacaggtaggggcttcaaagaagcatactgaaatgagaaggataaattacgcaatacaagtcaaatttaactttgaataaaagaagcgtcaagttttaccttcagcaggaacatatgtgagaaatctaccagattataggtgcaggttctgcaatcatgagaacataaagcttcctattagttggtacaactataacagaattctgaagtttgcatcttgcacttttgcagacacttgaaggatcacactatttgggctaaaattggcctccacaacttgttacccgattggacttggcccattaaaatgttttttcagttgccaggaacccagactggtaagaagatggaacatgcatgaagcattagtaaggttaaaaatctgtacatttgcggaaataccagaaagggaatgatactctaggattctagtttctacaatacaactttgaaacaggtgcttctcatctcaacacaggaaggggctccaaagaagcatactgaaatgagaaggataaattacacaatacaagtcaaatttaactttgcataaaagaggcgtcaagttttaccttcagcaggaacatgtgtgagaaatttaccagattataggtgcaggttctgcaatcatgagaacataaagcttcctattagttggtacaactataccagaattctgaagtttgcatcttgcacttctgcagacacttgaaggatcacactatttgggctaaaaattggcctccacaacttgttaccctattggacttggcccattaaaatgttttttcagttgccaggaacccagacatccagacaaaagatcgtaatcttttcctgtcttacaccaacctgttacttaacaactattcaacatttctaagacatgttgcaatatttttttatcagctacaactttcctaggtaggcaagctgacacttattcgaagagttctcacatgttaataccataaagtcaaacaaaccccttaaataggtcagaagtagagagaaaaaggttaatcttatttcaacttttcacctaaaagccagagcacacgtggtaatttgtgtgcaactgtgctatgggtatgcaaacaaacaaaagccatgcacatcaaatagcaaattactcagtgatacaaattttattcgtaatgccatctgttactttcaataattcaaggcactctacttaaccttagaagactcccttatgctaattctgcaatttcagaatggttacagcaatgtgggcaccatggtttgattatgccaaagacatactggtgactggtgagttctgtactggccataagcatagcttctcaacattactacctagaaggccattatggtacataagttgaatagtactgtaccagtttatggtagtattaaactggtcaagaatatttcagacttctattctattggcattcatattcgcatgtactagagattaaaaaattagccatattgaaggtggctgcaaagtttcaaacaaaaaaaaaggtggctgcaacctgcaattatagcagattaatattggaggatgatattcaagagcaaattcaaaataggtacgtcagcataagaaaagaagtgcattattgtgcaacaaccttatgttggtagcacctgacaagaaagcagctggtgtatttggtacttgtaaagaataatggaagcttcaatcttggcgcaaaccaagtttcaaacctggcgcaaacagtgtgtgttttcagaaaaaaaaaacgttttatataattagcaaaaacataaacgtttcacatcctccaggctacaagaaatgcttgcagcggtattcaaaggggtaccatcaagtgtatccatgtgcacacgctgaagtgcacaataacataatgaagaaaacaatcaaattgacaaccatgtggaaaagctatttcctaaatcaaaaggccggggtactgccaaaaggatctgtgggtttttctgctcaagtgcaaactgattatagttaacctatcaacttctctgtcaaagctctacctttttgataaataataaagaagctctggtgacttccaaaaagagtcctagactactagttatctagtaggattctaggtcaaagctgaattcacaatgtaatgtgactttagaatggcatgtcttcattgaacagactaggaccactaagaaagaacaaccgtccttcacattgctcagaataactaaaccaggaatgaggttttaatagccgacgttctttttctatcaatgccagtctggattgaggtaacttttaatcaaaagaagaactctaacatgcctagaatccatcccaaagaaaggaatgacgacctcatgcctcaaactgatacaccacccaccatcaatattcaattcttcccatcaggcgtcggagctgtgagaggcatatcccacctaaacaacaccttacacctacagcacgatgacccaattcataaaccccccaaggccccaactccccccatctccaggacgcgaacgcgcttgaccctactgccgcattacatcgaacacctagcgtgcgccccgcccgccacaactccacccacctatccgcacatgcggcgcgcgggcagccgagtaaatcgccccgcccccgcatccccgaacaaccgccatcgctgctggtttaagcacatttgatgcatcggtggtcctcgcgcctggcccgcgtgcgcgcgaaaagggaccgcgaccgaatctctctggcttctctagtaaagttggtggatgatccggagattaataaacatttaaacaattgggatcgaggtcggtggtaggatgggttgggtagccctggtaggagttgaccgatcgatcgatcgatccaataaacaactgtttgacttggggaaattaaaggagaggagaggaagagatcgtgcgtgcaaaatgtgatgcggcggagtccaaaactagtcgcctgggttggttagggcgactagtcccgataggaacagcaagcggtggagagaatggcgggtagggggtgaaacgatcaccttgtttgtggccgccgacgctgccggcggcgatgtcggcggccggatcggagaatcagccgtggtggcgtggtgttggtggacgactggtagacggtagtggcgggaaggcggagcagataatgaattgtgtttagggcaaatttgaattaagacaattgaatattattatccaattgtagtgtaaattaaggcaaattgaataatattattatcctacagtctgcaaattaaggcaaatttgaattcacctatccggttatcaaattgtactataaaagaatattgttaagacgaaatcggataggtgacactggtacttttataaatttgaattgatctattatcgttaaggtttctgtcaatatcttgctcccgattatttcttctctatctccggcgcgcatagtacaaaatgattgtcatagcggctgatggcatggatggccgtggagaagcagagtggcgcaagcgcatcgcagcgatgtgggggctcgagctcacctggcgaggcaacgatgtacggacttaagctcccaagggcgacatcgatgcggctttgagaggcagacaaagctcggtcacactgaaggacaatagtgatagtggttgctggagcgagctcctaatagcgatggcaatacaacttggagaggttaaggggagctcgatgacagtgagtagaggcgattgtggttgctaggacgtcagtgcatcccgttctgcctcgtcgtcctcttgccattgtcggatcccttgcctcctccaacaactcctggatctcctcctgtcacacctcttccacctgtcgctgtcaaatctcgtctttatcatgtctactctggtcgccattgttggatcccttcccgtccatctgtcgctggccacctcaagaggaagaagttacatgctttgacagctattgcacgtttcttattttagaatagtgaagtgacacaaatatactttcaattttgttagtgacatttttctaatacaatgtttcagtggcatgatcaaatttaccctcttgtttacgatgaagtctactaatcggacaaaaaaataatgaatgaacattcaattaaaggatatatgatagattatcttattctacattaatatttagagggtaacggagttaaaagttattttaaatactatcccaagaatgtatgtatttttttatggaaatgctaaataccgggataccgtttgctagcgttcaggacgggatcttctcccagcctcacacagctacagataagaatggtgtggagacaaccaggttccacggcagccattgcagtagagacagtctatttcacgcgaggttgcggcatggcgtctgtcgccgtaggttgtgggcgtcgccgtcgtgctgctcagctactcacgccaactgaggacggcgatggcgcgtggggcttggccgccgttgctgaatcgaagagaggtgccgtgttgaggagcagcgcgagctcgacatcggagctgatggatgtgggttgtcacgacgatcggggatagagctatcgtcgaagtggatagacgcggagcaaggaggacacagccgctggcgatgagctccgacatggcatggacggtggaggatgcggccatcagtgacgagcttcggcgtggggcctggatgacggagaggacacgaccgccgccactgagctccgacgtggcgtggacggtggaggatgcagccgccggcgacgagcttccggcgtgagacgtggacgatgggaccaccggcgacaatgccttgg

SEQ ID NO: 64258 - DNA, 829 bp, Oryza sativa
gcccaattattcagcagcagcacaatgccacaccctaatcgatgatgcaagcatgcccattatggcttgaactgcacgtttctcactgtattattggggaaaaagcagagtaaagcatcaggcatcactatgaaaacaaaatgaaaagaacttgtgataagtttgatctcacgttattttaataaatgatggctttgatgagctgaagattctcaggtccaggacaggtgctagattaacaagggtctcaagcatgtttgttatgagctcatcatcttctgttacatgataaaaatgcataaaaagttagtttgttatgagctcataatcttctggtacatgataaaaatgaatagaaggttagtttacatgttatcataacttggtcctaggataaataacttatttgatttagcacacaattaacatcaacttgaaattgaattgccctagacaattggatagaataatttgcaacacacttcttgctatctataaagttttccttgttggtaatttttttatatcctttagatctatgtaaaattctcttttaacttattttaatacattacagctggattatcccctaccatctcctgtcaaaagcaaaaattatggcacaacacaaccaaaagaggtagtcggtcatttccatattaatttatggtttttaaaatagaatataattgaatttggaactttaccagtgttttggtcttctaagcactgaaatacagtctccaaccagtgtctatgttgaaccataacagtctcattttctggcatgaaagagaaattgcgaattatattggaggctgcaacagca

SEQ ID NO: 64259 - DNA, 11637 bp, Oryza sativa
tcgaattcctgcagccccgctgccactcgacaagctggtgctcgtccagcgcctgaagcagaagggccacgtggtggccgtcaccggcgacggcacgaacgacgcgccggcgctgaaagaagccgacgtgggcctctccatgggagtccagggcaccgaggtcgccaaggagagctccgacatcgtcatcctcaacgacaacttcgacacggtggtgacggcgacgcggtggggccgctgcgtgtacaacaacatccagaagttcatccagttccagctcaccgtcaacgtcgcggcgctcgtcatcaacttcgtgtcggcggtgaccacgggcaggatgccgctgaccacggtgcagctgctgtgggtgaacctgatcatggacaccatgggcgcgctggcgctcgccacggacacgccgacggcggggctgatgcgccgcccgcccatcggccgcgcggcgccgctgatcagcaacgccatgtggcgcaacctggcggcgcaggcggcgtaccaggtggccgtgctgctggcgctccagtaccgcggcttcggcggcgccggcgccggcgagagggcgaacgggacgatgatcttcaacgcgttcgtgctgtgccaggtgttcaacgagttcaacgcgagggagatcgagaggaggaacgtgttcgccggcgtgcaccggaacaggatgttcctgggcatcgtcgccgtcacggtggcgctgcaggtggtgatggtggagttgctgaccaagttcgccggaacggagaggctggggtgggggcagtggggcgcctgcgtcggcattgccgccgtgtcgtggcccatcgggtgggccgtcaagtgcatcccggtgccggagcggccgttccacgagatcatcacggcgaggaggaggaggagaagatcgacataactatcaacgcttaccactgttcatattttcggatttttgtcggtagcttaggccattcttttggagatattataccatcttgttatttgccatatataatatgatatatgatttgtttggttcatcaatattactcatatcttttctcttttaggtcttgtccgtctaatctctcgcctaatccctttctcataggagttattaaacgaacaaggctttacgatatgccatttgccattttgtcatcaggcgtgacaactgacaatactcagatttgtgacacagaatttcataaaggacaaggcgcgtgcgtgcggctacgtgtatctcacgatgcataatgataataagttgggatttgctctatctcttccatgatctgaaaaatgcagaattatgtgaatgcaaccctaacctcaaagtgcagatatgtgctctgtcaaatgatttaggccgagtttagttccaaactttttattcaaactcccaacttttctattacatcaaaactttcatacacacacaaactttcgatttttccgtcacatcgttccaatttcaatcaaacttctaattttggtgtgaactaaacacacaggccggcctctgaatatctgattcagatggaaacctgaatttcaaacaggctagcagcatgcatcaagtaagtgtttttggcagtcgttgtcagaaccaagaaactttggttgttgcaaactccgaattcttgttgtcactcataaataacgattcttcccaatgttcggcaggagatgaggatcggatagttaggtatcgtaagttgtgatgagtcacaaaagatagtttgctccagatgctgagcgcaaggaccaggttatttttagacttgaactcagaaagaatgttacagaatttcctggacgtttccttcaaagaactctccatttctgtcagaatgggtttcgccttttgttcatatggaatcaacttataccacactgaagaaacaatggctcgtgaatgtacttacattttgttcatatggaatcaactttttttgaaaattttacagcgtgctgctccgtctttgcaagtttcagtgccacttctttctatcgccagttgcaacacgtcaacaaaaaagagagtaaattgcactttcgtatatgttgtaacagggtgtaaatgacatcccccacataatatgataagaaacttttgttcccaaatgcggttcttgctgtcactcagtaacaacgtttctaccaaatgttcggcaggagaatcggatcgttaggtattgcaagcttgtgactcaaaacatggttcattcggtcattacatatgctgatatgctcagcgctgggatcaggttgtttctatagacctgttatacaagaaagaaagttaagtgaatttcctgtatgtttcttccagagaactatccttttctgtgagaatggggtttcgcctttgcttataccaaactaaagagacatttgtttgtgattttacttacattacttttgaaaaattctgcagtgtgggtggcaactgctcctagcttctttgcaagtttccattgcgaggtctttctctcactgcacggtaaaaaaaaaaattgacctgaataatttagttttcacgtccttctcagattaaccagtaatgagaactctctcctgacaccgtcaaaaaattacttctagtttagtttaaacgtccttctcatatttacccagcagtttcttgggaatgagaagttaaggggaagtaaagttcattctttgagaagcttttgacagagtaatgtagatgaagtctaagtaaatttacttaggatgcatattttttatagtagtgctgaagacaaggttgtgtactgagcacaaaaaaagtctgaatttcctgtccatgctgatctaaaacaatgaactggtctaatctgattatctgaagaaccatctaaaaagatcttaacttggcaacttttgttgaaccaagccaatttccaccaacctataggatgtaaaattccttgaaaataaaacaaatcacaacaatacatcacattcccaaacgactgttgctgatcttgcctgtcacacagttggaaatgcaagttcagagattcacaggtactgtaacagattggctatacaacttacctgggattgacaggtgcaacaaccatacagagaacatcaaacacaaagtgaaacaaatgaaaaataaggcaataacacattaggctatcagcctatcaccagtatgaaaattgaagacagctgaacataaataggcccatttggaacacaattctcccatttcctaggagaattgagtgtttcctacttcctctgtcccataagataagggattttgagtaaatgtaatacatcctaggacaacgaatctacgtcacatcctccccaaatcccttatattatgggatggagtataatattcttgtagatatcctataaaattccaatgttccacacatagtataaacaaaaaggaaattccacaaaaccacctgttctgatgcatcctggagtgcaagtcccagaatcaatcaaatcactatgacatctacaaaagcaaaggtcagtaagtgatcaacaaacttgactggacagcagtagcaaagctcttgaaacctgatcataaatgacactaaaccatacatccagttcttctgaatgagcttaaacagatgcagcctcagatagtcagatagcaaaccatcacaacatcacaagcaagcattgtcatcaacaagtaacaaccaagcattagctagtcacccaacagagagaaaaatataagcagtttcacatcacaactacaccaagctgctgcaagtcaagtcttcagccctaccaccaaattaccaaaggtttagccagccattacacagattcaggaacacctaattcaggtaatcaccataacaacaagtcctaaatgattaagactactagtgaaaagataactgggatttttttctcactaatcccctagcagagaggtcatagaaaacttccaagaacacatagccgccgctgcctctcctactccttggcggtcttgttgatgagggacttgtggatgtgcgggatgacgccgccgccggctatggtgcccttgatgagggtgtcgagctcctcgtccccgcggatggcgagctgcaggtggcgcggggtgatgcgcttcaccttgaggtccttgctggcgttgccggcgagctccaggacctccgccgtcaggtactcgaggatcgccgccgtgtacaccgccgccgtcgcccccacgcggccgttcgccgacaccctccccttcagctgcctgtggatacgccccaccgggaactgcatccgccattgcccccaagaaaacaagcatcagtgagtacgcagttgtgcaagaactagtgaagctttcggataaagaactggaacaacacggggtggatttgcgcgaaaaattggggggaattcacgaaggcgacaaagatgaacagtaaatctggcaagaactagagcgttttgctaatgcactcgtctgaaattgaatctgctaacgaagctaagaacagaatcgacgcggaaccaccagatctaccaaaacgcagccaagaaaccgcctaaaaccatccagatttccgcaaccgcagccgagaacaaccaagaaaaagatgaaccgtcgcgagaggcgcgtcggggaagggagagagagaacctggatcccggcgcgggaggagcgggagacgggcgccttcttgcggtccttgtccttgtcggcggcggccttcgccgccgtcgtcttcgccgcgagcagccccttccctcccttccccgccattgctcctcctcctcctctccctctccctctctcgctcgcgttggtggttcggctgcctcgcgtccgctctctctccctctctctcccccttcctcgctgtagaatttatgtcggtttgggaggagcgcgcggaggttttggagggaaattttcgcgggcgacgcgggggttttgggcgaatttcgaattccaccgcgcggcgaggaattaatttcgaggaggattttcggcggcggcggcggcggcgtgggtgggagattaagggagacgtgaagggtagagagcgtgggccttgttaacccagtaaaacacggcccattaattagacagtacaaactgggccttctggatgagctggaacttcggcccattaacttgtaggcccattttgtttgggctgctatttttttcaatttcctggcccacgtcaggaaatgaatggactattcaaggttggatgggctaggatgagtccccatccaacaaaaggaaacaaaagcccttgagtgttggactgtttcaaggactagccttttcttttttttttcttttgctatatatttttcgactctaatttctcttttcgaattaactacaattttcaatcggggcctcaggggctattacgctctcttttcccaaatttaagtcgttttatagacatattataagaattaagaaaacaactcaaaagattttggccaccctgcatattgcattgataaagataaatcatttgactgtgaaaaacgagcatttaaattttcatggaaaatatgaaatcatagttaaaagttaaaacaaacgtctgagctctaaaatgacttacattgaggatacctttaaaaaagataaagaatttacatttaaaatcaaaggcggttgctgggctacttggctgccgcagcaaatacgaatggtactcaaagcctgcaaacaccaagccagaagcacaactacaattgcagccagggttcacaaaccatttaggatgtggttatcgccacccaacaatataacaattaccgtaaggtataccgtggtttcaaaaactaagaagattaccgcatgtgataaccgcgttgtattataaaccttgattgcagcatccgcctgcagaacaggcctagggtgtagtaaataaaaaaaatggtgttgctatgaaacacacacacacacacacacacacacacacacacacacacacacacacacacacacatatatatatatatatatatatatatatatatatatatatatatatatatacctatccgtctcgtaaaaggctcaattctagttatgaatctagatatatacgtgcctagatttataattagaattgttttttcctgtacagcttagttaggtattattggaaaatgaaacaatagtacatagattccctggatggtggtgtacatctttgtgccgtggttggcccttcttcctcatctttgatgcctctatccatccatccatccacatcctttactggctttgagcagcatcatcctcagttccaactttcagctacaagccacaactttcaacagcatacagttcttccagctttcaactcaagacgaaatcaacttttttttttgttccaaggagctacaggcaattcgaatttagtccttctttagttggaaaaaattttttgggtttagatgtcgcatcggatatatagacacacctttaaagtattaaatgtagtctaataacaaaacaaattacagattccgccagaaaattgcaagataaaattattaagcctaattaatcaatcattagtaaatgtttactgtagcaccatattgtcaaatcattgcgcaattaggcttaaaagactcgtctcgcaagttacacgcaatctgtgtaattggtttttttctacatttaatatttcatgtatatgtccaaacattcgaagggtttttttcactttgatgcaattttcaaccatactatttttttaagttaccaaaaaaatctatgtttactttgttgccaaatttagttaatacataagaaatcctgctaaaattttggcaatattgctatcttgccaaaattttggcattgccaaaacttggtcaggtttattttggctataatctaaacagacccaatatgacagcgtgaaaatttttgttttgggaactaaacatggccttaggttaccagttcaaaatatttaaggacactttcattcatgtccaggataggaagtttcagtcaggaatttcaaggaaattgaacttcccgatagggttttcaacctggttttgaggggcctttcaaaataataataataataaggctctagttaactttggcagggttgttgcagtgccaactgccaagcctaacacagcgagaccaaagtgcacacttttagcaatcgccactgaactaagagcttgtttggataattgccaacatgaactcttccaaatatagataggctgaaattttcaataaagcaggatcattccactgttgccaaagttttagtactacattttttttcataacaacaagcatgaatgtttcattctgtcggtattgccaattctcttgtatggttagcatttgtaacaaaccaaacaaccgcactacacatacgtaaaggacgcttccaccacgacctacttcccattgcatcttggttccttcaaacacaatgtaagtaaatataatactactggtcactcaaactactttcaagatacattcttattttaaaaacaatggaatagataaacataagtagtcactcagaactccatcaaatacattttccaagtatcagaggactgtgaccaagaccaagagagacacctccccaaacttcagaagaccggtctatggcaaaaaactgatcacgcatacgagtagtaatgggtacaacttttgatctaacaagatataaggggactaagagcatcctaggagctcatccaaatttcatcccctatattcacatttagattcatccaaaaagattctcactctatattttttcccactccaacagatcatccatactacatcatccatatatattttattgtatctttcaactatcacatttatatcatttacatttatcttcctctcttctattctacccctcatcatctcttctattctaccgatgaggaggacgaggaggggcgacgtgcggtcatcgggcgaaggaacagcggggttgcgggcggtcgccgggcggaggaggaccggcggcgcaggcgataaggtcgcggacagaggagcagtgcggcggtcaccgggtggagtagccgcggcagagacggcggggttgccgagcggcttcttctccaataacctccctagcccagatccggttggtgccacctctctacctcccttcttccttcgatagccaattttatcgaagctgcgccttatcctccccgtatctcctcctccatctgctttgcttgccgccgttgtgaactccgggtgggggcgggagctcaacccagagcggcggttgcgatttggcgtgaggagagaggaacgccaaaattggtatttctctctcatgttttagcgatccgctacttttggcgttgccgatggcgtatccgctggaggctggttttttactcccatcctctatttcttagatggaggattggatggagcatctgtttgggatgctctaagagccacgtctataaggtagggctgaaatttagttgatttttgaattaaaaatatttaagaactaaaatgagatgtgaaagaactcgtagcccctaacggcctgacccattaccaccctaacagaacagaaaaaacccattccgttacagtgcagactcacacatgaacagtactccccgggacaatctgacgatgaagccatgattagtgaagaccaaaactgaagtgaaagaaaaaaataaaataaaaaagagctccctgattctcctccagcctctgaatttctgaaaccatcactgttaccctcgggcccatacgtcagagttccgtgggcccgagccgtgacgccaacctgacacctaccagtcacgtcccatcaagctttggtttgatcgtcttcaggcttcagcttcacaacacttcagaatactcgcaaatgaggacgccacgtcgtgcagtaatctgtctctgaaagtggtgctttgttcttggattagccagagatgttgccatctgctcaaagtctgggctcgtatcatcatcgctttaccacgggctcagtttcgtactagtaaaagaaactctgctactgaacaggaagtatcactaataattatattcctatttgatatagtgatagtatcttagtttttgtttaagataacccattagatgccactgagtttgttatgagtctacgatttgccattacctttgtcacgttctataatatgccatcgacttttgctaacctatatgatttaccatcgtcgtccggttattccccgttagtactgtacactttcatccaaatgaccaaaatacccctgagacaaaaactttcaaattttggataaaaattctaaaatgtaagactttaagtttttggtcaaattttgaatgtttacaatcttatgtttataatatggtattttcgaatttttgtccatattttggaagtttttatcttagggtattttggtcatttggataaaattgtacagtactaacgtagactaagcggacggcaatggtaaatcatagaggttaagtaaaagtcaatggcatattatagaacgcaacaaagtcagtggcaaatcgtagagctgtgacaaactcagtggcatataatagattgtctctttttgttttgtattggtgtgtatgggatgggtgaaaaataaacttattttggctctgttcggctgcccttattttcactcagtatattatttttgagtaaattgcaaccatagtatatcaacttggcaggtgggtacaatttggtgcaagaacttaagaaatgagcgttctagtgcaacaacttggcagatatgtgcaatttagtacatagttgatcgcataaatgcaacaacttataagatatgtacgattttgatataataagttcagaagctatgcgacaacttaattatttggagcactttttttatacatattcaatttttaagtacttattttgacaatatactagtgtggatttgtatataagcatatttatatttttatcataataactaataactaaaagtcaattaaactagatataaaaattattatatttcagttgagatttaggaaggtgaaaaaaaacaaaaattcttaaaggtaattatatctaaattggatgtgcatgataattcttaaagattaaatttaatattataaggtaataccgtaggattgctatgtaatggcatattgacatcgtgagaaaaactcacctagcatatgcttagctaagttgatgcaccaaaatactaaattgccaagttcttgtactagaacgtacacacttgttaagttgttgcattcaaatgtttaattctcaagttcttatattatatcacatccacccgccaagttgttgtaccgtgggtataatttactcattgttgtggcagctgaacagggccgttgtaacagatggagtagtataataataattcaacttattatacaataaaagttgcatatcagtacatgatctgttcccatttctctaatactaaacgataaggtggtgatgtctctgtcatgccatatcagtattgccccttcacttctctcttcaacagcatatcccttttttcttcagcagcaggcaggcagcatctctccctatcctattcccctttttaataaattggttttgtttaccaatcacatcacatttctgtgaccactcccttctctgtcaacaccacaagagatagagaatattaggggagaacttactcaataattttctggtttattggatatggttctattctgctaggtagcactgtactagtacagctttgctgataggggttaacctgatcagggtatggcagaaatgattggcttggggaaagaaggagaaaaaagaaaaggcaaatgttaggtttgatagtcacatgaactatgttgccctggaccatggccataaagttgttacacagtgtgcagctactgttcacaagttttttgcatttgacttttatgactccaagatcttttgacaggtattgttggaaagattaatcaccagcgctgactgtataaagcagaatggaaaatggtctgtcctcaaaaggtattactatgcacttaccaggcaccagccaggataaatagctggattattgttttttaggtacatagaagatataaggaaaaaggtacaaattatttattaaagacagttcgagttacctgaactacaacatcaaacactcgacactcctcgacatttcacaatgtacaatagcctcctcaagcatttctctggatggttttggcctaagctagcacatgtggcaatccaacgtggtagtgtgtgccaaatataggttgattccgcaatcttctgttcctctgtctccatctcaaatccctaaccccaaccccctctcccaaatctctagccgatgtcggacaacaatgaatcgatggatggctgtgatcgcaccaggccgtgattcctccattactagcgcttccatctaggcatgtgcatagttatgaaggaaagtgaggaatagaggagaggacgctaatgccaatgatggaggggatggatttgacaagagatttgcagtcatgatagatctgggtcttcccttgtagagcgacataatcgaggagggctgcaggaattcgat

SEQ ID NO: 64260 - DNA, 7407 bp, Oryza sativa
  unsure (1)..(7407): unsure at all n locations
cctgaaaaaatgtcataggatttcagacaataataaaataagatgatttttattttcgttagttttgcaaggaaaaggacaggatcgatatgacatatgttacatatgacggcgtgttcatatttaaattcaaaagacgatgaaacgatatttaaagctcgttgacataaccgatcgaggcggcatttgtcatgcaaattgaaatctccgttatgcaactttagcaagtaatcaaggacaatatgtgtacggggtagtacggcacaatggatatgtacgagatgatcgatgtgtacgttaaacccataaattatccatgactaattgggatgtctatagccggtccgatttaaaaacatacatggctccttcgtctcaaaaaaaaaatctcctccatctaaaaaaaagtatatttagttcacaataaaattgaaagtttagttaaaattggaacgatgtgacggaaaagttagaagtttacgtgtgtaggaaagttttgatgtgatgaaaaagtttgaagtttaaagaaaaagtttagaactaaaccaagccttaatctcgttcaatatattctagcacaatgaatctggatataactttatattccgatttgttctaatattaggttgtctttttttaacggatggagtatatgctataagacaagcatggtaaaatatccataaaagtatttattactctctccgttttacaatgtaagtcattctaatatttctcatatttatattgatattaatggatctagacatatatacctatctagattaattaacatcaatataaatatggtgcgtagcgcagaccacaattatttgcaagacgcgtacgtacggctgcgggcggcatgatccagccgcgtccatatgtaacaacaaaaagctcacctgttgacagggacacaccagctaatatgtacctggagtactacataaaaagtcaaagacttcgccgtcgcagtttgcttagccctcaggtatacgcggatggctcgccgcgcgcgaacgtaacgtgtaacggtggcagggatatggctcgccgctcgccgctcgccgctgcttgcctgcctactagagcttcccggcaaaggcacgtataaatcgctgaactaaattaacacgcgcccagctgtgtttgcttcagttcacacatatccctgccactgccgtactgccaccgcgtggatcttcactgcaataagtgttgaagaaaaatacaaacattggtcatgcaatttctggtcacatcagaaatttagttcgtgaaaaaaaaattagggtgtcacatcagatatttgaccggatgtcggaaggagtttcggacacgaataaaaaaattaattttataaattgcctgtaaaccatgagacgaatttattcagcctaattaatctatcattagcgcacgtggattactgtagcacttatggctaattatggactaactatacaattaatattttcatgtaaactatgtaattaatatttttctcacatttagtgccccatatatatgtccaaacatttgatgtgacgtttttggcaaaaaaaaaatcatctaacgttgtgtttagttacaaaataattcttcaaacttccaatttttccatcacatcaaaacttttctacacatacaaaccttcaacttttccgtcaaatcgttttaatttcaaacaaacaatttttaattttggtgtgaagtaaacccagcctaatcaaggcctaatattgtcgctggcgatttgcttcgcctgcgccccttgcccgcacgctgtcaggcacgcggcggccgtaacggcagcggccaaggcgcgtaccgcgtggatgggatggatatacactgtgctgcctagccacctgccttgctacgcgtgcgtgaggcttgcctggctgctgctaccccgcggctaaagcaaagctgcgtgcgctgtggtccctatgtttcagtttcacatgttcatgcctaggtcacgcgtgaaatgactcggttagtttgctgcaaatgttaatgaagatgcctgtaaatctcggggggatgaacttttggtattttactttatatataagtattgatatatactctcactctgttctaaaatataaaggattttgcacggattggatatttcctagtattcgtagaaaattcaacaattttcgagcaaactttggaaaccaaaatttgaatgtgaaaaattgaaatttcattagaggtgatcagttttcgatcgaaatggcttgaaatcctaaaaatttctatcagtttaatttgtccaagatgccacgaggagataaaccaggggggcagtgcagaggctttagtcagcgctggagaaattggattgtgcttctcctatcgactgcatcatccagaattttactcaatgggatagcgggagaaccaactacacacaggcgaggcctccggcagggtgatcccctctcgccctacctcttcatcctagcaattgacccgattcaacgactactcaataaggccacacaagaggggcttctatctccgttatcaaaccgaacagcacggttcagaatatccttatatgctgatgatgcagcgatctttataaatctgatcaggaatgatgtcaacaacttgattagcatcctcaagttcttcggcgaggccacaggccttcaagtgaatctgcacaagagctcggtcgtgcccatcaaatgcgcagagcagaacctgtccgaggtgttggaaaatttcaatggacagcggggcaattttcccataacatatttgggattgccgctcaccccaggccgcatcaagagaatacacttgcaaccggtgatggacaagttgcaatcaaggttagcgggatggaaaaggaagttaatccagcaatcagggcggaagacgctagtcacgtctgttctcagctccataccaacctacttccttaccgctttaaagccgcctaaacagttcctcacagacatggacaagattagtaagaaattcctctgggccggcgatcaagagattagcggggggaagtgtaaagtgaattggaaaaaagtatgctccccaataaacacgggaggactaggcgtgttggaccttgataaattcgcgagagctttgagactccgttggctatggtttgagtgggagtgccctgacaaaccttgggttgggacaacacccccctgcgatgagttagatgagcaaatcttcgcggccgcaacaaaggtaacaatcggtaatgggcggaaggcaaaattttggacatccaactggattggccaccagccgctgaaataccgagcgccagcgcttttcaaccactctaaaggaaagcaacgcttggttcaggatgtgttaaccaatgacaaatggattgaggatattaggcatgagctgtccatgccactgatccgagaattcttcgtagtgttccgccttatctgggataatgagacaaacctagaggaaggagttgaagacaccatcatctggagatggacaaatataccggtaaatacacagcaaaatcggcttatttagcccaattcgccagtagagaagactcaagggccgccaccttgatttggaagacatgggcgccatccaaatgcaaaaactttgcatggcttgtcctgcaaaacaggatatggacatccgaccgcttgcaactccgacaatggcccaataactacttttgccaactctactacaggaacttggagacggcgcaacatttattaaaggattgtccattcacgcgagaaatttgggacaaaataatggctaggatgaaccacaaccaacccttcccggtgcacaatccggacgagagtctagttgactggtgggaatcaagaacaaagcaacaaagcaaatgtcaaagtaaggggatgcagtcactgcacatgctcttgagttgggaaatctggtgcgagaggaacatgcgagttttcaaagataaagaacttcaaatccctcaactaacggcaagaataatggacgaaatannnnnnnnnnnnnnnnnnnnngcaaaatatcttgcgagaatagcgccttaacctctcatcctttgttgtaattttccttttttctgctctcctcccccctgtctttccccttgtcaccattggtggtatttgtacagtgcttatcttctgaaatataaaaccagctaagctggcaaaggttttaaaaaaaataaaccaggggatttattgctcgaaattcgatcggttgcttcaaaatccaataggaaagtgtggaataatatggaaaagaatattcaatactccatccatttcacaatgtaagtcattctagcatatcacatattcatattgatgctaatgaatatagacatatatatgaattatgctagaatgacttacattgtgaaacggaggaagtatcattttttgtaaaaaaaaaaatcgtgtacgtatgccacttagttctacaaaaactttccactcaaaaaaaaaagttttacaaaaaccatagtattaatagttgtttttaaattttccagtattttttcagaaaaaatgacaggaacagtatttttcaattcgatctgaatataggattttgtcccaaaaaaccttaaatttctaatcgagattgagatgtcaatatcttacgaaaaccagtaagttttggccgagaatgtaaatgcatgaccaacagaatctcaaaatactaatcccaaaattgaggatttctaataaatcaaatccaacagttgccatgctcagatgctgaatgctttcgcggttgccccacagccaacatgaattgaatagtgccacattcactgtgcgcagcccctgtagacggcctgtcgaacgatcccttagaattcccagcttcagtttttttagttctgcacattaggagagtctacgttctcaatccgtgcgtaaagattatgttagtagattttcaagatgggattttaaagatggactatctcggtgagggaagggtattatcatactttaaatttccattacagatttcctaaaataagatttaggggattaaattttggatatctctctggtcaaacccttaaaccccgtagttacctttcttaatgcgctaaatataatttggatcgaaatggtactaaacacggttgtatgaaatggtaaataaaatacacacggtaaatttacctctagttacttctcttggttaccttccctcccaattactaaccttattctgttcaacaatttctatttttaactcacaaacggttgatctttgtaacagacatagtaataatagtggaggttatttccattacagatttcctcgcagcttcttggtagcttctgttaaaccgtgatatatatagggggcatataggaatccatccttccaccaccaattaaattcagtttcgcaccaattcagcaaatccttggaccattttctttgagagtaatcgcttgtgtttctcgaaattgtgagtagtttgatccattcatctttgttggtcgcttgattcggcagcgcctgatcgatcaggatcgggtactggatggagtgcgctgactacttcatcggctccgggcggcggtgctcgccgtcgacgtcgacgtcgacgtcgagagaggcgtggaggccggagaagcaatggcggaaagccaccaacgtcatcagggggtgtcataggcttctgcgcctcggcgtcctctccgccgccgccggcatcatgcgccggaacccctcctatgtcgagatcaaagtgcacgacgaaggcgagctggacgtctcatccggcggcgacggcgaggcacccgtggcgttcactgtcgccgcagatgatgagtcgttcaagggactcgtcaagaacaagcgggaggactgcttccgccttctgggcggcggcgccggcgtcgcggcggtgctggcgtccggcgcggagcgcggcatccgcggcgacgatgccgacgtggcgcgccgcaagaaggcgttcggatcgaacacctacccgaagcccaagcccaaggggttcttccgccacgtgtgggacgcgctcgccgacgtcttcctcatcgtgctcctcgtctgcgccgccgtctccctcgccttcggcatcaaggagcacggcatcaaggacggctggtacgacggcgtcagcatcttcctcgccgtgttcctcgtcgccgcggtctccgccgtcagcaaccacagccagggcaagcggttcgacaagctggcacgggagtccgagaacatcatggtcagcgtcgtccgcgccgcgcggcgccaggaggtgtccatattcgacgtcgtcgtcggcgacgtggtggtgctcaagatcggcgacgtcgtccccgccgacggcgtgttcctggacggccacgcgctgcaggtcgacgagtcgagcatgaccggcgagccgcaccccgtcgaggtcgacgccgtcaagagccccttcctcgcctccggcgtcaaggtggtcgacggctacggcaagatggtggtcaccgccgtcgggacggacacggcgtggggcgagatgatgcgcaccatcaccagggagaacaccgacccgacgccgctccaggagcgcctcgaggggctcacctccagcatcggcaaggtcggcatcgccgtcgcggtgctcgtcttcgccgtgctcacggcgaggcacttcaccggcagcaccagggacgagcagggcaacgcgctgttcgacaagaggaatgtcaccttcaacgccgtgttcagcggcctcgtcggcatcttccagcaagccgtcaccatcatcgtcgtcgccatccccgagggcctcccgctcgccgtgacattgacgctggccttctccatgaagaggatggtgagggagaacgcgctggtgcggcggctgtcggcgtgcgagacgatgggctcggtcaccgccatctgcaccgacaagaccgggacgctgacgctgaaccagatgaaggtgacggagttctgggtcggcgccgaccggccaagatccgccgcggcggtgaacggcggcgtcgtgaggttgctctgccagggcgccgggctgaacaccacgggcagcgtgtacaagccggacaacgtgtcgccgccggagatcaccggcagcccgacggagaaggcgctgctgtcgtgggcggtggaggagctccccatggacgccgacgcgctcaagaggaaatgcaaggtggtgcgcgtcgaggcgttcaactccgacaagaagcgcagcggcgtgatgctccgcgacgccgccaccggcgcggtgaccgcgcactggaaaggcgccgccgagatggtgctcgcgaggtgcaccgtgtacgtcggcgcagacggcgccgcgcgcgagctcggcgtggagcagaggaggaagctcgagcaggtgatcaa

SEQ ID NO: 64261 - DNA, 4581 bp, Oryza sativa
cctcgcggtaaccgtcaaaccgcttggtggcggtaacctcatccccaaacggtttggtaaactctgctacgaagaagcagatgctacaaaattagatacacaaaccttatactttagagtttttttttcctaaaacacactacaaatgcatgatactcataacacgcacacacttatccctatgaatacacacgcacatcctatctctatgatcatcttcgaaagactaaaccaatataccttgaggctgacgaacactactacagaacaacctatcaatgctggttcgattaaacccggtgctaacaagggtttacccggcattgataagaacccatcggtactgggttttttataggatcgacactaacaagttgagccttgagtggtcgagccgagccaagccaaaatgtgtagtagcgcactagcattctctctgttttctttttccatgtatctttcgatccccttctccccatcgctctatccttatctccttttctttccctctccctccccaggactggcgaccagatcattggaccctccccttctcttccttattccgtgtcacgcccagaaatttagcccaaattttcagactattttgtgtattaaatccctgtattacaaaatattcccggccatgatttttaaagggaattttaaattccctctattcttcacttgattaaattgctttaacttttatttaatttctaaaaatgcattatttaataatttttaatcccgaacgaatatcggggcgtcacattccgacaagaagtagccccctctccagctgcaatcgcagcctacccctagacgtcgatggcttgctgcttgggggaggaggaaacgacgtcatccacgttggtgcgcaccctgtcgatgagtaggctgacggtgtaaagttgcccaccaccaacctcgagtagaaggacatcgatgacagatgaggtcaccggtgatagatgtgacggctacgacttgaagagaacggcggtgaggtacgtcggctattccttccctcctccccagctccccctccctgctcgggagaccttcttgctagatctctacatgccaccactgcacatcgttctcatttgtgagggaacaacaatgagctagcgtgggaaggagcaatggactagtggtgccgtgatagaggcgacagaggggtcaaagcagtgatggtgaagggctcgagtgtggccagctctttgtgatgttcttgttctcaatgttcttgttcttgatgtggaattgtggatctgtgtaatatgcatgttcttgtctttagaaaacaatgtaaacttgattcatgtgtcatgttggatgttcttgtctagctttatctcaagtcatgcagaaattgatgatgggcggaatctgcaaattccactacaccgaagctagtcacctgtgacgggccctaaccatcacctttgacgggtttgggcctggtcactgataagtcccagtcacctctgacgggccagtattttaggtccgtcacagatgagagtcacctgtgacgggtggctatttccagcccgtcagaggtgtctgtcacctctgacaggtttaatttcaccacccgtcacaggtaggaaaaatcacccaaaaaaatcaaaagccctcagcccccagcaatgtctcgatatgcaagacacgataactttgcattttattcatagaaactttgcattttattcttagatctgttaacatcagagaacaacaacatatgaagcacttccacacaagtaatatatatcacagatcacacaacttatgtaacaatatacatcacacagtaatgattcccatcttaacaaactacaaatccacacaagcaatcaagatatagcctaatctgaaatttggcaatgaaaattagcaatgaatatagccaacctaatcggaaatggtggcggcgcttgtgggtgaaggagatgtggaggacgtcggcggtcggggggacgagccgcagacaccaacagttggggatggaggcggcggacgtccaccagatctggccgttggtcggcgggggaggcggcaggcggcgccggctggcggtcaggaggcgagggaggtggctgcgaacgctggcggtcggcggttggtcggcgggggaggcggctgccgccagatccgtgtcctccaaatttgttgaggtcggatccgcggctcgcggtcaggaggcgggggaggtggccgaggacgccggcggtcgacggtcggtcggcgggggaggcggctgctgccggatccacgtcccccaaatttgttgaggtcggatccggcggcaggcggcggcggctcacggtcaggaggcgggggaggtggccgcagacgccggcggtcgctggatccgcatcctccaaactcgtcgaggccggatccggcgaccggctattgggagacggggggaggagacggcggccccgagctcctggaggccggcggcgagcgaaggagacggcgacgcggtcatgggagggaggcgggaggccgcggcagccggtcgtcgtggggggaagcgacagccggtggagggtggacagggcgacggccgatggtgggtgggtggaagcgaggagaagagagaagagagaagagaggaggaagcgagaagatcgagaggaggaagagagaagagaagaggagataaggctggtgggtgggtggtgggcctcctacgtggggtggaggtttttttttttaaggtcaccagtgacgggtataaaaatccaacatgtttgaggtgaggtatctcacctgtgacgggttacaaacttaaaacccgtcacaggtaagaggtcatcagtgacgggtctgtacggggacacgtcaaagatgttgtgtgtcgggtccttatatagatccgtcatagatgagtacttacctgtgacgggttattttcttgagccctatctatgacgtgatttattgtaacccgtcacagatgaggttatctctgacgaggcactttggtccgtcactgataggccgtcacagatgggccgatctggcgtagtgttcgatcatcctttatttcggttggcatgttcttttcgaaagtagaatgactcttatggattattataacaatatctctggtagtacgtacgagcatgcatggagactcacttgaaatcatgttaacatgtcccaggaatcatgtcgtgtaacacgaatagaatcagatgatctaggcaacaacatacgtgatatctatatggactccacgagtttcattcggttggtattcacatcacacggactttctttcgcagttcgctcgcaagtcgtgacttcgcaatgaatgttgcgcgtgacaggaatcggatacgaacgacgtaccatagttttgacaaaaacatcttcaatatttaaatcatgggcgagggcaatgtagtcccaatcggacatgtggcaatggcaaatcacgcgcgcaaggacgtcacgggtccaatcgggcatgtgaaaaattgggcacgcgagggcattgcaggcccaatcgtggcggcgggcaaagccgtgtgtggaaaacaggcaggggcccaattgctgcgtgcggcaaggggtgcatgaaaaggtgtgggcccaattaattcacgcgcatctcgaataagagggacactctggtgtaagaaaaaaaaagaaaggatttcacagaaacataaaattaaaattgattcaaacatggatatcgtagcaaaattctggcggaaacatcttcaatttttataaggcggaatttgctacatgacatctaaaaaagtgtaattagctagaggacaccataaaaacatgtatttgctgtagggcatcgcaaaaaactggtaattaactgttggacacccgcagcattatttcataatttttggaggaaaaggagaaagaaacaatgattaaagataagtttgcccttggattaaatgactccaacgtgggccccacatggaagtcccctctcccccttcttcctagataggccgagtggcggtgccgaccacgttcgccgtcgggagagggggggtttacgtgcagccggcgccgttgcctaagtgcctcgggcaatccccagtgactggtggtcactacaatgaagcctccgaggcaatggtctttgtacccactccttccccgagcacccaccaccaccgaagcaccgattccccttcccagttcaagcctcaaccgttgccatgaccagctatataccaagccgtcctcctaccgtacgccacccgcccaccccccgggccgcccgcagccgccgccacgctgggccaacccactcccggccgtggcccagccgtagcgccacaccgccgtggcctcggccgcgccgccgcgcgctaccggccgccggcgcctgcgctgctgcgcccggccgtcaccccgcaccgccccgcgccaaccgcctcccgctcaggcgtgcactcacatggtgagaaaggggatcgagagagaagcaagaagaaagaatatagagaagagaggaaagaataaagaaaaaaaattcaaagggtagaaccgtatttacaagctgttttctcacct

SEQ ID NO: 64262 - DNA, 28264 bp, Oryza sativa
tcggatacaaattcgaatacagtagcgatggtatccgtcggaaattggattcggtcggaaactatccgacctttttttgccagatatccgaatcaaaataaacaacaaaatccaaattaacaaacatcgaaaaacgctcgtcgccgtccgccgcacaccgtcgcacgtcgcacgccggatccgctcgtcaccgttcgccgcacgtcgtcccctcgcgccgccgagccccatccgtcgccgtcgcctcacgacgtcgaatcccgcactgctgggctgtcgaccccggatccggccgccccgagtccggcgtcgccgtccgccacacgccgtcgcctcgtgctgtcgagttcccgccgtcgccacgacccggccgccccgaggccggcgcggctggttccgcttgtcgccgttcgctgcacgtcgtcgcctcgcgccgccgagcccctgccgtccgccgcacgaggccctgcccccgacgtcgccgtcgccgtccgccgcacgcggccccgcccccgtcgtcgccgtcgccgtccgccgcacgcgggccccgcccccgtggtggtcgcgggagccgggaggaaagggtggcggctgggaggagattgggaggtgtgggagaaactagggttaggtttatatatccctccatctaaatgggccaacgggcctaagaattagctattaagtctatatgtcctccctcaacttcgaattaaattttatgatactaaatgaattcatgtgaaaaagttatcaaaaacaaagttgtagaatttattgagatctaccaattttattttggtcatttcttcatccgagtttgattgaactatataaattttgaattttaaaatataagaaattcaaataatttttcgggtagtaaatgatttcaaatggaaaaagttgtcaacaacaaagttgtataactcatcgagatcaacaacttttgtttgggttatttttctatatgactttgtttaaatagtttgaatttggatttcaaaatatgacaccttcaaacaacattttcaaatactaaatgatttcaactgaaaaagtcaccaacaacaaagttgtataacttatcaagatctacaacttttattttagtcattttttcatccgacaaagttatagtaacattgtttacaaaatttacatatcttgtatatggtttcataagatataagagagatatgcaaattttataaacaatattactatcacttggtcggatgaagaaatgactaaaataaaagttgtagctcttgacgagttctacaacttttatattcataactttttcagttgaaattatttactgcttcaaaatattatttgaagttgctattttttgaaattcaaattttttacttgataaaacaaagtcacaagaaaatatggccaaaataatagcagtaagaacacaataactcgatagaacataattttagaacacaataatagcatcgtaatgtcttactcttgattgaatcgtctccctcaaccaaaaaatcgaatacaacaaaattattaacactaaaatttgaaaatgttgatatgttctattagaaaaaataacgagttatatttattcgttgatttgtgaaggtcggtttgaggggcttttatgttccgattaatattcgttaccgtattcgttttgattcgtattcgcttcgtatctgtattcgataatattcgattccgttttcatatccgggtttctgattccgagaaaaaaatatgaaaacgaatataataaagctagttttcgaccgtatccgatccgttttcatcctagtggtgagtggtgactgggtgagtggctggggtgagctgtgcggttcagcggctggatgggaacgatgtattcgcggcgaggacaaacagtgaagatccagccctattttgctccacggaaaatatccagtccttttttactccaccgaaaatcgtcctctactattgccggtctgccagttgaaattcgacctccctacgggaaatacgtactctatggtgggcatatcgtgcgtgtaggaattgatgaaatgcgtactctatggtgggcatatcgtgcgtgtaggaattgatgccattttgaacaactattcagattgatggcattttgaaccatattatttttagtaaaattaataaatatgttaataaatttagtttgttatcaaatattggtactgcctaaagaattttggtaacaaaacatttaatctatcctatcaaaatttggtaatattaaaatctggtaatattgttaacttgtccaaattttggtattgtcaaattttgaaaaggttcatttcggtagcaatctgaacaggtcctagaatccaattcaggtaattttttttatcttttttttaatcttcaagctttaacttttgaaccactataagtgaaaatatatactttctccgtttcatattacaagactttctagcgtcatccatattcatatataactagattcattaacatctatataaatgtgggcaatgctaaaaagtcttataacctgaaacggagagagtattttttatcctaaaattactttctccttctataacgtctctttagttctctggcttacaagtgggcctgatcagctatggtagccactacagtacattgcatgctgctgcacggtcgattggttgatcagaggacccacgaaaagaaaaacaataagaggattttttttctctagaaattggttaatttttccgtaaccgaaaagactttgacttagaaaaggagggctaaaggcaacgtgtatccatgattgactatttcacgatggtgaatgctggagcctggagtacatctgccagagtgccaggcacacactgcgtttgagaatactgatctcaggcagtcaggctcaacacccctcaaggaaaagtattagttaaactcaggacattaacgacctttcaggccatttctgttgcttgaagccgtagttattttcgctaatgaaacctctcttgcttcaagccatcggagtaacacgctgattacgtgatgacttgcctgagaccctctttacataggactaaaaacttttaagtccctatcacatcggatgtttggacactaattataaatgttaaatgtaaactattaataaaacctattcataatctgggactaattcgcgagacgaatctattaaacctaattaatctatgattagcctatatgatgctacagtaaacattctctaattatggattaattaggcttaaaaatttaaattaacttttatttatataattagttttgtaaatagtctatatttaatactctaaattagtgtctaaatatagagactaaatttaaatcatgtatccaaacaccacccaaagcggaacgagcaagcaattttctatacgaagggtacgtctgcctgccgcctgtggccggcttggcttgccgccacggtttccttgtcgaacgcgttgccatgtccaagtctaatttattaatagtagtatcgatcaaagctgttcctttgcaccaaataattcacccctctcagcgtgtccatacgacgatttgtcaaccaaatgaccgtttcgcaccgagacacaactctatcgctcttcgtctgaaaagagaggcgtcctggctacacagccttttacatttctagtcgtttttttttctcatgagctgcgtttgtgggaggtgagtttgtttgttttgttttcacgtgcacgctttccgaactactaaacgtgtttttctaaaaaaatttctataaaaaatttactttaaaaatcatattaatatatttttaaagtttaaaataattaatatttaattaatcatacactaatggctcttctcgttttgggtatcttctcaatcttctcttttcctcctctcaaacttgatgtttaactatttgcttttcctatgccaataacttgtgaatcgtttatgtatgtatgacatatgaatccaatggtatatgctccctccgccaaaaaaaaaatgaatctaggactgtatgagatatattctagtacaataaatctgggcatatgcatgtctagattcatattactaggatatatcaaatccagtaatgtgttggttttttatggaacagaggaagtagttaattatcatgtctaaaagtagcaaatagttaaggcttgttaactttgttatccaaattaaccatactggattttgatagattttggcattattaaattttggtagcattggctttatttgatttgatacatttatcaaaatttggtaggcttttaaaagagaaaactactaaaactaccaaattttgctaaggttataatgattgaagtatgtttagtttgttgctctattaaaatttgataatactaaaattttataaggttaaaattggcattgtggcaacatgaccttaagggccattttggtttgatttaaaaaacatatcttaccaatttattagcaaatttaatagtatgtgtgttactttggattgagatcaaatatttgggagtactatatttagtcatattctaaaagtttcttcactatactatcagaatttggctttatattggcagcaattcaaatattaactaaataattttaccctaccaacatttttttaatagtatgccaaatttacatagtctttaaattatctccctgcgggaccgttgatggagacgctcgcgacgtgtacgttaaccctcccagatacggagcaccgagagcatcttgtcacggtgtgtctcattgcacgtattaatagccggttcgtgcacagccacagcccgcaacacaccagttgtcgagttgccccgacgaaggaagctaggggttatttggatggtgaccatactttgccacaactttggcaagctactttgagcacatatttatcataccacactttttaattttgtgaacacacttatcataggtatatatctttgccaacatttgtctaacttgtgaccaagaatttcttagccacataaattgtggcatgccacatcttagttagagaagtttggtaaactgaaacaaaaatccaaacagcccctaaatccaccaccgcaccaccacccgtctccgcgcgcgggacggcgacgtcggcatcgcgcgtcgccgcgtccgcttgtgcgtggactccaccgcacgcatccgcaccggtgagaaaaactgggaacgcaacgcgtggcgcagacgcgtgcgcgggtcgatcgtgcgcccggtgggttttccggggaaattggggcgcgagctactctcaggttgcagctggtgcgggctggatcggagtaaagcctctgtccagtgatggagtgagtggtgactgctgttactcgatcggccagcgaacgaaccagccggccgcctagcctaagatggcacgatcagcaataactgctgtcctaacctggggggtgacttgtgggagtgtgaggccaaatctgtgctttattttccactaataaataaataatacgggtcgagttgggtgcgttttgtggtggtttctttgcgttgctttttggactagttcagtgtggtttaccctggtccggtcctgggctacaggccagcaagtccagcagagcttaggggtgtcaagcaccacaaaaaagttgaatttagccgttaaagaaaccgagctccacggctagtggagatgaacacgtccaagaatggtggtttggcttctctgctttaccttttccttttaacttttatttccatgctaggctgattctctacgggccgatagtggctttttaaaaacaattacgagccaattcggtgggtgttgctacagcattgctgcggctgtgcttcagctaagggagggcacaaaccactgttatcgactcgcagttgcagcctacacggttgtgataaagggcagccgaatagctcctatgtatagcatggttcttttctctaaaaacattctacaaaaccattgtttaaatcacttgttctatactaagttttggttttattcccacaaataaccaccaataatctatatcaatcatccatacaaaaacagagcataatgaccgcctggttaatgtggactgtggagtgtggacgcacgattgagctattctactctttaaacggtgttgaatattgatctggtccggtcttccagatgttctactccaggaaaagccaacacgccgtgaaagcatactagcagcagtagtacagtagtacaaatgcttcttgtttcaaacttcaaagtaaacagtagtagttgtaaagagagcgaaattgcttcaagctaaccgtattgtttacttcttgaccaggcccagatgtcaactagaggtggcaggcagtgacgcacaaactgcacaagtgctactccatcagtggcaacgttgaaaagtaaacaccgctgatgctccaaagctttcttccgttgaggaagtcaacttgagagggcacccttttgaccagtaaccacaccaccaactggaactggaaacatgctctaatgtgctagtgctacgtgccgtatttctatgttgagtcctgctatacgtatgacgtttcagttatacaactcatattcaactagataaatataattataaataattaaagaagaacatgtttatatgcactgcaaccatttacaaccattgatcaactttagttgtatgtaagttagacaggtcgtacgcataacaattttcttctatgttccatacgctttgagatcagtgcatggttcctcgaagacccgtctgggaagcgggacatttattttaaagcattactagaaaggcacatactacaagtatattatattcatataccccatgaaaacgtttttctaatatgttaaatacatattagcgacaaatcaatagcatcactaaaatttgaaagcgcatccgcatatgcgtaacatttacgaacactaggattcaaacacatggtggatggagttatgcatggcctccttttagaacgagctcgggagtcctaggataaattcacaatcttaccaatttttttgtttaaagttaaccgtgtgatataaaaatcgttggtattaaaatttaactcctgatagatgctataggacagaaatgtttccccttcatttgacatttttgatgcacccattcatttgacctttttgatgacataggacagaaaactacacccaagctaccttgaatacagatgtttggactttggaagggggcagataagcgactttctgtgggatacacatcaccatgccagcatgccccatgactaaatgctcataggccatgacagtagtttatgaaaacagataattttgatgctatgcgtgtattgataggcaaagctggaactggaagcagtcatgcttggcttttcgttcatgtatgggtacgtagcaatccatcagtccatggctccatgcctctagatgagccaaagggacacgactaacacgagtattagtgatgtttcagctcagttccccgaacctgtgggaagttaaatcattaatcatactagttcaatgaacattgtgcgttatttactcgtcaattctgatcgcaatcagcgaccaaacgcgctctcatcattgcgcagttggcatgttgcctatgtgccgaattcattgcatccatttttatttttgggtgtcattccttctgaacatgtcacgcacatgcgatgagccatgtctctgttatcttttgttccactgtccccttaggcccttatcaaatttagatgaacaagaagtagtacatagccatgacaaacagagatactgaactttgtggaagcacttacaagttacaaatcgctacatggctgacacttgtgagatttgttcaaattcatagtaccaggtaactatattttaatacggaagtagtacatagccatgacaaacagagatgctaaactttgtggaagcacttactttacaaatcggtatgtggttgacacttgtgagatttgtttaaattcgtagtattaggtaactatattttgagacggaagtagtaccatgcaagctaaatatagttgcattaatccgatcctgctatcacaaatggagtagagctaggaaaaatattatacaagagagtagacctatagtttgtaggaatacacatcagcaagtagcatcattttcccttatagttcaaaaagatcactcaagttcaccaaaaaggtgaaaagaaaacgatgatgaaattaagaattcatatcatcatccacgttgcattctccaaggtagaccttgatgcttcttggtgacccgcagttgccttctgcaataagagctctatcgtttgcagccatgtgttggattattttgtatatcatttcgatctaaggttgcatcaaggaaaggagttagtgcgtcaatccattgatgtttttaccagtgatacgagaaaagagcatggattacgggttacctcttcaggacagtggcagcgatctgcaatttgatccagtgtcaatggctcagcagggtccttgcagctggaagatagtaaactcgactataagcagaaagatctcctagtacaaaattaacacaacaaactggagactagaaatgttatcgtaaatcatatctttggttctcaccaatcttatagcatatccgcatctgtttctcatgaaaccatgtggagaggaattgaaacggttatatgttcatgacaaagagatgcctatatgtttcatgttttctttgtggagtactttgttcttatttaaattataaaaaaaaatattactgcaaaaaaaaggtcccacagtcacctcttccaactatttgagtcaactgatcagctattgtaatctatatacatatcattttttaaatggttgccgctaaccaaggtactcaaacatctccagaacatttttaacaggctattttattccaaaaggacgtgggtgtagttcaagaatttaggtcaacacatctatatgattttgtttcaagttctttggactatagccatacctagaaaaacaatgcgtggttattactgcaatgaaatcaaacagtagaagaaaagggaatgaatgcagttcaagaacattgatgttgcccccatgaagaaaaaaaaaaaagaagattgatgttccatacctggcttcgttaagaacaagtaggatccttttctgaagtgccaacacctctccagcagcctttttccctgcttcgacacctgtacaaagcataataatttgcatagatcatagcaacaaattttcttaacaattcttgagaaaatttaaaaaattacgagagagtcaaaccaggttgatgataggcattgatgttgattaaataagcataaagaccgacagcacgctcatagagtgcaacaagtgctccaacagctctagggtttacttcttggacagtgactgtaatagattcgcggtcatttgcataaagagctgaacgagttccctacaaaaattaactttgtttcatcatcagttttatgtaattggtatcatgtcaaatctcacttcatatttctatatcagatctggaaaattacatgtagcattccaaacaagtagtccccacatgtaacacttggttcaagctcccactcatgaccaggaggcctatcgcgcaaaacttcaataaaagtaacaaagaagttgtgcacaccttctctcagctgctgaatgtagctgaaatcagagataaatcattggtcatgcatttttctaatctatatataggaaagtaactgacacagaagatgagaagattgtaaagatgtaaacttacgcatgctggtctgtgcttcctttgttaccataaacagttagtccctgattaacctgcattacactatcatatgttaaaggcctgtttaggacatagtataactttttacagaaatctgtacattttccacatgaatagggaaaaggcccccctttgaataaagacctcgacatgactgataatataagctatgagaagaaaaaggaataatgcatacccgatttccatcaaggtcaaattcttttccaagagattccatgacaagttgttgcaagtatctactcaaaagaagcaggctatccttgtatggcaatacagccatatccaagaacagcaattagtatcgtaaagactaaggataagccaaaacacacaagcagtcacaatgcatacagatgcatggacatggaaggaaacttggaaggaacagcgaataagccataataactgatcaagttgaaaactactaaccttactgcctattccatccgatgcccaataccaacacaatgcaagcaaggctgctggattttccttaatctggacacgtaaaacatcataatcatatatatatttagttacaggagtggcattgactatttaacttgtattttatatgttcaaacaaatcatacttccagtattccctttaaaaaaaaaattcatacctcagtattcctagtttcctcatccatttgtgcagcaccaactagcatttccttgatgtcaatacccttgtaagttgtaataagtctcttatcagttgcaacattggaagtccatggaaatatttttctcctcaacagacaacagaacatgcaaatgtgaggcactgacctgtaatgctgctggcagtaaaccaacagctgacatttctgatgttctaccaccaacccagtcaaacatgggaaatctagctaaccacccctctattctggcagtgttatctaataaagaattctcttgagtaattgcaacaccctgcaaaatagctggtcctacattatatcaaatttaatcatggatcaaacacgtgcatccacgattagaagaaaataataaaattcacagggacctatgattcttattttgtttggtagaatcacaggaacctatgataatatacagtaagcaattatctgatcaatgtttggtcaccatccttgtaaaagaatgtcaggtcaccattggaaaaggtttctaattagcataatggatacataaaaaaataaattaaaatctggctatctatgttatggctcaagtactatgattgggagaagaacactaagacaacatttagtaaagcataatattacagtgatcaaatcatcaaaagaagggatattgcaggagactacttttttcgtttagaaacaaagtactacgtgacagacggtaaactgagaatgaaactttcacacccacagtctcgtacagagcaacatacagtatttgataccgaagagaaagaaagcatagaaggacaaaaaagaaccttaggtcacaacctgtttcgagaattctagtccagcatctcggaaggccttttgtacttctaatagaccatttcgtgtttcaggtgtgcctccactctagaagtacgaaaaaaataagatatatcagattagccatgaagtagaaaaaaaaacagataattagggtgtgcatgatgtacctttgatattacaatcacaagagttgatgcaagttctggtcctagctgtgcaatctgatggtcaattccagctggatcggtgttgtcgataaatcttatctgacacagccatcagaaagataaggtagatcacacttcacacacacagtactttgagctgcagaagacattttaacaatacattacattgcaaacgagctcactttacttatgggtaaataaagtccataagcaagtaagctactcagcctactctacagcttaaagtccctattgaaggatttgaatttcaacttggatcagacacaaatgatagattatttcaaggcaaaagtaatgttacacaaaacaaaagttcctagctcaaatgggcctttgtagtagatagatatgatggtgtagaaagcaaagactgttcatattttctttgtggtattcataaaactgaattctctattgaatttggaatctcttcgatgggccctgaatactcttggacctattacttcagcaaggaatggatcctagtaactatatagacaaagtaaatgagaagaaaatgtatggcagatggtacagtttacaggaataggaaataccatcagaggagggttatctggagcaagtgcctccgcaacaaattgtggccccaaagatgaaccaccaattcctatagaaagtatttgagtaaatcggccagcaggggaggatggaggtcttatctgcattaagtaaaccatcacaaaagtagcatgataagttgacacaggacataaaacgtacctacaaaagatgcaatgtgctaatgatacaatattgtattgttacgacaagtaatacaccactaagttgtttggatgctctgttatcccacatagaaccagaacttaacaccactaaggccctgctcttttcagccacttcactggattattgtcacggaaattgtttcttctactgcattgtttagttctcttgttgtaaggtaaattcatcaagtttatttattagaatacttaatttatatccataatcgtgtatataatccactacaataatccggccaataatctgcttgactacaatgctaacaggtcaaattattaaattaattaatattaaccccgagaagcagcctatccctatgacctattccatgccttatcacaattcacaatacacacaaatcgatcattgctatccgtaaaattgaaaacggactatccctcaagcgagtggaagctcaccttggcggagatgacgtcgctggcgaacgcgaggatgcgttcgagcgtggtctcgattttgtcgcggaggaaggagttgggggcgagggccgggttgcgcagccagtagtggccgaccatccggccctcgtcggggttggcgatggcgcccttctcgagctcccgcatcgccgcgaacgcccgccccatgggcgcctccatccgccgcaggaactcctcggtgaacccgatccggctcacgtcgacgaacagccccagctgcttgtgctggtacagccactccacgtagcggttccacagcctgatggggtccttgtccaccgcgccatgggcgaggacgtcggcgtggcccgactgcttggagctgagcgagcggggaggagaggatgacgacgacgagcaggagcgggagacgtcggtgatggagctgggacgggcgaggcggaagtgggaggagcgcgggaggtggtctcgccggaggcggaggccgcacgacgccccggaggaggagggcgccgccgccgccgcgccggagatggaagccatcgccggagttggagcgtgtggctttgggagttgggagttggaaggggactgggagtttacgacagaattgatgatgagattaaggtgataatttgatttttaatcctaatatttagtttggtagagaagatggacattgctagggagtttagttggagattaggtctttaataaaaacggatggctgagatttgcttagacaaaataaaataaaggaggcattcactcccaattatctgcccctaccttggtattaaaaaggtccttcatcaattcttcatctctatcccaccaaaattaacatgtcttctaaccaaacaaaacacttaatagtctcgtccctctgaactctcactctcactccctcctacaaactccctccgaccaaactggccggagaggtaagcctcgcgagatggaagctgctaatggggcccacttgtccgtgacggagcttacaggccgtccgtacggcccagaagcccagctcacgtgtccaagattgaagattccgagtgacggaatctttatgggcttttttacccttcgtgggactagctatccatcacacgacagatttttgggtgcaaatcacacagattttagattagttggattaggctcatttgatcacttgattagaagagtctatacatgtatcaacatatattaattatatatattgcatatattttatttgttagatctttatattgaaaaaaatatatcaccaacccatctactaaaagttaccgtgtaattacactatagttacattgtaactacactatagttattgtaactatagtgtagttacagtgtaactgtacacttacatgtcatatcaactaaacttacaaatataattttagttatataggattgtaattttatattttaaaggaaataacaagtatatatttacttatacaacatttttatcaaaattatagtgcacttacatgtcatatcaactgaatttacgaatgtaattttagttatatagatctgtaactttatattttatttcttcaatctcttcacctagccgcaacgacgtgcaatgtatgtactcatcaattatgtgccaagttagatgttgctggcctcatgcgtgcgtgggaaggaaacacatcatagccgctaattaaatcatgcacagactaatccacaaggatagtaaatccgagtgatttcgagccaaaaatttgtcgccagatttttagcaaaatcgttataggattcgtttctcatagtgccttttttttaaaataatggaataaatccgttttttttttgctaacaagagttacaatcacttattacacaaactcgttcaatagggatcacatatcatgtgacgtaggtaaaatcgaaggcttaaggctgagttcgtttaggagggttcccaaccattttccctcgttttccgcgcgcacgctttttaaactactaaacggtgtattttttttaaaaagtttctatacgaaagttgtttaaaaaaatcatattgatctatttttgaaaaaaaaagctaatacttaattaatcatgcgctaatggactgctctgttttccgtgcgggagggtaaggttcccaaccatgatccacgaacacagccttagggtttgaggatttattgtatcaatgttctgggctacgaggatcaaaatatatgcatatcccggtttgcagagttggactcaaccttaaaatcttaatattattggatgtagaggttggatttttaattttatttttttttaaaaaaatggaagatataaactcattatgtggagagattttgcttcatgcacccacttgtttggttcattgccctttctcaccatgccaaaaaaattggccatgctaatggactaacatgttcatttgctttctagaaaaaccagcatgttcaagatgctagctagagtgataaacaagaggctatacatataccaaaaattttgctgcatcccaaacaatcattttttaccaaaaatttgacgataccaattctttcgacaacccaaaacaatagttcttttgaataattaatgctagatcttaccattacaaagatctaaacacaggcccgttgtgtttagatgcaacatgtttcagacaatctcttctgattgtacatgcaactgtccttgtgactctctccaagtactgtactggttccatccagctctttagccgcgaggaagtttaggactagtagtagtgtagtacttataaaccgtgagctaagttaagctaatctcctactagtcctagatgtattgatccaatgtgtaacctgccggcctatcggatggtagtacggcacagtccctgaagcagtactctgacaaagaaaactgcacggttgctacgtacaccggtacacgcttaactgatgccggaagagtacaaggacagcttctcattctcattatgatcgtttgctgtagttttcttttctgacataactggtgaattggaagcaaaagattaattaggaaacacacaagacaaagtggagagtaagggtgagtttgagaggagggaaaaagagaagattgggaagatacgtaaaacgaggtgagctattagtatatgattaattgagtataaactattttaaacttcaaaaatagattaatatgattttttaaagcaactttcatatagaaaatttttacaaaaaacacaccgttagtagttcgggaagcgtgcgcacggaaaatgaaacaaactaactgacaaactcctcctgccgaacgctccctaagcttggctagttgcctgctggaaggcgctctagtgcatatggagatggattatattcgttctgctcaattaagtggggattaaggagccaaatccaatgatagccagatccgtctgcaccatttgcctgacaatactaatactgagttgtaaactttgagcttgctgggtttgaagtcaattcttaccataccaatatgagttttgggactaccaaatttaccgcgggtaaaaaattgatagaaaactaaacatgcatgagacactattgaaattgtcaagaatttgttagaacaaatattggcatcaatccaatcaagcccttttaactccaaactataaattagttgttttccatcagcgcttcccgaacagctaattaatacgttttcgttttgtgcagaaatttactatatatatacaagttttttaaaaaataaattcatttttcaaatatatagttgttaatatttaattaattagactacttctaagtgaccagtatgctacttctattcgatatataaggtttcaaacgggccctaatactacgatcaatcaaaggaggcccagggtggtgatagcctgatacggtcagcctctcatattcttagcatcattgggagattgattggtcctggccaagttggcaaccaacatgaatgaattaaattgatcctggacaaatgaatcaagaaacaacgcgactaacaaggcctgatcatccatatactccaacaatatcgttactgcaagtggccatgcaatgcaacaaatcagtttgctaataagctaggcgacatctcgatggatggatgagagcttgcatagggagtctcagcgcggagggcggcgacacgcaagctaagctagatatggcggatgttgtgggtgtgtgtgcgcgcgtatagagagagagagcagctctctataaaatatagtctttcggatattactatacaactataataatacaaagattgtgctataagaaacattttttaaaaaaaactactattatattataaaagtatttttttgattaatatctaaaaaataatttttatgcacccactttagatatttcagaaggtattgacctttaaagtgtatagaattcaactgaaatatgtcgaaacatgcacatgcaattatatttcccacaaaaatcacatattcaacaactgttttgaggtatgcaaagcacaattggtgttgaacccaatagtttaaattatagtgcccacgaatattctacaatgtaattgctcttttaattaaaaaaaatagtaaggctaggaatttacgtttctgttgacacaaaattcatcacacacacgaaggcatgggagatttgcatctgtgttgatctatgattaaagttggacatgtaaactaaagctgcgtttaaaataggatgggggagtactacgaaatggcagattcaatgttagattgattttttttttacgaagggagtataatcaagcgatctcgtcacgaaaataatgacttctttcccatctctcatttctatctcatcaatatgtacattaatttggagttatcattattttggagctgtaaatgcctaacaatgattccattaatttcgatgttgggccatgcaacaagcatactcttaacctcggttcgtgtgcattaatcagctagtagatcacgcacatcaattgtggagttaagggtcaaataagaaaaagtgacagtactgagggagtacacctacgtacgtagatggccgaacaatcgtcgctctctttgttttacgtgcttgtacttaccttctcttttgactcaccagttaaaactagatctaagatccctctaatgcaaatgtctagctagatctcacaggccttcctgagaatcgatgcactgtaacatgtgaccagttgccagttgggttatcttaattaaattcttaaattagactattgctgctgcagctctagctatatatactcctactatatatatatatatatatatgtatatatgtacatatatatgtatacatgtacatatatatatatgtacatatatgtacatatgtatatacatgtacatatatatatatatgtatatatctatatatgtgtgtatatatatatatatatatatatatatatatatatatatatatatgtatatatatatgtgtatatatatatgtgtatatatatgtgtctatacatatatgtgtatatatatatgtgtatatatatacatatatatatatacatatatatatatatatatatacatatatatatatacatatatatatatatatatatacatatatatatatacatatatatatatatatatatgtataggacactcatatggggcaccatggtgcctgggcaccatggtatcaaatacacaaaatcactcaaattttttaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatgtgtatgtatgtatgtatgtatgtatgtatgtatgtatgtaaagagaggattaagcagagttataataatctctctaggtcaaaaagaagaagaccaattagcgttacatcagtcgtctatgattaatctagaggggagagatatatatagatatgggcaatgggacaagagccttaatgaccgggtcgaccggatcgcatatgcacacaaacagaaattacgtaccggaccaagctttaattgcgtgcattatgaatgagctgattgtgacacttcgtcgatcgcttgaacatgcacactgacacgatgcaatgctagggccctaaacccctaagacagcaggggtattattcgagcctaataaattcctttactcaaaccagtagtgctttatatgaaaatttctttgatttaccactcgcaaaagcttattgtacaaaataccgttaacgaaaatgtgtaacataggccatttcgtagaattcgttatggttttcctcctttctaccattatctctctattattacgtttataatactcaaaatatccgtaggcccgttattatttacccaatggccactctaccaaggatttggttgagatcaagggtgaaatataatgtgtatttagatgcgatagttgtcatccatattattttgaagtagatttgaagtgagtaatgtgggcggattgcttcggatatcgaagatggattagagtcgatgcaagcttagtttaaaaatggattaaaattattggaggttccacgtatatataatcagttattaataatgagtcaacaatgcaacaggcaacaatataataactatagagcatatgatttctgaacatgatttatactctcgaggacaataatcagtcagctatcaagagacgagagtcggagaggcatcgcttgctgctgtctaccatcgtgttgtaggccatcaccagccgtggtggaaatcacattatcatgaggctatatgctgagtcggagaggagattaggatggccggaaggggcgtctcttgccgctcgttacatccctgcattgcgttggtgagtggtggcggctacataggtgtgaggtgttacagtgtgagcttgcgatagaggagtctaggttatctgatgaattgatgcatgggccaacttatattctatggaacaaatggagtgattacatgggttaaaaacaaatggagtggttacatgggttaaaattttttggataatccaataaaaattccgtagcataattagtatccaccagatattaggaacaccatatctatatctgaatgcacgtattatatctactagatttctataaatacagtcataccatattctcatttcggatggatttgaagtagatctgatcttatctattttaacccttaggccctagtagtgtaccatgtaacgttgctagtgcatgtggttcttgatcaaagaagtcgtgtgtgggatacttttcattcaaaaagtacaaaaaaggtaaaaggggaagaaattttttcgtgtgatggcattcatcaaattcatttcgtagcggcatttagtagaacgaagcattttgtaatgacgaattgtacccttataaaggctactcagagtgagtatgacattttatcgattttacatcaaggtgtctaagtccgtcctcgtagggtctttcgtgtcctcctccctcacgggcgacacgggaggcggcaaccccgccgtcgcccgttccccccttcctcctccgcctcgccgtcgccggcaaagccgcgcggccacaaggacgatggcagcggggcttcgtttttctctcgtctcgccggtagtggggggccgtgcggatggcgaaagaccacccagatccgagccatcgcgatctggcggggaggcagccgacggcgaggcagcgtggtgaggcggcggcggttggcggtggtggcggcagggtctggaggtggtggcgatggagaaggagaagagatggggactgacgacggcgggaatggaaggcggtagcgaagatggtgacggcaggcaggatccagtcacgccggaggtggatcccccctcccccgaggacggatctggtgtggggcgagctcgcggcggtggcggcgctacggagcccgcagctggccgacaacagtagcggctgccggctgctgtggcaaccagatgcactcaagacggcgacagcggcgcggagctcgtggcgacggtggtggcagcggccggacaacggcgaggtggctggccattggcagcagcggctactgtggctgcggagggaggaggcacgatggtggtgaccgtgactacggtgggaggaggcatggcggtctcggacagctagctggaggcgtggcagacgaccgcacctagctagcacgacaatgattggaggaggagtcggaggccgacttgccgcagagaggcacaggcgatggcagtggaggctggcacggcgcgagaggcacgaccggcggtggtggaggccggcttggcgcgagaggcacggcgatagcgggaggccggactggcgcgagagacgcgtccgggggtggaggaggctgacgcggcgcgatgaggcccggccggcggtaaaggagacgaccacggtgcaaggagaagctaccggtgggtgtggcgcggtcttcgatgcacaaaggccgcccggtgggggcgccagtgcagtggtcccacatgtcggcagaggttgagcggtgatggagcatcgatgcgtcagccgtggactcgcaggtgatgagctgcgggtgaaaacccagcccggacttggccggaccgacaacgatggttcattccccctcctgagggcgttgtcgtgccgtcttatccctcaagggtggttgccaagcgaaagcccaatcttggctcttttgagtccctgccgaacggcggtgacggttttctgtcgcttatttcgttggagacgtcgtttaggcatcctcttgccgaaaccactcgaatgattggtgcgagcaagctctaggatagagttgggctttgtgttggttgtaaggactttttttgggcgatctcgtctgtgttcctttgttggcctagcggtggtcggtcacacttagcggcgaccggtccagtgctagccttctcccggacctgtgtgttggcaatgtcggtgtgtgggtggtggtatatttttttccttttttctagctacgaccttccaatattgtaatcttgtaattttttttctgctctgtaaatagaacttcgtaccatctcgtgcgagtcgttaaaaaaacattttatcgatttctcccaaactggtaaaattttctcataattactgcattctatttttcttaggacaattgcttatttgaccccgttttgagccctaactactaatttgaccctactttttaaagtttgcttatttgaccctccttttcaaaaagaagctcgcgtatgaccctgttctgttaagggcatctaacggtgttaactaaagcacaaaatgtctcttttgcccttactgatttgaccctattacgtgtgggacccacccgcagttccctcttctcctctcctctcctctcttctcttctcctctcctctcctctcttctcttctcttctcctctcctccacggggcggcgactgatgggccggtggcggcggcgctctgagggggctgagggagagggggcatgtaacatcccggcctagggcttaataggattaatagaatactcatatcaacaagttgcaacttcttttctggaagccaatctccaaagaactccagggttaagcgtgcttggcctggagcaatttgggatgggtgactgaccgggaaattcttcccagaagcgtgcttggcctggagcaatttgggatgggtgaccgatcgggaaattcttcccgggtgcacacgagtgaggacaaagtgtgcagaaaagacatgtgttggtctgtgagggcagtctatgacctatgaaaggtgttagatgtaagtgggcctggcctgggagaggcgggtcgttacagggcgagggtgtggcggcgctggctccggctctttgtcgtcgtcctcctcctcgtcagcagggcaccggcttcggctcttcatcgtcgacgagccgccgccaccactcctcgtcgtcgttgtcgtcaccagggctggtgccggctcgtcgtcgtcactggggccggtgcctgctcatcgtcgtcatcaccagggcggcgccgatctgagggggtggcggcgctgactcgccacaagtcgccgccgttgccgcaaggagagaaatgtggatagggttgggtggatgcatatggttttctaagggtattttgagtattatgaatattagttgtatttttttaattttaaatcaaaacttaatggactaatggaaacagggtcagacggaagctttgtttttgataaggatggtcaaataagcaaactctaaaaagtagggtcaaattgatagttaggattcaaaacggggtcaaataatagtcccattttttttataagtagagggcaaacgctcccattgcagttattttttactacgtgtatgttttaactctttaaccgcccgagacaaaattaagctacgtgatcacgaatctggagacaggagagagatctaccggacggactctgccctcgatcctctgctccctccgattccgatcgattgcagaggctcacaaatacacatatacatccaaaagagagagacacatactgtatagtactcgccctacatacgtacgcgcgcatttcgcactacgtacccggcacccacagccaatatgtatgtatactaattaacaaagcgtacgtacgtgcgtcagagatcacgtacgggacactgtgttgtacaagtgacaatctacgtatacgattacgtacgtacgtactagctagctaagctaactcgtgtgtagctagcaagctacgtggaccacgggatttattgacgttgtgcgttgcgtttgcgtatagcacgtggaccacggagacgtgtaccgtgcacatctacagtttcgtttttttttttgggctccgttaccgcgcgcgcccccggcaaaattagtgcacgtacaatgtacgggagctcggtttggtggaaaccgcacgaagtgtacatgtgaggtaagccacacgggcacacggaggagtttggttaggtgcagcgagatgatcatcttgtgctgaggccatcctgtgctgcgcgcctagggcgtaatggcgatatcaggcaccgtcaataattccatcgtgaatctggcggagccagagtttactcatcaagagtaggatgaaactactataatctaccctaatgccttttatcctttttttttaagttgtgcttcatttcatacaattatttttttccagatgtttcattacataagacgtgcatacatacatacaattaactaattaacacatcatcttcactaaattgttattaattaatttctttaccctcaagatctctaattatattatatgcatatattatatttactagtgtctagtgtgccaattctaccgtaagccttatgggaaaaatactacctataagacatcattgagaaattccccaatgtaatgttatgattttctaatcatttgattaattaaaatcaaatgcatcacacatcaccctcgctatctgtgttcatctgtctccaacacatcgtcccctaatcccggcccatcgattaggatttgagcgacgcactcgcatcgactttcctgctatcatcacatacacacctttctccctgcctcacgcgctgtcatccctttgtctctccgacttcacctctgatgttagcgagaagccgagaacaacactacagatcttctccctccacttcatttttctctctcccccatcatgtttctcattgtcggtgctcctgagctatcttcctccacttcttgtggtttctgccgttggatcggccatcaatatccgtcatctttaatacgtaccgtcttgactcccctactatctccaaccaaatctttcacctcccatcgccctccttcactctcacggctttagtggcgcccccaccgtctcatcatcctcctattgctcaccgtccactggtcttctagactcgctctaaacccaaccctcctttgaatcaatcctccgaccccaaaaacctaacccggtgagattatcgccacatcctcgttgtcggagcgagagaagaaagaggacggacacacgagtcttgagatcaatctaatggtttaaaactatgagaattgtttctcaaatgtctgtccaaactctaaaggtagttagcaaatttgcaaagaaaaaataaaacaaataatgtaagcactaccaggacagagtggggatcagattgcacgccgatacgagaggccagctgagccatatataccacgcactgataagatgcacgtacgcgggcacacctgcaggatacgatacgatctcgtgaccctccctccgatcctacgggccagagttttgcaccttatcctcgacagggcaatgattccgatctactatagctactctctcataaatcataatactactgcagttaataattaaacatacatgcatgctactgcacatatactgctatctctcttgcaaattttaatgtactacacgcaagtgaattaatgtaagctcctagttggtttttctactttcccttgtacgtacctgcaaattaaagcaattggggtcccaatggcaccttgagagaatagttacacaggccgtgcgttgtttaagccacggcgagagacagccggagttaagggttttgccgattcgtatcgacgtccttgtcaacaaaatctgtgcatgtctggtaccatcctttacgcccccgtccggccggccggcggcgattattgtcacaacaaaactgcactgttgttggagtactgttattttctcgtaccctacgcttattataatgaatctggatataccattatagtattagatagtatcccgtttacttctcgattagttttattctcggttggtttgttatggaacggagggagtacgcttagtggctcctttggatcatacgatctcagtcctaaaaatatactccattcgttttaaaataagtttatctttgtattctcttatttatctcaaaataagtgtatttttaagcagtttagagtttataaaagtaggagataaatgtattagaagtagataaatcagaggataagtgcattgggatttgataaagtgaaagttattccagtcattttacttttgtattagtatgtgttgagatgggtgaacaatatatttattttgggatgtaggaggtaaggaattttggttgcatagctaaatctcttatatttcgaaacgcaggtggtaggatttttaaaacatggggaaaaaatagaagtatgttgtcacatgctatacaatacttcgagattttagggtttgttctctttattgccactttgatacgtatcaaattttggtaagatagcaaactaaacaataccttatgaatgccatcctaccaaaatttggtagttccgaactttcgtcttataaaaacgctaccaaatttttgaaagacgtcaaactaaatatatccaacactaccaaagtttaacaacgtcaaaattatcaaaatttaaacattgtcaggtcgaaattggtaacaaaatgaacatgcccttcaaatcgaaaaacaatagatataaataatgtactctttggatggttcacattagttgaaacaatgggattttaaagaaaatcttatatgggagagagatagagagtttgtattggacttagcaaaataaaataatacaaagatttgatgtcgttattaaatttcttatagaatagggtagggaagcaacccatagaaatcttgtaacgctgtttttatttttttcaaagggtatcacagattttttttccaagtactttaatggtgcaaaaaattctatgaacttcattcaatctaaaggaaccatgcattactggctttactggatactgctgccatgttagaggaaggttaatagtatcggcgactgctggcggcaaccgagtgccacatccttcaatagagagctaatctataatgcatacaacaacatgcaacacttctttattttttttaatcgagctagtgtctactccaaaggaaccagccagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatttcacgtccccattcattttttcattggttgtcgtgagagtaggtgggcctatggtaggtgaaatgcataggctcgcgcgaagagccagcgactaaatagtcgctcgtttttctctctccaagttttctttctcggccatgtataaaaaatcctatgtaagcatgctattaacccattgttgtacctgctcatgatactaatggtgcagtttaatctaggcatttttttagggaagataaactgcatatttttctgtgtgctctttcgggaaagccaatatatatctgagcactccctccgacggtggctgttaaattaaatcttgaaaaatccatcggtgaattcgaacttattttatctggaatagaaaatcacaatcagctactcactcagtctctctgttcaactccttcagagagggaggtagtagaacgttactgtcgtgatatgcgagagctgagctaggtagatagcgtttctagtacagtaataagcaagcaagcgatccgaaattctatgcaagtaaagcacaaaagaaccgccatgttgttagcttgaagctcttatctcccaaacaagt

SEQ ID NO: 64263 - DNA, 19311 bp, Oryza sativa
ttgtacacgttgttgttttcttcttcttttttactttcaaccagtaatattgtaatcataatccgtattcagattgaatctaagtactgtacttaattaaccaagacgatccgtaatgcttctaggacggaaatgcatgcgtgatgtgatcgagtacatgtcctgctcctggccatgtttgtactaacactaatcacagtgtttgtatagtttttacactatatctgtactgggaaggaacaataatatcagacacatttgtgaatgattgtgttgtgttatatcatcaacaggccaattgcatttgttgcagtagattgtaattgtagttgagcaaaattaaatactaactagcagatcgagctcctctcacagtttcacaactgcacggggccaggcatttcatacatgtctatattttacacaagtctttaccaaaacaggaatactcctggattttgctgtacatgtctttaccaaaacagagtactctcctagattatattgtacaagtctttaccaaaacagagtactcctagattatattgtacaaaagtcttgtccttgttgcttgaagtacatgtacatttttttcagcataatttttatcctgatgtattgatcaaaattaggcttgaaattaaatttgtgatgtgattggtgacaccacatatactatagttacttgctatattttagaatagatgtagtagcataattttacaatcttgtagaattgtttgtgacttgtgaggtcctcataggaatatctaaaacctctcattttgcatttaagagcgtcaccaacagatatccaacactcctccctttgagaatctctaaagagaatttgagcattaacttcctaaataaaaaggtggctacttgaaaaacatagtttctcacccctcctacgtggttgtgcgcccttccttacacgatatcccgagcaaagactctgggagcgagagcgctcccacatatgtcgatagtaagaactcttggtgaattcaatttttgattaaattgcctctatagactataaatgcatgtcggattcaactttatatatatatatatatatatatatgacactcatatggggcaccatggtttcaaatgcacaaaatcacttaaatttttcaaaattttcaaattgtgagtatatacctagttataagaattcgattcatacctatacctatcaaccaaacaactcaaatttaactttatttcacaatccatgattacatacctaactaattatatgtatggatgctatatacctagaatcaaaatctaacaaaaacaagttcaaattcagttcaaatttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatatatatatatatatatatatatatatacccaatttgaatgagtatgaaatttttttaaatgtttagatatgaacattaacttttttactaacaagtttgaactgagtttgaacttttctttgttagattttggttctaggtatataacatccaaacatataattcgttaggtatgtaataatgaattgtgaaataaagttgagtttgagttgttttgttgttaggtatttgtatgaatcaaattcatacctaggtatatactcacaatttgaaaatttttaaaaatttgagagaatttgtgtgttttataccttagagcccgagcaccatggagtcccatatatatatataatttctggaaattccataacttcagtagtactcccttcgtctcaaaatataagggattttagatgcatatgacactttctaatacaatgaatttaaacatagagccagtccaaattcatagtactaggaaatgtctcatacatttaaaatcttttatattttagtacggagggagtacttgtagtgtagacccaaacatggaaagccatcgttttcagtttgcatgcattgctactctgtttgatttcttggttacgctgaactatagtgtacagagtgtactcctgtcatttacttaccacacagtaatctcagcagcacgaatttcggatctgatctctactcgagttcgttagtactatgagtcttcagacagtacgtgttgtacacacaactagatacaaacagagagtagctgctcgtcagccaaaacgccctaattagcagagtacagtagtatctttttttttcttttcattttggcgctagagatgatcaaacaacgttctgtacagtacatgttcagcagtgaatgattttaggtggagttttgtgcttgtctttgatgtacatctacacttcaaatgactatttatgggtcattcgtgtggttaattggattgctagtagcgaatgcgtactgcatgtgtactgacaatagaatttgttacttgttagccccttttattggatcatcagctatcatgtacattttgccgattccgtttatctgtgtgtcataactaaccttggttgctctgtgatctagttcagctatatgtgctcgtaagataatcaccgggttatttaattggacaatcatcatcgctcaattagacaatatcacctgtttttttattataagacattttgtttcattaggataagattttagctatcattcgctttattaataattagttatgtgacatggaagcataattagtaagcatttttttaataagaatcttttctattaaaatagcgtaatagagaaattgtttgttaaagtattatcctcgtaaaataaaatatgtatatgaattccatttagaaaaacgtcaaggccttattaaaaagaacaccacacactaattatatacttgagctacatagtcatctcctatgttataaaatatacttaagctacatagccctctaacttactattgtctaactttgagggactgatatgtggacctacatgtcagtgacccacgttagagggcagtactttagatgagccctttcccaaccaaccatatacgatctcgaggtttctcatatactctctccgtcccaaaaagaaccaatttctcgctatgaatctggacaagatcatagccaggaattggttctttttgggacggagagagtacaatctaggtataaaatactccctctatcctaaaaaaacccaatcctacgtttgaatatgtatgtccaaattcaaacccaagattagtttttttttggagggggtatgtgtcaatcctgttataaaagcaccaacttattttgtctctcgttatttgcttgttagcttatcaattccaactcaaatttaattttattaagttgattttgagtcttttttttattgtagtctattttctagccttgccctttttctattgtaaccaccaaggtttaacggaaaaaaaattgtttttggttgcttttttttcgacttatttgtagttctaccatcatagccaaaggtaaatttagcaagggtttcgccaatttaccttttaattttttaaactgttgaacatataggggtgggcagaaaaagaccgaaccgaaaaattcaatcactaggccagtcaggtgttgaaagattgaattttattcggtcaattcggttagtactcgatcaacaacccaattaaaccgaattttgacccaattttagccttcagtatgctttgatttgatccatgatagtcaagagtctattttgtgtttatatttttttatctagaaattaagacttcgcttgattattttggaccttctaaaatttcggtcatgatttagacaaagaccgaatttcttggtgtccaagaccgatcgatctctaattttaaatgaccaaaatttctaaataacagatcgagactgaatttttcggtcggattaaacgcccaccctataaacatatcggacgaagcttcatgtaacgttacaaataccataaaaaatgactaaatttagcatgtagtactacctaggtataactcgctaaaagtattttataaccgtgtccaaaatcccaaacacggaagatgatcctctgatgttacccttcaacgtgactgatatgtgagctccaccactctcggacccacatgtcagccaccaaaccatttgaaagttacgtcacaggagcacatccacaccgaacgtgtttacacggccgagccttttgggcaacccttcgcgcgagagccgcaaggggcttgtcccgtgtcctcccagcctccaatctcagccgcccatccatccgatcggacggcctccactaccgtgaccgtgccctcttcctgcgcccccctccctccattcccgccccggctgtcccaatttcggcgtaccgtcgcgtcgcgtcgcgctttcccaaactgcccctctccctcctgtctccctccccagtacaaagcgcggcctcggcggcagcagcacagcgcgcagcgtctctctctctcgctctcgctatctatctctgtccttgtcactgtccgtccttgactcgctagcccaagaagaagaccaaccggagaggggaggggaggggaggcggagagatggctccgagctcgtcgtcctgccacgacgcggccgcgtcgatgctgctctgcgccgaggacaacagcagcatcctgtggctggaggatgaggagggggaggtgggggagaggaggagcggcggttgccggtcgatggtcggggacctcgccgccggcggcggcggcggcagcggcgggggtggagtggaggaggaggaggacatgttcccgcggcagtcggaggagtgcgtggcgagcttggtggagagggagcaggcgcacatgccgagggcggactacggcgagcggctccgcggcggcggcggcgacgtggatctccgcgtccgcagcgaggccatcggctggatttgggaggtgcattctttgatcgatctggcacaggatgcgccattgcctgaaagaaagaaaaaaaaaggaatgatttttgcgctgttttctttggtctttctgagtaaatgcaatagatctgccatgattagctccgttcatttaggggggaaaaacgtgtcttttttacttcgtttctggatggattcaaaaccattcctgcaacttgttttctcggccagttttcactaatctgcagctagcgttcgtccacgggcgtaaatgcaatgcatattatgcactgaagagttttttttttcactgtgtttcgagtaataaacattgtttgtcgtagtgcgataaatgtgacgatgacaaaagcaaattggggttaaattttgggaccatacatctcggacgaagctggcctttcatccgttcgcttactcacgagatgtcgatgtgcattgtctgattctagtttgtactactacaacgtttgcaatgatggggcggcattttttcggagccaaaaaaaaaaacttctgataaaagcatagaagataattgctgtggagttcttgtcctgaaaaatttgtttcttttaccatgtgatctctaacttattgtgttttttatctttctacaggtttacacttactacaacttcagctctgtcactgcctatctggctgtaaactacctggaccgtttcctgtctcagtacgagctgccggtaagaatcaaaaagattgtgtttgtaatcatctcaagatgtggccaatgctgtccatgttcatacaagtactagatgatgagctaagattcatgcttgcaaatacaggaaggcagggattggatgacacagttgctctcggttgcgtgcttgtctatcgccgccaagatggaggagaccgtcgtcccgcaatgtttggatcttcaggtcagcatcaaaccgtgacaagcatctcagatttcgcaatgcgttgcgtttttgtttgatattgttctaagcgttgttcttgttgttgatcagattggggaaccacggtttttgttcgaggtggagacgatccatagaatggagcttcttgttctcaccaacctcaattggaggatgcaagccgtgactccattctcctacatcgactacttcctacgaaagctcaacagcggcaatgccgcgccgagaagctggctcctgaggtcgtcggagctcatcttgcgcatagcagcaggtgtgccatgataggaagctgctgaacatggtttcattcagtgacatcctatagatcagaccataattcagcattctcagcatagtctgacgatgcatgttaaacttgtcaggaactggattcctagagtttagaccctcggagatcgctgcagcggtggctgccacagtggccggagaagccaccggcgtggtagaagaagacatcgcagaggctttcacccatgtagataaggtacagattgatgcaaaccctcacgtaaactcatcctcatagactcttactagctcgtttaattctgaataactcatgtgtactaccaatttggatccatcacattcataactgaattataataactcataatttgcaaccggtactttcgtagaacacagtaccggttcagaatgcgtgaaacgcatttatgggcgtgtgagctcggggagttaatgtgctgttcggcttttgccgctgtgtgtctgcaggggagggtgttgcaatgccaggaagcgattcaggatcatcactactccatggccaccattaacactgtgcaacctaaacctgcaagcaccaggagaggctcagcctcagcctcctcctcctctgtgcctgagagccctgttgcggtgctggatgctggctgcctcagctacaaaagtgatgatactgatgcagcaactattgcctcacatggaggaggaagaaggaagagttgctttgatagctccccggtcactagcaagaagaggaggaagcttagcaggtgactgaccagtcaaagtgccaaatgatagatcactctctctgtagtctgtacaccactcatctcgacaaaggcaaagtcaattggtttcgattgcaacgactgttagaaagaaagaacactggaagggggccaaaagggagggaattttgacatgacgagagagagctagctagcaagaagttgctgatgaataaagaggtgaggttgacaacacctaattgctaagcttttgcaagccagcaagccatggtgatgagaggtgcccccaaagaacaaagaaaagctttgtagcaacataaaagcttgatgagtttcaaaaaaaaaagaagaaaaaaaacataaaagctacatgagatgatcaagacaaaggatggtgaggggctttaggcaacaagtccaagaactaggcatgcactgacctggctgtgtagtattcttttgttcactagctctagttgcattagttgcagtattgttttcttttttccatttcatttgtaaggagaaaattagaggcggcagcactcctttttgtgatcagcaatgatgatcatccacatgaataaaataacatggtgtaaccagaaaagaaaattaacaagacccagaaaaagaggaaatgggtttctttcagtatattgctctgcctgcctatctctatattgtttgactgcttgtctgctttaagagcaggtataatagtaggctataagccagctgtaaatatattttaaggagataaataaggagagagaaggatagcgggctataaatttgtagccagctgtagcacgaactgtaagacgtagtatgtgtatgacaggcggggccaggtatcaatagtgtagtatgtaactattgtacgaatgaactattagattggctatagatgaattggagctagtagtaggctatactattaaactattaaacttgctctaagaccatgagcaccgcattccctaggaaataaaagaaggggaccttgtgacctgtcagcacgaaccttgggaagacaaacttaacaataccatgcggtttcagcgttgagcatctgtctctttgttcgaattagtaggtgcttctgttagtattttactccttaatttaagggctaaatgctcaatcatctaaaaagaacagttacatagggctgtcaagagtatgaatggtcccatgccgagttgggttggatacttggatcctatcataaagaggtccaatttgttacgtaaaaaagaatccatcgagggagatgaaaataggacaatttagaatttttcttcaaaattgaaaataatatttcagtaattttgttctctagtcatcgagggtgattggcggcggcgctcgaggacttgcggtaactagcgtgcctcaccgtggtgaatgatgacgacaaatgaggaatgtgattgagcaaggaaaactcctagccttgtttcactgtatgctacgaattcatagatttaccaacacccggtagtatagaaacacagttttaatccttttaactataatatagttaagtgagaggacacattaatctaaacctttatatcacttatactataagtatactagtatattgtagcgtaaaagttcttaaatattactccctccaacctaaagtatggctgtctctaacattacactgtcattaatcttttataatatattattaacaaatacaaaattaatatcatataaaaatacttccaaatgtgaatataatgatacaatatacataacaatagaaatacatttattggggttgtttggctgcactgtaaaaatgttgcattgcagtcagctgccgcttgacatgactgtggcgcagccaaacaacccacttgttactgacttgctagttaaagactacaagtgttgttttttcttaaaattactgaaaccttatgatatgggatagagggaatatgagaatggaatataactcaatttataaagaaaattctagcactagcactttataagaagcaattcattccccacaaaaatgagaaagagcccttagtttttatttttggctgcaaattgcagtgatgaactctcaccggattggaaatttcactgctcattcaaactagaagaccaaagactttttggctttgtgcccaacagtggaggctgaagatgtaaagttgtaaaccatttccattatctaaaattaaaattcaaacttggagacttaagaaaattggaatgatattgtaagctagtcactttaaatatatccttacacattctcttataatctactacatgtgaaattccttacattttaaaacggtacatttgcattctcacaaagtgtatataatgccagatcgatattcatacaagtgcattatcaccaatgagtgacatactggcatcaggtattagtatctcgggaaaaaaaatgattgtctataattcagttgttggcacttgaaattaggaaaagtttaccatatgaaagtttgtgctagtgagtagggactatctctatgtaatcatcatgccatttggcccatttctccggcagcatttcaagggaaaaatggatctcgtcaagctcttgggcagagatctagtacgttgtctacgcaaatcctatcatcagtagcagtgatgttatgatgtgtattagggcattggaccacagggtttaggcgtctacggagattatcctaagcgagagtctccatcatatctagtactactcaacgctgtcacatacacatttataatccttgtctcctttcatggccgttctatatgtgatcttgatctctgcacattacctaacattacgctcaagtataaatctacttatctacatatacccgtcagtgtacacaacgtctcttggcacgcagaaaggttaagaacaagaattccatttgattaaatttgcgtatgccacaccgttaaattatcacccgagatgtgagctcttcgatgttttaagtaaagtttattaaactcatcacgtttcgaggaatcgaccagtggcacagcaagaggcagcaggcgcgtacgtacaaagggaaagcctggaagtaactggtaagctcgcagtcgcagtggctgtcactcacagcgcgcggcaaaagctggaacggtacgtgcaaaagaccagctgatcaccgatcgctgagattattaacttttaacaggcgtgtgcacccgctaaagacgccgtcttttttactagtttttcgccgacggcgccgtgcagcgctgcatcaaaccaaccgtaactaatctcctctccctgaggagcatagttaaccatatcttggtatatcgctggggcgatgatgaacgtgtagcgacgcgggcggcagagatcgatggaatcgcgggtgtggaggcgaggcgaagcagctcatcgcgtgtgcgttccaggcacggtgctgactatctagctacggagttggtggagctcacgatgcgaggcggtcgactgcgtcgtcagactggtgtcgtgttacatacttacatgtttgggcaaaatgtgcacgcaggatggtgaatcttgtgagttgggacctgttggaggaagcttggggatttcttttatggttagcctgcttggattgcatttttgtgggatgcaacttgcgaagatacatgaccgatataacgtaattttagcataaaagacttttatcctctccagacaaagaaacccctccatttataatattatctttatctatatactacttaaaacattgatagtgtttttgtctaccataaatccaacaatcatgaccctttatccaatagatctaatggccagattcctacccctcgccttctgcctccacccctgcttcccgaatcgaactcggagttgatgagcaggactgatcggctccttcccctcgcctttcacctccgccctcgctttcgagtcggagtcagagttgatgagtaggatagatccaacagccatatccctactcctcagttgcccctcaaccttccgtctccacccccgcatctcgagtcggagtcggagttgatgagcaggaaggaagccatgttgaacatggagaaaaagaaaaaggaagagattgatcggttgatttcttaggctgaggtgatttggacgcaacgagcaggggtgcgacacatggccgaggtgcagcaacgtatggcggcaagagagcttttggtcggcgttggctgctttgtgaggaggcggtggaggggaggtccaacggcggtttcctatcttatcgatgttgtatctttacaatgataagctacctaatatgattgccattattgttaaaaaaaacatgagataacatgtagtttaatatgtttgccttcacccgttacaacagactggcattcttgctagtaacggtataaaaaaaagtaagtggtggacagtgaatctgtcgtacgtcccaattaacctcttagcttttggaaggtagaaaaataataggtgtggagccaaatggctcgtctataggttggaatgtagaaattaatatgtgagaaaaaagtaatggcgaaaacatattgagaacaatgttttatcattaaagttagtttaaggatgacttataattttttttcatatttacactaaaattttgaataaaacatataatgaaatgtaatgtccaaagttgtaataaaaaaggtgataaagaagagggcctcggtgttgaaataaattagttttgccggtttgacgtattttggaaataatttttataatgggacctagcaaaaacattttgtgtaaatcgatccttaataatggagtattgtgatcacagttagataccaattaatttaacgtcttgtaaattgatacgtacgatagtgcttgggcagatggcagatcagtagtgggacatggagaaaggggccattgagacgccgccaccgcaactaaagccaaggtcaggatagagtggtgggttgaatctgtagcgagagcaaacgcacaacgatacattaggagacagagggtgcataaatagatcagcggcaacatccgtcgaagacaaggaagaaggtaacattggggcaccgaaggcaagttcgatggcaatggacatggtagagaggaggtcaacaagggcggggtagtccagtgggctttctcaacatcaaaggtgacaccagcgaggcagatggatatatataacgtgttaggaagggaaatgggaggcaacggtacaatactagctagatcaagagggcgaaacaatatgtgttgggttgacgatatagaggagactaatatagtagtaagtccagacctagtttggacggttggattaaattttatcaaaaaaaatctcatgttacatttaatcgagttacatatcccggtgattttttgacagtctttaaatagattgcgtattgtgttgtccacgtgtaacaaatgcttcgaagagtaagttttctagcaaatcagttgtaaaaaatacccgttgaaattgttgtgtagggaattattaacatacgttaattaccccataattggctgcacaagtgggtaaagctaagctgcagcagagctcatcgagcgttctgctctgcaaactcggtccggccaatcaaaggaacttgcccgagccatcatgacggcctgcaaaaaaggaagatacaaaaacacagagaattttcgcacgggggccggctctcgagggcatcgagaattgcggggcgtccctgacgaggcgaacgccggttgaagcgatcggttcctttcgccgggacaccgccatggccaaggccaacaaacacacacggccagggtcgtgccgtgcaatgatcatcccgatcgatcgatcgatttctacggctttgcgagctcgttggcgagatgattttaccggtggaccagatctcctagcccagccaaaaagattgggcatggaggtagtaagctataccagctagtgccggaaagattcgagcaacgcgtgcacgcgcgcccgtggagacttccgcctctctctctctctctctctctcgtgcgtggagagaccgagacggggagagtatgtgtgtgtggctatcgtggtgtcagggtgcgtgccacattggatgctcggttttgttcaaggggaccaaccgaaatatactgcatggggatgcatcattgcaccactcaccacacacagcaaggtgcacatagtggtggtgcgcttattagagtacccgcaatggtaaagtgctatctataaaacatatacatctcagcaatagattagattaatagtaaaccacttcaatggtatgtctatatgggtatctatagctctctaattcattgccttgtttttctctatagactatctccaggttagtagatagctttgctctctctcttcatttaatctcttccaagtaggaaaatatgctgacatggatctcttgtagagagcctatagataaccattacgggtgcccttactcttgtagtagcagtagctacctatcctatatactccattcttggaggcttggagcagctagagcactagcgagacagaacggtgtgttttcgctggaaagaaagagagagcaaaagccgtgccaaagctaaccgttcgtttatagtactacgagtctgtgacaacgtgagccccaacattcacaacagaacaaaatcacacgctatcagctgatctctttcacagcaacacaacaacaaaaccctgttggatcttacgggtgacaaggtttttacaacaagcatttgtcaccatgcctctgcatggggcccagggacgtgcagggcagctagcctgtgttgtgtgtgtgtgttcgcctgagaccaaacatccccagcctgcaaggctggcgcacggctgcaattggattgctcgcgttgcagagcggcacagcttcgcgttcctctgccaagcgaagcgcgcgtgcgcgcgcgcggagtgtacgcagcgagacgaagtccccaaatcacaagtcggctctgggccaaacacgtcttgggccaaaaaacagacatgcttgcccatagatacgccgtacgcgttcacgagatccacctaggcttatatgggccttaagcccacaagcccacatcgacttgaagtccagaaaaaccatggccatccagaggacagtgaggcctagtgggagagaaggcagagagctacagtaaggactgacgcagcaacaatttgtggcaactagctcggcaaagcgaggagtgaggaccatacatatatacgtacatgacacagcaacatacccctgggacacacgtacatccgctcctttatactaccagcgtgcacatgtataccgacgactatagctagccaactgtggccaccatatctccgaatcaaactgaacagggcgcgagcatcgtcctcctacgtcggatagcagtgtagcgccactgtgctcacgtatgcacgctgcacaagctttgattttgctcgtggattcgtgcccggtagtactagaagacagttgttacagtagctatatagctacatcccgatcgataagctgttttacagcgtactgtacttgcgcacgatgctgtgtgcagtgcaaataatactgttcctgctgctgctgtactgcagataccctaatttggcatcggtcagccatccagccaggctcagggggctcaggctatcctgcacgcataaatccggcgacatggcatgagatctctaggagggcaggcatcacccatcacccgacatggcatcgctgcgacgcgctgcacagtgtcgcggcgccggggcgtgagccgtgagcggcgtcttcgacgacgacgagctagcgcgcggccggcgatcagcgtgcatgttaggcttagctaaaggccgtcctcgttttgtccctttcacgcgtagtactacgtacgtttacacaaccccctgcgacgatacgtccaagacggctttaaagcgcgagagagctagctaggtcctctagtaagcgtgaggcctgcgaaactctcgtcagtttttacggatagatagatcgatggatggatggatcatggatagctcgatcttttgctgagctgctgctccaacgtttgactacgagctcggccatgccgctgtctccatcaggtgtggtggacctacctgcaggtgatacacagcatctgatcccatgcatgtccaccaagtaaaggaggcgcctgctcgctgcatatgatcaccggcttgccatgcactgttacccgtctctgtctgagagagagagagagagagagagtaggaggaaaaggttgtgcaatggggatcatatctttagcaacaaccggtccacagtacaagtgcgtgcatgcagacagccgaggcatttggaaccttactgccgctgcggtcagcgagacagcgagcgagctgcatgcccatggatgatggatcaagttgatgtcgtggtggtgtctctttagctagggctttagcttggctagctagctagctactactacaccttttgggggtcgactcttcttcctcctacactttgctcgctttccatcaagtcgtcgaaccggaccgaacatgtgcaacccctactcccatgtcgactactgctctcttccgtttcaaaatatagtaatcttagtatgtgattacacatgtgctaattctacaaacttgatcaatttcatagtaacgaaaactatgttttatttcatactatatatgttgctgtatttttttttttaaaggatggaaggaatacatgctttgcggtgttgcggtaggcgatcgatcggcgctgctgctgcggctttgctggctccggagtccggacggaccgccggttcggcccagaaaccacaagttgggtccatgctcttttgccgctggtgaaagggctggctctgcattttgtcgcatcctagtgaagtaaaggctctccctcgatcgcctctcccgagaactacgacaacaaggctgtgcttatcctgctctccagctttgtatgtgtagttgtgtactatagcaatgaagggaaaaaaaaactgcacctcattactgtgttctgctgttaacccaaagtacaggaatggaaatttggattatcgttccagattaattgggcaacttggttttgagcaccattgcaagtttgcaaccagcaatcagtgcaacaatctctagtgatcacgggagccttagcagcttcagatagtaatctccctaaaaaaaaaatccaaattctaaccaaaattttatgggtttgttcattttgaaccttttctaaccaaaatttgataagataacaatctaaacaaaatattaccaatccaactctaccaaaatttgataattccaaaactttctactctcaaaacttctaccaagagttgaaaaggcttccaaccaaaccttaccttatcatactaaaatttgacaatgataacatttggcattaccaatagttgataaggtctctttttttttggcaaagaagcgaattatccccaagacacgcagctacaatatcaagaagataaattagtagcaaaaaatgggatgactctatagctagatatgcatatgggaatatgtgcccgaaaatgaccgtggggcaataactgggaatgaccgtatcttaacgcctcctcacactctttaaagccagcgaatctcgtctcggtcaggtacggtaccaattgaacaagttgatgatcgcttgcttccactgaatgtacagtactaagttgcagcattgaggatcacatgtattgcagcattgaggatcacatgatgtatacggcatctgtacgccgtgttgatgaatgggctcatggttaaatggcctcgacggacgtgaccggaccggccggccggatgcccggaagcattcagcgtcaacatgccgacgttagccttacagggttacagcacacgacggtgcaaggacatgcctggcaatctagcatttcacattttcactagagtgttggcacggtcacctagcttgcgacctgcttgccagtacatgagtaattgctaactacaccgagtacaagattactactgctccagctcgtgatcattcctggtacaattcgaaaaattcccccaaagggtcacagctgtattacatttgaaaattttgtcaagggttaagtccaactttaactcatggaatttgcccaaagtccatttctatctcacccaaaaccaaactacaaaaccgtttgtttttcacccacaaacccaaaaaagtcaggtaaatggtttttcactaatatgaacatacgaatgcttgcgtaataaaagtacgaactagctagaaaaacaacttacatttaaaacaaaacaaataaaaagtactagtaagttccaggatgtacttcggtttgcaacattagtcatcttttgaagagttcataatgaaaataatcaggttgtagttaagataaaagatgaacttcgaataaacttcaaggtccataaatggattctacccattttgtaagtggatgcatcatcattttagaaaatatcatgaaatgaacaaaatgaagattgttgtacaaccaggaagtttttctccggtccctcaatattttcaagaatcaaggaaaaaacatattgaccttttgtttttccttcaattgaactggagtacaaaacaaaatgggagcggaaaatatgcccctctcctaattaacgaacaccaaaaatctgtccgacttctagaccacatacataattgcatgtgtaattcctgcatgtataatatttttcccatcctgattagtgctacgagctatatatacatcttgattcctccccaaaggccataaagaactcagaacgtatatatgttcacgagactcaaatatttagatcattcgggagattaacacccaccgccaacgcacataatcccccaagcaatataccctccaactcaaaaagaattatccatgtgcatagccaaaaaccaaagtttcttttttagacgaaggtagtgcataatagggaaactatcatgaactctcgaggggatgccccctcaaatagttatgaaaaaaaattaagatgtattagcatgtgatatatcactccataaacatacaacttagattttaactttatatttcgcaacaaaaaaacaaattaaactacagctagttaacgtatattgacagtcaaatttgtttttttcgttgcgacatgtaaaaaataaattttaagttgcatgtttgcaaagtgatatatatatatatatatatatatatatatatatatatatatatatatatatatatatatatatatatatatatatatatatatcacatgttaatatatttctcaattttttcaaaatttttcataataatttaagtaacatgcaagcaacgaaaagacatcccctcgagagtttaaaatcaactcctgtgcacgtaacaatccaatgggacagaacaatgccaactgggcatgtcctgctccgccgatatcctcttgaccctaatctgttcaaatttccctaccatgaaactgaaatatagcctaaatttttagtacaggtcaactgtagacacaacttccctttcgccatatagctaaggattacatatgcatgcacacagttcaggcgtcgaacccagtggcgcaaccagtggacatgtgagagcggccgcgctcagacagcaaacttccaactccaaccgccatccgaaacccaaccagatttcttcccaattaaatccccctccctcctctactcgatcgctctacacgaccgatcgatcgatcgatcgagagcctgacccacgcgtcgtaccggaccaggatgttggattccattaatgccagcagctatagcccaagtagcttagctagccatacaccgccgtcggccagcttggcgagaccgcgacgttcgcgcgccgcgcggcaccggccgggagggggggggggggggcgagcgcgacggggacccgcggccgcgcgcggcacggcgccgtggtccacgtacgccgatctacctagctcgtgcagtgcggactacgcatgcagcgcccactaccaccttgccgcgcaacaccagcatttctctctcgcctcgtctcgtctcgtctcggctcggggtcggggtcggggtcggggtgtgcagtagaaaacaaaactttgcaccattcagattctgctagcgcacgcctcgccaccaccaggccgcgcgcgcgcggccgtgtctacagtctcgaagtggccatcaaggatggcttcaataatggcgggggcgggcaaaagtacaacacgggggggggggggggggg

SEQ ID NO: 64264 - DNA, 1492 bp, Oryza sativa
cgaatctttgaacatatgcatgaagcattaaatatagataaaaagaaaaactaattgcacagttaggggggaaattgcgagacgaatcttttgagcctaattagtccatgattagccataagtgctacagtaacccacatgtgctaatgacggattaattaggctcaaaagattcatctcgcggtttcgagacgagttatgaaattagttttttcattcgtgtctgaaaactccttccgacatccggtcaaacgtccgatgtgacacctaaaaattttcatttcgcgaactaaacggggccttaatgcagtaaacaaaactggtgttcaatcattacatctaattttatgtttttttacgaagaaagtactatactactttttttgatgtagtacaatctttgctattgaatttacacgcccccggtcctatccacgtcaccatcgtccctaccaatcgttttctcgttctcgcaacgctgtacccttttatgacgtgcaagtgtgtaaaccccccatgccgtgtatatccacaaccggtggccgccgttcaccggagtccggcttgccgcgcgtgacaaaaaaaaaacgtacaacagcgacgcgccatggccggagcagccgctcgtctttcgctcggacgagatcaagacaacacacccaaggaatatccggttccaccgacggtggggcccacccacgaggtggtccccagctgtcagcgtctctctacagtctatgccacctacctagtgataatgaagcaccgggatactaatttagggtgtgtttagttctttgggtgtaaaatttttgaagtatacggacacacatttgaagaattaaatgcagactaataacaaaacaaattacagattccgcatgtaaactgcgagacgaattattaagcctaattaatccgtcattagtaaatatttactgtagcatcacatggtcaaatttttcccacatttaatatcccatgtatatgtccaaacatttaatgtgacgttttggctaaaattttttaggatctaaacaaggccttacttcttatcttatgatgagaggagagtaggaagaacacatcatctattcataaaggtaatgcagagcattcccattgtttcattgttcatatgacaaaatgtaatccatacgaagaatttccaacacgacgcgaaaaaaaaaagaggaagaaatctcgagtatagctttttaaacacaagaaaccggtgtactgcatatgagttataacgacaggaagaacggctgttgttgttctgaaaggttgcaagatttccaagaagaattcatttctgtgagctatctgtagcgaagtaaggtatggccacgatcaagctgagaggagctgattgatcttcatggtgtagcagctttgaaattactccttgccatcggcagcacggagggagcccagctgaaccggggcctgggtggacaccaccttggatgagccgtaacccgcgatg
